United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 7

SEQ ID NO: 18148 - DNA, 390 bp, Triticum aestivum
  Clone ID: PAT_TA_18148
gaggtccagacatagcaaggattgacagactgagagctctttcttgattctatgggtggtggtgcatggccgttcttagttggtggagcgatttgtctggttaattccgttaacgaacgagacctcagccagctaactagctatgcggagccatccctccgcagctagcttcttagagggactatcgcccaagaaggccaccaagtcccccaagaaagccaccaaggcgtagattgtagtagtgcggtgtgctgattgttcgagtttggttagatgtagtagctgcttcactctgtatcctgcgcccctgatgtaatcgcgaacaaaggggaagccgcttgcttcctcttgacttatgaattatcaactaagcgtttctgaaaaaaaaaa

SEQ ID NO: 18149 - DNA, 655 bp, Triticum aestivum
  Clone ID: PAT_TA_18149
cgtccgtctcgctccgcctcctcgatcgagtccagtccaactgccccgcccgccacccgcgtcgcccagccgctccgctagggtttgcccgccctcccgtggccgtcggcggccgtcggcccgtgctccgtccggaagcaatgtctacaccaactgggaatttcgtacgtccttttcatccggatgtgattgggaatgcgtttgctcaacaatactacagagttttgggttcgtcaccagagcatgtccataagttctatcatgatgaaagtatccttggtcgaccagattctgatggtccattgacatctataaccactacatatgctatcaatcaacacttcttatctacagatatgaagggctgtttgatacagttagataatgtagatactcagccatcccacggtggtggtgtgctcattttggttactggatctcttaccatgcttgatactgtgaagcatagatttgttcagtcattcttccttgctccacaagaaaatggaggctattttgttttgaatgatgtgcttcgagctgtgccggagatgccattggctgagacaaatgaagctttagttgaccatgttaatggaaacactcagattgctccatttccagctgaaccagaaacatctgtcaacgagagcat

SEQ ID NO: 18150 - DNA, 743 bp, Triticum aestivum
  Clone ID: PAT_TA_18150
atcccagcaaggagcgagcaagccaggaagatggacgccagcaagctgaagaagtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggcaagcaacaccatcttaatcccccctccctctcttcggatgaaccgccgcccttctctccggcgtggagcgagctaacaagcttgtgctgcaggtgctggagctggccgggaacgccgccaaggacaacaagaagacccgcatcgtgcccaggcacctgctgctggccatccgcaacgaccaggagctcgggaggctgctgtccggcgtcaccatcgcccacggcggcgtcatccccaacatcaacccggtgctgctccccaagaagaccgctgagaaggccgagaagaccgccgccaagtcgcccaagaaggccaccaagtcccccaagaaggccaccaaggcctagatcgtagtagtgcggtgtgctgatggttccagtgtggttagatgtagaagctgtttcactctgtatcctgcgcccctgatgtaatcggaatcaaaggggaagccgcttgcttcctcttgactaatgaattatcaactaagcgtttctggaaaaaaaaaaaa

SEQ ID NO: 18151 - DNA, 746 bp, Triticum aestivum
  Clone ID: PAT_TA_18151
gcacgaggctcccctccaccctcctcccccctcgtcttattttaccgagcgatccccccagcgagctaaaccctagatcctccgcccaaccgctaaaaccctagcaggccaaggtacggctcctccccggcccctctcgcgctagtctcctcggctgtacggatcgagccaacttgtttctcgaaccctagtgtactaatctgttcttccttggattgctgttgtttcgctgcgcgcgattagagctgctgcgtcggggacgataggatggccgagccctccagggtgatccacatccggaacgtcgggcatgagatctccgagactgacctgctccaggtggtgcagccgtttggcgcggtcgccaagctcgtcatgctgcgcaccaagaaccaggcccttgtccagatggaggacctgtctgcttcaatcagcgccatccaatactacactacaattcaacctagcgtgaggggaagaaacgtatacttgcagtactcatctcaccaggaactgactactgatcagagctctcatggacggaatcctgatcaggatgaacccaaccgaattctcttagttaccgttcatcatatgctctatcctatgaccgtcgaagtgcccctggattcagctttctctttgcttgtagtcgatttccagcagaccatgctatttggtgtatggttcatgtaaaaccttgcgttgctttatctatatctatatctataccaataaaaaaaaaa

SEQ ID NO: 18152 - DNA, 851 bp, Triticum aestivum
  Clone ID: PAT_TA_18152
ctttggcatctaaaaccttcccctcgccctccccttccaagcgtgaacaatgcaacgttgatggccataagagctcatcgaagcatgcagatctcaatccacatgctaatgatagtgttctcggaattattcttggaggtggtgcagggactagattgtatcccctgacgaagaagcgtgcgaagcctgcagtgccattgggtgccaactacaggcttattgatattcctgtcagtaattgtctgaacagcaacatatcaaagatctatgtgctcacgcagttcaactcagcttctcttaatcgtcatctctcacgagcctatgggagcaacattggaagttacaagaatgaaggatttgttgaagtccttggctgcacagcagagcccagataaccctgacttgtttcagggtactggcagatgctgtaaggcagtacttgtggctattcgaggagcataatgttatggagtatctaattcttgcccgagatcacctgtaccgaatggactatgaaaagtttattcaggcacaccaagaaaccgatgctgataatactggtggctgcggttgccatggatgaaggacgggcaactggcattgggcctaatgaaaaatcgtgaaaaaaggaggataattgggatttcgcgaagaaaccaaaaggggaaccagtgaaagttttttatggttggtaccacccatacctggcctttgtgaacgcaagggccaaggaaaggcctttaaattggttgcatggggtactttgtttttaggcaacacgtggaaggttacagtttttcccggggcaaatttctgggacctaagacattttggagggaggggatttccgg

SEQ ID NO: 18153 - DNA, 768 bp, Triticum aestivum
  Clone ID: PAT_TA_18153
cggcgaggcacaggattcgacactccgcggcgtcgcgctccagctcgccgccgtcgccttcgaggccacccgcctcgtgctcatccagatcctgctcacctccaagggcatctcgctcaaccccatcacctcgctctactacgtcgcgccctgctgcctctgcttcctgctcgtgccctggatcttcgtcgagctgcccaggctgcgcgccgtcggcaccttccagcccgacttcttcatcttcggcacaaactcgctctgcgcctttgcgctcaaccttgcggtcttcctgctcgttggcaagacctccgcgctcaccatgaatgtcgcgggagtggtcaaggactggctcttgattgccttctcctggtccgtgatccgggacacggtcacccccatcaacctcttcggctacggcatcgccttcttgggtgttggctactacaaccatatcaagctgcaggcgctcaaggcaaaggaggcgcagaagaagtccgcgcaggccgatgaggaggctggctccctgttgcaggagcgcgatagccacagtgatcgcaagagcgagaaccaggcatagagctccagatcggatccgggcatgcccacattggttggttctaaaatccatttgagtgatctttcgttttctactgcatgcaggctaggcttgttatttttcttgatttgccatggtagaggaataaaaatcgaagaaatgtatgattcattggcagtatgaaaatcgcgatgtactttgcccactcttgt

SEQ ID NO: 18154 - DNA, 978 bp, Triticum aestivum
  Clone ID: PAT_TA_18154
caaacccaactcaacaaatctcttgtgggcttaattagtagaccagacgaccttcgtgcaccttaccagacggcctccagctagtatgatagatgcaaagtatctacagtccatgcctggaattgtcgaatgcggcatggacagacgatgcacattgacgtccttctaatccctcctatgtcaaaggatctcattccgtatcataggggtttccattttgttgtattccgacagtgtaattaatacataaactttacgatcacaagcattacaaattgcccgaaaccaattttgtttacataaatagtgtctacagtattcttcgggccattgttaatgttgggcttcaggctctttcttctctaggtaaccttgagccctagcatagcgagataactggtagagttgaacgctttcgttggaggcatgggttgccataagaaaatagttccgcggccgtaccacccatgcgaacctcataaataggccagaatacacacacatgactgcagtcatatggccggatatcaattcaggtggcttgttcatgttagccatacccgcgaggatgaagccccagttgctgacgggtccccagaagtgcgtggtcctggggccgacggggctgttcaagaaccccttgagccccgtgggcatggccgatgccctcgccccctctacggctgcttgcttcccgtccgcgggtgcggatggactcgtggagacggccaacggttgagcctcgtgccgaattcggcacgagcccgtacgacgtcgtcaacgatttcaagggtggttactagagcgcttgtttcctgagcagaagcttgagccagtttttagtatctatgcttgttcccaatgttttggtactgagtagttctctttttgctccgccgagtgtgaacttctctgtggttaacattaaggatttccctgtggttgatttcgttcaaaaaaaaaaaaaaaaaaaaaaaa

SEQ ID NO: 18155 - DNA, 714 bp, Triticum aestivum
  Clone ID: PAT_TA_18155
attcggcacgaggtaccgccggcgtgcatcttccggggggaggagttcgacggggcggagtcggtgaagcggctggagcagtggctgatcgagaaccacagctaccagccgcagtacgcggtgacggagctgaacgagaaggacttctggcgcatgttcgacgcgtcgcactacgagcactgccggcagaaatacggcgccgtgggcaccttcatgagcgtctactacaagagcaagaaggggcgcaagtccgagaaggaggtgcaggaggccgaggccgccatcctcgagcctgcctacgccgacgaggcctaggcgtgttcgtcgtccatcgccgtcgtgctcgtcgtcggccgcctgtgtctcgccggtttcggtttcggtttcttcggtcgtcggaactctggattaattggttcccttttgcttggttgcttattaataagtagaacttgatcgatcgtgtagcgttgattcgtagcagtctgcagcctgtagcaccatgagtcattgttgtcgtccgtgagtacttgattcaaccgcccctttatgttgatgggattaaatgcttagaacttaaaatcaggcagatgcgtatgtgggaataatattgtgatttgaggtgaacactctgcgtgtcaaagctgagaacctgaatgctgttggtatgtactccctctgttttatttattctgcatattagagttaaaaaaa

SEQ ID NO: 18156 - DNA, 663 bp, Triticum aestivum
  Clone ID: PAT_TA_18156
cgtccgcggacgcgtgggcatgaatgtcgcgggagtggtcaaggactggctcttgattgccttctcctggtccgtgatccgggacacggtcacccccatcaacctcttcggctacggcatcgccttcttgggtgttggctactacaaccatatcaagctgcaggcgctcaaggcaaaggaggcgcagaagaagtccgcgcaggccgatgaggaggctggctccctgttgcaggagcgcgatagccacagtgatcgcaagagcgagaaccaggcatagagctccagatcggatccgggcatgcccacattgggaatctggtgcaaagtgcaaagactatagtttggtctacagttgctttcaaggaggtggatgccggttctggtttatctttttaactttagttggatctgaggagcaaaccaagtcaatttgttgatctaacaaatacttgcatttgaacctccttctggagggttagaaggaacacttatattaccctgttatttatttttgcgtttttgtttctctcacgcattccgtatttatttgttccagtagcctaggtaaaaatgtactgcacattggtatcatttcggtgggtatcatctggtggttatcatctatatataatgagcttactgtaaactaaaaaaaaggggggg

SEQ ID NO: 18157 - DNA, 845 bp, Triticum aestivum
  Clone ID: PAT_TA_18157
gaacaaaagacgggtccagaaggaccctgatgctgcattaacactgaacatgaagtacacagcattttacagacggacccagaactaactgcaaataacacactggtccctgtcttttacaaagaggaccccaataaccagataagaaaagcaatcgggtccttgacatcttctgcacggccgtaacttcgccgtcgccggggacattgccacttgggacaactaagcttccatggcaccacgccataaactccgtgcaaaaaatgagctgcctccctttaggcattttggccgggaggaaaaagtaaaaaggccgcccttcggccagcatgtacgatgacgtgatggagccggccggccgccgaacgccgtagctggcgccaaggccactcccaaacagccaccggataagagcactgacccgatctggttctccatctcttctactcttcgtcttcaccaccacggcgacgccacgagctagagaagtagcggagagcctccagaacaggggaccagacgagcttattggtggatgagccagcagcacgcccctcggcagcgaccggccgccagccagccttgcctgagacgcagccgccgtgagccaccagccgctgctcgtacgcggcggcggcgctctccacatcggcatacagccatacaccacatgggcactactcgacctcaacctatacctagactctatatacataggacaacgccatgcacctctcccgtctccgctccggccggcgtcgccgtcggagaagataagggatcgggccgggagcggtggaactctctcgactctcaacgggggctggtcaactcggacgcgtggg

SEQ ID NO: 18158 - DNA, 952 bp, Triticum aestivum
  Clone ID: PAT_TA_18158
gagcgccttcccttggagcgggggatctgctctgctctgctctgctctcctctcctcctcctcctccttccctcctgaagtcagcctccagccatggcggacctgcagacgccgctggtgcgaccaaagaggaagaaggttctggtggactacctggtgcagttccgatggatcctcgtcatcttcgtggtgcttccggcctcggcgctcatctacttcaacatctacctgggcgacatgtggtccgccatgaagtccgagaagaagcggcagaaggagcacgaggacaacgtgcagaaggtcgtgaagcggctcaagcagcgcaaccccaagaaggacggcctcgtctgcacggccaggaagccgtggatcgccgtcggcatgcgcaacgtggactacaagcgcgtcaggcacttcgaggtcgacctctccgccttcaggaacatcctcgagatcgacgccgagaggatggtcgccaaggtcgagccgctcgtcaacatgggccagatatccagggccacctgccccatgaacctctccctcgccgtggtggcggagctcgacgacctcaccgtcggcggcctcatcaacggctacggcatcgaggggagctctcacatctacgggctcttctccgacacggttgtcgcgctggagatcgtcctggccgacggccgggtcgtccgagccaccaaggacaacgagtactccgacctcttctacggcgtgccctggtcgcagggaactctcgggttccttgtctcagccgagatcaagctcatccccatcaaggagtacatgaggctcacctacacccctgtgaagggccctctgaaggaggtggcgcatgcgtacgccgactccgtcgcgccgagggacggcgaccctgcaaaggtccccgacttcctggaggggatggtgtacagcgcgacggagggcagcatgatgaccg

SEQ ID NO: 18159 - DNA, 1615 bp, Triticum aestivum
  Clone ID: PAT_TA_18159
cgtccgccgcggtaagccggaccccgagcgtgtgacacaacacacaggtgacgggagccgggccactccctcctctccgtgccaagaaacccacatccacacccacacccgtcctcctctccaaaatcccccaactaccagcctcctcctcaattcctcatcctcctcccagatccgcccaccctccccgcccccagatcccccacgcaggcgagcgaccgcgcgcgcgcgcaggcccagatccgcccgccgcccggccggagcagcagctatggccaaggaggccggcggcgagggggccatgtcggagtcggtgctccgcaaggtgctcgtctcctactgctacgtcgcggtgtggatcttcctctccttcaccgtcatcgtctacaacaagtacatcctcgaccccaagatgtacaactggcccttccccatctcgctcaccatggtgcacatggccttctgctcctccctcgccgtcgcgctcgtccgcgtcttccgggtcgtcgacctcccgtcctcgcccgccatgaccacgcagctctacaccagctccgtcctccccatcggcgcgctctactcgctctccctctggttctccaactccgcctacatctacctctccgtctccttcatccagatgctcaaggcgctcatgcccgtcgccgtctactccatcggggtgctcttcaagaaggagaccttccgctcctccgccatgctcaacatgctctccatctccttcggcgtcgccatcgccgcctacggcgaggcccgcttcgacctccgcggggtcgcgctccagctagccgccgtcgccttcgaggccaccaggctcgtcctcatccagatcctcctcacctccaaggggatctcgctcaaccccatcacctcgctctactacgtcgcgccctgctgcctggggttcctcttcctgccctgggtcttcgtcgagctgcccaggctgcgcgccgtcggcatgttcgagcccgacttcttcgtcttcggcaccaactccctctgcgccttcgcgctcaacctggccgtcttcctgctcgtcggcaagacgtcggcgctcaccatgaacgtggccggcgtggtcaaggactggctgctcatcgccttctcctggtccgtgatccgggacacggtgaccccgatcaacctcttcggctacgggatcgccttcctgggcgtgggctactacaaccacgtgaagctgcaggcgctcaaggccaaggaggcgcagaagaaggtggcgcaggcggacgaggaggccggctcgctgctgcaggagcgcgactctcacggcggcgagcgcaagaccgagacccagtcatcatagagccgctcatctcatttcatccgatccgatccaacaacaccaacagcacgcccaatttggttggttctctcagtccggcgtagcaggttccccaaaatgtgatccgatccttacatgtttgatgatgcaaaatctgttcatttcttgccttaatttgtgttaggaaggcaaataaatacaggaaacatgacaatttttgtgccgggcgtgtgaaaatacgatagttcttagcagacagtgcactaccagtatcaaaaaaattgattccgt

SEQ ID NO: 18160 - DNA, 2843 bp, Triticum aestivum
  Clone ID: PAT_TA_18160
agtaacctgtcgcagaattaggagaggcactcgtggaagaagactgtcgaagtagtactgcaaagaaacaataaatgacaaggaaatttagtttaccaaacgtgtgaatgctatttctcatttcaagctactagaataatggcctggaaaggaaatactagacggatacgatagcatataacttgtcaagaaacataaagtggtaacagagtatgattatgaggttaatttgttctgttgtatttggcatacgagcgtctaggctagggccgaggtgttctcagttattgtggcaaacagtgacaacaaaaactaaactgaagtgttttttttggccaaaataagaactagtcaaatgactgctagtgcttcgtgccaactgagacagatatccattgctgtatcagctagaccataagaatttaagtactcacccaccaaacagtaatagctgatcaaaccaaggagtttaccaactgtcttgattcaaccaaaacacaagcaactcaatctggtactaatttccctctagcttgcatatggaataaaattaatagactactggagatgctatccattgtaccaaaatatcacataatcctgactatgaatgtatgtgggagccaaccagtcaagagttttttacatgaacttaggcgtcctaaaacaaagttcaaaagcttccagttctaaggtacttattacacactgggcctcctttttctatacgggaaatggacttgattctcttggtaaatatgcccatagatcttttccaaagcataaagcatggacagaaagggaaacaatagcatctcaagccaagaaattaacaatacaggacatatagcttgaaacagagtaaagcatctcaaaagcacacatcatttttatgtgcaatgaatacttcaaccagttgaaaatatggaacactagtggcaaaagtgaaaagaacattcgagtaacatatcatgacaaacctttacaaagtggttactggtggaagagatctctcctcttaaagcaactccacaattgaaatttccgctcagtatgccaaatcaacaggtgagattcaacaaacagatatttgcacttaggctcagaaaatagtatgttaatcatgtatgtcctcagatgtgcttgggtaactatagaaaactgtaatagcagctctatagtaaagttaagtcaaatggaaaaaatgggggcatagtttaagagatatacctgaccaaggataacatcacgcacataaacgcccatagttgtcattttaccattggatccaggggaaaactcctcatcatcttgaatgtagggctcataccaggtccataaggtctttgggtccgcagcatagcgcaggtacaggaacccaatttacagctctgatgtagggggagtccgggtgcttgagcaggccgtgcatctggttgacggtgagcttcatggtgaagagcttgtagaggaggcagaaggcggtggaggggccgcggcagttgcccgtcatccagggctcgacgagatctacaaccaggtggaccacgtcgagccctggatgacgggcaactgccgcggcccctccaccgccttctgcctcctctacaagctcttcaccatgaagctcaccgtcaaccagatgcacggcctgctcaagcacccggactccccctacatcagagctattgggtttctgtacctgcgctatgccgcggacccaaagaccttatggacctggtatgagccctacattcaagatgacgaggagttttcccctggatccaatggtaaaatgacaactatgggcgtttatgtgcgtgatgttatccttggtcagtactacttcgacagtcttcttccacgagtgcctctcctaattctgcgacaggttactgcccatcttgagaaaatgaagctcccaacaaagcagtcagggataactggggattctagccgccttggttcagatgatactgcccggcggcctccttcagtgaaggcttctctgtcggtctcttttggtcagcgtgctccacaccgtgcatccacaagggattcatccccagtccgaaagacattgccatctgtacgagaaagggaaaggagtcatgatggcggtcatgccaaatctccacccaggaagcaccgaagtcagagtcgtgagcgcagccgtgacattgagagggaccgttcagatcgcgatcgtggtaggtacaaggatagggagcatggtcggcacagccgtgataacagagaccgtgactaccgccgctcgagctattctgatagggatgtcgagaggcggggccatgaaaggagggatagggactccgacagaaatgggcgttcgagtggccgcagaagcaggagcaggagcaggagtccaagccgtggcagaaccaacggggacagccatcgctccagtccgtttggtaaagcgccggagccatccaacctggcgaagctgaaggatctgtacggtgacgccacaaacgcaaaggacgacgccggcgatgatagagcccgcagggattccggaactgaagaggtgatcagattgggaggcgccaggtggaggtgactgccagaagccgaaaaccatggagattctattctggttgtactagcattgctatacactgcgggcgatgcgcagcagtcaatgggtttcgtctcccctgcgatctctgccttccctagggaaaagtgcctccgactagggtgtacaacgcaaaatctgttgaccggctaagcaatttagtggtgattcaagataaattgttcactttggatagccatgttctgtatctgatatatgatttatgtgttgagctcaaaaa

SEQ ID NO: 18161 - DNA, 1370 bp, Triticum aestivum
  unsure (1)..(1370): unsure at all n locations
  Clone ID: PAT_TA_18161
cgtccaaatccgcgcgataagaaccaagccagccttgctgtgccgccgtttcgcccttccgctgccgcaccacctccttatataatacaccaaagagaatggtgccgctccgcttataccgccacctgatcccgcaactggcagctgcagccaggtcgccctccgcgcccaaggccgccgcctcctgcgctccccgccgtatcccgccactgccggccctcgcaatggcggcctacggcaccggtgtttgcgcggacagcaagctcctcttcaggcagctgttcgagaaggagagctccacctacacctacctcctcgccgacgtcggtgaccccgagaagcccgccgtgttgattgaccctgttgacagaacagttgatagagatctcaatcttatcaaggaattaggcttgaaactcatctacgctatgaatactcatgtacatgctgatcatgtcactggaacaggactaataaaaactaagctaccaggagccaaatctgttatttcaaaagctagtggagcaaaggccgaccagtctgttgagcacggggacaaaatatactttgggaagcttttccttgaggtgcgagctactcctggccatactgctggctgtgtgacttatgtaacaggtgatagtcctgatcaaccctcaccacggatggctttcactggggatgccttaattatacgtgcatgcggaaggacagacttccagggaggaagctccgatcagctgtacgaatcagtgcactcacagattttcactttaccgaaggataccctgctttatcctgcccatgactacaaaggtttcacggtaactactgtcgaagaggaggttgcctataatgcccgactatcaaaagataaggaaactttcaagacgatcatggaaaacctgaacctgtcttacccaaagatgatcgatgtcgctgtacctgccaacatggtttgcggcttccaggatccaccatcgaaggtctgaggtgttccagctgaagcagctttgcaagtggcggtgctcctgctcctggttgttgtgaagtcaagatcagatcaagagggcttgcggctgcgttgtatacatgaaataatttgtctgcgttgtacattaaacaatttgttggctgatgcggctctgtctccgtttgactttaccgcctgatncatcatcatatacaacgagaagaagacanttcgtttaatttagaaacaattaaaacncntgtattggctgctntccttccccgtgtattatcccctttaatttttttcnagaanaaaaaanaaaaaaaacccccanggggggcccgtaccaattcccctaaaangagtcctattacccngccnatggctccnttta

SEQ ID NO: 18162 - DNA, 1715 bp, Triticum aestivum
  Clone ID: PAT_TA_18162
ggggcgtcggaggcgaagcgacgagcagacgatgattgtgacggcggggcgggcgggcgcctgagttgttcaccacctaccctcccccgtctctcgaagactttccacccaactgatcacaccaacagcaacagctaggcacagcccacgaacaaactgccgttgagaaggcgaaccatttcttcctccccggagacacgcggagaaactcgacgactcctctccctccccactttagtcccgaactcccgatcgggaaatctcagcggaggcgcagcatctccctgggcggaggatctcggggcccggcggagaaggtggaccggcatcacgccaactaatcgagccagagccgagagggacaggacagggaggaagcggttcagaagacgaagaggagatgtcgtccgacggcgggggctcccagatgggcgtcgccggcgcgctgggcctctcggtcacgtcgtcagtagccattgttatttgcaacaagtacctcatgagcacccttgagttctacttcgcgacgacactgacgagctggcacttgctggtgaccttctgcacgcttcacatagcgcagcgcctgcgcttcttcgagccgaagccaatcgacgcgcagactgtcatctcctttgggtttctcaatggaatctccattggcctcctcaacctttgccttggcttcaactcagttggcttctaccagatgaccaagctggctattatacccttcaccatgctcttggagaccatctttttgagcaagaagttcagccagagcatcaaggcctctctcatggtcctcctcctgggagttggcatcgcatcggtcactgatctccagctcaatctcctcggctcaatcatcgcagtgctcaccatcgctgcgacctgtgtctgccagatcctgaccaaccaaatccagaggaggctcaaggtgtcttccactcagctactgtaccagtcctccctgtaccaatccgcggtgctgctcatcaccggccccttcgtcgacaagctcctgacaaagaaggacgtcttcgcgttcgagtacacattcgaagtcgtggtgttcatcctgatgtcgtgcgggatcgcggtgtccgtcaacttcagcaccttcctggtgatcggcacgacgtcgccagtgacgtaccaggtgttgggccacctcaagacgtgcctcatcctctccttcggctacgtcctcctcaaagaccccttcacgctccgcaacctcgccggcatcctcatcgccatcttcggcatgggcctctactccttcttctccgtctccgagagcaggaagaagaccgagggcgccacgttgcccgtcaacacccagatgagcgagaaggattcggcaccgctccttggcacgaaaacctcgccgtggcaggagagcaacggggtggagaactttgacgacgtgccacggaccgcgaagaccgcgtttagccggcagctgaacccgtagcttaggatggatatgctttggtaagttggtatagcagcatcagtatctattctttcccctttggggtttctcctacaatgatgagaattgctcgatgatgaaagtaatggtggtattgtaaggtgattctaggacctaaaaagttctggaagtaatgtagggcagcaagtaccaacttctcctacaatggttgtagggcagggatctcgcggaaattgcacaagaaattttctgg

SEQ ID NO: 18163 - DNA, 1427 bp, Triticum aestivum
  Clone ID: PAT_TA_18163
tcgttcagatcccccacgcaggcgagcgaacgcgcgcgcaggcccagatccgccgccccgccggagcagccatggccaaggaggccggcggcgagggggccatgtcggagtcggtgctccgcaaggtgctcgtctcctactgctacgtcgcggtgtggatcttcctctccttcaccgtcatcgtctacaacaagtacatcctcgaccccaagatgtacaactggcccttccccatctcgctcaccatggtgcacatggccttctgctcctcgctcgccgtcgcgctcgtccgcgtcttccgggtcgtcgacctcccctcctcgcccgccatgaccacacagctctacaccagctccgtcctccccatcggcgcgctctactcgctctccctctggttctccaactccgcctacatctacctctccgtctccttcatccagatgctcaaggcgctcatgcccgtcgccgtctactccataggggtgctcttcaagaaggagaccttccgctcctctgccatgctcaacatgctctccatctccttcggcgtcgccatcgccgcctacggcgaggcccgcttcgacctccgcggcgtcgcgctccagctcgccgccgtcgccttcgaggccaccaggctcgtcctcatccagatcctcctcacctccaaggggatctcgctcaaccccatcacctcgctctactacgtcgcgccctgctgcctcggcttcctcttcctgccctgggtcttcgtcgagctgcccaggctgcgcgccgtgggcatgttcgagcctgacttcttcgtcttcggcaccaactccctctgcgcattcgcgctcaacctggccgtcttcctgctcgtgggcaagacgtcggcgctcaccatgaacgtcgccggcgttgtcaaggactggctgctcatcgccttctcctggtccgtgatccgggacacggtgaccccgatcaacctcttcggctacgggatcgccttcctgggcgtggggctactacaaccacgtgaagctgcaggcgctcaaggccaaggaggcgcagaagaaggtggcgcaggcgctacgaggaagccgggctcgctgctgcaggagcgcgactctcacggcgagcgcaagaccgagacccagtcatagagctgctcatctgatccgatccgatccaacaacaccaacagcacgcccaatttggttggttctctcagtccggcgtagcaggttccccaaaatgtgatccttacatgtttgatgatgcgaaatctgttcatttcttgccttaatttgtggtaggaaggcaaataaatacaggaaacatgacatttttgtgccgggcgtgtgaaaatacgatagttcttagcagacagtgctactaccagtatcaaaaaaatttattcggttgtcaaaaaaaaaaaaaaaaaaaaa

SEQ ID NO: 18164 - DNA, 1003 bp, Triticum aestivum
  unsure (1)..(1003): unsure at all n locations
  Clone ID: PAT_TA_18164
agcgaaattttctcgcgagnagttcgtgtgtagtagaggagttgaggagatgaagccggcggttgaaggtgacgagcgtgcggcggagatcgcccgcatcaaggctgccgcggccgccgccaaaaaggcggcggaagaggtggtggatgtggacgatgagggtgaggacgacgagggagatgaggaggaggaggcggttgacggcgacgacgacgacgacgacgacgaagtcgacgacgatggggaagaggacgaggacgagggggtggagggtgaggataaggggtcggcggcgcagcaggtggtcgacatctccgacgaggacgacgacggcggtgatgaagaggagggcggtgacgatgacgacgacgacgacgacgacgacgatgacgaggaggatgacgacgaagtcgacgaggaggaagagcccgaggaggagctaggaactgaatatctggtgcagccgcttggccgtgctgaagacgaagagcattccagtgacttcgagccagaagaaaatggtgatggtgctgaggacgaggagattgaggatgacgatgctgaggatggtgaggatcctgtcaaggcgcaatccccatcaaagaggaagaggtctggtggggaggatgaagatgatgacgacggtgatgatgatggtgatgatgatgagaagcctccatcaaagcgatagtcaatttgttcgtgctgatctgtgatcttctctgcttgggccaagaaggaaaataatcctcatggagaggattgttggtaaatgctgtagctttaggacatctgtggtaggtgtagcagctcaaacttgagtctacccatgttagttgttagtgcatactgctgatgttgattaacagcctccgggaacttctgtatgagcattagatatggggcttgttatatgcttgtgtagcttctgattaaaacctttggaatgtggatgctctgttctgaatcttgttttcatgatatttctcttgaactagcttgc

SEQ ID NO: 18165 - DNA, 1418 bp, Triticum aestivum
  Clone ID: PAT_TA_18165
atgccgtacgacagtacttatggctgtttgaggaacacaatgttatggagttccttattctggctggagatcacctgtaccgtatggactaccaaaaattcattcaagcacacagagaaacagatgctgatattactgtggctgccctgccaatggacgaggagcgcgcaactgcatttggcctgatgaaaattgacgatgaagggagaattgttgagttttcagaaaaaccaaaaggagagaagttgaaggcaatgatggttgacaccaccatactgggccttgattctgagagggccaaggaattaccttatattgctagcatgggaatctatgtttttagcaaagatgcgatgcttcggcttcttcgtgacaattttccttcagcaaatgactttggaagtgaggttattcctggtgcaacagaaattggaatgagggtgcaagcttacttatatgatggttattgggaagatattgggactattgaggcattttacaatgcaaacttgggaataaccaagaagccagtaccagattttagcttctatgaccgttctgccccaatttatacacaatctcgatacttgcctccttcgaaggttcttaacgctgatgtgacagacagtgttatcggtgaaggttgcgtcattaatcattgtacaatcaaccattctgttgttggactacgctcgtgcatatcggaaggcgcagtaatagaggattccctgctaatgggtgcagactattatgagacggaaaatgacaagcaagtcctttctgaaagtggcggcattcccatcggtattggaaaaaatgcgcacatcagaaaagcaataatcgacaaaaatgctcgaatcggagaaaatgtgaagataatcaatgttgatgatatccaagaagcttcaagggagagtgatggatacttcatcaaaagtggcattgtcaccgtgatcaaggacgccttaattcctagcgggacagtcatatagagaggcaaccgtcaccgccatgtatataagccaggttggcttgcagacttacagtgacctccaatgcatccatggctggtttcccatgcagcaagttcaccaagctctgcatcgactcgggagtatcgtcggcggaaagaataaaacagtggcccccactcaaggcaccatttttttcctgttaactagtatatgagcaaatgttttgaagttgaagtctgaaaattgcattaggaatctggatgttttggcatgtacaatcatgtccttttgtagtctctaggcttgaactggacatccgatgtttatttgcatcgcttagagcatctctagccgatcccctgtaatttagccccccaaagggcttttcaaaccttaaccccttacatttaaggagttaataaaaatctctagccgatctcctat

SEQ ID NO: 18166 - DNA, 1450 bp, Triticum aestivum
  Clone ID: PAT_TA_18166
ccatccctaccggccaccgggcacctcgtcgccgatctcgtcacgccatcgcgcccatcgcctcgccgctacttctttatattatcatccatagcagccctccacgaaccaccgcgaggtccacgccgcgggcgacgccgtccaaatccacgcgataagaaccaagccagccttgctttgccgccgtttcgcccttccgctgccgcaccacctgcttataaaatacaccaaagagaatggtgccgctccgcatataccgccacctgatcccgcagctggcagctgcagccaggtcgctctccgcgcccaaggtcgccgcctccgcctcctgcgctccccgcccgatctccccgctgccggccctcgcaatggcggcctacggcaccggcgcttgcgccgacagcaagctcctcttcaggcagctgttcgagaaggagagctccacctacacctacctcctcgccgacgtcggcgaccccgagaagcccgccgtgttgattgaccctgttgacagaacagttgatagagacctcaatcttatcaaggaattaggcttgaaactcatctacgctatgaatactcatgtgcatgctgatcacgtcactggaacaggactaataaagactaagctaccaggagccaagtctgttatctcaaaagccagtggagcaaaagccgaccattctgttgagcacggggacaaaatatactttgggaagcttttccttgaggtgcgagctactcctggccatactgctggctgcgtgacttatgtaacaggtgatagtcctgatcaaccctcaccaaggatggctttcactggggatgccttaattatacgtgcatgcggaaggacagacttccagggaggaagctccgatcagctgtaccaatcagtgcattcacagattttctctttaccgaaggataccctgctttatcctgcccatgactacaaaggtttcacggtaactaccgtcgaagaggaggttgcctataatgcccgactatcaagagataaggaaactttcaagacgatcatggaaaacctgaacctgtcttacccaaagatgattgatgtcgctgtacccgccaacatggtttgcggcttccaggatccaccatcgaaggtctgaggtgttccagctgaagcagctttgcaagtggcggtgctcctgctcctggttgttgtgaagtcaagatcagatagagagggcttgcggctgcgttgtacatgaaataatttgtctgcgttgtacattaaataatttgttggctgcaacattggctgatgcggcctctgtctccgtttgacttcaccgtctgttcatcatctatcaacgagaagaaggcagtttgcttgcccttcacctcacctctgcaaatacaataccgtgccccttcacagacaataaaaaaaaaaaaaaaaaaaacgcgagactagttcttc

SEQ ID NO: 18167 - DNA, 1712 bp, Triticum aestivum
  Clone ID: PAT_TA_18167
gaaagagcaacacatgttacatgttactattttagacatacatatatgataggacacttacattcttattcagtgactgttactccctcgctgaacccacctcgtgccgaattcggcacgaggagagaactagtctcgagtttttttttttttttttggtctcagaaatctcataaattcacacattgcaatcgaggaaccttgatacatactactgtttatgtatctgtagaaagccctgttctttttccagtagcatggcatggatcagagtttccattaacagcgtaaggatacatagaccacatccctcccctcccctcattttagtgtacatggcagggaggaagtaactaaaaggtcctagagtatttcttgatctcgtacaggatggaggatatggagaccaggtccttgttgagcgcggagccgcagttgaccctcttgacgcattcggtcagcctcgtgtagtacaggagcagctgtgtgagggccgccttcaggatctccatcccgcacaggaagttgctgaaggatgtgatcacatccttgtgcatcagctcgatcgcggccttccatcggttcgcgaaatccttcaccaatggctccacgtcgccgatgttggccttgtccgaactcgaggcagggtcttccgatgtacgcgttttaacaaacttgatcaaatcactgaaatgctccagaagcacttcctccacatatattgcaatgttgctcttaagaacctcctcgaagtgaagttgtgtttttccaccctcagtgccagcttccttcaatatggcaattgttaaatcatagttgtttatcaggaaaacagtttgcatctttggtttagggaacatcttggccaacttaacaagcaagtcttcaatagccatccgtaatcgctcaagatttagatcaagctgaccatccccatattcaacattgagatgaacaagagacgctgtaaattcagcatatcttcttgttacatagtgaggatgcacatcatcctcccaaagagtcttaatattagcattccgcaagctgctcaaatgcaagtcaaagaccatcttgaagcgaggccaaagtgacatgttaaccttgtctaggtaagagtccaaacatggaattcgccgcttaaacatgataagctggtgctgatgaattatccgaatcataagcattattcctattgcatcgtagcagttcagaagtacagcatcgaaatattcatcgacaacttgaattggtccagcaaatatatcttggaataaagattcttcaccaaagaaatcatccgagaaaaggtactcagaagtagctgtatcaatcagaagtttttgtaagcttctgaaaagaacttcatatggatacttctgtgacttggcttcagatatatgaggtatcaatgcaggctgctcaatatcctttaagacgtttattctttcaccaagagcaaacaccgaagaacgggctttcagaggttcctttccaatggagaaaaggtatcctgtacttctagtttcaactccaagtaagtcagtggaggttgctatatccagctgtaatttctctaaagcttgtatataggcacgaaaatgtgcactcagaaccttattcatagtatcaatgtaagccgtgcgaacttctgcatatatctccttagcatgttccttgaggaaaacaattgtgtatttgtatttaaggac

SEQ ID NO: 18168 - DNA, 1028 bp, Triticum aestivum
  Clone ID: PAT_TA_18168
gcccaaatttcccctgaattttccacaaccacaacaccaacttaaaccagaggagaaattttctcgcgagagttcgtgtgtagtagaagagtggaggagatgaagccggcggttgaaggcgacgagcgtgcggcggagatcgcccgcatcaaggctgccgcggccgccgccaaaaaggcggcggacgaggtggtggatgtggacgacgaggtagatgaagaggaggcggttgacggcgacgacgacgacgacgatgacgacgaagtcgacgacgatggggaagaggacgaggacgagggggtggagggtgaggaaaaggggtcggcggcgcagcaggtggtcgacatctccgacgaggacgacgacggcggcgatgaagaggagggcggtgacgatgatgacgacgacgacgacgacgacgatgacgaggaggaggaggacgaagtcgacgaggaggaagagcccgaggaggagctaggaactgaatatctagtgcagccgcttggccgtgctgaagatgaagagcattccagtgactttgagccggaagaaaatggtgatggtgctgaggatgaggagattgaggatgatgatgctgaggatggtgaggattctgtcaagccgcaatcctcatcgaagaggaagaggtctggtggggaggatgaagatgatgatgacggtgatgatgatggtgatgatgatgagaagcctccatcaaagcgatagtcaatttgttcttgctgatctggtatcttttctgcttgggccaagaaggaaaataatcctctgggagaggattgttggtaaatgctgtagctttaggacatctgtggtaggtgtagcagctcgaacttgagtctacccatgttagttgttagtgcatactgctgatgttgattaacagcctccttgaacttctgtatgagcattagatatggggcttgttatatgcttgtgtagcttctgattaaaacctgtggaatgtggatgctctgttctgaatcttgttttcatgatatttctcttga

SEQ ID NO: 18169 - DNA, 2075 bp, Triticum aestivum
  Clone ID: PAT_TA_18169
gcacgaggctccaacaccaggcgagcccttggagcgggggatctgctctcctctgctctgctctcgtctcctcccccctcccctcccctcctgaagccagcctccagtcatggcggatctgcagacgccgctggtgcgaccaaagaggaagaaggttctggtggactacctggtgcagttccgatggatcctcgtcatcttcgtggttcttccggcctcggcgctcatctacttcaacatctacctgggcgacatgtggtccgccatgaagtcggagaagaagcggcaagaaggagcacgaggacaacgtgcaaaaggttgtgaagaggctcaagcaacgcaaccccaagaaggacggcctcgtctgcacggccaggaagccctggatcgccgtcggcatgcgcaacgtggactacaagcgtgtcaggcacttcgaggtcgacctctctgccttcaggaacatccttgagatcgaccccgagaggatggttgccaaggtcgagccgctcgtcaacatgggccagatatccagggccacctgccccatgaacctctccctcgccgtggtggcggagctcgacgacctcaccgtcggtggcctgatcaacggctacggcatcgaggggagctctcacatctacgggctcttctccgacacggtggttgcgctggagatcgtcctggctgacggccgggtcgtccgagccaccaaggacaacgagtactccgacctcttctacggcgtgccctggtcgcagggaactctcgggttccttgtttcagctgagatcaagctcatccccatcaaggagtacatgaggctcacctacaccccggtgaagggccccctgaaggaggtggcgcaggcgtatgccgacgctgtcgcgccgagggacggcgaccccgcaaaggtccccgacttcgttgaagggatggtgtacagcgcgacggagggcgtgatgatgaccggcgtgtacgcgtccaaggaggaggccaagaagaagggcaacaagatcaacagcgtggggtggtggttcaagccatggttctaccagcacgcgcagacggcgctgaagaagggcgagttcgtggagtacatcccgacgagggagtactaccacaggcacacccggtgcctgtactgggaggggaagctcatcctgcccttcggcgaccagttctggttcaggttcctcttcggctggcttatgccccccaaggtgtccctgctcaaggccacccagggggatgccatcaggaactactaccatgacaaccatgtgatccaggacatgctggtgcccctgtacaaggttggagaagccctcgagttcgtccaccacgaaatggaggtgtacccgctgtggctgtgccctcaccggctgttcaagctgccggtgaagacgatgatctacccggagccggggttcgagcaccagcagcggcagggggacacgagctacgcgcagatgttcacggacgtgggggtgtactacacgccggcgtgcatcttccgcggggaggagttcgacggggcggagtcggtgaagcggctggagcagtggctgatcgagaaccacagctaccagccgcagtacgcggtgacggagctgaacgagaaggacttctggcgcatgttcgacgcgtcgcactacgagcactgccggcacaagtacggcgccgtgggcaccttcatgagcgtctactacaagtccaagaaggggcgcaagtcggagaaggaggtgcaggaggccgaggccgccatcctcgagcccgcctacgccgacgaggcctaggccgtcagctcctcgtcgtcactctggatgaattaattcgcttttgctttgcttggttatgattattaataagtagaacttgatggacgggtcgtgtagcgttgcaactttggtgaggttcgtgacactttgtgtgtagcagtgtcattgttggatttgccccgtttttaatctgtggaattggttgttagaacttgagccgggaagatgtgtatgtgtgtcttgtccctgtttgactggactggaataataatgtagtgaaccctggatatgtgtgta

SEQ ID NO: 18170 - DNA, 1688 bp, Triticum aestivum
  unsure (1)..(1688): unsure at all n locations
  Clone ID: PAT_TA_18170
ggttctccatccgtccatccctcccccctcctctcctctcccccgtcttatttaccgagcgatccccgcagcgagctaaaccctagatcctccgcccaaccgctaaaaccctagcaggccaagctcctgcgtctgggggaaggatggccgagccctccagggtgatccacatccggaacgtcgggcatgagatctccgagaccgacctgctccaggtggtgcagccgtttggagcggtcgccaagctcgtcatgctgcgcaccaagaaccaggcccttgtccagatggaggacctgtctgcttcaattagcgccatccaatactacactacgattcaacctagcgtgaggggaagaaacgtatacttgcagtactcatctcaccaggaactgactactgatcagagctctcatggacggaatcctgatcaggatgaacccaaccgaattctcttagttaccgttcatcatatgctctatcctatgaccgtcgaggtgcttcatcaagtgttttctccttatggatttgtggagaagattgtcacatttcaaaagactgctggttttcaagcccttatacagtttcagtcacgccagagtgcaatacaagcagctggtgctttgcatggacggaacatttatgatggttgctgccagttagatattcagtactcaaatctcagcgagttgcaagttcactacaacaatgatagatctagagatttcacaaatccatctttgcccacagagcaacgcccaagatcctctcagcttggttataatgatcctagcctttttggtttccaacagcctggagctgcatatggacaggctgcagtgattgctgctgcatttgggtggaacattgcctcctggagtgactggtaccaatgatcgctgcacacttatagttagcaacttgaacagtgataaagtcgatgcggataagctcttcaatctattttctatttatggaaatatagtgagaatcaaggtactccgcaacaagccagaccatgcccttgtccagatggctgatgggcttcaggctgagcttgctatacactatttaaagggagcaatgttacttgggcagaaactggaagtgaacttctctaagtacccgagcattacccctgctcctgatgcacatgactactcaacctccaatcttaaccggttcaacagtaatgtggctaagaactaccgccattgctgtgctccaaccaagatcatccacatctcagcgctttcaccagagatatccgaggacacgatccttgaacacctaggtgagcatggcaccatcgtcaagtcaaagctgtttgaggcgagtggcaagacgcaggctcttgtgcagtttgagagcgaggaagaggcgaccgaagcgctggtctgtaagcatgcgagcaagctggagggatccaccattaggatttctttctcccagatgcagaacatatagcagttcttcctggaaaaagtgtgatggcccctctttctttctaaacttttcaagtttgttatgtggacctgtctttgtttgccccatgaccaaggattgttgcctgtatcttgtgtgatggttgtaaactgctgccagctcatctgtatcgttttagcctgctatggtttgcttccgagttacctgttcanaaaaaaaaaaaaanaactcgagggggggccgta

SEQ ID NO: 18171 - DNA, 1778 bp, Triticum aestivum
  Clone ID: PAT_TA_18171
ttcggcacgaggctcgggctcgctcgccctctgcccccgtcaaacagaaacaggcctgcgctcacctaatcccaaatccaagcaaatccggctcctctcaaatccccggttctccatccgtccatccctctcccctccaccctcctcccccctcgtcttattttaccgagcgatccccccagcgagctaaaccctagatcctccgcccaaccgctaaaaccctagcaggccaagagctgctgcgtcggggacgataggatggccgagccctccagggtgatccacatccggaacgtcgggcatgagatctccgagactgacctgctccaggtggtgcagccgtttggcgcggtcgccaagctcgtcatgctgcgcaccaagaaccaggcccttgtccagatggaggacctgtctgcttcaatcagcgccatccaatactacactacaattcaacctagcgtgaggggaagaaacgtatacttgcagtactcatctcaccaggaactgactactgatcagagctctcatggacggaatcctgatcaggatgaacccaaccgaattctcttagttaccgttcatcatatgctctatcctatgaccgtcgaagtgcttcatcaagtgttttccccttatggatttgtggagaagattgtcacatttcaaaagactgctggttttcaagcccttatacagtttcagtcacgccagagtgcaatacaagcagctggtgctttgcatggacggaacatttatgatggttgctgccagctagatattcagtactcaaatctcagcgagttgcaagttcactacaacaatgatagatctagagatttcacaaatccttctttgcccacagagcaacgtccaagatcctctcagcttggttataatgatcctagcctttttggtttccaacagcctggagctgcatatggacaggctgcagtgattgctgctgcatttggcggaacattgcctcctggagtgactggtaccaatgatcgctgcacacttatagttagcaacttgaacagtgataaaatcgatgcggataagctcttcaatctattttctatttatggaaatatagtgagaatcaaggtactccgcaacaaaccagaccatgcccttgtccagatggctgattggcttcaggccgagcttgctatacactatttaaagggagcaatgttacttggacagaaactggaagtgaacttctctaagtacccgagtattacccccgctcctgatgcacatgactactcaacctccaatcttaaccggttcaacagtaatgtggcgaagaactaccgccattgctgtgctccgaccaagatcatccacatctcagcgctttcaccagagatatctgaggatgcgatccttgaacacctaggtgagcatggcaccatcgtcaagtccaagctgtttgaggcgagtggcaagacgcaggctctcgtgcagtttgagagcgaggaagaggcgaccgaagcgctggtctgtaagcatgcgagcaagctcgagggatccacaattaggatttctttctcccagatgcagaatatatagctattcttcctggaaaaagtgtgatgactcctctttctttctaaacttttcaagtttgttatgtggacctgtctttgtttgcgccatggaccaacgattgttgcctgtacttggtgttgatggttgtaaactggctgccagctcatctgtatcattttaagcctgctatggtttgcttccccgagtttaaaaaaaaaaaa

SEQ ID NO: 18172 - DNA, 602 bp, Triticum aestivum
  Clone ID: PAT_TA_18172
tcgagcggccgcccgggcaggtccgagccaccgaatccacctctcgccggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcatcgggcgctacctcaagaagggccgctacgcccagcgcgtcggctccggcgcccccgtctacctcgccgccgtcctcgagtacccggatgaacatctacatcctcctcatcaagataaacaacgcttgcataatcatcccctccttcaaatagaaatccttgagcttcggtagcatcggtgctaatgagcacatcccatttcttcttctctaggagcttttgtttcctagacaacatcctattgttgaaccttatgaagaccaaattgttgcatcgctccgttgtgagcctatttcttctcttggtatgtatcggggctgtagcttttattttcacatgcttttgcaagcttctttccaaaagttccttctttgttttcatatttcagaaaccctcggccgcgaccacgcta

SEQ ID NO: 18173 - DNA, 1028 bp, Triticum aestivum
  Clone ID: PAT_TA_18173
gcacgagggcctctcggccctcttgttcttccccgccggctacaaatcgcccaaaatttcccctgaattttccacaaccacaacaccaacttaaaccagaggagaaattttctcgcgagagttcgtgtgtagtagaagagtggaggagatgaagccggcggttgaaggcgacgagcgtgcggcggagatcgcccgcatcaaggccgccgcggccgccgccaaaaagtcggcggaagaggtggtggatgtggatgatgagggtgaggacgacgagggagatgaagaggaggaggcggttgatggcgacgacgacgacgacgaagtcgacgacgatggggaagatgacgatgacgagggggtggagggtgaggagaaggggtcggcgccgcagcaggtggtcgacatctccgacgaggacgacggcggcggcgacgaagaggagggtggtgacgatgacgacgacgacgacgacgacgatgatgacgaggaggacgacgacgaagtcgacgaggaggaggagcctgaggaggagctaggaactgaatatctggtgcagccgcttggccgtgctgaagacgaagagcattccagtgactttgagccagaagaaaatggtgatggtgctgaggacgaggagattgaggatgatgatgctgaggatggtgaggattctgtcaaggcgcaatcctcttcgaagaggaagaggtctggcgcggaggatgaagatgatgatgacggtgatgatgatggtgatgatgatgagaagcctccatcaaagcgatagtcaatttgttcttgctgatctggtatcttttctgcttgggccaagaaggaaaataatcctcacggagagggttgttggtaaatgctgtagctttaggacatctgtggtaggtgtagcagctcgaacttgagtctacccatgttagttgttagtgcatactgctgatgttgattaacagcctcggggaacttctgtatgagcattagatatggggcttgttatatgcttgtgtagcttctgatta

SEQ ID NO: 18174 - DNA, 1091 bp, Triticum aestivum
  Clone ID: PAT_TA_18174
gcacgaggattgtttgtccctcggcaatggatatgcctttggcatctaaaaccttcccctcgccctccccttccaagcgtgaacaatgcaacgttgatggccataagagctcatcgaagcatgcagatctcaatccacatgctaatgatagtgttctcggaattattcttggaggtggtgcagggactagattgtatcccctgacgaagaagcgtgcgaagcctgcagtgccattgggtgccaactacaggcttattgatattcctgtcagtaattgtctgaacagcaacatatcaaagatctatgtgctcacgcagttcaactcagcttctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggagtatctaattcttgccggagatcacctgtaccgaatggactatgaaaagtttattcaggcacacagagaaacagatgctgatattactgttgctgcgttgcccatggatgaggaacgtgcaactgcatttggccttatgaaaatcgatgaagaagggaggataattgaattcgcagagaaaccaaaaggagaacagttgaaagctatgatggttgatacgaccatacttggccttgatgatgcgagggcaaaggaaatgccttatattgctagcatgggtatctatgttattagcaaacatgtgatgcttcagcttctccgtgagcaatttcctggagctaatgactttggaagtgaggttattcctggtgcaactagcactggcatgagggtacaagcatacctatacgatggttactgggaagatattggtacaatcgaggcattctataatgcaaatttgggaattaccaaaaagcccataccccgattcagtttctatgaccgttctgcttccatttacacaacaacctcgacacttgcctcccttaaaagttcttgatgctggtgtgaaaaacagtggtaa

SEQ ID NO: 18175 - DNA, 718 bp, Triticum aestivum
  Clone ID: PAT_TA_18175
ccatggcaccacgccatagactccgtgcagaagatgagctgcctccctttaggcatcttggccgggaggaagaagtagaaaggccgcccttcggccagcatgtacaggaaaagagaaaacttctcaacaatctcggcgtctcgccgggcgggccgccaccacgatgatcagcatcctcgcgcaggagcgcctcctcgggttcgccctgggctccgtctccatgggcgggttcgtcctccaccagcgccgctccatctaccgctcccttgccgacgccgacgcggcctctgggggtgcatccttctcctaccagacaagtgcaacccaccggtagaggagtttcagcctgagatggctcacgtatggaacaaggcagtggacgagacacttggccggcttgttgtgtatcttagctctcgtggatggtaattcaagcattgagagtgaagcactactccctgatcacggcgttgttgttctaaattgagacacatgtgctctgccatttctcagtaccaacggttgatcataatgctttcttttgctttaaaaatgggtgtggaggataatagtcagattggaccaatggcgccctcctgctacacattgtcccccagatgtatcgtgggttcaggggctacagcctaaccctgttaaaatgttttattgttgaagttattatctggtcttaaaaaaaaaaaaaaaaaaaactcgagac

SEQ ID NO: 18176 - DNA, 921 bp, Triticum aestivum
  Clone ID: PAT_TA_18176
tagcgtggtcgcggccgaggtacacagcattttacagacggacccagaactaactgcaaataacacactggtccctgtcttttacaaagaggaccccaacaaccagataagaaaagcaatcgggtccttgacatcttctgcacggccgtaacttcgccgtcgccggggacattgccacttgggacaactaagcttccatggcaccacgccatagactccgtgcagaagatgagctgcctccctttaggcatcttggccgggaggaagaagtagaaaggccgcccttcggccagcatgtacacgaaaagaggaaacttctcaacaacctcggcgtctcgccggcggccgccaccacgatgatcagcatcctcgcgcaggagcgcctccctcgggttcgccctgggctccgtttccatggggggtttcgtcctccaccagcgccgctccatctaccgctcccttgccgacgccgacgcggcctctgggggagcatccttctcctatcagacaagtgcaaccaccggtagaggagtttcagctgagatggctcacgtatggaacaaggcagtggacgagacacttggccggcttgttgtgtatcttagctcgcgtggatggtaattcaagcattgagagtgaagcactactccctgatcacggcgttgttgtgctaaattaagacacatgtgctctgccatttctcagtaccaatggttgatcataatgctttcttttgctttaaaaatgcgtgtggaggataatagtcagttcggacaaatggcgccgcgccctcctgctacacattgtcccccagatgtatcgcagattcaggggctacagcctaaccctgttaaaatgttttattactgaagttattgtactggcctttttgcccacggccgggcaagaggaagggatttc

SEQ ID NO: 18177 - DNA, 627 bp, Triticum aestivum
  Clone ID: PAT_TA_18177
atagagttgaacttgaaatattgatttgtaccaaagcccaaggtgaaagaaagagcaacacatgttacatgttactattagacatacatacatataggatatgacccttacattcttattcagtgactgttacaccctcgctgaacccacacatcacacttcttttagctaattgactcacatgaacacactcccattcactgacacaaccgaccattatgtagctgaaaattcaaggacaccatacatgacaagcaactgacgagtgcatgataatgaccacaactcacaaggacacggtaaaccggtgggtaaactaaccgtagccccctcctccaaacacggatttagatggagagagggagacctggaagaaaggcgtagccttcccttgccaataagacttgccttttttcttctgcatcactgaagcacccctgctcacatgccggcctccggtgcacccggaagaaggcacggcaagcatgcttctggaaattcacactgctgagagcgcgaccaggtagcagcagcgtgctccacacttcttcttcttcctcttcctcgacatcattcacggagagctctctgtttactgtttacctcgtgccgaattcggcacgaggc

SEQ ID NO: 18178 - DNA, 1713 bp, Triticum aestivum
  Clone ID: PAT_TA_18178
tccaagcacccatcccctcacctcacctaaaccccccgcaaccttaacccatccccaccgccagcccccagccgtgtccccaaccccaaatcctcagatccgcctccgctcccccgagcccaagtccacccctccctccccaccgcggcgcgcacgcacgcacccggccaccacccacccggatccagatccgcgcggcggcggcgcaggtcagcaggagggagcgatggccggcggcgggggcgccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgccgtggggctcgtccgcgtcctgcgggtcgtcgagccgccctcctccccgcccatgacgccgcagctctacacctcctccgtcgtgcccatcggcgcgctctacgccatgtcgctctggttctccaactcggcctacatctacctctccgtctccttcatccagatgctcaaggcgctcatgcccgtcgccgtctactccatcggcgtcctcttcaagaaggagaccttccgctcctcctccatgctcaacatgctctccatctccttcggcgtcgccatcgccgcctacggcgaggccaggttcgacctccgcggcgtcgcgctccagctcgccgccgtcgccttcgaggccacccggcctcgtgctcatccagatcctgctcacctccaagggcatctcgctcaaccccatcacctcgctctactacgtcgcgccctgctgcctctgcttcctgctcgtgccctggatcttcgtcgagctgcccaggctgcgcgccgtcggcaccttccagcccgacttcttcatcttcggcacaaactcgctctgcgcctttgcgctcaaccttgcggtgttcctgctcgttggcaagacctccgcgctcaccatgaatgttgcgggagtggtcaaggactggctgttgattgccttctcctggtccgtgatccgggacacggtcacccccatcaacctcttcggctacggcatcgccttcttaggggttggctactacaaccatatcaagctgcaggcgctcaaggccaaggaggcgcagaagaagtccgcgcaggccgacgaggaggccggctccctgttgcaggagcgcgatagccacagtgatcgcaagagcgagaaccaggcatagagctccagatcggatccgggcatgcccacattgggaatctggtgcaaagtgcaaagactatagtttggtctacagttgctttcaaggaggtggatgccggttctggtttatctttttaactttagttggatctgaggagaaaaccaaggcaatttgttgatctaggaaatacttgcatttgaacctgtttctggagggttagaaggaacacttatattaccctgttatttatttttgcgtttttgttctgaaaggcggccttgcttcctctctcgctcattccgtatttatttggtcgagtagcctaggtaaaaatgtactgcacattggtatcatttcggtgggtatcatctggtggttatcatctatatataatgagcttactgtaaactatattcaatagttgcctcctttagctttt

SEQ ID NO: 18179 - DNA, 843 bp, Triticum aestivum
  unsure (1)..(843): unsure at all n locations
  Clone ID: PAT_TA_18179
cccacgcgtccgccaaccccaccgaatccacctctcgccggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcgcacggcggcgtcatccccaacatcaacccggtgctgctccccaagaagaccgccgagaaggccgagaagaccgccgccaagtcgcccaagaaggccaccaagtcccccaagaaggccaccaaggcctagatcgtagtagtgcggtgtgctgatggttccagtgtggttagatgtagtagctgtttcactctgtatcctgcgcccctgatgtaatcggaatcaaaggggaagccgcttgcttcctcttgactaatgaattatcaactaagcgtttctgaaaaaaaaaaaaaaaagggcgggccctnnctcgcntcanggaggcgctcgagaagcacacggagaggccgcccccgnccacctccaggggggcgttcagggagaaggagctgctcgccgcgggcaagataaccacttatatcggcaaggcccccaaggtttccg

SEQ ID NO: 18180 - DNA, 689 bp, Triticum aestivum
  Clone ID: PAT_TA_18180
ctcgagtttttttttttttttttttttttttttttttttttttttttttttttgaaagaaagagcaacacatgttacatgttactattttagacatacatatatgataggacacttacattcttattcagtgactgttactccctcgctgaacccacacatcacacttcttttagctaattgactcacagtgacagtcgacacacagaccgacacatgaacacactcccattcactcacacaaccgaccattatatgtagctgaaaattcaagaacgacaccatacatgtcaagcaactgacgagtgcatgataatgatcacaactcacaaggacacagtaaaccggtgggtgaactaaccgtagccccctcctccaaacacagatttagatggagagagggagacctggaagaaaggcgtagccttcccttgccgataagacttgccttttttcttctgcatcactgaagcacccctgctcacatgccagcctccggtgcacccggaagaaggcacggcaagcatgcttctggagattcacactgctgagagcatgaccaggtagcagcagcgtgctccacactgcttcttcttcttcctcttcttcctcgacatcattcacggagagcgagctctctgtttactgtttagttagtaggaagcccggacgcgtgggcggacgcgaggg

SEQ ID NO: 18181 - DNA, 634 bp, Triticum aestivum
  Clone ID: PAT_TA_18181
ttttttttttttgaaagaaagagcaacacatgttacatgttactattttagacatacatataggataggacccttacattcttattcagtgactgttacaccctcgctgaacccacacatcacacttcttttagctaattgactcacagtaacagtcaacacacaggctgacacatgagcattcaagaacaccataacattcactcacacaaccgaccattatgtagctgaaaattcaagaacaccatacatgacaagcaactgacgagtgcatgataatgatcacaactcacaaggacgcagtaaaccggtgggtaaactaaccgtagccccctcctccaaacacagatttagatggagagagggagacctggaagaaaggcgtagccttcccttgccgataagacttgccttttttcttctgcatcactgaagcatccctgctcacatgccagcctccggtgcacccggaagaaggcacggcaagcatgcttctgggaattcacactgctgagagcgtgaccaggtagcagcagcgtgctccacacttcttcttcttcctcctcttcctcgacatcattcacggagagcgagctctctgtttactgtttagttagttaggaagccagaacga

SEQ ID NO: 18182 - DNA, 788 bp, Triticum aestivum
  unsure (1)..(788): unsure at all n locations
  Clone ID: PAT_TA_18182
gccggccgggtcgggaaacacatcaatcaatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgccgtcctcgagtacctcgcagccgaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccggcaccgccgccaagtcgcccaagaaggccaccaagtcccccaagaaagccaccaaggcgtagattgtagtagtgcggtgtgctgattgttcgagtttggttagatgtagtagctgcttcactctgtatcctgcgcccctgatgtaatcgcgaacaaaggggaagccgcttgcttcctcttgacttatgaattatcaactaagcgtttctgaaaaaaaaaaaaaaaaaaaaaaaaaggggcgtgccgattatagaggnttttccaagggcttacgggtacgcgggtggcatgcgnacgtc

SEQ ID NO: 18183 - DNA, 2187 bp, Triticum aestivum
  Clone ID: PAT_TA_18183
ccacgcgtccgcccacgcgtccgctgctctactctaatccacactaccaaacccacacctcctcctccaaatagtcaaatactactccggcaccaacaccaggcgaggcgagcggcttcccttggagcagacgggggatctgctctgctctcctcctccccttccgctcctgaaattagcctccagccatggcggatctgcagacgccgctggtgcgaccaaagaggaagaaggtcttggtggactacctggtgcagttccgatggatcctcgtcatcttcgtggtgcttccggcctcggcgctcatctacttcaacatctacctgggcgacatgtggtccgccatgaagtcggagaagaagcggcagaaggagcacgaggagaacgtgcagaaggtcgtgaagcggctcaagcagcgcaaccccaagaaggacggcctcgtctgcacggccaggaagccctggatcgccgtcggcatgcgcaacgtcgactacaagcgtgccaggcacttcgaggtcgacctctctgccttcaggaacatccttgagatcgaccccgagaggatggttgccaaggtggagccgctcgtcaacatgggccagatatccagggccacctgcccgatgaacctctccctcgccgtggtggcggagctcgacgacctcaccgtcggcggcctcatcaacggctacggcatcgaggggagctctcacatctacgggctcttctccgacacggtggtggcgctggagatcgtcctggctgacggccgggtcgtccgggccaccaaggacaacgagtactccgacctcttctacggcgtgccctggtcgcagggcactctcgggttccttgtttcagccgagatcaagctcatccccatcaaggagtacatgaggctgacctacaccccggtgaagggccccctgaaggaggtggcgcaggcatacgccgacgccgtcgcgccgagggacggcgaccccgcaaaggtccccgacttcgtggaagggatggtgtacagcgcgacggagggcgtgatgatgaccggcgtgtacgcgtccaaggaggaggccaagaagaagggcaacaagatcaacagcgtggggtggtggttcaagccatggttctaccagcacgcgcagacggcgctcaagaagggcgagttcgtggagtacatcccgacgagggagtactaccacaggcacacccggtgcctgtactgggaggggaagctcatcctgcccttcggcgaccagttctggttcaggttcctcttcggctggctgatgccccccaaggtgtccctgctcaaggccacccagggcgacgccatcaggaactactaccatgacaaccatgtcatccaggacatgctcgtgccgctgtacaaggttggagacgccctcgagttcgtccaccacgagatggaggtgtacccgctgtggctgtgcccgcaccggctgttcaagctgccggtgaagacgatgatctacccggagcctgggttcgagcaccaccagcggcagggggacacgagctacgcgcagatgttcacggacgtgggggtgtactacacgccggcgtgcatcttcaggggggaggagttcgacggggcggagtccggtgaagcggctggagcagtggctgatcgagaaccacagctaccagccgcagtacgcggtgacggagctgaacgagaaggacttctggcgcatgttcgacgcgtcgcactacgagcactgccggcagaaatacggcgccgtgggcaccttcatgagcgtctactacaagtccaagaaggggcgcaagtcggagaaggaggtgcaggaggccgaggccgccatcctcgagcccgcctacgccgacgaggcctagggtcgtcgtgttcgtcgtcgtcggccgtccgtgtctcgacggtttcggttccttcagtcgtcggaactctggattaattggttcccttttgcttggttgcttaattattaataagtagaacttgatcgatcgtgtagcgttgattggtagcagcctgcggcctgtagcagcatgagtcattgttgtcgcccgtgagtacttgattcaaccgcccctttatgttgatgggattaattgcttagaacttaaaatgaggcagatgcgtatgtgggaataatattgcgatttgtgttgaaaaaaaaaaaaaaaaaa

SEQ ID NO: 18184 - DNA, 2016 bp, Triticum aestivum
  Clone ID: PAT_TA_18184
attcggcacgaggcacacatcactcaatatctatatccttccattgcttatccctcggcaatggatgtgcctttggcatctaaaaccttcccctcgccctccccttccaagcgtgaacaatgcaacattgatggccataagagctcatcgaagcatgcagatctcaatccacatgttgatgatagtgttctcggaattattcttggaggtggtgcagggactagattgtatcccctgacgaagaagcgtgcgaagcctgcagtgccattgggtgccaactacaggcttattgatattcctgtcagtaattgtctgaacagcaacatatcaaagatctatgtgcgcacgcagttcaactcagcatctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggaatatctaattcttgccggagatcacctgtaccgaatggactatgaaaagtttattcaggcacacagagaaacagatgctgatattactgttgctgccttgcccatggatgaggaacgtgcaactgcatttggccttatgaaaatcgatgaagaagggaggataattgaattcgcagagaaaccaaaaggagaacagttgaaagctatgatggttgatacgaccatacttggccttgacgatgcgagggcaaaggaaatgccttatattgctagcatgggtatctatgttattagcaaacatgtgatgcttcagcttctccgtgagcaatttcctggagctaatgactttggaagtgaggttattcctggtgcaactagcactggcatgagggtacaagcatacctatacgatggttactgggaagatattggtacaattgaggcattctataatgcaaatttgggaattaccaaaaagccaatacctgatttcagtttctatgaccgttctgctcccatttacacacaacctcgacacttgcctccttcaaaggttcttgatgctgatgtgacggacagtgttattggtgaaggatgtgttattaaaaactgcaagatacaccattcagtagttggactccggtcctgcatatctgaaggggcaataatagaggacacattgctaatgggtgcggactactatgagactgaagcggataagaaactccttgctgaaaaaggtggcattcccattggtattggaaagaattcacacatcaaaagagcaataattgacaagaatgctcgtattggagataacgtgatgataatcaatgttgacaatgttcaagaagcggcgagggagacagatggatacttcatcaaaagtggcattgtaactgtgatcaaggatgctttactccctagtggaacagtcatatgaagcagatgtgaaatgtgtgccaagggacagggctacttgcatcagtctggaatcaaccaacgaggccgcgaagagatcataagagcaataaaaaggagtgccatgcaaggcacttctccaccctttttcccccttgatgtattaggaactgtgatgtacaagcaactgtgatgcacttaggcgaagtgcccctggattcagctttctctttgcttgtagttgatttccagcagaccatgctatttgttgtatggttcatgtaaaaccttgcgttgctttttatataaaatgcgctgaaagcctatttcgctaagacaatggctgcaaccaggacaagggcaacaagggtactacccaacttctctgcaacagacaggacaagggcagcaatcaggacaagggcaacaaggctactacagctggggccgtgtttttgaggagcaccagtttagtccccctaaaggtggcaaaggcgcattttttattagggacacctgacggcaatgtgccggctggaggtcgacaacgcattgt

SEQ ID NO: 18185 - DNA, 2061 bp, Triticum aestivum
  Clone ID: PAT_TA_18185
gaccaaccccaaaacctcctctcctctgctctctactctagtctaatccccgtactcccaaacccacgctccaaatagccccttggagcgggggatctgctctgctctcctctccgtcttcactccccggaagtcagcctccagccatggcggatctgcagacgccgctggtgcgaccaaagaggaagaaggtgctggtggactacctggtgcagttccgatggatcctcgtcatcttcgtggtgcttccggcctcggcgctcatctacttcaacatctacctgggcgacatgtggtccgccatgaagtcggagaagaagcggcagaaggagcacgaggacaacgtgcagaaggtcgtgaagcggctcaagcagcgcaaccccaagaaggacggcctcgtctgcacggccaggaagccgtggatcgccgtcggcatgcgcaacgtcgactacaagcgtgtcaggcacttcgaggtcgacctctctgccttcaggaacatccttgagatcgaccccgagaggatggtcgccaaggtcgagccgctcgtcaacatgggccagatatccagggcccacctgccccatgaacctctccctcgctgtggtgggcggagctcgatgacctcaccgtcggcgggcctcatcaacgggctacgggcatcgaggggagctctcacatctacgggctcttctccgacacggtggtcgcgctggagatcgtcctggctgacggccgggtcgtccgagccaccaaggacaacgagtactccgacctcttctacggcgtgccctggtcgcagggcactctcgggttccttgtttcagctgagatcaagctcatccccatcaaggagtacatgaggctcacctacaccccggtgaagggccccctgaaggaggtggcgcaggcgtacgccgacgccgtcgcgccgagggacggcgaccccgcaaaggtccccgacttcgtggaagggatggtgtactccgcgacggagggcgtgatgatgaccggcgtgtacgcgtccaaggaggaggccaagaagaagggcaacaagatcaacagcgtggggtggtggttcaagccatggttctaccagcacgcgcagacggcgctgaagaagggcgagttcgtggagtacatcccgacgagggagtactaccacaggcacacccggtgcctgtactgggaggggaagctcatcctgcccttcggcgaccagttctggttcaggttcctcttcggctggctgatgccgcccaaggtgtccctgctcaaggccacccagggcgatgccatcaggaactactaccatgacaaccatgtgatccaggacatgctggtgcccctgtacaaggttggagacgccctcgagttcgtccaccacgaaatggaggtgtacccgttgtggctgtgccctcaccggctgttcaagctgccggtgaagacgatgatctacccggagccggggttcgagcaccagcagcggcagggggacacgagctacgcgcagatgttcacggacgtgggggtgtactacacgccgggcgtgcatcttccgcggggaggagttcgacggggcggagtcggtgaagcggctggagcagtggctgatcgagaaccacagctaccagccgcagtacgcggtgacggagctgaacgagaaggacttctggcgcatgttcgacgcgtcgcactacgagcactgccggcacaagtacggcgccgtgggcaccttcatgagcgtctactacaagagcaagaaggggcgcaagtccgagaaggaggtgcaggaggccgaggccgccatcctcgagcccgcctacgccgacgaggcctagtcgtgttgtctcgctgctggtttcggtcttgagtcggcggaactcctccgatcctggattaattggttcccttttgcttggttgcttattattaataagtagaacttgatggatcgtgtagcgttgattcgtaccccccctttatgttgatgggatttaattgcttacaacttaaaatcaggcagatgtgtatgtgggaataatattgtgctttgtgcttaaa

SEQ ID NO: 18186 - DNA, 772 bp, Triticum aestivum
  Clone ID: PAT_TA_18186
atggcaactaacatatattgttcgcgcagcgatgtacatccacagagaataacatactgcaccgagccaccgaatccacctctcgccggagtcccagcaaggagcaagcaagcgacgatggacggcagcaagctgaagaaggtggccgggaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgccgctgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtctgcggtgtactgatggttccaatttggttagatgtagtcgctgtttcactctgtgtcctgcgcccctgatgtaatcgccaacaaaggggaagccgcttgcttccccttgacttatgaattagtatcaactatgcgtttctgaaaaaaaaaaaaaaaggactagttctagatcgcga

SEQ ID NO: 18187 - DNA, 767 bp, Triticum aestivum
  Clone ID: PAT_TA_18187
ctccacagctcagcttccacccactctcaaaccctctcgccggagcccccagcaagccagcaagcaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctgagaaggctgagaaggccggcgccgcccccaagtcgcccaagaagaccaccaagtcccccaagaaggccaccaaggcctagatccggccgtgccggtgaactgatggtgctccggcagccctcgtgtgcctagtgtctctgtgttaagttagctatggtgtgttccagagagtgttgaagcttgtccttttgctttgccccaccatgtaaccgtgaacgaagaggaagcgtcttgcttcctctgttcttctgaatccatctggtgtctaatgcagtgtttgttaaaaaaaaaaaaaaaaaaaaaaaaaaaa

SEQ ID NO: 18188 - DNA, 2164 bp, Triticum aestivum
  Clone ID: PAT_TA_18188
accctactaaagggaacaaaagctggagctccaccgcggtggcggccgctctagaactagtggatcccccgggctgcaggaattcggcacgagtctctctcccttccccctcgtgatctctcgccacgggagccccgtgactcgagctcgtcattcacctcaatggcgatggccgcggccgcctccccctccaagatcctgatccccccgcaccgagcctccgccgcgaccgctgccgcgtccacctcctgcgactccctccgcctcctctgcgcgccgcgaggacggcgccagcgcccgcgcgggttggtcgcgcgtccggctccgcggcggcccttcttcttctccccacgtgccgtgtcagactccaagagctcccagacctgtctcgaccccgacgcaagcacgagtgttctcggaattattcttggaggtggtgcagggactagattgtatcccctgacgaagaagcgtgcgaagcctgcagtgccactgggtgccaactacaggcttattgatattcctgtcagtaattgtctgaacagcaacatatcaaagatctatgtgctcacgcagttcaactcagcttctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggagtatctaattcttgccggagatcacctgtaccgaatggactatgaaaagtttattcaggcacacagagaaacagatgctgatattactgttgctgcgttgcccatggatgaggaacgtgcaactgcatttggccttatgaaaatcgatgaagaagggaggataattgaattcgcagagaaaccaaaaggagaacagttgaaagctatgatggttgatacgaccatacttggccttgatgatgcgagggcaaaggaaatgccttatattgctagcatgggtatctatgttattagcaaacatgtgatgcttcagcttctccgtgagcaatttcctggagctaatgactttggaagtgaggttattcctggtgcaactagcactggcatgagggtacaagcatacctatacgatggttactgggaagatattggtacaatcgaggcattctataatgcaaatttgggaattaccaaaaagccaatacccgatttcagtttctatgaccgttctgctcccatttacacacaacctcgacacttgcctccttcaaaggttcttgatgctgatgtgacagacagtgttattggtgaaggatgtgttattaaaaactgcaagatacaccattcagtagttggactccggtcctgcatatctgaaggggcaataatagaggacacattgctaatgggtgcggactactatgagactgaagctgataagaaactccttgctgaaaaaggtggcattcccattggtattggaaagaattcacacatcaaaagagcaataattgacaagaatgctcgtattggagataacgtgatgataatcaatgttgacaatgttcaagaagcggcgagggagacagatggatacttcatcaaaagtggcattgtaactgtgatcaaggatgctttactccctagtggaacagtcatatgaagcaggtgtgaaatgtgtgccaagggacagggctacttgcatcagtctggaatcaaccaacgaggccgcgaagagatcataagagcaataaaaacgagtgccatgcaaggcacttctccaccctttttctcccttgatgtattaggaactgtgatgtacaagcaactgtgatgcacttaggcgaagtgcccctggatccaactttctctttgcttgtagttgatttccagcagaccatgctatttgttgtatggttcatgtaaaaccttgcgttgctttatatataatgggccgaaagcctatttcgtaaaaaaaaaaaaaaaaaataaagacttgaggggggccgggacccattcgctataagaggtgattacaatacctgcccggtttacacggtgacgggaaacctgcgtaaccattatcgcttgaccttcccttcccattgggtaagcaaaga

SEQ ID NO: 18189 - DNA, 1281 bp, Triticum aestivum
  Clone ID: PAT_TA_18189
ttttttttttcaagtataagcactgtaaaattaagacggacaagttgaaagccaacttataacacaactttcagtctccctctccctcatcacaatgtcgatagcagagataacaagttcatctagaaaatcctaaaacacaggtttttgtccatagggtagatatagcagatcgcatcagattctagatatccattcatgcctcacaaaatatgaactttaagccgcaaagacatctcaaggggacatcctagtctactcccagccttgagcagggggttgcaccgcggcgtcccagccagtagcagccacaacaggagcagggacggcaccttccacagcaacaggtgcccctgctgcatcccatccatcaccaccagcaactggagcttcagccatcggccactcgccaccagtaacaggcgggggagcaggtgcgtcagaggtccactggtcaccaccccattgaccagctgcagctccgtaatcagtgatggcagcatactctggggctccagcagcttcatcctcctgctccttggcttcctcagggtccctgtagaagaacagatcaaccatgacatcccacttgtgccctggcaggatagtgcccctcatctgcagaaccatcctggccaagagccagtacagacagccaatgctgttcctccccttgttgtttgctgggatgccgatatcgacgtatctcatgggagagtcagtgtcacagaaggcaatggtagggatgttccccagagcagactccttgatgggctggtggtcggtccttgggtcggtgaggatgagcaggcggggctcgctgaaggaggtctgcatctggttggtgaaggtaccaggggtgtgcctcccggcgatggcgttggcgccggtgtgctgcgcgaacttgaggacggcgcgctggccgtaggggcgggcggactggacgatgatgtcctgggggttctcgatggcgacgatgaccctcgccgcgagctggagcttctcccatgtcttgcccagattgatgatgtagatgccgtcggagcggcgcttgtaggcgtagcgctccatctggaagtcgcagttcttggtgccgaggtggacgtcggcggcgagcatcatctgtatgtcctgctccttctgggacagcgcccgaggggcctctccagccgctgccgccatggttggtcgggggctcgagcgtccgggtggcgccgcgaaggggaggaggaggggagggatgtgagcggcggcgcgaatagggagaaggcggacgcgtgg

SEQ ID NO: 18190 - DNA, 796 bp, Triticum aestivum
  Clone ID: PAT_TA_18190
aacctcctcaaccgcaccacagctcagctcccacccactcccaaaccctctcgccggagccccagcaacccgccagcaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagctgtggtgtgttccagagtgtgttgaagcttgttcttttgctttgccccgccatgtaaccgtgaacgaagaggaagcgtcttgcttcctctgttctgctatatcaatctggtttctaatgcagtgtttgttaaaaaaaaaaaaaaaaaggcccctagg

SEQ ID NO: 18191 - DNA, 878 bp, Triticum aestivum
  Clone ID: PAT_TA_18191
agctttccccccacaccaaccacccttctcccgccgccgcaccgcgaagcaaagcaggagcagcaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagactgtcactcccattccctacgatgtggtcaatgatctcaagggtggttactagggtgtttgggttatctgcctgcacaaccagttcaaatctatggtgctcttatgagtaggatttgctctctgaactgtagtctgggttgggtctttattcatgtcaagaagatattcggtgtaggttgctatcatgagttttgcagaaatgctatactgtgctatttccttcagaatgatggtgtgctctgttgaactatatagttacattgcttgcctccaaaggttcacttcgcctctacagccttggtactgcagggctgctgcagcttgctgtttgtctttcgagtttggcccaatcgattcaatacttctcg

SEQ ID NO: 18192 - DNA, 1911 bp, Triticum aestivum
  Clone ID: PAT_TA_18192
ccacgcctccgcccacgcgtacgttccattgtttatccctcggcaatggatgtgcctttggcatctaaaacattcccctcgccctcaccttccaagcgtgaacaatgcaacgttgatggccataagagctcatcgaagcatgcagatctcaatccacatgctaatgatagtgttctcggaattattcttggaggtggtgcagggactagattgtatcccctgacgaagaagcgtgcgaagcctgcagtgccactgggtgccaactacaggcttattgatattcctgtcagtaattgtctgaacagcaacatatcaaagatctatgtgctcacgcagttcaactcagcttctcttaatcgtcatctctcacgagcctatgggagcaacattggaggttacaagaatgaaggatttgttgaagtccttgctgcacagcagagcccagataaccctgactggtttcagggtactgcagatgctgtaaggcagtacttgtggctattcgaggagcataatgttatggagtatctaattcttgccggagatcacctgtaccgaatggactatgaaaagtttattcaggcacacagagaaacagatgctgatattactgttgctgccttgcccatggatgaggaacgtgcaactgcatttggccttatgaaaatcgatgaagaagggaggataattgaattcgcagagaaaccaaaaggagaacagttgaaagctatgatggttgatacgaccatacttggccttgacgatgcgagggcaaaggaaatgccttatattgctagcatgggtatctatgttattagcaaacatgtgatgcttcagcttctccgcgagcaatttcctggagctaatgactttggaagtgaggttattcctggtgcaactagcactggcatgagggtacaagcatacctatacgatggttactgggaagatattggtacaattgaggcattctataatgcaaatttgggaattaccaaaaagccaatacccgatttcagtttctatgaccgttctgctcccatttacacacaacctcgacacttgcctccttcaaaggttcttgatgctgatgtgacagacagtgttattggtgaaggatgtgttattaaaaactgcaagatacaccattcagtagttggactccggtcctgcatatctgaaggggcaataatagaggacacattgctaatgggtgcggactactatgagactgaagctgataagaaactccttgctgaaaaaggtggcattcccattggtattggaaagaattcacacatcaaaagagcaataattgacaagaatgctcgtattggagataacgtgatgataatcaatgttgacaatgttcaagaagcggcaagggagacagatggatatttcatcaaaagtggcattgtaactgtgatcaaggatgctttactccctagtggaacagtcatatgaagcaggtgtgaaatgtgtgccaagggacagagctacttgcatcagtctggaatcaaccaacgaggccgcgaagagatcataagagcaataaaaaaggagtgccatgcaaggcacttctccaccctttttctcccttgatgtattaggaactgtgatgtacaagcaactgtgatgcacttaggcgaagtgcccctggattcagctttctctttgcttgtagtcgatttccagcagaccatgctatttggtgtatggttcatgtaaaaccttgcgttgctttatctatatctatatctataccaatataaaaaaaaaaaaaagggcggccgccctttttttttttttttttttttttttttttttttttttttaagagcaagaaaggagcacggaagacaatattgagaaagagagcctgaaacatatgatcctgattaggcctgg

SEQ ID NO: 18193 - DNA, 776 bp, Triticum aestivum
  Clone ID: PAT_TA_18193
attcggcacgaggcagcttccacccactctcagtcccctcccgccgggagcccaagcaaggaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtgcgaccgtgcccggtggtgctccggcagccctcgtgtgccctagtgtctgtgttaattaagttagctgtggtgtgttccagagagtgctcaagcttgtacttttgctttgccccgccatgtaaccgtgaacgaagaggaagcgtcttgcttcctctgttcttctgaatcaatctggtctctaatgcagtgtttgttaaaatgtcactgaatttctgttctaaaaaaaaaa

SEQ ID NO: 18194 - DNA, 1300 bp, Triticum aestivum
  Clone ID: PAT_TA_18194
gcatagaacacatcacgtataagcactgcaaaattaagacggacaagttgaaagccaacttataacacaaactttcagtctccctctccctcatcacgatgtcgatagcagagatcacaaattcatctagaaaatcctaaaacacaggtttttgtccatagggtagatatagcagatcgcatcagatgctagatatccattaatgcctcacaaaatatgaactttaagccacaaagacatctcaagggagcatcctagtctactcccagccttgagcagggggttgcaccgcggcgtcccagccagtagcagccacaacaggagcaggaacggcaccttccacagcaacaggtgcccctgctgcatcccatccatcgccaccagcaactggagcttcagccatcggccactcgccaccagtaacaggcgggggagcaggtgcatcagaggtccactggtcaccaccccattgaccagctgcagctccgtaatcagtgatggcagcatactctggggctccagcagcttcatcctcctgctccttggcttcctcagggtccctgtagaagaacagatcaaccatgacatcccacttgtgcccaggcaggatagtacccctcatctgcagaaccatcctggccaagagccagtacaggcagccaatgctgttcctccccttgttgtttgctgggatgccgatatcgacgtatcgcatgggagagtcagtgtcacagaaggcaatggtagggatgttccccagagcagactccttgatgggctggtggtcagtccttgggtcggtgaggatgagcaggcggggctcgctgaaggaggtctgcatctggttggtgaaggttccaggggtgtgcctcccggcgatggcgttggcgcctgtgtgctgcgcgaacttgaggacggcgcgttggccgtaggggcgggcggactggacgatgatgtcctgggggttctcgatggcgacgataaccctcgccgcgagctggagcttctcccatgtcttgcccagattgatgatgtagatgccgtcggagcggcgcttgtaggcgtagcgctccatctggaagtcgcagttcttggtgccgaggtggacgtcggcggcgagcatcatctgtatgtcctgctccttctggggcagcgcccgcggggcctctccagccgctgccgccatggttggttcggggctcgagcgtccggggggcgccgcgaaggggaggaggaggagggagggatgtgagcggcggcgcgagcggggagaagcctcgtgccgaattcctcagcccgg

SEQ ID NO: 18195 - DNA, 1299 bp, Triticum aestivum
  Clone ID: PAT_TA_18195
tttttttataagaactgcaaaattaagacagacaagttgaaagccaaacttataacacaactttcagtctccctctccctcatcacagtgtcgatagcagagataacaagttcatctagaaaatcctaaaacacgggttttttgtccatagggtagatatagcagatcgcatcagattctagatatccattcatgcctcacaaaatatgaactttaagccgcaaagacatctcaaggggacatcctagtctactcccagccttgagcagggggttgcaccgcggcgtcccagccagtagcagccacaacaggagcagggacggcaccttccacagcaacaggtgcccctgctgcatcccatccatcgccaccagcaactggagcttcagccatcggccactcgccaccagtaacaggtgggggagcaggcgcatcagaggtccactggtcaccaccccattgaccagctgctgctccgtaatcagtgatggcagcatactctggggctccagcagcttcatcctcctgctccttggcttcctcagggtccctgtagaagaacagatcaaccatgacatcccacttgtgccctggcaggatggtgcccctcatctgcagaaccatcctggccaagagccagtagaggcagccaatgctgttcctccccttgttgtttgctgggataccgatatcgacgtatcgcatgggagagtcggtgtcacagaaggcaatggtagggatgttccccagagcagactccttgatgggctggtggtcggtccttgggtcggtgaggatgagcagccggggctcgctgaaggaggtctgcatctggttggtgaaggtaccaggggtgtgcctcccggcgatggcgttggcgccggtgtgctgcgcgaacttgaggacggcgcgctggccgtaggggcgggcggactggacgatgatgtcctgggggttctcgatggcgacgatgaccctcgccgcgagctggagcttctcccacgtcttgcccagattgatgatgtagatgccgtcggagcggcgcttgtaggcgtagcgctccatctggaagtcgcagttcttggtgccgaggtggacgtcggcggcgagcatcatctgtatgtcctgctccttctgggacagcgcccgcggggcctctccagccgctgccgccatggctgtcgggggctcgagcgtccgggtggcgccgcgaaggagaggaggaggagggaggggtgtgagcggcggcgcgagcggggggaaggggagggggcgagggctcttcccgacccggccggc

SEQ ID NO: 18196 - DNA, 911 bp, Triticum aestivum
  Clone ID: PAT_TA_18196
cccacgcgtccgcccacgcgtccgcccacgcgtccgcccacgcgtccgacacactcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggtgcgtggtgaggtcatcagcaccaagaggcagccagcaggccccaagcctgggttcatggtggagggcaccaccatcgagacggtcacccccatcccgtacgacgtcgtcaacgatctcaagggtggttactagagcgcttgttgtttcctgagcagaagcttgagccagttcttagtatctatgcttgttcccaatgttttgggtactgagtagttctctttttgctccgcggagtgtgaacttctctgtggttaacattaaagatttcctgtggttgatttcattctcgacatgctgctggatatatttgcttttggttgattgggcaattgtctgtcctacgagttccttctgagaagctgcagatttcacgggcaatggatttcccacgtaattcctgtgtaagcaagcagcttcgagatgcatgtcaagat

SEQ ID NO: 18197 - DNA, 1315 bp, Triticum aestivum
  Clone ID: PAT_TA_18197
gccggccgggttccgactagtcccccccacaccaaccacccttctcccgccgccgccccgcgaagcaaagcaggaggagaaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccactcggccctaaacctgggttcatggtcgagggtaccacaattgagaccgtcactcccattccctacgatgtggtcaatgatctcaagggtggttactagggtgtttgggttatctgcctgcacaaccagttcaaatctatggtgctcttatgagtaggatttgctctctgagcagtagtctgggttgggtctttattcatgtcaagaagatattcggtgtaggttgctatcatgagttttgccgagcaccagcagcggcagggggacacgagctacgcgcagatgttcacggacgtgggggtgtactacacgccggcgtgcatcttccgcggggaggagttcgacggggcggagtcggtgaagcggctggagcagtggctgatcgagaaccacagctacagccgcagtacgcggtgacggagctgaacgagaaggacttctggcgcatttcgacgcgtcgcactacgagcactgccggcacaagtacggcgccgtgggcaccttcatgagcgtctactacaagagcaagaaggggcgcaagtccgagaaggaggtgcaggaggccgaggccgccatcctggagcccgcctacgccgacgaggcctagtcgtgttgtctcgctgctggtttcggtcttgagtcggcggaactcctccgatcctggattaattggttcccttttgcttggttgcttattattaataagtagaacttgatggatcgtgtagcgttgattcgtaccccccctttatgttgatgggatttaattgcttacaacttaaaatcaggcagatgtgtatgtgggaataatattgtgctttgtgcaaaaaaaaaaa

SEQ ID NO: 18198 - DNA, 1746 bp, Triticum aestivum
  Clone ID: PAT_TA_18198
gccggccgtgccgggaacctttgcgaccttcgacaactccacgatcttcgacaagtcccatcaccaggtcgactaataacagcagccatggcttccgagaaggcaaacaaccccatgcgggagctgaagattcagaagctcgttctgaacatctccgtcggagagtctggtgatagactcactcgtgcggctaaggttctggagcaactttccggacagacacccgtctacagcaaggctcgttacaccgtccgaactttcggtatccgacgtaacgaaaagattgctgtccacgtcaccgtccgaggccccaaggctgaggagattctcgagcgtggcctcaaggtcaaggagtacgagctccgcaagcgcaacttctccgagactggcaacttcggcttcggtatcagcgagcacatcgatctcggtattaagtacgacccctcaattggtatctacggcatggatttctactgctgcatgacccgacctggtgagcgcgtcacccgccgccgccgaacaaagtccaagatcggtgcctctcaccgcatcaagcgcgaggagaccgtcaagtggttcaagtctcgcttcgatggtattgtccgataaacggttgaaaaggaaaattgttatttgaatttacggattggtcacggcgaaaactaaggggaaaacacacatggggcatgtattttctgttgccattgctgcatcagctcgactcttttagtcgagccacggcctgagagaccgaccggcactctgccggctttccgatattcactcactctgaatgtgacatctgccatcaatcgtcagatcattggtactttgtctaaaaaaaaaaaaaaaaaaaagtccccccacaccaaccacccttctcccgccgccgccccgcgaagcaaagcaggaggagcaggatgccggcgggccacggtctgcggtcgcggacgcgcgacctgttcgcgcgcccgttccggaagaagggttacatcccgctcaccacctacctgcgcacctacaaggtcggcgagtacgtcgatgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgcggaggagttccgcctgaggaaagtgaagaatgaccagctcaaggaggaagccaaggcacgtggtgaggtcatcagcaccaagaggcagccgctcggccctaaacctgggttcatggttgagggtaccacaatcgagaccgtcactcccattccgtacgatgtggtcaatgatctcaagggtggttactagggtgtttgggttatctgcctgcacaaccagttcaaatctatggtgctcttatgggttggatttgctctctgagcagtagtctgggttgggtctttattcatgtcaagaagattttcggtgtaggttgctatcatgagttttgcagaaatgctatactgtgctatttccttaagaatgatgatgtgctcttttgaactatgtagttacattgcttacctccgaaggttctctttgcctctacagccttggtactgcagagctgctgcagcttgctgtttgtcttttgaactttgacccaatcgattcaattacttctcagggcattttgtat

SEQ ID NO: 18199 - DNA, 922 bp, Triticum aestivum
  Clone ID: PAT_TA_18199
ttttttttttttttttttgaacaaaagacgggtccagaaggaccctgatgctgcattaacactgaacatgaagtacacagcattttacagacggacccagaactaactgcaaataacacactggtccctgtcttttacaaagaggaccccaacaaccagataagaaaagcaatcgggtccttgacatcttctgcacggccgtaacttcgccgtcgccggggacattgccacttgggacaactaagcttccatggcaccacgccatagactccgtgcagaagatgagctgcctccctttaggcatcttggccgggaggaagaagtagaaaggccgcccttcggccagcatgtacgatgacgtgatggagccggccggccgccgaacgccgtagctggcgccaaggccactcccaaacagccaccggataagagcactgacccgatctggttctccatctcttctactcttcgtcttcaccaccacggcgacgccacgagctagagaagtagcggagagcctccagaacaggggaccagacgagcttattggtggatgagccagcagcacgcccctcggcagcgactggccgccagccagccttgcctgagacgcagccaccgtgagccaccagccgctgctcgtacgcggcggcggcgctctccacatcggcatacagccatacgccacatgggcactactcgacctcaacctatacctagattctatatacataggacaacgccatgcacctctcccgtctccgctccggccggcgaggccgtcggagaagataagggatcgggccgggagcggtggaactctctcgactctcaacgggggctggtcaactcgtacgacgtgagggaagcaacgtacggttgcacattactggcacgtgcgcgcatgttcggaagcggaaac

SEQ ID NO: 18200 - DNA, 773 bp, Triticum aestivum
  Clone ID: PAT_TA_18200
attcggcacgagggcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtggttactagagcgcttgtttcctgagcagaagcttgagccagttcttagtatctatgcttgttcccaatgttttggtactgagtagttctctttttgctccgccgagtgtgaacttctctgtggttaacattaaagatttcctgtggttgatttcgttcttgacatgctgctggatatatttgcttttggttgaaaa

SEQ ID NO: 18201 - DNA, 892 bp, Triticum aestivum
  unsure (1)..(892): unsure at all n locations
  Clone ID: PAT_TA_18201
gaggaattcggcacgaggcacactcccccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcagccatccaggtgcaacgaggagttcctccagaggaaactcaacaacgacaagctgaaggcggaggccaaggcgcgcggcgaggtcatcagcaccaagaggcagccagcagggcccaagccggggttcatggttgagggcaccaccatcgagacggtcacccccatcccgtatgacgtcgtcaacgatctcaagggtggctactagagcgcttgcttcctgagctgaagcttgagccagttcttagtatctatgcttgttcccaatgtcttggtaccgagtagttctctttttgctccgccgagtgtgaacttctctgtggttaacattaaagatttcctgtggttgatttcattctcgtcatgcactcatgctgctggatatattttgcttttggtcgattgggcaattgtttgttctactaagttccttttgagtagctgcagattgcacgagcgatgagtttactgacgcaattcctttgtaagcaagcagctttnagagggataccaa

SEQ ID NO: 18202 - DNA, 940 bp, Triticum aestivum
  Clone ID: PAT_TA_18202
agggaactacatgcctgacttacaaacattatcatgataatgaacacatacttccatcaacattatgggaaaaatcaaactatgtatgccctccacttatttggctaatattggtaacaatttgcagttttttatttgcagcgagatagctccctacatcttgccaaccaacggatcaagtgtggatatccacttgttgtagtccattggagaaccagagtcactgagtggtatgccattaacaaagtagtagggtgtcccggtgacgcctcgtgcacaaccaaacttgaaggaaatccttgtggcctgatccgactgcgagtcgttgaagcccgctctgtatgctgccaaattggcctcgccaatgacgggggcgacaaggttgttcgctatttcggcgaccaccgccgctcttgttttggtgtatgtcggcatgttgtaataaccctcctggtatttgaagaagttttcgagcaggggatacacggctgacgcatttagcttgtgcaccgtgtggatcgaccggcaagccatgaaggcgctgctgtggtaagggagcgggaagaggtgcacgacgacggcgacgcggcgggcgccgtagtgggcggcggcccgctgcagcggcggccaggcgtcgcggctgtcggggcagacggggtcgaagaaggcctccaccaccaccgcgtcgccccacgccggcgccgccgcgtggcccccgtacacgaacccgtccgtcctcaccgggatcggcagctgcgcgccgcagcgcccgacgacggccgcagccgccacgagcacgagcagcaccgccgccgccggcacacggtggcggctgggctccatcgatcacgatcacgatcgctcggctcggctgggggctggggctggtgcacgacgtagtagctatagcttgcttgggtgcttgaccggtagctcgttg

SEQ ID NO: 18203 - DNA, 1123 bp, Triticum aestivum
  Clone ID: PAT_TA_18203
ctcgtgttttttttttttttctttccttagcctggtaatgacacgctcccttcctgccacttcatggccgcgtgcaccgacggcccccctccactgacctgtctagtattcgtagccttgtgcacattgctgacttacacacgttatcatgcttgatatcgaacacaaacttccctaaccatcatggcaaactcaagtaatttatgccctccacttatttggttaatattggttacaatttggagttttttatttgcagcggagatagctccccaacatcttgccaacccaaacggaatctaagtttggatgtccgcttgttgtagtccccttggagatatcttggccagttggtgtcatgccattcaagcgagagaagtaggttatctagttcggcggcctcgtgtgctcttgtattggtgtgtgtcggcatgttgtaataaccatcgtggtatttgaagaccttttcgagctaggggataacacggctgacgcatttgagcttgtgcacaggtgtggatcgaccgggcaagccatcgaaggcgttgctttggtaagggagcgggaagagatgaacgacgacggcgacgcgggcgggcgccgtagtgggcggcggccctctgcagcggcggccaggcgtcgcggctgtcggggcagacggggtcgaagaaggcctcgacgaccaccgcgtcgccccacgccggcgcggccgacttcccgccgtacaggaacccgtccgtcctcaccgggatcggcagctgcgcgccacagcgcccgacgacggccgccaccgccacgagcacgagcagcgccgccgccgccggcacacggtggcggctgggctccatcgatcacgatcacgatcgctctgctggggctgggctacccactagcttgcttgcttgggtgtttggctggtagctcgctggtgaagtaacaggaagtgaacacagctgagctgaggtatatatttggatggaacatcatgcagtagacgatagagcagaggtcgttaggacgactgatgatagccgagcacgaccgtagtacgcacacaggcagccaatggttgaccggtagctcgttggtgaactaagcggaacacagctgagatgagcttaat

SEQ ID NO: 18204 - DNA, 1167 bp, Triticum aestivum
  Clone ID: PAT_TA_18204
accccaccatagggtattgggaatcggttaggccccgattagaggagtaaaaacgaggttttactgctttaatcggttattgggatgaaaaatgcctttacaaacaatgtcctggactgtcaccgtttagaaatccattttcttttctaactacacacagcagagcggggcggggtgtaatccgataagttaatttgctggttacaatccgacatgtgcaacggacggatggatggatcgatcgagatactgtgctctgcatgcatgtgcatgttgttgatcatgccgggtcacttcttcatattgacccactccagcttcagcattatttccccgctctcgacgttccggaggcgcaggatcatgtcctggacgaacttgccgttcttccagcacacgcggctctcctcggcgaggcagttcccgctgctcggcgcgaccgaccgcaccacggtgccgttgcggatgccctcggtgtccagttccaggacctccgtgaagggcagcacctcgatgtccgcgttccccattgggtcgtccttgctgaaggtgtccttgtcaaacaccgcaagcttgattggtgcattcgggttcgtgattgacagggttagctcctcatgccagatagggttcacggatcgcttcttcacgctggtcttcaactgctgcttgccgaggcgaaggacaacatatggatcactgccacttgcatcgccgtcggcaaggtcaatcccacgcaccacacgctccttcaacagcccaaccaaactaaccatgtccgtgctagacccgatcgatacgcagtgtagtataaggtatgctatgctattgggttgcttctcatgcaagataggcttcacagatcgctgcttcacgctggtctgaagtttctgcttgccgaggcgaaggacaacatatggatcactgcctcttgcgtcgcggtaggcaaggttgatcccacgcaccacgcgcaccttcaacagcccaaccaaaccatccatgctcgatctcgatccgatcgatactcagtttaattaattttatgctatgctattattttacgtacagaggaatgtggtcggtgcggtgtggtgtggcgtgggacgaagaagcgcctaatccaatcctcgaattagaattaggcgacttcttgccccccgccttcct

SEQ ID NO: 18205 - DNA, 1144 bp, Triticum aestivum
  Clone ID: PAT_TA_18205
gccgtcgggccgggatcgatcaaggatcagacgacacgagctagtagccacaaagccaacgatctcgaccgctcgggtcatcagcaacgaaccatggcgcgggtgctggctctcggcgccgccgcggctttcctcctcctggcagtggcatcgaccatggcggctgcgcagaactgcgggtgcgcggcgagtcagtgctgcagccgctgggggttctgcggcgccaccagcgagtactgcggcacgggctgccgctcgggtccctgcaccgtgcccgtcaccaacaacgtgtccgtgcccgccatcgtcacgccggccttcttcggcccgctcgtcgcccaggccgccgacgactgcgccgccaagggcttctacacccgcgacgccttcctcacggcgctcggcgggtaccccgccttcggccgcaccggctccgacgacgactccaagcgcgagatcgccgccttcttcgcccacgtcaaccacgagaccataaagttctgctacatcgacgagatcaacgggccgagcaagaactactgcgacccgacgaacgcggagtggccgtgcgccgccgggaagggctactacggccgcgggccgctgcagatctcgtggaactacaactacggggcggcagggcagagcctcggcttcgacgggctcaacgacccggacgcggtggcgcggagccccgtcttggcgttccaagcggcgctctggtactggatgaacagcgtgcacgacgtcatcgtctccggccaggggttcggcgccaccatcagggccatcaatggcgcgctcgagtgcaacggcaagaaccccagcgccgtcaacgaccgcgtcgccttctacaagcagttctgccagcagttcggcgtcgacccggggaccagcctcacctgctaagctcactatctaggacatcgcgtggacttggttgtggcatatgtgcgtgcatctgattcggacagacatattcaggataaaattgctttctgatttgatactatacctgttaatttaatactaccttcgtctcgatgaataagtcattcgcatagttctagatcgacgatttaactatctaaatatgtattatatgtgacaaaatatatatatttaaaaacttacatccgtgtag

SEQ ID NO: 18206 - DNA, 1028 bp, Triticum aestivum
  Clone ID: PAT_TA_18206
ccaacatggctcttaatcgtcttgttgctgaggatttcctggaatctttgggtaaagaactgggattggaggttcctccagagaaacctgcccagccaccgaatgtcttatttagatcagaaatccttccaacggctgatgcaagtgtatctaggaatggccagacatctacttttagggagataaaggagaacgagggttctttgggtttgatggaagctgccaatggtaatggggacggtccttcatccaatgtcgaaaagcttgatttgaaatatgagcataatgctgacataggccggtcacactcttcacatcgtcagattcggaacggtagtccagagtctgatacttctattgaacggcataggagtaggaaaagaagatcccatcatcgaaatcggagtccaacacccgattctggttcttctgatgaacgacgtagtggtaagaaaagaaagtcacattcaaggcatagagcaggcaggagtagaactcctgatgccgatttgtcctctgacagtcaaaagaataagagaaaacgtcgggagaaaaggagtcatcggacccgcatgtctgacagtgattctagtgatcatgaatacaaggaaaaatatacatctagtagtagaagatcatctgataaagacagaagtagaaagcattctaaacaccgcaggcacagaagaaaagactctgcatagtgttcttgaatacagctactgggaatacatggctgcaaatgaaagaattcacattagcttctccagattatccaagttggtgaaaatgttgggcccgatactgaagtgggatgtttatattacaagttgataccgtgttatccagtcatccaaaactatttgatgagcccggaagcttcttgcgtactccctccgttccgaattacttgttttagatttgtctagatacagaggtatctaacactaaaatgagtctagatacatttgtatctagacaaatcgaagacaagtaattcggaacggaggaagtagtagttactgaga

SEQ ID NO: 18207 - DNA, 1291 bp, Triticum aestivum
  Clone ID: PAT_TA_18207
ccacgcgtccgctccgatgcttaaacatttggcgaaaatggcaacggcatcatctcacacctacgcccctctcctgctcttgttcctcctggcctgttcatgcagggcatcatccggccatgcggtcgaccctgcctgccctccggccaaggcgtcggcgctggcggtggaaatctcggactgcggcggacctcggtgccagccaccggctccgcacgtcccggtcccggtgttcccgtacgacatcgacccgatgcagttcgcgctgaacctggagtacaccgaggccgagttcttcctccacgcagcgttcggtgtagggctcgaccagatcgcgccgaacctgacgttgggagggccgcctccggtgggcgccatgaaggccaaccttgacgaggtgacatggcgcatcgccgcggagtttggccttcaagaagtcggccacatcagggctatccagaacacagttggtgggttccctaggccgaagatagacctgagcgccagcaactttgcaagggtgatggaccaagcatttggttaccatttggatcctcctttcgacccctatatggacagccgcaacttcctgatggcgtgctacgtgatcccctacctgggcatcaacggctgacaccggcaccaaccccatcatcgacggctacgagacttaaacaccttcttgcagggttgctaggcgtggaggcggggcaggacgcggccttccgcgcgctgctcttcgagcggaagagcgagacggtgccgccctacaaggggatcacggtggcggagttcaccgaccgcatctccgcggcgaggaaccagctggcgaagtgcggggtgaaggacgaggggctcaccgtgccgcccgagcttggcgcggaggggaggatctgcaccaacgtgctctccgccgacagggactcgctctcctacgcccgcacgccggcggagctgctccgcatcctgtacctcaccggcgacgagcacgtgcccggcggcttcttcccggagggcgcgaacgggaagatagcacgggagtttcttcgcaagccgtttgcagctgggggtaacagggtgccagcaaattaagtaggcccgtatgagtgattgcagcgtcaatcatcggcctgaatgaataataatgtaaatagtgtgtggatggcatgcttcgatggaataagatggacagtgtttgtgcggcttctgaggtccttagaaattgaacccgttgcgcaggctgcacaatgtgttgtacggaaattgaatggcaaaacagaagttgcagtgt

SEQ ID NO: 18208 - DNA, 1352 bp, Triticum aestivum
  Clone ID: PAT_TA_18208
gcgaatcttcgagaggaagtaccacaacgtttcacgctctcccttatcctcccgctatagtagatcggagaggagactcgtttggcgacctcggcgcctgagctcctgccgtcgatctcgtcgggccccctcgcttccgtcgccctcgtcggcgtcgtgaggtgacgggggcccagatcctcgggtgggctgtacatatagcttagtttggtggctgtagctaggcttttgctgtcggggcgagctcctcggcgtcgcgcttggctccggccgggcggcgtgggtggcggagacgtccgcgatttggtgtgtttcgggtgctgcgtggtctcgtcggcctgtccctggtggcggcttcaggtctgctgcttgtgtgtgctccgaatcgagcgctcgatctggttgggcgctcgccggcgtcgtccttggctctggctcgggaggcgatggaggagctgcacgcgagtatgtcttcgtcctggcgctgctctggcccgccggctccgtcgtcggtggcggctgcagcttgggtgcgttttcgcggggacgccgcttggttggaggctgcgtctcgtcggcgttttgttcttccggggctcactccatctcgagctcgtcttctcagacgggatcgatgggccatcggcgtagattcctgccgctcgtcttgggtggtgaggttagatttggcctggccggcgtgcgcggcggcgggcttggtgtgctcgggtttggtcgaggaggcggcgctgtcgaccaaatcaggagttttgcttcctcggcttcgtctctgccacgtcgacacgttctccggtgtcgatgagaagccggtggagtcctgtacaggagtgctttggccggcgatggtcatcccgatggtggccgcgacggctggcgagagatttggtgggcccaatgctcggatggtggctcgtggctgcagttctggagattctccttcgacttcatcggatggaggtgccggagctgcggccgaggtgcatggggatgatccccggtcgacgcgccacagcggcaacgcctcaccgttcgcggcggggttcatattcgactcacaaagccgtttccggcaatggtgtatccccggtcaagggtttgctggatatctgcattttcctctggcgttcgtctcgacgacgacggcagtcgactgcaggagatggtttcatttgtggattggccccccagggtcctcattgtatttttctttctttggggggtcttttcgcatgtgtgttgggacatgtgtggtctctcggggtctttcgacgatgctgcgtctgtgctacatctgtatccgtttctggataaggtttaatgcagtttcttct

SEQ ID NO: 18209 - DNA, 1785 bp, Triticum aestivum
  Clone ID: PAT_TA_18209
ttttttttttttttttttttttttctgtccttcaccccaccaagaaaacgagccattacagacatatataatgaaggtagcaacagaccacagcctacgaccattacaagttcacccatgcttccaactgtgccatatttaaaccatcacaccccgactctaatagatataaaaagcacagaaggctatcattgaattaactacttataacttaaataatgcagtcaagcactaattgtggttgatcacgcgcctggtagtcatcaatctagaccacagtgcgcgaagcacatcaggtaggaggagtagcagtagtagttgagctgccaaattaccatctacagtatatcagacgattcttcttttccttgtggagaagacaatgagaccatccagtgtggttcgcgcagaacttggcagcaaccagggaaggtatgtcaggatggaaatctttggaaggctggacttcttcccatggcgctggcgccggcaagccatctttgatcggacgatggctgcaggacaggagagactttgtgcgcatgtcgatgctgatcacacactcaatctccctgcatagccgagcccttctctcccaatcaaggtagtaatctcccagcaagaggtaaaggacaccatcctcgtcggccttgaggactgggcactgcggcatggcctgcggcagcctctcgcgcttgtagacctccgactgccagagcaggggcaagggcagctccatgtcttggtctctcgtccatgagcggagatctggcgacagggtccagctccgcagcacgacatcggcagggggcgtgttgtcacgggggttgtcgccactgatggtgacaatggagatgagctttatggagtccccgacagggcccatggtccgacgatccttggggtaactgcgggagaagtcacggccttggcactcctcgggaagatgaatgaagtccagctccacgtggtcaaggtcttccctggtagtggtaccggtggatggcatgtcacagacaatggcgccaagcatgagatcggcccagaaaaccttccctttgaaagtgaaggccgcgtctactttgtccgccggctggcgcggcacctgggtatgcgggctgaagcgcgcctcctgcttcgtccacttcttgccagcggcatggctcgaccaccggaagatgatgcccgacgacccctgcaacactctgtcgcgtgtagcgaaacggaaccccagattgaacagatcgtaggaaccgtcgtcgcgtggcaggacagcaggtggcctcaggaagaagaagggcacagaatcaactctcgacgcgaagtcgtagcccgcgaaggaatccatggtggcggggagcagcgagagcgagttcttggcggcgtcgtagacgagcccgtaccacctgtcgccgaacaccagagtcatgacgaggtagttctccacgacggagtcgaggacgcacccgaagccgcgctcctgcgtctcgatcttggcgcgcacggacaaggtggagagctccggcggctcgacgaggtgcgcgtcgagcgagaactggtccagtatccaggacccattctcgatgttcccccaatctttgctcgccttggccatgatcttgtcctcctgctccttctcctcggcgtcgaagaccgggacgtgcttcctcagcacgacccaggaaaacctcctcggtgaagacatggcggaaggtggccggagatgtggctagggattggcgtggattgagagaggatgcggcggcctctggggccccctcgtgc

SEQ ID NO: 18210 - DNA, 1161 bp, Triticum aestivum
  Clone ID: PAT_TA_18210
accatgtaatgagatataagtatctattaagttggttctaaatcagtcacgtatgtatgctttcaatacttggcgcgctctcgctttttgcgccatgagcgcaacgggtcatctagtattggagtagacgagccatgacgctgtctagcatgagtctcttactatggcaggcacactgatgtgttttattattacagccgtccatccattcacttggacttacattcatagatgcattacacaggcagagcacaacaaagcactggtggctgaagaattgatagatgcagatagtactacgtactactaatgtacgtagttgtttcagattgctgcagcagattcaggtgttggtggcggcgtggggactgctactgtcactgggagtccgttgtgcagccacgcagcgtagcctcctcccacgttcttcacattcatgaatccagctgctagaagatcgatgcaggcaagctcggacctcttgccgctctgacacccgacgagtatgtgttggtctgtgctgaagagcgaggcgacctgctccacgaaccgtgggttcttctcccgggtcccttgtggtgtgacgaagaagtaggggacgttgagggagccgccgatgtggcccttccccatctcctcctccgtcctcacgtccaggtacatcatgccgtcctgctgctccctcgccgccgtctgcacgtccaccgtcgtcacttccaccgccggtgtcgccaccgtcttcgtgtccacggccggcgttgccgccgtctgcacgtccaccgtcgtcacccccacggccggtgccgccgccgtcggcacgtccactgccgtcacccccacgtccggtgccgccgccgtctgcacgtccaccgtcttcacaggggtggccggtgccgccaccgaccatgctcgtgtcgttctcgtggggaggaggcgcgttcgcgcacttgctagcagagctgcaccgtcctgcacgtccaccggcgtcacccccacggctggtgtcgccgccgtttgcacgtccaccgtcttcaccgccgtggccggtgccgactccgacctggtcatctcgttctcgtggggaggaggttccatcgatcaccaacacttgctagcagagctggaacagtccctcaggtgtttcttgtgtgtgtttgtgtg

SEQ ID NO: 18211 - DNA, 2454 bp, Triticum aestivum
  unsure (1)..(2454): unsure at all n locations
  Clone ID: PAT_TA_18211
cggacgcccgggctcccccaggttttttctttttttttttttttttttttttttttttttttacaaacgaaaaatcccgtcgaaaaaataatgaatcggtcggtccattacaatcagtacaaaaaacaactgatctcatctgtttttatctcacaaaagaaggtacaacaacaacaaacaaaaaacgactttctctgccggctatttacactgatgcacaaacagggtaacatttagcagaggatgtgaaacaagaaaaccactcttaactttatatattttaacttacacgggcgcctaattctgtagatgctgtcatttgttcgaccattggaactcgatttccaggttcctattcggaccgctcttgctctccggcagcagggtgtactctccggcgactgaccccagcatgacgacccggtcgatctggatcgtcaccttgccaaacgatttctttccgaatttgctgttgtttttgcaagagatatgaagcttctggcccttgggagggctgtcaaaagcccatgcaaaggcctcgtcccattcaggtgactcaccggtcgagacaatctttgtcagccttgctggattatttccaagagttaagcttgcagaatgcactagcatttcccactgattccctcaggttgttgccacgctttatagtaactgtaagtgtcccaggcaagcactgaagtagcaactctgccttctcttgaaaccgtggtgggccagactgtatcaagtactgaagtagaggaatagcctctgaggcagcaactgattgagctttaaatacttccgctgggcaagccgtccatgcttgtcttagcagatatagtgaatccagtgctgcttcttgagttgcttcagaaccagttttaagggatgttacaagatgcggaatacatattgtagcaggttcagtgactctcagacgagggaaattgctaagtaaagcattaagtgctttaaggtactcctcattagcactcccagatgcccatatatccttctcaattgaagcagttataactctgactgtttcactcgtggcatactcttggatggtgtggttgttgaacagaagtttgacaaacattgctgcctgaacagaagtatcaggattgcttgaactgataaggtccagcaagacctggacgccaccagattctgcaactgctcttttatttgctcggctgtacatgactagattctgcaaggcacaaatggctaccactttcatctcttcggttggctggtcttcaagaagattgaccagagcacggcatgctgcgacggcatcagtagaacgagcaagaccttcattttggaaaagatctccaagagcaagagcagcaagcaatcttccctgttgagactgtgtctgtggatccagaaggtacatggataaaggtgcaatagcatttttagcagccttcgcctcccttattcttatgttgttcagcaatgcctcaatgagtcttgcagcagcttcctcacactgatgactcctcaagagatccagaagagcttctacagcaccactctcagccattgcttctgcacttgttgaatcatcactctccaatacaagcagggcattcagtgcacccacaacggtactttcagtccctgatctgagcaactgcactagtaccgcaacaggaacctcaaggaaaaactcggtactgtactgcaaaatgctagacaggacagctgctgcagattcccatacaacatgaggcaaaggaggatcacccccccgcagcaccttggacaactcaaacacaccaccctcctttgcaattgtatttggccaggctaatgcaagattagcgagagcttttatagctctctgctgtaaatttggcaaacctgatgagagaatttgaatgagggcagggatggattgctctgctactgtatccttctgaaggtgttcttccaggagaagatgagataggagctccgccgccaattgttgcacagctggtggagatgaattcagtaaggtaatgactggctcaattgtttgccggggtgtcaagttgtaatcagctcggcattcaggatgctccaaaatattgacaagaacctgcaaagtgctatactgcccctccggaccagtatctgccttcgatagcagagagaaaagaggctgtactactttggctgcagatgggccttttgctatgctagcattatttgtcaaaatccgaagcatttccgccaatgcagtgcaaagaaaatntggagcatcatgaagaatatcaagaatgctctcaattacaccagctttgaccatttccaatttgcaagccggcctatcttttccaatcttcaccaaagctctggcatctgcctcatgaagcatgaaatttttgccaaacaaaagcccaacaagaggaacgactgccccatgcnntgccactaattcagcgagctgtt

SEQ ID NO: 18212 - DNA, 825 bp, Triticum aestivum
  Clone ID: PAT_TA_18212
aataataacacaatgtgcatgctagtttgctaggcgtcattgcattacattgttggtctgatctgagcactagtatccctccccatccatcgcccacgcgcggcaccagcaaaaacacggccaaagaactgacaagaaaaattgagctttccttcacaactatataaacaccccactagccaccaacgctcaacacaccatgcaacgcacagccacagccacaggcacggcacaagaaaagaaaagacgaccaacacacaaagtaaacgccgtcgttgatcaccaccaccatcagttccggccggccggcgagacagcaaagcaatgcagctcgcggcacaaagccagagcgcgccggcgtccttgaggagcgggacgagcgtgccgttgatgtggcacgccatcaccttctccacgccgcccaggagcctcccgccgacgaacaccacgggcactggcggctgctggtggtggccggcgccgggtccggggggcagcagctgcgccagcgccgcctggatctctcgcccggcgccgcccatctggtccaactcgtagacggtggggccgacccccaggccaagcaggaggcgcttgacgacgtggcacatgcagcagccgctggcgctgaagacgaccaccgcgttgccgctggccatgcgagccacccgctcgtacaccgccgcctcctccgcctccgccatgatgccgccgcccaccacgccctccacctgctgctgcatcctcaacatcttggcgcctccttctccctccccggcctagcctagctagctagtgagagtgtagttaattgtttgttggcgc

SEQ ID NO: 18213 - DNA, 753 bp, Triticum aestivum
  Clone ID: PAT_TA_18213
ttttgcttatgaatattaactattaaggcagtgaaggcgttgaaccaccagaaatggtaacttgttctaactggagtgaacaggggcagtatcacttccatcttctgataacacaggtgcttgctctttagatggaacattaagccaatccctcatggaatcgtacacagtaaaccctagggctgccgaggggacaacctatgcaatctgggtaactacctccatcaatagttgataagcatgacactgaatattcctacttcaacctccaaatagttgataaatggcccagaaaacagttgcttccaaccttgatatttcactagcctagcaagggttccaagaggttgctgccccttgaaaggattggacgatgaaagcgcctgaacctgaatttgctgaataacatgcgccaggggaaacgttaactagtagtctaacaaaccagcaactgacccacaagcaagtttggcttctgacaacatagggacaaccacagctgcctgctctctagatggaacattaagccgatcctacatcgagtcatacacagggttccctatggcgacggagccgtcccccggcataggcctgtcaggccatcctgcctgcagttgcttcccaccctgtcgtggcgcccttcataacccggctcccagggcttcctttcccttcagcggtgggtcacggcacctgggacctgataagccaactttgtgcgaaccagatcaagcggatatgtggatacgactg

SEQ ID NO: 18214 - DNA, 604 bp, Triticum aestivum
  Clone ID: PAT_TA_18214
taggggccttttttttttttttttttatcatgcatgtgagctcggggccttgggagtgcgctgtcgccttcatggcacgtgaggcgcctatcgttttgcaactttgggtcgtgatccatcgatcgatcgacccaccgaaagaaagttcaccacacagggttacatcacacttcccctctcgcacacaccacggcagacagcgagtagggaaagtattggttccttttttttttttttaccatcatatagtatattccattagccattaggtgaagcagaaggtagcagctggaagaactagctacgagaaccgaatcttgtgagggccgttgaggtgcctggcagccgcggccatctgcctggtcgggccgtcgccggcgaccagctcgccgtggccgccgccttcagagccgcagcagaagctcgccagccacgacgccagcgcggccggccaggagaagctctgtgctgatttgtactccatcatcacatgcacctctcccacgatgttgtttagcacttgagttctgaactgggcaaaaactgaagcgaagcttagtttggccgactgttgtggtttggtcacacccccggccggccgcga

SEQ ID NO: 18215 - DNA, 812 bp, Triticum aestivum
  Clone ID: PAT_TA_18215
cgtccgcccacgcgtccgcccacgcgtccggtgcccgcccgctgacgtgacgtacaccgcaccaagaacccgtcggaccctccgccggccacggcgggagcgagtgccacgcgcgcacggcctcacgtgccgcccaccgcccgtgaccccaatccccaaacgagcccacgactatcctctcggtataagtgctcccccaccaccgccaccgtcttcccccccctctccgacccgaaacccccatccgtccgtccgtcccggggagaagaccgccggcggaggagaggagacgcgggcgaggcaagaggagagtcaaatccccatcttgctcccccccccgcgccgccgaccccacccgcggcattctctccggcgtccctcctccggccagggggaaaagcagcagcaggatggtgctgtgggtcttcgggtatgggtccctgatctggaaccccggattcgacttcgacgagagggtcgtgggattcatcaagggctgcaagcgaacgtttaatctcggcacctagagtcgcgcggcgacctcaccgtcctcctcttccacatcgtcctcggctgcaagttcatcgcctctcaacgacaccggcaaagccaagctcaacggcctctcagttcagagcaacgtccaggcaagccgttcgtcctgtttcctctcttcatcacagttgctcttccgtgagaatggtgctatgatgatgattgcctatgtgctttggtgtgggttcatcgggtggaggagcagaagaagctagacgtgccctccgatgaggtgttggtcaatgcccctgtcagca

SEQ ID NO: 18216 - DNA, 1010 bp, Triticum aestivum
  unsure (1)..(1010): unsure at all n locations
  Clone ID: PAT_TA_18216
cccggngtcgacccacgccgtccgcccacgcgtcgggccacgcggcggcgtcccgaaacccccatcccgtccgtccgggggagaagaccgccggcggaggagaggagacgcgggcgaggcaagaggagcgtcaaatccccatcttgctcctcctcccgcgccgccgacccacccgcggcattctctccggcgcccctcctccggccagcaggatggtgctgtgggtattcgggtatgggtccctgatctggaaccccggattcgacttcgacgacaagatcctgggattcatcaagggctacaagcgaacgttcaatctcgcttgcattgaccatagaggcacaccacagcatccggccaggacctgcacccttgaatccgaagatggagccatatgctggggaattgcttattgtgtcaaaggtggtctagaaaaagaacgagaagcaatgcagtacttggagagaagagaatgcgagtatgaccagaagatctctgtggatttctacaaggatggaaattctctggaaccagctgtgacggatgtattagttttcgtatccactcctgatccagttggcaacaaatattatcttggccctgctgctttggaggatatggcaaggcaaattgctacagccagtggccctaatggatataatagggactacctattctcaatggagaaggcactgtccaatataagccatgaagacgacacgatcattgagcttgcggatgaggtgaggaaggtgctgagcaggtcgacggagaagaaggttaccggctccgacataccattaaaatcgcatacacctgttgtgcacatctctgctcttcctgagggcaccgttgcggtttcaacatagtaagaagagcagcacggctggatcagcgaaagagatggcattttcctctgaccacactcactcttgacattntaccattgaaagatntgtggtttaatttagntntggcaccattgagggtgtgcgctaattttttttggc

SEQ ID NO: 18217 - DNA, 1765 bp, Triticum aestivum
  Clone ID: PAT_TA_18217
tggacgagttgggcctatgccgaacccccatgccgtccgtccgtcccgggggaggacgaccgccggcggaggagacgagacgcgggggaaaaaagccagcaggctcccccccgtcgcgccgctcaccccagcagcggcgtcctcacccgcgtccttcctcctgctcccgcgccaccgacccagccggaagcagccgttcctccgccggtttgcgcccctggtatccacgaccggatcctccatcgcggaggaggaagccggcctgcgggagaggcgcgcgtgaggcaagaggggttaaatcctcacgtcgagcctcggggcccaccaccggagctgcccacgaccgcccccgtccggtcacgataaacaagcaacagaaagaggaggctgttggtcgtggagtaggtgtcctggatcaggaagcccgggacaatgacttggacgagaagatccagtgaatcatagagggccacaagaaaacctctaaggtctcttgcaattgatcaaagaggtcacaacaccagtgtccaagccgtgaccgtggattcttgtaatccatcccatgaagaccgtatggctgaggtgaattatttgatcgtttgcttttggggggattagaaaaagaatggcaagaaatactgtgcttggagaggagagtatgcgggtctacctgtaagaactgtgtggattccttcacgtatagaaattctctggaaccagttgtgacgtatttcttagtgatcgtatgaactcctgatccagttggcaacaaataatatcttggccctgctgctttccagcatatggcaaaacagactgctacagccagtgcccctaatggatataatccgggactggctgttctcaatggagaaggcactgtccaatgtaagccatgaagaggactcgatcattgtgcttgcaggatgacgcgaggaaggtgctgagcaggacgtccgagaagtaggtcaccggctccgacattccattaaaatcgcatacacctgttgtgcacatctctgctcttcctgagggcaccgttgcggtttcaacatagtaagaagagcggcacggctggatcagcgaaagagatggcattttcctctgaccacacacactctatgacattctcccattgaaagatctgcggtttacttcagctctggcaccattgagggtgtgcgctaattttctttggcaactattgtggcaaaggctgtagcttccagagtgctaatgcgaaagcctgagacttgaagtgttattgcttcccttgtgataccctaataataaatgcatttggcgacttcagcacttctgcgccgctgaggtgtgatgctttgcttcacaaacttgatatggttgaggcaattttacttctgttgtttctgatgaaatgtgtggctcatcagagctattccacaattttgtccccacttgtacctttttgcactttatatctgtagcttctttcaattttttaagacattgtttttcgttttttaagtcttcacgtgtgcaaaattacttctgtggtgagccgacatctggttagcttgacgagtacttcctgacggctgatgtcctggagaactatggacttatgtagaagaaaaaaactagagtatcttcgggctatatccctgtttgatctataaatgttcggcaaaatcacttttcttatcaaaacatgtggacatttgcttataagatcacagttttagtactctccttgagggtgatttaaaaaaaaaaaaaaaaaaaa

SEQ ID NO: 18218 - DNA, 576 bp, Triticum aestivum
  Clone ID: PAT_TA_18218
gtcgtcaagaattctcgcatgctactgctacgtgttattcatcaccaacaaactgaagagactaagactctgccaataacaataccgtgatacagaatgaagccaaaatccagatgcaaaattaactagcacaacgagcccatacaaatctccacccggacagcacaaatactacaatagaaataaccatgatcaactatgagcagctctgagtgagtagatcatcgtgggatttcctggtgttggcagtaggaacttgtgatcagaagcacatgtcgagcaggcagcagcagcaaatagcagcacaacatcctttccagaagccgtcgcctccgcggtcctgcgagtcctgcggcggggcttgctgctggtagttagcggcgacaggcggcggcgcgccgtaccctggaggcgggtaggcctcctggcccggcggcgggtacgcggtgcccggtggcgggtagctcatggtcgacgccgcggtcgatttcacagagacaatagaactactgaagcagggctggtgatgctacgaggcgctctctgctctcgactgtagatcgagtaccggccggc

SEQ ID NO: 18219 - DNA, 642 bp, Triticum aestivum
  Clone ID: PAT_TA_18219
gacctcacaaaaacactttaatcaactagaacagacaaacaaaatcgtcggtaagtcgtcaagaattctcgcatgctactgctacgtgttattcatcaccaacaaactgaagagactaagactctgccaataacaataccgtgatacagaatgaagccaaaacccagatgcaaaattaactagtacaacgccatacaaatctccacccgaacagcacaaatactacaatagaaataaccatgatcaactatgagcagctctgagtgagtagatcatcgtcggattgcctggtgttggcagtaggaacttgtgatcagaagcacatgtcgagcagacagcagcagcaaatagcagcacaacatcctttccagaagccgtcgccgccgcggtcctgcgagtcctgcggcggggcctgctgctggtagttagcggcgacaggcggcggcgcgccgtaccctggaggcgggtaggcctcctggcccggcggcgggtacgcggtgcccggtggcgggtagctcatggtcgacgccgcggtcgagttcacagagacagcagaacaactgaagcaggaacctggcaaggaatacttgctgatgctacgaggcgctctctgctctcgactctgtatccgtaacggccggc

SEQ ID NO: 18220 - DNA, 573 bp, Triticum aestivum
  Clone ID: PAT_TA_18220
cgtccgcgacgtacgaggcggtcaggacgaacaagatactaaaagtacaaaagggacaagggccttgatggcaaggcctgcaagctcgccgcccatacgctgtcctcgtcctcgtcgcccgccaaggatctgttccacgcggtccagacgtccggcgttctcggatgcagcgtcgatgccggcgtttacgatgacgtcgcgtcgaggcttaaggctgtgatcaaggacaccaattcgctgctggagttctactattctgtcagagggctgctcagcctgaaggaacaaggccacagtgttgttttatctgatgcggatagcacatttcacgcaattaaggcacttagccaaagtgatggaagatggcgctatgacaccaacagtgctgaatccagcacatttgctgctggtatagcactagaagcattggcaggagttgtttcactgtctgatgcggaggttgatccgtctatgataggagtcgttaaaaatgacatcgtgaagctatttggcacaatcaagagctatgatgatggaaccttctattttgatgagaagtatgttgatgggtct

SEQ ID NO: 18221 - DNA, 1034 bp, Triticum aestivum
  Clone ID: PAT_TA_18221
cgttgagcaagacgtagctgtgttggcacaagcatatgccataatcgagttgcaccgcaaggcacagatccatcaagatgattcatagacacgtgaacaccaaaactattttaagttgtaataacaagggggaaaacaagctggtgtcaacagaatctattccaagcaacgttcggctcacatctagaacaagtcatcagtacaatagggatttcactggaccatcgcatcaaagctcccagctgcgagaatgtcgaggagagagttttggggctccatctcttcatgccagagtggcagtttgtcaccagggtggaagctcctcttaacacccgcctcgttaatagtaacagtgcgaacaacccctccactagcaccatcacgagcaatagcaagggaaaccaccttcaccacaaacttctcagcttcttcctgggtcataccctctttccattcatgatccatcaatccatacaggtaactggaaccagatcctccaattgcgaatggttgcctcagaatcgttccaccaagaggaaccgagtaaatttggcctccctcgtatttatcccatccaccaactatcattccagcttgtaacatgctcttgttctgataggccagcaacctaaccaagttggatgcgactttcacggtagctggttgcccaagctgaattgtgtgttggtggagaaaatagcgcacataatctgaaataacttgtgtatcagcagcagatccagaacggcagacatagacattatcagtgagctgactaatcttgtccgaagcacggtttgccacatacattccggtgctggtcctggagtcggcggcgaggacgacgccgccggcgtagcagaccccgacgatggtggtgcccatgcggtgctccccgtcggtgggcgcgtcggcggaggaggggcccatgagcgaggaggcggcgtccatggcggcggagaccctagagagcggcttccgcggcgagcgagcgagcgagatttggagcggcgttgtttgtgcggacgcgtggg

SEQ ID NO: 18222 - DNA, 1795 bp, Triticum aestivum
  Clone ID: PAT_TA_18222
ctaaaaaatttagcaatcgacgcactactccgagagagttgtgttgcacaggaggacacggatccatcaaacaaggaacatgtactattccatgagtctgctcttttttctcgaacaaggaatgtacagtgctattaattcgtaataacaagggaggaaaataagctggtgtggaacaattcgggcacaatttacttaacaacatttagtctcaaattcagaacaagtcatcatcagacacaatacgaagaaccagtagaaagcttggcttactggaccatggcatcagagctcccggccgcgagaatgtcgaggagcgagttctggggctccatctcctcatgccacaggggcaagttgtcgccaggatggaaactcctcttcacgccctccccatttatagtaagggtgcgatcaacccctccactagcaccatcacgtgcaatagcaagggaaaccaccttcacctccaattttctcaagcttttttcatggtcatcccccgtttcccatcttcatcccgtcaatcaccctgattccctggatcatgcaccctcccatacagatcgttggctacgaaatcgttcaactaagagtgccgtactcaaaattggccctctaagatggcaagacctaacatgcactcacttcccatagtgcaatccaccaaatgtcttgataggttaggacagccactaaaatctgatagatcaatcactttaacacgttggatagccctaatactgtgtccgtggaagttgatgacaatcatgtgctggaggttaaatgaaggttcctaatccgggatagctcgtaagtcattaagagattcagttctgtagcagttgatgttggtagacaactgtttatacctgttaggaggaggctttggctcgtggattccgggcatggtcgtgctctagaaggcgatccaacccaccctttggtttcagccgccgatctttcgtggtgtgggtgcagttctccctgggggggatggcgacggcgatggaggggaaatataatggaggtcagcgtccatggtgggcatcggattctagggggccgcgtaagaggatatcgatcaagtgcgatgcgtggcggtcctgggcaatggttgcttcctggctctcatgtcgctttcattagagcagagactacaaacttctcagcttcttcctgggtcatcccctctttccattcatgatccatcaatccatacagatagctggaaccagatcctccaattgcgaatggttgcctcagaatcgttccaccaagagggactgagtaaatttggcctccctcatacttatcccatccaccaactatcattccagcttgtaacatgctcttgttctgataggccagcaacctaaccaagttggatgcaactttcacggtagctggttgcccaagctgaattgtgtgttggtggagaaaatagcgcacataatctgaaataatttgtgtatcagcagcagatccagagcggcagacatagacattatcagtgagctgactaatcttgtccgaagcacggtttgccacatacattccggtgctggtcctggagtcggcggcgaggacgacgccgccggcgtagcagaccccgacgatggtggtgcccatccggtgctcgccgtcggtgggcgcgtcggcggaggaggggccgcccatgagcgaggaggcggcgtccatcggcggagagcggcgggcgagcgggcgagatgcggagcggcggcctcaagaaacggacgcgtgggcgtgcgtgctgtctgcggctttggcccga

SEQ ID NO: 18223 - DNA, 1363 bp, Triticum aestivum
  Clone ID: PAT_TA_18223
cccacgcgtccgcgtccgcgtccgcggacgcgtgggaaggaacttcagtttgacctcgacaacaatgttcattacttggacattactccattgaaaatagatgttgggaagtactcgctagtttttgagattactcttcaggattcagaacatgaaaccgtttacactactggagggagaaacactgagtctgtcgttgttacaggactgatcaaagttgacaaggcagaaattggaatttctgagaatgatgctgggagtgcggagtctgtcgaaaagttagatctgctgaaagatacaaaagtttctctctctgcgaaccatctgcagaagttacgtctatcttttcaactatctacaccacttggacgcacatttaaacctcaccaggttttcttgaagttaaagcatgaaagcaaggttgaacacttatttgtggtgccaggttctgcgaggcaattcaaaattgttctagattttcttggattggtagagaaattttactacctttcgggaacatatgacctcgagctttcagttggtgatgcttcaatggaaaattcgttcctacgagcccttggccaattggagttggacttgccggaggccccagaaaaggccccacgtcctccggcacaagctgttgacccgttagcaaagtttaggccacagaaggagatagaacacatattccgtgtgccagagaagaggccaccgcaggaagtctcccttgcatttactggcctcacgctcctccctttcattgggttcttgattgggcttatgcgtctgggagtcaacttgaagaacttcccttccctgccaggaccagctgcattcgcatcactcttccatgccggaatcggagcagtactgttgctctatgttctcttctgggttaagctggatcttttcacaactctgaagtacctcagcttcctcggcgtgttccttgtgttcgtcggccataggaccctttctcatctttccaacacggcagcaaaacagaagactgcttgatgggaagatgcgaagaatgcgtgatcatcaattttcgggcagtggcagttgcttgggttctgcaaatgcttttgcttgagatcctgaccgagttcttgcgcaacttgagttttgagggacaactgggtgtcattttgtagtgggtgccaagaatcctggtactagagaagtggtaggacctcaccttcatgttttatgcaccgatgtttactgaagtggtaggacctcaccttcatgtatgatgcattgatgtttactaaataggctggatttgttaaacatagaattaataagatcatattcttactcaaaaagttaaaaaaaaaaaaaaaaaaaaaaaaaa

SEQ ID NO: 18224 - DNA, 968 bp, Triticum aestivum
  Clone ID: PAT_TA_18224
ccctgtcgacccagcgtccccagatctcaagctctcaactcacctcacctcgcatctcaaacagtcttctcttttcggttggcataattgctagaagcagggttctatccatggcaatggtggtgaaggccctcctcgttgccgtcgtggccgtggcagcgcttgcgcagctcaccgtggcagtggatcaccaggtgggcggcagcggcgcgacctgggccaccagcggcggctacgactcgtggtcggggaagcagaagttctctccgggagacagcctcgtattttcgtactcgccggcgcacgacgtcgtggaggtgagcaaggccgactacgacgcctgcacggccagcaaagtcgtcgccagatacaccggcggcaagaccaccgtcaagctcaccactgccggaaagcgctacttcatctgcagcatcaccggccactgcgacgccggcatgaagctccaggtgaacgtcgccgccgcaaccgccgcccccaccaagcccaggggccagaggagcgtcgcccctgtcgccgccccggcgccggcaccggaggggtcggccaccgacgagcagctaccgacagtgtcgtcgcccacgggaacaccgacgcccagttcgccgtccggctcgggcgccgctagcatcggtgcgagcgctgcggtggcgctcgccatgggcatggctgtggcgttggccaccgatccatgggtaccaaggcttaatcatgtcggtacatttgcggatttgttcttgttattcttggctggcagtggcatgcacattgccttccctgcatgttccttccttcctacagtgctgatagggttcagtgtactactgtgccatttatttgttgtatttgtctgtcggagaataaatacaattcacattcgcgtttagtggtggtttgccgcccggccggtgattcatcacatctcacattcctggggggccgtaccaatc

SEQ ID NO: 18225 - DNA, 593 bp, Triticum aestivum
  Clone ID: PAT_TA_18225
gccggccggtgccgggctacatcaaaaccatccatgcatctatccatctccaagctagaggaggcaatccatcagtgtgcgctgtaaacatctgggttgtcgggtttggcaacatactgatctagatggcattcccggtctcggacgagctactgggcacgttcgtgcccatcgcggtgtactggctctactcggggctgtacatcgtgctggacgcgctggggacggccgaccgctaccgcctccaccccaaggaggacgaggagaccaggaacataccctccaagcgcaccgtcctcaagggcgtcctcctccagcaggccgtccaggtcgccgtctcgctcatcgtcttcaagatcaccggcgatgggagccgcgacacgagggagcagcctccggcgccggtgatagcgctgcagttcgtcgtggcaatgttcgccatggacacgtggcagtacttcgtgcacaggtacctccacaccaacaagttcctctacaagcacgtccacgcgcagcaccacaccatcctggtgccctacgcgttcggggcgctctacagccacccgctggagggcctgctcatggacaccgct

SEQ ID NO: 18226 - DNA, 3768 bp, Triticum aestivum
  unsure (1)..(3768): unsure at all n locations
  Clone ID: PAT_TA_18226
actcagattagaaatgctgagagagccttacctggtaaaaatgaagatacctcaaatgagcagccaagtgcatcttcccctgtacggtacaacggcaaatatagcagaggaactgtgttatttgcagaacatagcacggataccactccgccacaggagccactgaagttttctgcaaggtcttccacagatgaatttgttaaagcaagcacgctgttccctgaacttggttcagatcaaactctgcttcaagagtgtccgaagaagttatcctcagagtgccccagcaaccagtacgttcaagctaattcagtgtttgaagcatttgatgtacaaactccgtcccaggatccgttaaagagaatcttttctgggccttttcatggagcagatacacctttaccagagtatcgttcatatccaattcctttgcagcatccatcgaaaaatttgtcatcgggctcttctagtggtgaataccttagagcagtgacaccgcttggacttgattcgaatgatactcccacagcaaaacactcaaagaagctattctctgggtcttcagaccattcatacattaaagcaactaatttgtttccggaatttgattcaaatggaactccgctgcagaaccactcgaataagttctcagtatctatgaatggtaagcatattggagcagctgctacactgtttccagaacttgattctgttcttctgaaaccagaaactccagtgacacgagcagtggctcctcgcgggaagagagttcaacaggatcaacgcatgactgccaataacagccagtctcctttgtggggttcaaataagaaggtgaaatcagctcattgttctccacctgggaaaatggttcatgatgaaatggctgaaagtgcacgtagtaaatttgaatggctgaatcctttgaatatcagggatgcaaataaaaggcggccagatgacccactttatgacaagagaactctttttattccacctgatgcactgagaaagatgtcaacatctcaaaagcaatactggtctattaagtgcaaatatatggatgttctcctcttcttcaaagtggggaaattttatgagctctatgaagtagatgctgagatcggccaaaaggaacttgattggaaaatgactattagtggggttggaaaatgccgacaggttggtatttcagagagtgggattgacgatgctgttgaaaagcttttagctcggggatataaagttggaaggatagaacaaatggaatctgcagcacaggcgaaatctagaggaccaaattcagttatcgaaagaaagttagctcatgtatccacaccgtcaactgcagctgacagcaatatagggcctgatgctgttcatcttcttgcattgaaagaggttactctagcttctaatggttctcggctctacggatttgcttttctagattatgctgcacttaaaatctgggttggttcacttcaagatgatgattcgtctgcagctttgggggctttgctggtgcaggtttccccgagggagataatctatgaatcctcaggcctctcaagagaaagtcgtaaatcaatgataaaatatgcctcagcaggctctgtgaaaatgcaactgaccccactacctgggacagatttctctgatgcctcacaaattcaaatgctagtacattctaaaggatactttaaagcatcaacagattcttggttatctgcattggattattcagtgaatcgagatgcagttatctttgcacttggtggacttattggtcatttgactagacttatgctagacgatgctctaaaaaatggggaagtcttaccttacaatgtgtaccaaacttgtttaaggatggatggtcagactcttgtgaacctggagattttcggcaataactttgatggtggctcatcaggtactctgtacaagcacctcaatcactgcataaccgcatctggtaagcggcttttaagaagatggatatgccatccactaaaagatgtcgatgctataaatagaaggcttgatgttgttgagggtttcatccagcattgtggggtaggctctattacactttattatctccggaaaattcctgaccttgagaggttacttgggcgaatcagatctactgttgggctaacatctgctgtcctgttgccttttgttggtgaaaagatattaaagaggcggattaaaacgtttggcatgcttatcaagggcctccgggttgcaattgacttattaagtgccttgcatagagaggaccatggcatcccagcgctgtcaaaatcagttgatattccaaccctgagttctcttgatgaattagtccatcagtttgaagaggatatacacattgactttgaacagtaccaggatcatgatatcaaagacggtgatgctaccaccttggctaatttagtggaactttttgttggaaaagctaccgaatggtctttggtaatcaatgccatcagcactgttgatgtccttaggtcctttgcagcaatggcattgtcatcatttggcaccatgtgcagaccatgtattctgttgaaagacaaatcgcctatacttcggatgaagggtctatggcatccatatgcttttgcagaaagtggaactgggcttgtaccaaacgatttgtctcttggccaggatttatcgggtcataatcgctttgcattgttgttgactggtccaaatatgggaggaaaatctacaataatgcgcgctacctgcttggctatcgtgcttgcccagcttggctgttatgtcccctgcatatcatgtgaattgacccttgcagactccatctttacacggctaggcgcaacggatcggattatgtctggagaaagtacttttcttgtcgaatgtagtgagactgcatctgttcttcagaatgcaactgaggattctcttgtcttgcttgatgaacttggcagaggaactagcacatttgatggatacgcgattgcatatgcagtattccgccacctggtggaacaggtgcgatgccgtctgctctttgccacccactaccaccctctcaccaaggagttcgcctcccacccccacgtgagcctccagcacatggcctgcatgctgaggccaaggagcggcggcaacggcgagatggagctcaccttcctctaccgtcttgtgtcaggcgcctctccggagagctacggcctgcaggtcgccacgatggcggggatcccaaagtccatagtggagaaggcggcggtcgcgggcgagatgatgaagtcgaggatcgcagggaacttcaggtcgagcgaagggcgagcggagttctccaccctccacgaggactggctgcagacgatcctggcgatcggcggcgtcaaggacgcgcacctggacgaggacaccatggacacgatgttctgcgtcgcccaggagctcaagtctcatttcaggaaaggaggaagctgagcgctgagaagtcgccaccggtaattatgcgtggcaccattagatgcaggtagtctgaaggaggaagatgagcnccgagaaagtcgccgctcaccattaatcatcagtgttttaatccgtcccagtcgacggctttgtatatagttacctcgcgtttgtaatcacgcaagcgcacctgggcctgagttcatctgaactgtcaaaaacttcatctcgtagtttgtaatcacatgcacattcctagtgattagtcgagagtttcaaaaaaaaaaaaaaaaaaaaaaa

SEQ ID NO: 18227 - DNA, 1451 bp, Triticum aestivum
  Clone ID: PAT_TA_18227
gcggggaggccttcggctaggctaacattggctgctaaggcggctaaatacacaagacagagggaagcaagtacttgacggtagctagcagtgccactagctagctcatccatggatatgtgcccggttggcggctgcgaccgccgggaaccacgtcgtttgtgcgcggtgaccggtgggcggggattcatggcgagtcacctggtgacggcgctgctcggctcgggagattggtctgtgcggatcaccgaccttggcccccaggctgccctgtctcctgccgagagtgatggactcctgggcgctgccctccgcgatggccgcgccgcctacgtctctgtcgacgtctgcgaattagcccagcttacaaaagctttggaaggggtagatactgttttccacactgctgcggcggatcataccaacaacaacttccaacttcattacaaggttaatgtcgagggtacgaggaatgtcatcgaggcttgtaacacatgcaaggttaaaacactcatatatactagttccagtggagttgtattcgatggagttcatggcctctttggcgtagacgaatctacaccgtatccagataagtttcccgacgcatacacagagacaaaggcagaagcagaaaagatggtgataaagtccaacggaagaaatgagcttgtcacttgctgtatacgtcctggcagcatttttggtcctggagacacgatagtgccaattttagtatcttatggaggaatgatgatcattgttggtgatggcaagaattgtgatgattttgtatatgttgagaatgtagcgcatggtcatgtatgtgctgaaaaaactctttctaccatagacggtgcaaagagaagtggaggcaaagcctattttataacaaatatggagcctgtaaatatgtgggactttgtttatatgattttggaagaacttggatacaaaagccgattcagattaagaataccttcgtattttctcaagccaataacatatctggtagattggagctaccataatatattctctcactatggaatgcgtcaacctggcatgctaacttccgcaagcattaagtatgcaacgctgaatagaacgttcaactgcaacaatgctgctcaacaacttggttacaaaccaatagtgtcactcaaggagggagtaaagatgactactgatttctacaggcgattaagagcatgagatatgcacatttttattttagaagaaagagggtgcacaattaagaaacatcaactgtctacaccaagcaatgtctagatatctatcattctattagtggttgaaacgtggtggcgatcttggaccataataagattcacaatctattgcacatattaccatgaatagtgtgccaagaaaagaacacatacatgtaatagttgaaattaattactttgatgtgtggttaatgcttt

SEQ ID NO: 18228 - DNA, 3111 bp, Triticum aestivum
  unsure (1)..(3111): unsure at all n locations
  Clone ID: PAT_TA_18228
ccacgcgtccgaatcaataatgcaaacgccctggcaaaggctcctccgtcagaagccattgatttgaatgcctcgcaggggcaacaacaagattcttctgtccaaaatgcaacaaaggtggtcgacaagcagactgtgccatcaaccatggatttgctaacagttctatctggtgctcttgggacatcaacccccgagaccaatacatctcagtcccaggggagcagtgatagcagtggtaataacaagagcaagagtcattcaacagagccagcatgtgttgtaaattcccatgagaaatccattcgaccttttcccgcagctggtatgttaaggagtagcagcacccatggaagtccacctgaagtatataagcagccagaccgagatacccatccgtacttgtcgctgcaattgtttggtaacaatgaggacattcctgtgaaaatggacactgcaaataagtacttgtcttccgagagcagtgagcctatggacgagaggtctccttcatcctctccacctgtaacacacacatttttccccactcgttcagtaaatgaaggcatcaggcatcctcgtattgctgactatggagaagatggtgcaactgttgagaacagtaccactcgggcatggtgcgcgccaccgcttgagctttttacggtttcccttcccccttcccatgatgctccgcccatggacatggatgatgaattgtaatatttgcctggataaaaccttgccggaagtaagtgttgatatgtggggataatcagcagccagcttctaagggcagagactcaagaaaaggggaattggagaaccctgcccaaaaggtaaaacttgggcagggttggcacatagtagttttgtgacgagggaggaaggtacaagagcttgtcaatgtcaagagcaataagacagaggcaacaatagttctgtgcttaatcagtaagtaaccttgatttcttttttgctgggtgtaagtgtgaatctgctgtttcatgtatcataagatggtatttatttatcttggtctctgttcttactaccagttggtgtcgtacaaagatggaatgacccgcctctcaaaatcatggagaacatggaatacccctgagttgacccttgtgacaccaattgctgttgttggtgggagaaagacctctctcgttcttaagccccgtcttctggcgttcccgggcaccctgacccactgcaccagcgcggggaaagtatatatcgaaagaggtactatgttcagcgtatccgggtaccatatatgatgattcaaggagtcngagacctttgacttaccgggaagaaccaagtcttactcttggccgttgctttattgaggtttngagaacaggtccagaggaaacagcttccctgttatttttgcgaataaaagcatctgtccaggagtttaagaaacctggaagatgaacttgaagatccccggtttcctgaatgtctctccagatgatcaggtccatgatgctaggccgctaaagccaagggatcaagttctgcattttcctaatgaacttggctggccctttcaggcgcccgcgccatcctcaccttccaccttccctgatgtttctgattcagagttgattcagttctctactgcacggttcagacaccttctgttgttttcaaatgagcgggactggtgctccctcactaaaacactactcgaaattctttccaagagaagtatggttagtgaggagctatcacatgagactctggagatgctctccgagattcatcttctgaacagggcagtgaaaaggaagagtagccacatggtgcatttgcttgtgcattttgttgtaatttgccctgacaattccaaactgtaccctttccttccaaattatcccggccctggtggtttgactccattacatctagctgcatccattgatgatgcagaggatatagttgatgcgttgacagatgatcctcaacagattggtttgagctgctggcactccgtgctagacgatgaagggctatctcctgagctgtatgctaagttcaggaacaacggctcatacaatgaacttgtcacacgaaagcttgtggacaggaagaatagccaggttaccattgtgctcaacaaaggtgaaattcatatggatcaaccagggaatgttggtgcgaataatgcatctgggatccaagcattggaaataagatcctgcaaccagtgcgccattttggagtctggcttactaagacgccctatgcgttctcgaggattgcttgctcgcccctacatccattcaatgcttgccatagcagcagtgtgtgtctgtgtctgtgtattcatgcgagctttgctgcggtttaattctggtaggtccttcaagtgggagaggttggatttcggtcctacatagacattggaggataccttattacttagccgtgtgatgttattaaggaactaccttacaagaaccagaaggtgtggaaccagatcgcttttaactgctccactttccatggaactctgtccatggttatggatggtgaaatgtaatatttgcatggataaaaccttgccggaaagaagtgttgatatgtggcgataatcagcagccagcttctaaggggagattgagaatcaagaaaaaggggattggagaaccctgccaaaagataaacttgggcagggttggcacatagtagttttgtgatgagggaggaaggtaccaagagctggtcaatgtcaagagcaataagacagaggcaacaatagttctgtggttaatcagtaagtaacccatgatttctttttgctggtgtaagtgtgaatctgctgtttcatgtatcataagatggtatttatttatcttggtctttgttcttactaaatcttttttgtgtatcaaatacagtcctactgttttctcttgtgttttagacggtagcagggggaagtataaatggtcgatagtgtcagtagctaaataggaatgaggcagatttacatgtgtatccggatctattggtttattcgattaccatcacaactctggagttctcatcctgttttgatagaaagcctggagtatctatctttctttt

SEQ ID NO: 18229 - DNA, 511 bp, Triticum aestivum
  Clone ID: PAT_TA_18229
cattcctctcaggccgcgcccaaccagagagtgaggcggaggccgaccgccgtaggtcgccgcgatgctcgccggcgtgaagcaacaggccggcgtgctccgggtccgcgcgagcggcttcagctgccgttgtggttggaggctgagggccgcggcagcctccaccgctccacggacacgcctccatccgcgcgatcctcgccgtcgccgaggtcgccgccatccgaggcttccgtccccgagctgaccatactcgacgccgacggagtccgccctcgccgagctgcgtctcctccgccgcacaccttcgcgtccgtcgcgacggcgcggccatttttaggcgatagcatcgcccctcgcctcggcgcccacctcggtcgcgtcttctccgagcacggtgtccatgggcgacgggaccctcctcctcgtattatatggcttatcggacgccggggaactcgtgcgctgcgcgttcacccggagacgactgtgccatcctgcgtgggggggc

SEQ ID NO: 18230 - DNA, 747 bp, Triticum aestivum
  unsure (1)..(747): unsure at all n locations
  Clone ID: PAT_TA_18230
aagttgaacttgctgcagattcttctcatgctccgtctgtgcagaccatgctcggcacatccacagataaagttaaagtccatgccacatcattagtgagaatttctggtgctccaatctgccagatcatttctcgtgccttgaaagttcatgccaaaaaccctgggatattgtcaccgacaaatgcaggcacaaagcgtttaatacaagcaggttgtcatgctcggaatcaaatgggtggactgcgaactgttgaggatgatatttatccaaaaaagcaacggacggacggggcatttgatgaagcaagttcggttccggcgtttggaggcagagtgtccaccgacaccagcacactggtgaacttccggccgaagctgaggcccgtctgctccatgtgaagacagagatggttgatgggctaccgcacccaccggtgctgttgcagctagcatttggttgtttgggtcctgcggctgctcctatactgctacttagtgcttgcgccctgattgtctcctgcttgcttgcaactttgcaagtctcctagaactcataatgttatgttatgctatgatgcgagtactatatgtagtcgtggcgctcttgttaattagagctatatggtgatgctagtatgttagatgtcatgtgttttaatggaacacctgcatggtcttgggtattttttttggtgcgtacaagatgctaatnatctagctcttccaagcaaaatcngaaaagcaa

SEQ ID NO: 18231 - DNA, 1286 bp, Triticum aestivum
  Clone ID: PAT_TA_18231
catcagcttaataagctgcaccttggtctgttccacggcggcggttttaaccggcttgacgctctaaccccgtcttcccggatatctaagggctttgtgctcagcagcgcaccagcccatgacagcgtctcttgcttgttgacaatcggtacaccacagagcacagaagactctgttgacagaaagacaccacatataatgtcgtctgctctccccctgccttccgggcagccgggcacgcccagtggggcttgccagtcactctcctccagcttaataagctgcaccttggtttgttccacggcggcggttttaaccggctcgacgctctaaccccgtcttcccggatacctaagggctttgtgctcagctccgcacccgcccgcgcctgcgtcgcttgctggtcgccgctcggtactcctggaagcggaggaagttgttcgcaccgtcgaattctccgtcttcgggtctttggaagggtcgttcttccgtctcgccggctggcttcgcgtcgagaaaggagaaatctcaagccagctccgtcaccgtgacgcggctggtgctgtcatgcacactggtggattaccgttcagcgacttcatggttcatcaatctgcattggattctcatcgcagggtcatgaggcttctgacctaggattggaagctgggcactgcaaaggtatttatggaatcggaggatgttggtcgcaccatcgacttgtctgtctttggctcataggacgagttgtatggccgtctggctgacatgtttgggatcgagaaggaagaaatcataagccatcttcgtgtccgcgtcactgctggcgccgtcatgcacactggaggattaccactcagtgacttcatgaaagtggcacggaggctgacgataataagcggcgaaaagggagggctggcgaaacctctcatcgaatgcatggttcggccggtgggcttccgtgacgtgcacggatttgatttcctttgaaatatatttaaccttgggtctagggctactctccatatgcatgcgttttattagcggtttgtttacccgtgctgtcaagcggaactgcgtcatcgttagtactacaatcttgtggattgctttttaatatgtactcactgtatttgtctgttagctgcttgttcagcgctgttgatcgcccaagttaagggctggtcatccggcggctgagttggaagtgtgcttctcaacgaactctgggacggtttcgcgcggctgggttggaagtgcttatcaacgaactcttggacggattt

SEQ ID NO: 18232 - DNA, 1138 bp, Triticum aestivum
  unsure (1)..(1138): unsure at all n locations
  Clone ID: PAT_TA_18232
caagccgagggtgccacggttgctggatgaacaatttgatctgcttgctttggaagaatatggagctagtgatgatgatgatggagctgttagagatggggaacatgaactcccaactgaggttatagatgaattgaagctgttccacaatcaaaatgtatgcgttgatgaagaatatagaacaccagcagattttgttcgtggaaaacttgactcaaccaccgctgaggaggtggatgaatctgctaatgtgatccaaaagtgtgctgaatatgctgaaaggtatttaaatgaaactgcagaagatgaagatgtcttgcttgtttcggaaagcagtgatgaatctgaagtttgggactgtgagaccattgtttccacgtactctaacttggacaatcaccctggcaaaattcaaactccaggaaatcctaaaaatcgtcttcccaaagttttccctggggaaacagctacaacgaaagatatcatcaagcttcatggtaaagagaaacttcctgtagattacctgccacagaggaaaagaaaagttgaaaaggagaagaaagcaaagcccacagaagcttcagatgctgaatattattttgaaaaggttgtagttcagaaggaaacaaaagatgaaaagaaagctagaaagtccgcggtaaaagaagagaagagagaagcccggaaagcaaagaaagagctcaaagaactgtataaatttgaaacacagaaggctcagaaagttgctgctgttacaggaccatcttccatacggctaatataattgtcctgtgtcatatgtaacgtgtttcctacatctgctgaactgttgaagccttgaagacagtagtccagagcaagataggcatgtcatatgtaactgctggtanntacatttcatgccttgcttaaggttgtcccattnnctggactggaggcagtgaatgattctgcttggcattacctttttactgctgaatgtatgagttttgtgttaccttaatgagcacaccaagtgaatcaaatgggcgaatagttttgtatgcctacgcagaaattcgcaggatccaaatacctcccgaaatcctctctccaaaacagagattacaaagatttatcaattccaggtgttcgaacc

SEQ ID NO: 18233 - DNA, 2162 bp, Triticum aestivum
  Clone ID: PAT_TA_18233
gccgcccctcactccacgctccttccctcacaccacaccacccctctctctctctctcactcgcgctttccgctctcgtctcctcctcttccctcccgcgtcaccccccttcttccccggcgttgatccgatccacctcctccctcctcccccgcgttcactcggccgggccgagatcggctcgtccaatgactggtgcggtgagaccctgctccccccccgtgcgtccgatcaacctccgccgccgtcctggccctagatgcgtggccgggcagggataggccgtaggattgataggcgaacgcaggaggtggtgatcggcagggcggcctctccgccatggcgcgcggcggcggcaacggcgaggtggagctctggggtcgggggcggcggcgggcgcggcggcgcccccggccggcccggacctacacgccctggacatcatgcctcggcacgactcatcctcgccggcatggtcgccggcgggcgtgcagtacggactgggcgctccagctcttcccagtgctcagcccacttcgatctgggactctcggaactttcagtatgctctgacttcattccatgtgggtctctgcggccctattgctggtttagtgggacattggagcgttgctctgtgagatcacaaaagagagatctctatatggtaggcgccgatcgcgcactgctgatgtgtgtcttcctcttctggctcgctgactggtctctcaacacactgcgctggcaacagcgctggcctggttggcagatttgtaagctcagcatggacccagtgcagcaaattcaatcttctgttcttggattggattgggaaatgacctatggtacgcctctggttccacaaataactggcacaagtggtttccgttcctccggacaagggcttgctgtgaagcctgcgcaaatctgaaaggcgcatttctggtggcagtgctgttcctggccttctgtttggtgataactgtgatcttcgccaaggagataccgtacaaggcgattgcgcccctcccaacaaaggccaatggccaggttgaagtcgagcccaccgggccgctcgccgtgttcaaaggcttcaagaacttgcctcctggaatgccgtcagtgctcctcgtcactggcctcacctggctgtcctggttccccttcatcctgtacgacaccgactggatgggtcgtgagatctaccacggtgaccccaagggaacccccgacgaggccaacgcgttccaggcaggtgtcagggccggggcgttcggcctgctactcaactcggtcgtcctggggttcagctcgttcctgatcgagccgctgtgcaagaggctaggcccgcgggtggtgtgggtgtcgagcaacttcctcgtctgcctctccatggccgcgatttgcatcataagctggtgggctactcaggacttgcatgggtatatccagcacgccatcaccgccagcaaggagatcaagatcgtctccctcgccctcttcgccttcctcggaatccctctcgccattctgtacagtgtccctttcgcggtgacggcgcagctggcggcgaagagaggcggtggccaagggctgtgcacgggcgtgctcaacatcgccatcgtgataccccaggtgatcatcgcggtgggggcggggccgtgggacgagctgttcggcaagggcaacatcccggcgttcggcatggcctccgccttcgcgctcatcggcggcatcgtcggcatattcctgctgcccaagatctccaggcgccagttccgggccgtcagcggcggcggtcactgagcatggccaaggccggaggtcccagcccagcccgccatttaccaaattttcgcataggcgtaactaggtggctctcgcctaaggactccgtagagcagaataagaattgtgaggaacctgtatgtgttgtgtctgtatgtgcgtgtaagtcagtgcgtgtagcggaaaatggacagaggaatgtgggcatccatcaccggctggggtgtcgtctttgggttgtgacttgtgtgtagcaagtcatggtgttcaggttagggtatagcaaaggaagatgaacaatcaacgacaaaaaaaaaaaaaaagaactttcagcgacaaaaaaaaaaaaaaaacacctcggccgcgaccacgct

SEQ ID NO: 18234 - DNA, 698 bp, Triticum aestivum
  unsure (1)..(698): unsure at all n locations
  Clone ID: PAT_TA_18234
cgtgagacccgggggccggccgggccacgtgggccattggtcccggttcgtctggacctttcggtcccggttggcgggacaaaccgggaccaatgtgccttgctcctggcccaccaccattggtcccggttggaggcatgaaccgggaccaaaggacgcccattagtcccagttcgtaccaccaaccgggactaaagtgttggtcctcgttgcggccagagtttagtcccacctcgccaaccgaagggggctcacaccggtttataagcccctccctctctgccttgttgagctcctctcaaaatgaaaatagatgcccttatacaggaaatttgacctaaattcatactgaatttctctgaagttagtagaaatttattatgaatttaggtcgaattttctctataagctcatctatgctcatttctgagtagtttttatattttttttcntttctgctaaattaattttttccaatttttctgagttgtnataaatcattaaaantaaaaaagatttagtanagttaacacactatttttcctccaattattcngagtagtttttaaaaattttcctttcngcaaattaatttttcaataatccgagtgtaaaatcatnaaataaaaggnttngtnagtaacaaacatttctcaattattccgagantttaaaagtttcctcgnaaatanttcatt

SEQ ID NO: 18235 - DNA, 981 bp, Triticum aestivum
  unsure (1)..(981): unsure at all n locations
  Clone ID: PAT_TA_18235
tcggcacgagggggatgggctgctcatgagcgagngctcggtgagggaggagacggggagaggaaccgctcaggtgcaggagaaggggtcgacgacgaggggaaccgctcaagcggacgagaagagctcgaagaagaggggaacgcttcctcgcatggtacagccgcaagggtggaaataagatggcacatgattgggaaacaaaattgaggccattcgttgagcagtggagaacagcaagctcggttcactggcacgaggaggcgctctttgacctagctgcacacgaggcttacctatggtgtggtcacaaatgagattctgctacataccaagagctgaccctgaggacatggagacggctcagacttcagcttcggagacgcactacagttcttccgtgactagcgtcatagatcactcgggaatttgcaagcccagttgacgctggaggctcaagaagagactgccgcgatagttaaccgactgaccatggggaacgaaatgactccgtccgagaatctagcagcatggcagtgtattgagagcaagccgcggaggatcttggagactttgaggcataccatcagacaacctgcctagttgcgaagcacacactcccccatgcccctcacaccgtgctaggccggcgttccagccgactccgatggcgtggcggcagccaactgtccggctgctgcctccaccttccgcagtccggtggctcctcctggtagcaccagcctctccctccccctgcacagctctcagtgatgatgacaacaggttcaccagatactccaccaccgccggccacacaggccattctggtcatgccacctccagcgcaatcccatacccgcaagagacatcgccgtcctactcgtagtcatagagttgctgcgcagggtcgtggacagggaagacatgaggatgatacggttagaggacagacagacggttagcgatgtcccactatat

SEQ ID NO: 18236 - DNA, 912 bp, Triticum aestivum
  unsure (1)..(912): unsure at all n locations
  Clone ID: PAT_TA_18236
gaggaaaatagtaaaaatatatgtagaaagaacaatgctctatctcaccaaacatgtttntggaaccctgtacatggtacgttctttcaactacactctctggaatgtcgcacagcaactttaatttttatagtaaaaactaaacggcgagttaaaatatcagttggttgatgtcataagcaacagcaactaggtggccagtccacacaaccagttactgtccttcacctgatccacctgatgctggtgctctatcttgaagaaacatttggctggcctctttcatcttattcacgatctcgagtacctttgggttatggaaacggtccctaacatacttattttcctctgcctgtatttctttgatggcgcttggatatggatttggaggtggcggctttccttctctgcgtgcaatttgtttcagttccttgtatgctagcttctttgcttttttctctgctccatactccatatctgctacagccattgcatcatcttcattgactccctgttctttcaactctaagacacgccaagcaaaaactcttgctggcggtggatcaaacccgcttatctttattgcatcatggtagagtgaatcaggatgccttctgaagaacctcttgacatagacatcctctggcagttctatcttctcgattttaccatcagttctagggaatgtgactggaggtgcctgcggactggccttgagccaggcaggggcgggcttggccagccccttcaccagtttcctcgtcttcgtcagcaggtcgcctcgcatgtacgacatctcgccttcacagccggtgggcggtggccgccgccgccgccgctgcaaccgcgagtgggaggaaatgccggcgagatggggcggggagattctcggccggccgcctcgagcggccg

SEQ ID NO: 18237 - DNA, 912 bp, Triticum aestivum
  Clone ID: PAT_TA_18237
tcgcgatctaccgattagtcatcgcaaagagagaaaaaaaaaatccccgatccagcaccgagcgcgcaccggtggagatcgtggtgggaggatgtcgtcggactactcgtcgtcgtgggcgcgcgcgctcgtgcatatctcgccctacaccttctccgccatcggcatcgccgtctccatcggcgtctctgtcctcggcgcagcatgggggatcttcatcacggggagcagcctcatcggggccgccatcaaggcgcccaggatcacctccaagaacctcatcagtgtcatcttctgtgaggccgttgcaatttatggtgtaatcgtggcgatcatcctccaaacaaagcttgaaagtgtgccaacatcccgaatgcatgatccagagtctatgcgagctggttatgcaatctttgcctcaggtcttattgtcggctttgctaatcttgtttgcggggtatgcgtgggaataattggaagcagctgtgcactctctgatgcccagaattcaacactctttgtaaagatcctggtgattgagatcttcggcagtgctttgggtctctttggagtgatcgtgggcataattatgtcagctcaagcaacatggccaacgaaagtctaattccatccatctgggaatctctgtaaattattttgggtgaagccctttggaatgttaacatgtgttcaactgtttcttatctattcttttttcttttgcacgtttttggtaaatcatgtattttggtgcttgatgcatctgatcgtagagatactgttcctactgtaaagactccatatgcctgccaggtatcatcttgtaggtgctattgcttttgcagaacgtggactgcctgttgaataaaagcattgaacttgagaataaaaatttaactcagccttacgtgg

SEQ ID NO: 18238 - DNA, 1085 bp, Triticum aestivum
  Clone ID: PAT_TA_18238
ctcgttcccccgtcctgtcgctctcctttcccagttacaaatccaaaacgtcgcgagaaaaaaaaaaagatccccgatccagcaacgagcgcgcaccggtgaagatcgtggtgggaggatgtcgtcggactactcgtcgtcgtgggcgcgcgcgctcgtgcatatctcgccctacaccttctccgccatcggcatcgccgtctccatcggtcggtctctgtccgtcggcgcagcatgggggatcttcatcaagggggacgcagcctcatcggggccgccatcaaggcgcccaggatcacctccaagaacctcagtcaggtgtcatcttctgtgaggccgttgcaatttatggatgtaatcgtggcgagctagtcctccaaaccaaatcttggatgagtgttgccaactattcccgaactggctatgcattctttgcctcatatgttagctggctatgctaatcttgtttcctgggtatgctttggtagaatcggaagcagctgtgcattgtgtgatgccgagaattcaacactctttgcaaagagtctcactagtctggttttcgagattttttgcagtctttttggagtgatcgtgggcatattgtgacagctcaagcaatatggctagccaaactctaagtccatccatctggggaatatctgtaaattattttgggtcaagccctttataaatctcattcaattttctcttgtcttttctgttttcttttatcatgtgtacgtatttggtatttcaagagatttcctctggtggttgtatcttctcgtttctactatcaattctactggaaaagtgactgagtaggggcctgcttgcatgtccttgagccgggcaggggccgggcttggccagccccttcaccagtttccgcgtcttcgtcagcaggtcgcctcgcatgtacgacatctcgcctccacaaccggtgggcggtggcggccgccgccgccgctgcagccgcaagtgggaggaaatgccggcgagatgtatcatcttgtaggtgctattgcttttgcagaacgtggactgcctgttgaataaaagtattgaacttgagaataagc

SEQ ID NO: 18239 - DNA, 545 bp, Triticum aestivum
  Clone ID: PAT_TA_18239
ggtttaggcgatgaagatctgggcaattcgatagtagaggcaaaatctgagcataatgaatttgctaaaaagaagaaggagttggagatgcaagagaagaaataccacgaggagctgaagatggaaattgagggaactactttctctaatttgtcaaataagaaggctgatagcgcagccgatgttgctgacgaagatgaggcccaggcagctattgaccaagctgagaaggatgctgatgacattgccaagtctgtcgtttccaggaggaagagaggccttattgaagcaatgcagattagcaatgataggaagaagagcaaagtggagctgctcaagcaaaggaagaaggcggccgagtccagtgcttctgctaaagctaaacgtcgctgatgcgggacggcatattatgttgtagtatccgaatcgatgatacacttttacgagtgatgagtatccgcctttgtggtatttatgttgttttgcattgactggatgtaccaagatacctgaatggaaaattttgatctgcgatcattgtgctc

SEQ ID NO: 18240 - DNA, 2138 bp, Triticum aestivum
  Clone ID: PAT_TA_18240
cccacgcgtccgccaacgcgttcccgcccccttccccgaagggcgaccactcccgccgccatgccgaagcactaccgccccgcgggcaagaagaaggaggggaacgccgccaagtacatcaccaggaccaaggcggtcaagtacctgcagatcagcctcgccgtcttcaggaaactatgcattctcaagggagtgtttccccgggagcccaagaagaaggtggaggggaaccacaagacctattaccacatgaaggacatcgccttccttgcccatgaccccttgattgagaagttcagagaaatcaaggttcaccagaaagaaagttaaaaaggctatggctaagaaaaacagggatctggcggacagattgttgaatcgaccaccgacttacaaacttgatagacttatcattgaaagatatccatcttttgttgatgctctcagtgacttggatgattgcctaacgatggtgcatttattcgcggctttacctgctattgaaggtgaacgtgtgcaagtacaacgaatccataactgccgcaggttaagccatgaatggcaagcatatatttctcgaactaattccctgcggaagagcattcatatctgtgaaagggcatatactaccaggctgaagttcaagggcaaaagatcacttggcttactccgcatgctcttcagcaagttttaactgatgatgtcgacttcaatgtgatgctcacctttttggaattctacgagactcttctaggatttgtgaacttcaagctttaccattccataaatgtgaactatccgcctattctggatcctcgtctagaagctttggctgctgagctctatgcattgtcccggtatatgtcttctggaagactgccgggaaatccagagtctaatgggcttattgaagacaaagagactgaaaataataaagagagctcaaaaactgacgagtctgagctcagattggcacagcttcaacatcagctacctgctaatgaacctggtgcgttaatgcatcttgtagaagaatcaactgctgatgatacagaagaggaaagcgttaaagagtgcaggactttattcaaagatctgaagttctacttaagtcgtgaggttcccagggagtctctcttgtttataattccggcatttggaggaactgtttcgtgggaaggagaaggagctccatttgatgaaacagatcaagatatcacccatcagattgttgacaggccaacccagagccatgttttcctctccaggcattatgttcaaccacaatggatttttgattgcgtaaacattctcaaagtaattcccacagatgactatattgttggaagggtgcctccaccacatatatctccttttgtggacaacgataaagagggtcatatacctgactatgcagtgaccttggagggatataaatctgctggtcaaaaccaagttatgcctctgccaggtttaggtgatgaagatctgggcaattcgatagtagaggcaaaatctgagcataatgaatttgctaaaaagaagaaggagttggagatgcaagagaagaaataccacgaggagctgaagatggaaatcgagggaactactttctctaatttgtcaaataagaaggctgatagcgcagccgatgttactgatgaagatgatgagacccaggcagctatggaacaagctgagaaggatgctgacgacattgccaagtctgtcgtttccaggaagaagagaggccttatggaagcaatgaagattagcaatgataggaagaagagcaaagtggagctgctcaagcaaaggaagaaggcggccgagtccagtgcttctgctaaagctaaacgtcgctgatgcactaaattcatcaggcaacggcatattatgttgtagtagccgttttgatgatacgcttttaccagtcctggtggtatttatgttgtttttactggatgtactgagatacttgaatggaaatttttgatctgttttaagctgtgctcacgtagttgatcgtgaccaaatctgaatttgttggccggtgtgcatacttttctgatgttcctagggtcctttgttcccactgcgtgaaagcaatttgctctgttattctgctaaaaaaaaaa

SEQ ID NO: 18241 - DNA, 813 bp, Triticum aestivum
  unsure (1)..(813): unsure at all n locations
  Clone ID: PAT_TA_18241
gcaggaattcggtcgggcgctaacgcctccctccacgcgtcgaatccagccaccatgaaaccctaagaccaccgtcctcccgaatcctccattgccctccccgatgcaggcgttcgcgcgcctctcctcccccgccgcctccagaaaggtgatttcgggcgtctctggagcggtcgcaaggccgtgctaccggacatggcggtggaaggcgcatgcggcgccgctgtcggctccgggcccacccaagggcaagaagagggaatacatatccaagaatgaaaggaaggctaggatgaaggagtttattgagggttatcaggcatcaaatgacggtagatttccgactatgcaaatgattcgtcaaagtgttggagggggtcactacacaattagggatgtactctcggaagtaaagtataaccagataaagtttccgtttgataagtctaaggcagcccagcttcaggagacagctgaaggtgctgagcagtcaaggccagaggaggacagtgggaacagttcattcaactctcagagctttaacggaaatcaggatgaagatgacacactcctatcccagaaagattctcctgctggcaatacaatcatggaaaacactgaagcttccatatctttggacgcaaaggaggcgaagttacccgctatataactccgaggcagcccagctccatgagacaggtgaatgtgctgagcaatcaaggctcgaggaaagcgggagcagtgcattgaacccagatgacacactnctcttccagaaagactctgctatgggcnctacaatcatagaaaaca

SEQ ID NO: 18242 - DNA, 606 bp, Triticum aestivum
  Clone ID: PAT_TA_18242
acgcgtccggtcagctgaaacttgagctggcggacatcgacagtcactggacgaagtgtgtctggcccattgagcccattggccccggaggtgaccaacatcccaaaccccactacaggccggtcaggccagctccttccagcgttaatgaacatgtcagggccgttgatgggtgtccgcagctcggctggtcatctgaggagccgtcatgtttccagggatagtggagactactattttgacaccccaaattcaaatgatgaatttctgcatcaagggggcagtggaattcatgggattaatgctattgagcttcaatctgcattacaggggcaccagcacttgctttcacgtgccgacatagctttgattctccttgctgaaattgcttatgaaaatgatgaggacttccgtgaaaatttgcctctgttattccatgtcacgtgtgtttcaatggatagctcggaggacattgtgcttgagcattgccaggatttgctcgtgaatctcctctactcgcttgctggccggcatcttgaactgtatgaggtttagagcagtgaatgggagaataatcagtatgtggtgagcttgataaaatacatt

SEQ ID NO: 18243 - DNA, 810 bp, Triticum aestivum
  Clone ID: PAT_TA_18243
tctccgacccgcccaccctcttttcgtcagcaagttttctgccaaccactggatggcactcgataattctacactttaaaatgcacttgagctttccttgaatacccgtcgatgcgatgtggtcatcagcatcctagtgatcaagcgcatgcaagtctggtgcccctttgtttctgcgattgttccatgctacatcgcaacagtgccccattaggtgatttaagataaatgctattgtttacattccctgcaatctggtgcagattcttctggaaatttggtcaaagctgcaagcaaccaaagatatgtgacatgctatatgaactaagatatgaattttgtgttcccaggtctataatatccgtgcttagccggttccctgcaagcgctttcggccatgacctcaagttctgcagctaggccgtgaatgtgttgatccttctcaccgtccaccgatgatggcccgagagaagtcggggaaggagaaaaggatgttgttgtcatggtcgtcggaacgacttgccgtggacgcagtcacgcactggatgccatcgacggctagccgtggacgagcacctcgccgcctccgcaaaatatggatgcacgggattctggtactaacattgcagtgtgtgctatttcggtgttgtgacttatacactctgtggaagaaacccccggtttgatttacaggtgatgctgattcgtctggggtctacttctaacagatcaatttggtttgttggttgctgagtggcttcatgtgatgctatagtgagcatcacatgaagccggacgcgtgggcggacg

SEQ ID NO: 18244 - DNA, 704 bp, Triticum aestivum
  Clone ID: PAT_TA_18244
gcacgaggcactccccgtcgccgttcctctcatgccgcccgcggaaccgctgctgctctcctcgccgagcttgctcgccgccgccgcatcccatcccggtcgcgctcccgccaccattccttcttccctcctaccactcccctcctccaggcctagaaatcgaggaggaggccgagccgctacccgctgtcggtcctcagaccgtcctgatcgaccaagctcagggtcgaggggcgcgccggatccgggcgcggcagctcgctccccctgcgctcttgctctggatctcgtcctcctcctctagccgccgttcgtcctcctcggtgcgtctttcttcccaccgccgtcatctccttcgcccagccaaccgccgccgcaccgcacgaggtgggatgtgacccatggagatccccgccttctcctcggcccagccgaccacccctcctctgcattcctgcccatctcactgcccctcccccatcgctcctccttctcctcagttgccaggagaggctcggcctcgctcgggccgcagctcccccgtcgagttcgtgcgtctgcatcgtcgggaggagcggaggctgcgtcacagacgggccaccctgtccagcctggtctctgcgcccctggcgtcgtcgctgtcgtctcttctccactccctctggtgctccttgcctgcatctgcacctccgtggactgcagct

SEQ ID NO: 18245 - DNA, 1455 bp, Triticum aestivum
  unsure (1)..(1455): unsure at all n locations
  Clone ID: PAT_TA_18245
cagcttaccaacgcgccccagcgcaccgtccatccgcattagatcggcgcactgtccgtcgtcactaggtggaccccttcgctctctttccctcctaatcttcttccctctctttccctcgtcctcttacagataatcccgtattaatcaatttacagataatgcctggataattttcttacagattgcgtgcgggggcttctttagattgtttcgagatggcggcgtgccggggattcttcgagtgcctgctcaggctgctcaactttttcctcaccgtcgccggccttgccatggtcggctacgggatctacctgctcgtggagtggatgaggccccgccggctgagttgcttacgttcggccgcccgatgctcacggtcgtggcccttggagaaggaggcagtttcttcgacaagctacccaaagcatggttcatctatttgttcattggtgttggtgctgttatcttcgtcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaatgaaaactggaagattgcaagatgggttgctcttggtgttgttgtttttgaggtattgcttttcttgttagctcttgctgtcagggcaatgaacaaacctgccgagtatgacagtgatgatgaaatcattggaactgctcgaagcactagcatccgtcagcctcttatccattcccagaatgctccggctaccggtgttcccgtcccaacacttgatcaacgtgcgagcagaaatgatgcatggagccaaaggatgcgagagaagtatggtctggacacaagccaatttacttacaacccatcagatgcaaccagatatcagcaaaatggggcacctccagctgaagaaaggagccgttgcaccgtaatgtgaagatccttcacgacgttatccaaattgatggttcttgaacaggccatctcagcttgcacagtttggctataccgtgttgttcagagtggtgtatgaatagaggtctttttaccttaatgctcatcttatctgctgtcttctgaacaactccatgcacctgtaatttttgtgtgaacgagtattggccatcgatatctcattatatttcatgttttcctcagattccttttgttggcattccatttctcccttgtctaccctttcaacttgtatcaatgaactagacgtaaatggtgaacttcgcctcgcaaaaacgcgccgcccgcccgccngccgccgccgccgccggcaaccgtnccgtctcctccctccgccgagcancggtcccangtatccctccantccccaattatgna

SEQ ID NO: 18246 - DNA, 1906 bp, Triticum aestivum
  Clone ID: PAT_TA_18246
gaaaactgaagcgcagctctctgcctgcggcactccaagtggacaagagctcttgtccttatttcaccgagctgtgctacaagattctagagttgattgatagagagtcggacacatctgtgaaaattgctgctatttcttcacttgaaacactagcgaaagaatatccctctgaaaatcctgcatatagcaagtgccttgcgacaatcattagtcacatcagctctggtgattctgtcacttcttccgggttaataaataccgcagggtctctgattaacgtgctaggatcaaaagcattacctcagcttccacttatcatgaaaaatatgctgcaaagagcacatctagtgtcatgctgccctagtggaaaatatgttcatggttctccgagaactgatgccagcctttcaaaccaatctatcagtatgttgctatccgtacttgcaactattcaggtgattgtgcaaaagcttggggaatttgttagtccatatttggaagaaatactggatctcgtgatattgcatcctgaatgtgctactcaaattgatggaaagttggatgtaaaagcagcagatgttcggggcctactgaccgagacagttccagttcggcttattcttccacctttactgaatttgtattccagtgctaccaaatgtggagatgcaagcctgtcattgtcgttccaaatgcttgcaaatgtagttggtacaatggatcggctggctgtaggaacttaccatacaaaaatatatgaacactgtttggaagctcttgatctccgtcgtcagaatctggactccttgaagaatataaatttagttgagcaaagtattacccacaccattatcactctcacgatgaagcttaccgagtccacttttaggcctcttttccttcgtactcttgaatgggcagagtctgaagttgatcagtcaacatcaaagagaagtatggaccgagcaattgttttctacaagttggtcaacaagctcgctgaacaacacaggtccttgtttacaccttacttcaagtacctacttgagggatcagtacaatatctatcagaagatggtgtcttgatcagttccaagcgaaagaagaaggctaaacttggagacgatatagtcaaatataaggatagtttgtcaggacagaagctgtggaacttgagagcactgatactgaaatcattgcacaagtgctttctttacgacaatgatcagaagatcctagattcctccaatttccagactcttttgaagcccattgtttctcagtttgtggcggaagcgcctgaatctcttgattcagttccagacgctccatcagttgaggaagtggatgaaattcttgtttcgtgcttgggccaaatggcagtgactgcgcgatcagatgttctgtggaagcctcttaaccatgaggtgctgatgcagacaaggagtgacaatgtccgccctaagatgctgggcctcaaggtggtgaggtacatggtccaacacctgaaggaggagtacgtggctctggtcccggagaccatcccgttcctgggcgaactgctcgaggacgtcgagcttcctgtcaaaacgctgtcccaggagatactcaaggagatggagaccctcagcggcgagagcctccgggagtacctgtgagtgatctctccccagagtcctcgcgccagtgaagtcagcccctacgctgcccctgctggtagtctgcttcgttcttgcttcttgttgtatgtaaactacataggatggatggcttcgagttgaactattttgttgtttatacatgtgtgagctatattgttcttctgtccgggccttgctactgaatgctattttaaacaccgacgtgtgaacatcgggcgcctaaaaaaaaaaaaaaaaaaaaa

SEQ ID NO: 18247 - DNA, 1448 bp, Triticum aestivum
  unsure (1)..(1448): unsure at all n locations
  Clone ID: PAT_TA_18247
gttaaatcactctgctggcccgttacccattcatgcataccctcaggtcccctgcactccctgatggaacgaccttcatgctctatgtctctccggttggcgtcatgtcttgtctttgactttatctctgcagtcgtcaggactcctttcttcctcttcctctctgctcctgttttaagctctttattctttctgtaccactaaagcttatactcctacaattacttgtaaatcttgtaaggcctctactcattgtataatgaatgccacattttaaaagtatttgtataaacccaatacctatgttcactccactctgatcataattggggtctcccttttcaagtatcccttcattagttacggttcatgaaacctagtataccttttagcattcttaggttcgactaaacctatcatgattgtatcacatacaaactttccatacaaaaattggtaaggaaactagttttgacatcctcctgcccgattccataaatgcagctaatgctaacatgattccgacggactttaagcatcgctacggatgagaaaacctcatcgtagtcaactccttgaacttgtgaaaataacctcttcggccacaagtcagagcttcatagacggtgacattaccatccacgtccgtcttcttcttaaagatccatttatctcaatggcttgccgatcatcgggccaagtccaccaaagtccatgctttgttctgatacatgtatcctatctcggatttcatggcttctaaccatttgtcggaatatgggcccaccatcgcttctccatagctcgtaggttcattgttgtctagcaacatgaccttcaagacaggatcacagtaccactctgaagtagtacacatcctcgtcgccctacgaggtctggtagtgacttgatccgaagttgcatgatcaccatcataagctcctccttcaattggtgtaggcgccacaggaacaacttcccgtgccgcgccacaaactgggtgaagtcatcgttcaatacccccccctagtctcctccgaaaacaccctaacgacaagtcgagctttcttattggtgattcttaccatcattgtctgtcttccttttaaaatccatctgtacccaatggccttacgaccatcaagtatttcttccaaagtcatggctctgttctcggatttgggcccgcgctccgtccggatccgggccacatcgctctcatacccgtaggtcatgtgnctacaacatgactcnaagacagattgcgtacatctgatgtacnatgcacnttgtacctacaagtaggtntgcctgatcgaaatcagatacatcanaactcantcaattgggtagcgcaaagacattcgtccngnncacaatgatgcggtanacccanaagccactcncaccattttngaaatttccaggggcggacaatcccaagnntg

SEQ ID NO: 18248 - DNA, 670 bp, Triticum aestivum
  unsure (1)..(670): unsure at all n locations
  Clone ID: PAT_TA_18248
ngacacaaccaaccagcagcaggtagtgcaacacaagactggcaagatcgatcgaccgaaggtagctagctagtaaggaagagcaggaagaagaagaaagatggcggcaggcggcgtgtgggtgttcaagaacggggtgatggagctggagcaggaggcggcgagccggaaggcgctggtgtacatgccggcgaacgagacgatgcggtcgctggaggcgctggagcggcggctggggtcgctggggtgggagcgctactacgaggaccgcgccatcgtgcagctccacaagcgcggcggcgtcgacctcatctccattccccgggacttctccaggctccgctccatccacatgtatgacgtcgtcgtcaagaaccgcgaccacttcaaggtcgtcgacctctagttagccatcttcatcggtaatattcttcctattcgagccggataagttcctggctccgcgccacaaatatatgtatagacgtcatatacaaataagaacctctgcgtgtacgattatgcatgtgttgtactgtccctgtgtgatgtagtatgtaactgtgtgcctttgtcagaacctgtgtgtacttaacggtgaaaaatatatgtatgccagtaccggggtttaaaaactctgattctgaaacttgaccccgctgaaataaaa

SEQ ID NO: 18249 - DNA, 1102 bp, Triticum aestivum
  unsure (1)..(1102): unsure at all n locations
  Clone ID: PAT_TA_18249
cgtccgcccacgcgtccggacgaactccgcgaccgcctctccctcctcttcctatccccacacgtcacgtcaggcgtgccgtagcgcttcttccttctctccctcccgtcggatccggctataaattacccgccccctcccgtctcctccccacacatccgatccgatccaatccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaaaaccatcaccctcgaggttgagtcctcagacaccattgataatgtgaaggccaagatccaggacaaggagggtatcccaccggaccagcagcgtctcatctttgctggcaagcagctcgaggatggccgcacccttgcagactacaacatccagaaggagtccactctccacttggtgctcaggctccgtggtggtatgcagatcttcgtcaagaccctcaccggcaagaccatcaccctggaggttgagtcctcggacactattgacaatgttaaggccaagatccaggacaaggagggcattcccccggaccagcagcgtcttatctttgccggcaagcagcttgaggatggccgcaccccttgcggattacaacattcagaaggaatccacccttcaccttgtcctncgncttcgtggggggatgcaaatntttgtcaagaccctcaccggcaagaccatcaccctggaggttggggnccttgggcaccattgcaatgggaaggccagatccaggacaaggngggattcccccggaccagacgcccctgttttgcgccgggcanttgtgggtggncgcgccctcccnt

SEQ ID NO: 18250 - DNA, 3405 bp, Triticum aestivum
  Clone ID: PAT_TA_18250
ggcccgcgctcgtgccgaattcggcacgaggggaaagaggacattgtctcatcagacgagggttcttctatggctaacaccaactcaaatggtacagctaagcttgactttgatttgaatgaacttggggacgaggggaatcactctgagccagctacctctactgttgtatgttcgtctgcaattcatttacccggtctttctccattcgtctcacctattttaagtggtctgccggcccaaataacagttgctgctccagctaaaggaccttttgtccctcccgagaacctactaagggtgaagcctgaggctgggtggaaaggtgcagcagctacaagtgcatttcgtcctgcggagccacggaagactttagggatgtttctaactacacctggtagtgcagtgtctgatgctgccgggaggcaatctcgccaagcatttgacattgatctaaatgtagcagatgaccaagttctagaggaagatatctcacagagttctgcccggacaattggttctgaatctggcaaccctagaagtcgcagtggccctgtacgaagtgctggctttgaacttgacttgaatatggccggcgaagttgcagagaataaccaatttatctcaaatgcttcacacagagttgaagtcacattgttgccatcaagaccgttgccagaaggtttacctagtactgatacaagtagctcgaggaacttctttgatctcaataacggaccaagccttgatgaagccagtacagagcctgcacaaaggaccctatcatctaaaggtggctatgcagcataccaactcctccctcaacgttgctggtccgtagtacaaacagtactgaaattaataacagatcaccttggtattcttttgatagccaaggaggaaccgtagctcggccctcatttttctctcctggacaacaatttcacaacgtcgactgggcggttacctccaacgggtacacactgtttgatgacgccaccgccggcgtttgctgaggagcaaacgagaatgtaccaattgcctcgtctcccgatacagaggacggatccccagggtagctatgttcacgattgatcatcccacacgctattctcatggcagtacgaacgttgccgagacgtcgcatccacttcttttatctgacgccactgcatgtggaattgaggccttgtattgcacctgcgtgaccctgatgagttggggctgtgatatcctactaaccaatgcattcatgtctgaaacgacatggaattaaaggcggtatgggtcatggcagtaattgctgaagatgttgacaaaagtcatactttcatggaaccaattttcgtctggatgtccactgggtgtgctatgggttttgtttctgccaaggcttaattctggtgttgccacgaagggcttgggttgggcgataagaaggaaacttcctccagttcagttgatgataacaagctagtggaattcccagctgttgtgctgctgggggataaagattctaaagatagttataatgaatacaggactttgacatagctcgactctccgccacctcagacttttgagcatgatgcaaactgaatgcggaagttgtagtgcgcccatgtcggcgcgatgaggtatctagtttccacggatgcgggctcttttataactgcacaggccaaaccaaatgttactggtaagcttgattttgatttgaatgaacttggggatgaagggaatcactctgagccagttacctctcctgttatatgtacttctgggattcatgtacctggtctttctccattcgtatcacctgttttaattggttggcctgccccaataacagtagcagctccagctaaaggaccttttgttcctcctgagaatctactacgagtgaagcctgaggctgggtggaaaggctcagcagctacaagtgcatttcgtcctgcagaaccacgaaaggatgtggggacatctctgactgcacctgatattgtaggatctgatgctgctgggaagcggtctcgccccgcgtttgacattgatctaaatgtagcagatgaccagattcttgaggatgatatctctcagagttctgctcagacagttggatctgaatctggcaacagtagaagtcgcgatggtcccgtgcgaagcgctggcattgaacttgacttgaatagggctgatgaagttgccgagaataaccagtttatctcaaactcttccaacagagttgaagtcacattgttgccagcaagatctttgccaggaggtttaccgagtactagtatgaatggctcaaagaacttctttgatctcaataatgcgtccgcggacgcctgggctagcacagagcctgcacaaaggagtctatcatctaaaggtgctagcagcataccattccttcctcaagttgctggtcttagaatgaacggcacagaaatcaataacatgtcaccatggtttgcttctgccaacccatatgctcctgtagctatgcaatcgtttttgcctgctagaggagaacagccttatccaattgaaacagcatctggaacccagaggatgattgtgtctgctgcagacagctgccaattcggaagtgattcaggcagggctccagttgtttccacaccaccaacaatggtgtttcaccctcctcctgcatatcaatatgcaggatttcctttcacccccagtgttcaccttcagacagcaggttttccaattggatcgacgtcatatgccaattctgcacctgcaggagttccatactttccaaccattgccccgtcacttgttgggtcaacgggtgcattacctccccaacatgtgaggcaatatgcaataaaccgtcctgaaggtagcagtagtgatggtctggacggtaattggaaatggaaaagaccaggagggtttgatcttaattctggtcccgcgagtatagatttagaagggaaggatgaacgaatactttcatcggttagacaaaatttgatgacgccacagcaggcctttgcggaggagcaaacgagaatgtaccaattgcctggtgtaggaataaagaggaaggaacccgagggcagttgggatcccgacagatcatcatacaagcaattgtcatggcagtaagaactttggcgagacctcgcatcgacttcttttgtctgaggcaactgcatgtggaagtgaggcgttgtattgcacctgcgtgaccctgccgctgctgggctaggatatacaactcacacatggattcatgtctgtgacgacatgggattgtgggagggaatgaaacatggctgtaattgctgtaaatgttaaccatattcatacttccctggaaccagttttcctcagcttgagcagttgcttggctacagtaaaaaaaaa

SEQ ID NO: 18251 - DNA, 621 bp, Triticum aestivum
  Clone ID: PAT_TA_18251
cgggtccacgggggcccactgaccccgcagaaccctattcagcccccgcccgcatcgacgggacgctactccgccgccggcgatggaggacatcgaggacgtgctgggaccggccgggttttccggcggcggagctcctcccgggctccgcctacccctctccactgtcgccgtcaagcccaagcgcaggtcgtccaagctcgtgcagacgcagccccagcccgatgcccggatcccaggcacccagacgatatacgtcaagacattcgggtgctcacataaccagagtgacagtgagtacatgtcggggcagctctcggcgtttggatatgcaattactgaagagcctgaaggagctgatttgtggctaattaacacatgcactgtgaaaaatccaagtcaatctgccatgtcaactctcatatcaaaatgcaagacggcaaacaagccactggttgtagctggctgtgtgccacaaggaagccgggatctgaaggagcttgaaggtattagtataataggagtgcagcagatagatcgggttgttgaagtagttgaggaaactttaaaagggcatgaggttcggttgttgagtcggaaaacactgccctcacttgattt

SEQ ID NO: 18252 - DNA, 708 bp, Triticum aestivum
  unsure (1)..(708): unsure at all n locations
  Clone ID: PAT_TA_18252
ccgcgcacccgcggcagctcccccctcccgccacagaagccgtctcccccgaccccgcgcacccgccagagaagccgcctccatggcctccctcgccgccgcctccgcctccacggcgctcctcttcccctccacctcctcctccaagccccgcctcccgctctccacatcccttggcttctccgcgcccgcgcggtcacgccgcgccactgcggtggcggggagctccggcaggcgcccggggctgctcgtcgtgcgcgccgccaggggcaagttcgagcggaacaagccccacgtcaacatcggcaccatcggccacgtcgaccacggcaagaccaccctcaccgccgcgctcaccatggtgctcgcctccgtcgggggcatgcgcgcccaagaagtacgacgagctcgacgccgcccctgaggagcgcgcccgttggtatcagccatcaacaccgccaccgtcgagtacgagacgggagacgcgccactacgcgcacgtcgactgccccggtcacgccgactacgtcaagaacatgattaccggggccgcccacatggacggcgccatcctcgtcgtctccgggcccgacgggcccatgccgctgcccaaggagcacatcctgctcgccaagcaggtcggtcccacactcgttgttttcnaaaagaggncaagtccacaacaagactgctcangggggncggttn

SEQ ID NO: 18253 - DNA, 1501 bp, Triticum aestivum
  Clone ID: PAT_TA_18253
gcgctcggtaggagctcaagtcgaacggagggagggaaatggcgggcgcgaccttcctctctccccccgcgctgctcctcggccccgcgtccgtctcgtcgccggcgtgctgacacgcacgcattcaggggtgctgccacaccaggtccgggggctccggggcggaggccgccgccgctggcgaagaggctctggggctccgcggtagggatcggtccgggggcggttgcggtgccgccgttggcttggagatccatacgagctctctagggtgatcagcggtgcctgcatccgcggtgccggccgaacgccgggagggctccggggctccaatcaaacagcaaacgcaccctcacagcagccagagaggcaaacccagagcttctcccatcactcttgaccttggcactgaatgatgctatgacatacgaacaaggcaaccaaagacaggagggccaaatggatcctgcaggctaagatcacaaataaccagaccccgaaacagtgggctttctgctggcatgggtctgctagtggaagcaaagaaagagatagatacatattccaagggaggccccaattcatttgcagatttgatccaaatgggagcatcaccagccacttaagaaaacattccttgatgcggccattgccaaaactggggggaacgaagagaagggaagaaccctatactcagcatacggttcaagtggccagtggggtttcttcgacaaaatgttcgggcgacacgacgcacaggaacctgatccagagggcagggtgcctcagtggagcaccgcttctgtccaggaaatgaaggacaagtttatctccgtcggtctcggtcctcgtcaggttgctgtgatgtcggccttcttcggacctgaccaagctgccacggaggagaaactgatcgctgatccagactgccggccatgggtcgagaagtaccagcgcagtcgcgagacggtctcccgaaccgactacgaggttgacctgataaccgcggtcaccaagctgagttacctgggccagaagataaactacgaggcctacacataccccaagcaaaagattaacttgggtaaactgaagctgtgattgatgattgcgctgggcatatctgcgagcgattgggtgtgtatggagaatgagtttgatatggggagagttaatgttttggcttgagtcttgtcgtgttttggaaaaagaaagatttattgcttttgctctctgcgtcatagatgcacacacatacctttttttagttgttggagctgattctggcagatccatcagtagggtatcccagcgaggtgagtagatcggcaggagaccagatttacctaggttcaggtcctccttacgaggtaaaaccctactcggcctcggcttatttttagttgtatgttgtctatcgactagctagcttatataagatattgcggcccctgggttgcacaaacctagtcagctatgtccccctaaaaaaaaaaaaaaa

SEQ ID NO: 18254 - DNA, 771 bp, Triticum aestivum
  unsure (1)..(771): unsure at all n locations
  Clone ID: PAT_TA_18254
gagnagatttatacccctgntcgaaattaaccctactaaagggaacaaaagctggagctccacccgcggtggcggccgctctagaactagtggatcccccgggctgcaaaaacttagccctattctacgactgtccccgcgtggccgccgccaatggcgtctctgctccgcctccaggccctcttctcccttaagctggccactccccgccgtctcccatcccatctccgctgtgccgcagcagttgcgtctccgctccctcgccgcctccctgctgccgcctcgaacggctcgccggagcagcgggcctcggaaacggatttggagtcggggttgtatctagtggcgacacccatagggaacctcgaggatatcaccttgagggcattgcgtgttctgaaatgtgctcatgtgatactctctgaagacacaaggcattctggaaagttacttcagcattacaacatcaaaacacctcttctcagcttccataagttcaacgaacgagagagagagcccattatcttaaagaggctccatgaaggggaagcaattgcagtgattagtgatgctggtactccaggcatcagtgaccctggcatggagctggctagactatgcgcgactgaaaaaatccctgttattcccattcctgggccttctgcagcaattgctgctctttctgcatccgggtttgccaacagaggaattcacatttggggggtttcttaccaaatcatggccgatcaagaacccggtaatcattctttc

SEQ ID NO: 18255 - DNA, 960 bp, Triticum aestivum
  Clone ID: PAT_TA_18255
gcccttcgccgtccccgccgaataccaccggttccccttgccgccgtcctcctccgccccggcagcagcatcccggggcagcgctggcggcgatgtcgaggaggggatcgtcatcacaacgcccctaaaaagaaaagctccatgtgagagaaagcgtccgcattgagtcaactgaatggatgataaccagccctgggtttactgaaggagttagcagtccacatatgacccctatctctggaaaagctgctaggacatacaaatcaaaggctaaaggcagcaaagatggactgcagacccctatatcaaatgctggttcacctggtactccactcactcctggttcttcccgcgctgaacattcattaggggaattgactaaaaagttcatcagtttgctcaagcaggctgaagatggcattttagatttgaataatgttgcagagatattagtggttaaaaaaagacgcatatacgacattacaaatgtccttgaaggaattgggctgttagaaaagaagcttaagaacagaatccgttggaggggtttggatgactcaggagctaacttagacaatgaaatttcaattttggagacagaacttgaaaatcttaaactccaagaaaaagcattggataatcgtataagtgaaatgcatgaaaaggtgagggagttaactgaagaagagaacaatcagaggtggctataccttaccgaggatgacatcaagggattgccctgctttcagaatgaaacactaatcgcgataaaagcacctcatggcactacactggaagtaccagatcctgatgaggctggtgattatgtccaaaggagatacacaatcgtaataaggagtacaatgggttccatcgatctttacctggttagtaaatttgaggaaaacatggaagagctggttggtgtcacaacgcctccaaggcatgcaaatgtggccg

SEQ ID NO: 18256 - DNA, 1094 bp, Triticum aestivum
  Clone ID: PAT_TA_18256
gcacgagggcgcgcgctcccgctccgcagggtcacgcgcgcgcgcgtacacgcgaacagcagtgtcacgagcacgaccgacggccatggcgagcggcgacccgaagccggacgaaaactactcctccgatggcggtgacaccaccgacgccgagtcctccgacgagtccccgcatcagccgcggaggcccccccgcgccaaccccatcctgacgcgcctctccgtgtcgcggaatccgagcccgctctccgccgccaccgcggcgcctggggtctgcctcctccgcttcgcctgggagtcggccgccggttccctcgtcggcgccgtcgttggatatggaaaaggtttggttactacaaaagggtttaaaggctcatttgctgacgctgcctcttctgctaagatatttgctgttcttgccggcgttcaaagcttggtttcttgctctttgagaaagctacgtggcaaagatgacgttattaacgcaggagttgcaggctgttgcactggccttgctttgagttttccaggtgcaccgcaaactctgattcagagctgtctggcctttggaactttctcgtacatcatagaaaagctcaataggcagcaacctgcgcttgcgctaccgtcagccgctggcttaacatgccgcacgatgcgatggaaggcttctctttgtttcacacctttttttcagagttccgagaaagctgaaggacctgggggcatgatactttgatgtctgtgcatgtaaatgcatcgggctgagctttttggtttccagtttagtgtatcgcgaaggatgatcattctactctgcctttgaacggtttggcaatttaccctcgaggagcattctactttgcctttgaacagttttgcaaattaccctccagaaggaaatcagcttagctggtgcccaacctgatgaataatcgtgtataacctgggcagcagattgcctgaacctttgtgatagtcctttactagcgaatgctcttgtatatgacgggtactcggtaatgtttcatcaggtctcagaataagactagactggtaattatcaaggattgtcattttatttaaaaaaaaaa

SEQ ID NO: 18257 - DNA, 578 bp, Triticum aestivum
  Clone ID: PAT_TA_18257
cgtccgctcgcccccgccatctcatcgacggctcgaagccgaaccctcggcaagtaaaagatacctaaccctagctcgtccgccatggccagggaggcgtcgtcgtcctccgcgccggggccctcggagttgccgccggccgctcgtggcagcggcagcggaagcggaagcggcggggacacgccgcgagtgccgcggcggcgcgcccgcggcgacccgctcctcatcgtgtgcggctgcttcagcgtcgtcacggccgccaccgccttgctctgcgtcgccgtcaacgtcctatccgctgtccagtccttccgccgcaacggtggctacatattcgggggcatattccggtgctatgcggtggtgatctcgctattcgtggccgtcctcgagactgagtggggattcatcatcaaattctgcaagatattggaatactggcctgcaagggggatgctacagatatttgttgctgtcatgacaaaggcatacccaaacgttgaaaggagcgatctgattttgcttcaggacattgccagctatctgctccttgcatgtggactaatctatgtaatctc

SEQ ID NO: 18258 - DNA, 1051 bp, Triticum aestivum
  Clone ID: PAT_TA_18258
gccggccggtccggcagatcaatcgagcctgcccttctcgctcgcgtccccactccatttccctttcccccgaggaggctgccgccgtgacctgagagcacacgcacgcaccatgtggcgccgcctccaaaccctagcccccgccctccaccgcgctgccgccgcagccggcgcggccccctccccggccagcgcccgggccgctcccctctccacggcggtcgcggccttccgccgcactgggcccctcctctctgcggacaagccggcggcggcagggacgagtgtggaggacgtcatgcccatagccacggggttggagcgcgaggagctcgaggcggagctccaggggaagaagcgcttcgacatggatcctcctgtcggtccctttggtaccaaggaggcaccagccgtcattgagtcctattttgacaagagaatagtaggttgccctggtgatgaaggagaggatgagcatgacgtcatatggttctggttgaaaaaagatgagccacatgaatgcccagtctgctcacaatactttgtgcttaagggcaattggtctatggtggaaatccagatgggcatgatgatgatgatgatggtcatcaccactaaggatatccatggtggttctgaaaataagaattttatgaggcatatgatttcgcttacgctgttcttaagcaccagactgctccacggcatccttgtttatgaatatacatttgcccagcaagcctggcggtagttttcgccttaggtttttttgtggaaacaatactcttttcagatttttccagtgcatgtgttatggagcaacatctaataacgagatggtctgcagaagaattttaactattgctactgagtagcaaatgggtgcgatggacctgtacttatgcaactgagcaggaattggtggctatggaagttaccaaataaatcatgcaagaaattatgttgtgcagttagcaaaatatctgttaaatttaaaacctcacccaatcctgtcccgtttcatcgcaattgttttctcaaaaaaaaaaaa

SEQ ID NO: 18259 - DNA, 1417 bp, Triticum aestivum
  unsure (1)..(1417): unsure at all n locations
  Clone ID: PAT_TA_18259
gaattcggcacgagcagaagttggaggaggtcaagacgttcatctaccagatctcagcaaagtgctggcatgctggatatctcaaattcgattcctttcgacgatgaaacggaggacggaaaaagtcatgaactcaaagtactctccctggaccgcattaaagctgctactggtagtttcagtgaatccaacaagcttggggaaggtggatttggcccggtttatatgggaacattaccgggtgcggcacgagtagctgtgaagaggctttgtaagaactcaggtcaaggccatgaggagttcaagaatgaggtcatactgattgcaaagttgcagcaccggaatcttgtcagactattagcttgctgtatacagggagaagagaagatcttggtttatgagtacatgcctaacaagagcctcgacgcatttatctttaatcctgaaaagcgaggtctcctagactggaggacaaggtttgatatcatcgaaggtattgctcgaggactgctatatctccaccgggactcaaggctacgtattgttcatcgtgatctcaaggccagcaacattctcctagacacagacatgaaccccaaaatatcagatttcggaatggcaaggatttttggaggggatgaaaaccagttcaacacgaaccgtgtggtccgaacattcggctacatgtcccctgagtacgccgtggaaggcattttctcggtcaagtccgatgtctatagcttcggagttctgatcttggagatcattacagggaagagggctgtcagctttcatggccagcaggagtccctaaacatcgcgggatatgcatggcaacaatggaacgaagacaagggcgaggaaatgatcgatccgttgataaaaccgtcgtgctcgattcgacaggtcctgaggtgcatccacattgcattgctatgcgtgcaagatcatgcccaagagcgtccggacgtgccggcggtcatcctgatgttgagcagcgacagctccagccttcccatgccgagggcgcccaccctgatgctccgtggccgtgctcttgagtcgagcaaatcaagcgagaacgagaggagccactccattggcaccgtatcaatgacacagttgcatggaagatagcatggcaggggcagtatatactgaagatatcatgtctttctttttctccaaatgttatgttgcaatgctggtgttttctgtagattaggatctgggcagtttgaggaagcccaatgtgtacgaaagaagatattcatttatgtcatctgtaaagtcggaatgaaggtccattctcaagtttagttaaaaaaaaataaaagcatgacaaaaactgaaagcgacccaaatctctgggttgacggcgaggctcggctgtactcgtgtatanatctacatttnc

SEQ ID NO: 18260 - DNA, 966 bp, Triticum aestivum
  Clone ID: PAT_TA_18260
ctgcacgaggcttcagacgagctgtttcctctcatgtactcactcaggctcgctaccagcggcagcacagcactaggcttcacgctcggccggttcggcgggaagacaggcggcggcgccgcagcaggaggactagcggcacccgcagcggcggcgcacgtagggaggaggagcgtctccgcgacgtcgcactccgccgcgccggtgccgggcgaccagggcgtcggcatggacccgggcaagcagcagcagcagcacaagccccacgcgccggcgggggagcagcagggcgaggacgtgcacaagaccactactgctcacggggacgtgatcgacccactcgttcggggaggggtactcgacgaggtcggacgaggaggggttcggaggggtctacggccagaacgaccctgtgctcaaccctgggaccgaagtgcacccagaccatcctgactatgacaagtcgcagggatcggaggtgaaggagaaggagaaggcgcgccatctcaaggacgacaagcacgcgacctgagatggaagtctagattgctaggtggggatcaataatttggattatcgtagctgttcagtgtttactttgctttgtttggtcgccatgaggtgccaggctgcttctttctgagcttgccacgtgctactgatcggcgctgaaatggaaagtgaaggctggctgtctcaagcacgacaagcacgcgaccttgggtgtgagtcttgatttcttgttggggagctctacctgcgtgtgtgggaggtgttcttcgtttcgttcgctgtgtttggtcctcaggcggtgtcaggctgctactgaagttcgctgtgatgtgaaattagtactggttgtaagcttattctgcaaaaaaaaaaaaaaagcgtgcgtgcgtgctgacttgatttgcttgtgctcgtgctgcttgtgtgcgaggagaaattcgctaggacgagtgt

SEQ ID NO: 18261 - DNA, 1418 bp, Triticum aestivum
  Clone ID: PAT_TA_18261
tcgacccacgcgtccgatgacattctccctggatttgaacgcatcaccattgcctgaagaagaggatgagcagccttatgaagaaccacctggtgaggctgattatgcgcatgaggaggaacatgttgagtctgctgttgcaacattgcgaagggagcgtgaagagaggcggaggaaattgaagagagagcaccaggatgaaggctcaatgcaacaccctcagcagataaggaatgattatgcacctccaatcaaagttggtagaggccggattaaagaggcacctgagggttggttggattgtcctgcatttggtgagccaatagataaaatcataccctccaaagttcctcttgatgaaacattcaatgaatcagttcctcctggcaaaagatattcttccaaacaagtagtaaacaagcaaagaaaagctggccgtgaaatagggctggtgattgatctgactaatacttctcgatattactcaccagcagagtggacaaagcaaggtactaagcatatcaagattccttgcaagggaagagatgctgtaccagataatgaatctgttaacacatttgtctatgaggtgatgatgtatcttgaacgacaaaagcataccaagactcccaagtatattctagttcactgtacccatggtcataatcgtacaggtttcatgattattcattacctcatgcgtacacgcatctcttgtgttgctgaggcaatacgtatttttgctcaaaggcgacctcctggtatatataagagggactacattgaagcattgtattcattttatcacgaggttcctgagaatataattgtaacatgcccttcaacaccagaatggaagaggccttctgatcttgatctaaatggtgaagctaagccagatgacgatgatgacaacggtgatgtttcaccagtacataatgatgtagaggagaaagtcatcactaatgatgatgtgctgggagacgctgtaccttttgatcagcaagaggctctgcggatcgtatgctatcgtttgcttgaacttccccctgcgagagggcatgcacaatttccaggatcacacccagtctctcttgacagtgataatctgcagctacttagacagcgatactattatgctacttggaaagctgatggaacccgatatatgatgcttataatgagggatggttgtttcttgattgatcggaatttttgctttagaagagttcagatgcgctttccccataggaacctgaatgaaggtccacatgatatgacattgattgacggggaaatgattatagatacagtacctgattcgcgactgcggtagaggtacttagcgtatgatctgatggcacttgattcagtgtccaagacaaagttgcctttctctgagaggtggagattaattg

SEQ ID NO: 18262 - DNA, 1045 bp, Triticum aestivum
  Clone ID: PAT_TA_18262
atagcattttacggccccccttctccccccgccccgcctccccgccgcgcccccggggcctccgcgccgcccgcctccatggcttcagccgcgacgtttccgaagctccagcttggtccgcgatgcctcggcttctcccagcttcaggcgaccgacccggttcatatccacatgaagattggtgatgcctgcaagtgcccctatgcctgcccaagggttgcttgtttcgaccgggagaagtgcgaggcacacattacctgccggtgtcggcggctcgatcaggtcgggccgcatcggtcgccgaggccgagaagaccgggctctcgctggatagcttcaagacaaccgttgtcaaacgtgacgaagaaaagatccatttaagaatcgagctgcccgggaaggaaacgcagaaggtgtttgatgcagccctgacgagcctggccaaggacgcgccgccggtaccaggtttcagaaggtccaagggagggaaaacatcaaatataccaagcagcattctcctgtcgatgctcggcaagagccgggtcaccaagttcatccttcaagaaatactcagcgtcaccgtcggcgatttcgtcaagaaggagaacctcaaggtgaaccctgagatcgcgacgacgcaatcggaaggcgacctggagtcgtcgttcgcgccgggctcgtcgttcgggttcaatgtgatcctggagctggagaaggagcctgacaccgatgacgccattgatgtggagctgtccgactccatggacgctcctgacgtgttgcagtccgactctgaagagccttctgaagaggagcctgcctcctcctcctgatagttcagagagaaaatgcctctgtgtatttattccctgatgaatgtgctccagattcagaaatagcattagcaggcaaacaattgttcagataaaacatttgagatgatctgcaggttgcgggtgacacatcactgaagatatgtgtgtagcagcactgagcatgcagacacgttagatttgggggaaaaaaaaaaaaaaaaagcccctag

SEQ ID NO: 18263 - DNA, 415 bp, Triticum aestivum
  Clone ID: PAT_TA_18263
cgtccgggcggccggagccactccccctcccccttccctttcacccactcgatatcccccgctagtccacgagcacttctcggagatggtgagattgatttcaccggttccgcaggcggtgctcatggcggtcggagatcggaggtgggtggaaagggcgaccaggatccgggacactaccttcgtgtggatccagcgggttcaagagtggaaggtggcagatcaggcggtggtggcggcaagagatccagagacgcgagctgcggcggtcaggtatgcagaggtttgtcgtttgagggcagaggtagagcagaggattttggcgaagaggatctacgacgaagcctctgtggcggagagacgaaggatgccttccttccctctctcccagtcagccgatttcatccagtgggcg

SEQ ID NO: 18264 - DNA, 954 bp, Triticum aestivum
  Clone ID: PAT_TA_18264
cggccgctgccggcggcgggcggggttcccattcacaccgtcacaagtatactctcgagaacaacaagagcggcaatcatccatggcgcccactcgcgtcctccacctcatcgccctcgtcctcgccgccgccgtcgcagcagatgcggccaccatcaccgtggtgaaccggtgctcctacacggtgtggccgggcgcactcccaggcggcggcgcgcgtctcgacccgggcaagtcgtggcagctcaacatgccagccggcaccgcgggcgccagggtgtggccgcgcaccgggtgcaccttcgacggcagcggccgcggccggtgcatcactggcgactgcggcggcgcgctggcctgcagggtgtccggccagcagcccaccacgctggccgagtacacccttggccagggcggaaacaaggacttcttcgacctgtccgtcatcgacgggttcaacgtgcccgtgagcttcgagcccgtcggcggttcgtgccgcgctgcgcgctgcagcaccgacatcaccaaggagtgcctcaaggagctgcaggtgccgggagggtgcgcgagcgcgtgcggcaagttcggcggcgacacctactgctgccggggccagttcgagcacaactgcccgccgacgaactactcgaagttcttcaagggcaagtgccccgacgcgtacagctacgccaaggacgaccagaccagcaccttcacatgtcccgccggaacaaactaccagatcgtcctctgccccgcccgaaatgatttacacatggatcagtaagtagaggacgtactactccttgtggtcttccttacttatgatgatcaacgatcatttctgtgtgtgcccatatataatgtcacatgtgcgtgcgtgcatggctggtgcgtgccattcagcgaataaatgtataaataaaatggaaatgtaatttctacgattatgtg

SEQ ID NO: 18265 - DNA, 1125 bp, Triticum aestivum
  unsure (1)..(1125): unsure at all n locations
  Clone ID: PAT_TA_18265
nnnnnnnnnnnnnnnnnnnnnnnnnnnnnnnnnnnnngccccnnaataaaagccgatataccaccggccgctcgggccggccgggcccccccagccgcaccacatgcaccactcaccaccgctgcacgcacactaccgtcacaagtcgtcctctcgagaacaacaagagcggcatcacccatggcgtcctctcgcgtcctccacctcatcgccctcgtcctcgccgtcgccaccgccgcagacgcggccaccatcaccgtcgtcaaccggtgctcctacacggtgtggccgggcgcgctcccaggcggcggcgcgcgtctcgacccgggcaagtcgtggcagctcaacatgcccgccggcaccgcgggcgccagggtgtggccgcgcaccgggtgcaccttcgacggcagcggccgtgggcggtgcatcacgggcgactgcggcggcgcgctggcctgcagcgtgtccggccagcagcccaccacgctggccgagtacaccctgggccagggcgggaacaaggacttcttcgacctgtccgtcatcgacgggttcaacgtgccgatgagcttcgagcccgtcggcgcgtcttgccgcgccgcgcgctgcgccacggacatcaccaaggagtgcctcaaggagctgcaggtgcccggagggtgcgcgagcgcgtgcggcaagttcggcggcgacacctactgctgccggggccagttcgagcacaactgcccaccgaccaactactcgaagttcttcaagggcaagtgccccgacgcctacagctacgccaaggacgaccagaccagcaccttcacctgccccgccggaaccaactaccagatcgtcctctgcccttagattaggacgcgttgaaggatcaaaagtatatataatagctgggatcaataaggaacaaggactactctgagtagtctacttatatgtatgtgccatgtcacatacatgcatatgcacgactgtgcctgtatgttgaccaataataaataaatggttaaataatagtataagtaaaaaaaaaaaaaaaactgtgccttgtatgttgaccaaataataaataaatggttgaatgttaaaaaaaaaaaacggcacgagctcgtccgaatc

SEQ ID NO: 18266 - DNA, 2243 bp, Triticum aestivum
  unsure (1)..(2243): unsure at all n locations
  Clone ID: PAT_TA_18266
cgggcctcaccgccgccacgtcatacccagcccggaccgaagagcccccgtcccctttctcctccacccggctcccgctcccgctcccgctcccggggcactcctctgccatggcgccccctctctcctcctggccatgggcgagcctgggcatatacaagtacttcctgctgggcccgctggtgtggaaggtggcgcaggagtgggcggagcagggcggcgcgccgctgggcgcgccgtgggtgccgctcctgcagctcttcgccgtgcgcggggtgacctaccagttccgggtctcctacagcagcatgctcttcctcacccgccgccgccgcgtcgtccccgacctcgtcgacttccgccaggtcgaccacgagtgggactgggataacttcctggtgctgcaaacgctgattggtgcggcgctgtgtcaacggcccgctgcccctcccatcgggatcgaacgatctccgcgtgtgggacccgcgggggctgggcatcgcgctgctgctgcatgtgggcttctcagagcccgtgttctactgggcccaccgggccctgcacggggccccgctcttcggccagtaccacgccgggcaccactccacgccggtgacccagccattgacagctggattcggcacgccgttggaggccctgctgctgacgctgacgacgggggtcccgctggcaggggccttcctgatgggggctgggtccctgggcctggtctacgtgcacctcctcacgttcgactatcttcggagcatggggtacagcaatgtagaggtcatctctcacagggtcttcgaggctcttcccccgctcagatacctcatctacaccccgacgtatctgagcctgcaccacagggagaaggactccaacttctgcctgttcatgcctctcttcgacctcctgggcggcaccctaaactccaagtcatgggagctgcagaaggagatctaccaagggaagaacgatcgggtgccggagttcgtgttcctggtgcacgtggtggacatcatgtcgtcgatgcacgtcccgttcgtgctgcgctccatctcatcggtgccgttcgagaaccacctcattctgctccccttctggcccgtggccctggtctacgggctgctcatgtggtgctgctccaagaccttcctcgtcagcttctactacctccgcggccggctccaccagacctggagcgtgccccgccacggcttccagtacttcatcccggccgccaaggccggcatcaaccgccagatcgagctcgccatcctccgcgccgacaggatgggcgtcaaggtcctcagcctcgccgccctcaacaagaacgaggcattgaatggaggtggcacactgttcgtggacaagcaccctgacctgagggtgagggtggtgcacggcaacaccctcacggccgccgtgatcctgaacgagatccccagcaacaccaaggaggtgttcctcaccggcgccacgtccaagctcggcagggccatcgccctctacctctgccggaaaaagatcagagtcgtgatgctgaccatgtcgtcggagaggttcctgaagatccagagggaggcgcccgcggagttccagcagtacctcgtgcaggtcaccaagtaccaggccgcgcagaactgcaagacgtggctcgtgggcaagtggctgtcgccgagggagcagcggtgggcgccgccggggacgcacttccaccagttcgtcgtgccgcccatcatcgggttccgccgcgactgcacctacggcaagctcgccgccatgaggctccccaaggacgtgcagggcctcggctcctgcgagtactctatggagcgaggggtggtgcacgcgtgccacgccggcggcgtggtgcacttcctggaggggtgggagcaccacgaggtgggcgcgctcgacgtcgaccggatcgacgtcgtgtggaaggcggcgctcaagcacggcctcacgccggtgtgatgtgatcgctcgtcgtcgacgcaggtgaagcgcaggtgcagaatgcagctgaaacgaagcaactaagatcgctccctcctccatccatatgtattgttgtactccattcatgtcaaatgtaccactaataccggcttgacaagagagagactggattaattgaaccacccaaggacagcacacttgttttgattcgtcatttttctctatgacaagnnnccccaaaagggacagtagagtttaaannnnnaaannna

SEQ ID NO: 18267 - DNA, 699 bp, Triticum aestivum
  Clone ID: PAT_TA_18267
tcggcaccgtccgcgcgcgctcacctcgcagtaaccatgccgctgctagctccagcagctaaaaccctgttcccctcccggctcccgccttcgcctcgcctccacctccgccgcgccaccgccaccgctgccggcgggaggggcgacggtgcggcggcagtgtcggcggcgtccggcacgtcggccagggaccggcggctggccagggtgcgggaggagcggcgccgccgcgagtacgaccgcgagcacacctaccccggctgggccagggtcctggagaacgcctgcagggacgacgaggagatgcgcgccatcctcggcgacagcatcgggaacccggagctcatgaagcagaggatacaagagagggtgcgtgccaaaggcagggaggggttcaacagacccaagacgggctccgtcgctgcgttcaaagtcagcttccgagacttcaacccgttaaatgctttcatctggtttgaactctttggagaaccaactgatcgagatgttgaccttcttggcggtgttattcaggcttggtatgtcatgggaaggctaggagctttcaactcttcaaatttgcagctggctaactcaatgctggactttgacccttcgtacgattctgaagaagcttctgctgtaatgccttcatctttccatgatatcagtgatgtcgagtttcaagacagttggggc

SEQ ID NO: 18268 - DNA, 1176 bp, Triticum aestivum
  Clone ID: PAT_TA_18268
gcacgaggcacgcgcgcccgcccgccccgctgtcctccctccccataccgcccgctccacctctccccaaatccgattgcccccgcaacctaggagctccgctcccccacgcctctcgccccacctccgatccctccacggcctcctccggcgacgccgccaaccgcaccaccggtccccgaatctagggttcccccgcggccggatcacgcctggaggcctccgacgatgctgccgtgcgcgcggtcggtgctgcggaggagggggctggccctcctgcgcgggttcgccgagggcgagtgcggcaggggggaggcgctcgccaatgccaggtgcgcggccacgctggccgggctaggcggcgcccgcggcagggtcgggcgctgggccgatccgccggcgcgcggcgagccgcgccggttgggcgcgggctggcccgcgggcgcgcagacgaggagcttcctcgggtgcggcgacggggaggaggggagcgtcctctccaaggtctacgaggagaggcgcgtgatggggtactcgccggagcagatgtatgccgtcgtcgcggctgtggacctctacgaggattttgtgccctggtgccagcggtccagggttattaggcggtatgacaacggctcgtttgacgccgagctcgaaattggattcaagttctttgttgaaagctatgtctctcatgtggagatggagaagcccaaatatatcaagacgactgcgtctcaaagtggacttttcgatcatttgataaacgtttgggaattcaagcctggtcctgttcctggaacctgtgacctttacttcttagtcgattttaagtttcagtcacccctatatcggcaggttgcttccatgttcttcaaggaagttgtttccaagctcgtgggctcatttagcgatcgatgttttagaatttatggacctgccgttcctgtgctggaaaagtcttacaggcatggaagataaacacaaataatccaattttgaagaatctcttcatggtaacttgtctcggtaaactacaatagaggatgaccatgcatatagtccatttgtgatgtcacggttccgttagggaagtgggtctcgagggaaattggccagaattttcactctttggctatttctgcagagagattttttatgtacaactagtttact

SEQ ID NO: 18269 - DNA, 562 bp, Triticum aestivum
  Clone ID: PAT_TA_18269
gtgcaggtacttcgcctccgggcatcttcgtctccggcgtttctcaaaaaataaaataaaaaaattcttcgtctccggcgagcaaatcggcgactaagaaggggcaggatgggctacctatggcgggtgcggctctcgtcgttcgcggccggtgcatcgacggcttcagcggtggggttcttgctcctttacaaagaccacctcctggcccgcgccgccatcgcccgacaggtggaggatgtcaaaagaatttctgaaaagcactatgaagcactgaatcatcagatctcagctctggaaaacagaaaagaatcaggaactaataaagaggcatcagattaattatgcacgttggttgtgtacaatggttaaacaactgccaatgtaatttgtggttgctgcatgcgtattactgcagcatttaagctgtagtaccattttgttgttcaaattgctatgaatcctcattgtcatcttcatggctttgtgagatggacagagaccaataagaaacaattttgtcgttaatgagtcagcctatctcattgttagaaaaaaaaaa

SEQ ID NO: 18270 - DNA, 637 bp, Triticum aestivum
  unsure (1)..(637): unsure at all n locations
  Clone ID: PAT_TA_18270
gaantttgatncgtcaagctcgaaatnaaccctactaaagggaacaaaagctggagctccaccgcggtggcggccgctctagaactagtggatcccccgggctgcaggaattcggcgcgtctccgccggcccccgacgccccctccggcgagtagaccagacccctctccaccgcgccggatccccgccgccgctgacccccttcgcctcccccctcgttggcgaaaccctcccctccgccgccatgctgctgggcgccaaagtcgtaccccgcgacaaggctgtgccacaaggaggcggcgacggctcgggatccgacggctccgccgggaagacgcgcaccaagcgtagcagcagcaagaggagagacaaggaggagaagcggaggcggaggcaccggcggaggagccggcgcaggtcggacagctcggaggaggggtcggacgactcggtcgacgaggaggaggagaaggagctgagccggagcaagcgccgtaggaagcagcgccgcggggggcgccgcgacttctccgacgaggatgaatccagcggcgaatctgacaaagggagaggcagtggcaaggggaagcgaggaggcgctgcaagtgacgatgatgaggatgaggatgaggatgaa

SEQ ID NO: 18271 - DNA, 483 bp, Triticum aestivum
  Clone ID: PAT_TA_18271
cccacgcgtccgcccacgcgtccgcccacgcgtcccctgaaatcaaaccaagatcgagcggaagcacggcagcaagcaatggaggcgctgctggagctagagaaggtgcagagggtgctctccctcatgggctcccgcggcctctccgactccgacggcagcggcggcggggaccgcttcctcgcccacttcctcctcttcctggcacaaccgtttgattcacttgccattgagaagaaggtcgtattaatctctgagcttttgagagaggttaattctgatactctcaaagaagtgcaacgtctagccagtctggaaggtactaatagggaagatgaagtaagattattcccactataccttccaactaagaagttcaagacggatgccgagaaattaaccattcaggatgcgcctatgattggattcgatgcaatgatgagagccaattccacgcttgaagatttttgcaggtcatacttc

SEQ ID NO: 18272 - DNA, 532 bp, Triticum aestivum
  Clone ID: PAT_TA_18272
cgtccggccggcgtggaggtggcgctggtgcaggaggtgccgggcaccgtgcccgggcggtcgtacaggctctcgttcagcattggggacgcgcgcaacgggtgcgtcgggtccctgggcgtggatgtgtacgcggcgagggagaagctgagggtctcgtacgagtcccgcggcaccggcgggcacaagtgcgccaagctcgagtttacggcgatcgcgaacaagacgcgcgtggtgttccagagctcgaaccaccacaccgtcaacgccacgctctgcggcccgtcgttgatgacgtctggctcgtcaggatcaagtagctagcttcgagcgtacgccgtccgtacgtgttagcatgttacctggctgtgtgcggcctgccagtacctgtatacccgatatgggggctgcctggccattttctccgggcgtccgggctggttcctgggcttccgctcttctcgacggcctcttcttgatggttgggccttggtttgggggcctggactgagacttgtgctagacactgagg

SEQ ID NO: 18273 - DNA, 2229 bp, Triticum aestivum
  Clone ID: PAT_TA_18273
gcacgcgtccgcggacgcgtgggcggacgcgtgggcacctacatcagcatcgccgaccaattcaacaacctcggcacccccgcctggctgcgggccacaaacacctacccggccaacaacatccccgacgtcggctccgtcaacgtcaccgtcaactgctcatgcggcgaccctgggatttccaccgcttacggcctcttcctcacatacccgctcagggacagagagaccctcgcctctgtcgccgccaatcatagcttctcgtcgccggagcagatggacctgctcagaaagtataaccccgggatggatggtgtcaccgggagcggcatcgtgtatatcccagccaaagatcccaatggaagctaccttcctctgaaatcacaagggcaaaattggtcctcccgggagctaattattgctcggtgttaagggaaaaaaagttcagcgggagcaatagcaggaggtgttgtggctggtgtacttgcactagtgctgggtgttgtgttattcttgttttataggcgaagaaaggcgaaacaggacgctttgcttccatcttctgaagaatctacccgtctagccagtgcagtatccatgcagaaggtgacaccatcgagcagtcaagctgatggagcttcaccagctgctggcattacagttgacaaatcagtcgagttctcatatgaagaactttttaatgctacagaaggctttaacataattcataaaattggacaaggtggttttggtgctgtctattatgctgagctcagaggcgagaaagctgccataaaaaagatggacatgcaggctactcaagagttccttgctgagttaaaagttttgacacatgttcatcatcttaatctggtgcgcttgattggttattgcacggagagttctttgttccttgccttcgacttttgcgactttgccaccttgcgccaccatttgcgccgtccgggttatgagcctctttcttgggttgaaagagttcagattgcactagattcagcaagaggtcttgagtacattcatgagcataccgttccagtgtacatacatcgggacattaaatccgcaaacatattgatagacaagaacacccgtgcaaaggttgcagattttggtctaacaaaacttacagaagttggtggtggtacatctttgcaaacacgtgttgttggtacattcggttacatgcctccagaatatgcccgatacggtgatgtttctcctaaagtcgacgtctatgcctttggtgttgtcctgtacgaactcatttcagccaaagatgccattgtccgatcaactgaatctgccagtgattcaaagggattggtttatctgtttgaggaggctctcaacgcaccggatccgaaggaaggcctcaagaggctgatcgatccaaagctgggagacgattaccccatcgacgccattctcaagatgacgcacctggcgaacgcgtgcacacaggaggaccccaagctgaggccgacgatgagatccgtggtggtggcgctgatgacgctgtcctccacgagcgagttctgggatatgaacgccctctacgaaaacccgggcttggtgaacctcatgtccgggagatgacctcctctctttagccacatccacatgcctcccctggcgttgtacatcggggttctacagtcaaatgcgggacgataaggcggcagtgacagcctgacagcatcgattgttttggctatatcttcgacgtgtaatttcccatcggtatagattctttttattctccttttatttatgcccgagttcatatttttcttcttcttggagaccttagcgccacgttcatctgagttgtatcattgtatgtgtcaagtgtaatatattgacgtggcaatggaaatagctaataggccttggaaaaaaaaaaaaaaaaaaggcccctaccgcaccccggcgccccatgcccaccctcgcgtcgttcagccgggtgcgacagcctgacgccggccgttgtggcggctgtgtctccccgacggcgtcgttccctttggctcgtttccttcgacgtgtcacttccctttggctcctttcgattctccttttatttatgtccgagttcatatttttcttcttggagaccttagcgccacgttcatgtgagtagtatatgtcaagtgtaagtaatatatgtacgtacgtgtttattttgacatggcaatggaaatagctata

SEQ ID NO: 18274 - DNA, 803 bp, Triticum aestivum
  Clone ID: PAT_TA_18274
ggcacgcgtccgcccacgcgtccgcccacgcggccgtccaagcggtcgcgtacgcgcgaatcgcgatcccctttcccctcgccgtcaccacggttccaccccgcagaagaggcgccgccgcccgatccggtgccgatgccgcagaagaggcgccgccgcccccgcaggaggtctccccgcgaaggatcctcccgccggctccgtggtgaagatggcgcatcgttgtctggatcccttgtcgaatcggatgggagcagcagcagcagcagcccgagttccggctcaccgtccctcgacgacccgtcggacacccggtcgtctcgcaggtacgagtccaggtaccatgagatcctcgcctcgcgccttgcccaactgcctctaccagcctgcgccgacgacgatggcccagatctcccttctgatgaaactgtcgaagccctcgttcgttcttctttctatgatgacgagctgcgggctgctttggtagaataccaagcccacaacttcttcttgggcggaccagacgtccagggacgagatggagattctggagaatttgattcctcctcagtgattcacgatgtcacccaggaggatctcttggcagacaatgaacggctcaggtctcacatacatgatgaaattgacaccgagtctcaattggatttagaggagctggacaggctctatcacaagtatgcacgatatcgcctcaaagcttgcatgttgctgaaaggaatgcctattgacgatgctgcactgggaatgccagtacatccaagagttgccttggattacctgaa

SEQ ID NO: 18275 - DNA, 1871 bp, Triticum aestivum
  Clone ID: PAT_TA_18275
cgtccggcgacctacaacttcttgacaatggtgggccacagccgaagcggaaacgggtcacgcaaattgctcggcagcggcgatcagggcggtgccgtggccttcgggtctggttcggacccgtcgaagaggttccacgtcgcccttacggcgacggatgcgctgtacagccagtggcagtcgcggataatgtactactggtacaagcagatgagggtcaggcctggctcggatatgggcggcttcacgcggatccttcactccggaaagccggatggtttgatggatgagatacccaccttagtggttgaccccctccctgaaggcgctgaccggggttacattgtcctcaatagaccttgggcatttgtccaatggttgcaaaaggcaaacatcaaggaggattatatacttatggctgagccagatcatatctttgtgaagcctttgccaaacttagctcatggtgaagaacctgctgcatttccgtttttctacatcaaaccaactgacaatgagaagatactaaggaagttctttccagaagaaaaaggtcctgtctcaaatatcgatcctattggcaactcccctgtgattatccagaaggcccagcttgagttgccggtcggacgtcggcgctcttcgcggccgccgccgaaacctccctggcggaggcggccggcgaagagtactccccccttcgtcgtgagtagaagtgagtagtacttcctgctctccccgcgctctctgcggtgtcggaggttgaccgcgatctcagatccaccgaatccgattccccggcacgatcgagccgaatcgggagcccctaaaccctcaatcgtcggcggcgccgccgaaccacctagcctctgactccccctttactgggtgagctccccttttgctgtgatcccacgggacacgaggtgcagcccgcccccttgttggatcggagcgtcgacgatgatcgtcgggaggaagaatggctgcaaggcctcccaatgtttcgttaaaaatgaaaggggctgtggagtctgacagagcttttggatgggtcttggaaatgtatgcatatgctgttgcaagtgcattgcatggtgtgcaccacagcctccaaagagatgtcatgatgcagcctccatgggacgcaaaatcagacaacacattcatcatccactatacttacggatgtcactattcatccaagggcgagctgacttattgtaatattggtaaatggcgttttggtatcaggtcttatcttcgctcaccaccaccaagaaatctttcattaccccctccaggagttcctgaaagtgtggccacccttgtgaagatggtcaatgaggccactgcaaacattgtagggtgggacgacgaaatatgaatgatgattttgccagagaggagcttaattcatctgatgctggggtagaatcaaagaatctcaatgatcaataataccagagcattcaattcatgttctcttgagcggaggatggtggctaattcctacacattaacctagaatcagttgttgacaagagaatacgtagtcatttgatcctttgtctcatttttgggttgtaaagcagaaacataagctctccttttttagtctcctggtccattcagttgtacaacaaagcggaaatgaaggatccttgggttctctcataacttcccaccgtgggaagtatattacagcctggaacaaatcctggtggctgcttaagaacatcctgctgagtgatctgaatgataagctgttacccgcaaaccacccacgtcatgttccccggtccttttcgagggactcagactttatatatcatatgttgtttattttacctcacttcaaaaaaaaaaaa

SEQ ID NO: 18276 - DNA, 753 bp, Triticum aestivum
  Clone ID: PAT_TA_18276
gagccagcaaaagtttgcctcgaatgtcattgagaagtgtttatcctttgggaatcctgtggagcgccaaatcttaattggtgaaatgcttggatccacggaggaaagtgaacatcttgaggtcgtccggaaagaccagtttgcaaactacgtggtacagaaggtgttagagacctgtgacgaccagcagagggaggcgatcctcacaaggatcaaagcacatcttaacacgctgaagaaatacacatatgggaagcacatagtagcacgtgtggagaagctcgtcgcagcgggagaaaagcgactcgggctccaaccgtcccgtgtgctgcctgaagactaaagcatctctagctgtacagctaacagtggctaggtttgcatgctggcgtcttcgtttttccatctacaaggcgtcagggctatgcgtgcgccttgccatcggaaataaaatgagtaataggagccgaggagaatgtagattctgtagctagctgagtaaagatgtggagaatgagtaattacaggcttgttgttactctgctgtagaaatttagaactagagagagagggaaaagagaaagctgttagctgtaacctacttgagactgaaagccgttagcccttttaattttctgtcctgtggcagatgtaatggcatgttgttgtaacataacatatacagatggggatggtggtacttcaactgttttctctgcaaagctggagctatttatctaagctttgcctttt

SEQ ID NO: 18277 - DNA, 839 bp, Triticum aestivum
  unsure (1)..(839): unsure at all n locations
  Clone ID: PAT_TA_18277
gctgcccccgccactggcccagcccgccccggcggggcccctcgaggagctgccagcggtgctcgcgcctgagcaggggcccccggcggggggcgtgcggaattatatacccaccattggagcagcaagcgatagaggggagcgaagaagagcagccagaggagaacgcaggagaggagaaggtccggcggaggtggacgtcgagagcccggcggaaatcgcccggagcgattgagccgcggagtctccccgggcgggctggttcccggcggtcggatcgaagcggccctcaatctcggggcaccccgattcgattcggcggcacgggccgtgccgctgttgattaatccatttcggctccatgggatggcataggcagggctgtgacgtgatcttctcgcatggcttcatcctaggccaggtccctggcttgcttgccaagcctccaagttgtgtcgtcatctccagttgtggtaaccaggggggcatgattagtagtggcaagaatggtaacgttgcttccagtgggtctgaaccagaaatgccggtgtggttcggcccttccggtggtgattggtttcaattgatgatttgtctaggcatcgatttggacactgaaatggcaagatactgagagggccgtggaaaggaactggataggtgtactgcaggagcgattacagatttgggggtcttccttctcgctgagtatcagagattggttgcgatgggtttaccccaagtttcttcagtcagggaggatgtctctacaggatcaaggacacctgtgtcaagcccttcacgtaccaatgggtgntgggtgcctgcgatttggacgg

SEQ ID NO: 18278 - DNA, 913 bp, Triticum aestivum
  unsure (1)..(913): unsure at all n locations
  Clone ID: PAT_TA_18278
cggcccccccttcgtccaaatcttcccganancctccgtccgcccacgcgtccgcggacgcgtgggcgatccgccgacccagtggccgtcatgcgcgacccggcggagatccgcagcctccccatcgacatcgccttcgcccgcctgcaggagtggctggtcgaccgaaagcgggtgccgcaggactggcggaagcgccttgccgccatccgcgcccgcctcgccgccgccttctcctccctcccgcgggacctccacccctacctccaaaccctcgagctcgaagaaattgggtaccttgaagcaaagaagatatacagcatactcctggaatccaacaccgatagcaggaacatttttggccgcctgacaggctccgcgggcgaatggtattcgatcgttaaagcttatgagaaggaccatgttttccttggagaggcagctcagatcatggtccagaatgtgaactatgacataccatatcagaggaaacagatgcagaagactcagcagcagctagcagaactggaccgcagggaggctgacattaagcgacttgctgccctttcagcaactaggtatgcggaagcttgccaggagcttggtctgcaggggatagatgtgcggcaagaactggatagaatctgcaaaaacacttccatcaacattttagcaaaatccttggaagtccttgaccagtgatactgtctcacaggccatgggactactatacaacttttgtttagggactgccatactgaggataaggagaactacaagccgggggtacaccgtccgactcatttacgtgtancctccttccctggnactctcattatttaagagggcaaatcacttgggacaacaatggacggnggagaccanccaacctaagtcctgcantgatatgatn

SEQ ID NO: 18279 - DNA, 1029 bp, Triticum aestivum
  unsure (1)..(1029): unsure at all n locations
  Clone ID: PAT_TA_18279
ncnagttccgtttccggtgcgactgatcagatcactggtttttttcatcattttacaattatccttatatcagttgcctttgcgatccaacaggactaaaccagtacaaaattccttctcgtttcaaactcaacagcacccctacatttggcaaccgaagtagataggaaatatttcagagaagaagtgctcaggcatcatcaggcatgacgacgcatcttaaatgaatttggggagagtaatgacatttgcaagatcctgcgaggatagaagggttgcaagttaatttgtgaatgaaatacacgcatcgtttacgagtttaaccaattaataaatgcacatacctctttgatgtccctgcacgttgagtctggtttttcctcctacgtgtagctatgatgcagagcaccgcatcgatcaatctttgaagatgacggtgtcggcgatggccatgagcgggccaaggcagtcgggcgcgaacttgcgcgcgaacatgtgctcataggtggagctgttggactggcgcagctcggcgacgagccgcggcgacacctcgggcgcggcatacgtgtgcgggtggccctcgaagctgtcggtccagttgacgcgcgtgagcgtgtaccgggtgcagccggcggggtcggccatgtcgagaagcgtcgggaaatagtgctcctccgggtagcacgagtcctgcgactccggcaggcacggctccctaaactttcgccagagacggcgctcgcggacgactagcacggcgtggcgccgggccagcgtgaagaactgggagccgatgcggaaccggtcgaagggcacctccgggagcatggcgtcgtcaccgcgcgccacgtagcgcgcgggcatctggggctcgccggcgagcacctcgatatagctcgggaggcggtggtggtgcgcggccttgggcgggaagagcgcctcgtatagacacgggaaggagtggagcgggacgcantgctgcgagagcagcgcgaantaggcgttggcccggtcgtcgagtagcgc

SEQ ID NO: 18280 - DNA, 1261 bp, Triticum aestivum
  unsure (1)..(1261): unsure at all n locations
  Clone ID: PAT_TA_18280
tagcgtggtcgcggccgaggtgctgcttaataaacaaattgttggagagggtgcaagctcggcagattctacacaggctccagttgtgctacctccacctccacctccccctaggttgccaccgaactcgaatgaaatgcaggctactgacgatactgctatggatactcctgttgtgaaagaagatgctaaaattccaaggttcttaccaccacctccaccgcatccatcgcagttactgcctttgcctccaaggcctccaatgatgcctccagtacctccccgggcgcccgctccaggaatggtcagatttcctccaccaccgtcacaaccagattcaaggccaccatttatggctcctggtgttgctgccaggccccctccacctcctccagcattacctccggctcaaatgccaatgtcaccctttggtgtacttcctggtccgtcagcaatgcttaggcctccattttttccaggacccgagtttgctgcttttggcccaaggccgcagttacctcagcagccatcttacgtcaaatcggctgcttcaacagttgtaaagagaccattagcacaacatactcctgagctaacagctatggttcctgcatcagttcgagttaagagagaatccgctctccctaaaccaaaaccaaaggcgcagcagcagcagcagcagcagtcatctgcaccatcatattctgctctgaagccttcagtaacccccataaaatctgcagcccagccttcaccctcagcttctaagccacaaagcattgatgactcctacatggcattcctggaggatatgaagcaactgggtgccctcgatgagtagctcagcacccagtcccttctccctgatggctgtcagcagcttggtcatgaacctgaacctgaacatgattctgttctttgcattgtggcttatgaatggcttttcctgctatgatcttagaaaccgtttctgtttttccatgagcaagcatttgagatgtattccagttcgaaatggggagacaactatcatcaacaaatcttttcgttggtgtcattgtgcaacacagccgtatcgagtcaaacaatggaagcatttgatttgccatttctttttccgcggcacttgattggccgctcagctaatagggaacgatactatcacttgtcgtgtacgattccagacacgttngatacctggcgtgggaaatacggancttgcgntaacngattggtgnttaaaagaatgaaaaaaaaaaaa

SEQ ID NO: 18281 - DNA, 837 bp, Triticum aestivum
  unsure (1)..(837): unsure at all n locations
  Clone ID: PAT_TA_18281
gccgtccggttctctccctcggcagaacgacagacaaacacagaaaagaggaagcagaggaccgccgagaaagggaagaggagaatggcggcggaggtgagctccatcgccaggatgctccgcggggaggcggggaagcgtagggccggcgccgctgggaaggcgccggagatggtgaccatggatctgctcggcgggtgcggcggcgacgccggcgggcaggacgaggtcgtcgacctcgaggtcaaggtgcccgccggctgggagcgacggcttgatctgctgtccggcaagacgttcctgacccctcatcgccaccaggccgcccaagacgggcagccggacctcaacctgcctcccacggcgaccaccgctcccgccgccgccgtcaccacatgcgcggcggtctgcaccctcgacatggtccgcgacgccctacagcgcgccgccgccgcgcggtcagcccgctcgccggacacttcgtcctcctcgtctgcgtccactcctcgtcgtgcccctccctgggaaagcccccctcgctccttnaagcacgngtccccccggcaaccnggcatccgctcgcntccttctgctaactantctcaatgcnagcacccgggcccgnnactcaagngcccntcccaaaaccgccgcacatacggaaaacnaaatnactgagtgcccnataaacgatgatggaaagtatnacatcntttttcttcgggaaatttcatatagtgganactnatattatagaacngtctntagaatntanccatacaaggcaatnaatagttgcttntatattcttttctaaaaaaaaccagggggcgtcat

SEQ ID NO: 18282 - DNA, 1238 bp, Triticum aestivum
  Clone ID: PAT_TA_18282
tcaccataggacaatgctggcggcacgagcgtcggcccgcgggaaggcgccgcgagcattatcagtggaacatggacatttttggtatgcctaaagtccgggctgaggctgagctcattcaagctatcgttctctaagacgagggtcttgggattacgtcttcagatgtggggatcagactgtccagccgcattgggctgcaggacctgttggatatgtactccgtaccacaatacttgtttactcaagtttggcttattctggacaagctggggaaactgagtagggaagaaattgagttcaaattgatttcaactggtctgtcatctgaagctgtacagggtatcattgaagtgctctctcgcgagtcactgtccaaacttgaatactagctaggctcaggtgtgttaggacgttgctgacttgagaattgtcttctcgcttgctgagcaatatggttatactgattggatctgcctttcgatgcatcctgaattgttcatggccttgcatactacacatgggattgtttttgaggcttttgatagggaaggggaactgagagcgatttgtggtggggggaggtatgacaggctactgtcaacatttggaactgaagatgtaccagcctgtggctttggatttggagatgctgttatagtggagctgctgaaagaaaagggtcttttgcctgacctgccacgtcaaatagatgacattgtgttcccattggacgaggagcttgaggggccagcatctagtgttgcatcctctctgcggaagaagggcagatctgtagaccttgtagaagacaagcgtctgaaatgggtgttcaaacatgctgagaggataaacgctagcaggctgatcttggttgggaaatccgagtgggagcgaggcatggtccgtgtgaagatactatcaaccagagaagagttcgaggtcaaggcgggcgaattgcagtagctgttagctgatctggtcgatttgaaggtttgacttgtcccctttcttctttctgatcatcttcaacactgtaagttttgcaattcacgtcgtgtatacaaacaattaggtggctttgaatgctattgccatcttcgttcggatcattcaccttgcaacaaacaaagaaattgtaggttttgccattcaccaacatgtattgagaatgcctttgctgcctgagaatagaatgctcatccgcttcgaactaaggcttttctgaagcgattatt

SEQ ID NO: 18283 - DNA, 1782 bp, Triticum aestivum
  unsure (1)..(1782): unsure at all n locations
  Clone ID: PAT_TA_18283
agatnnctttnatacnctagctcgaacttaaccctactaaagggaacaaaagctggagctccaccgcggtggcggccgctctagaactagtggatcccccgggctgcaggaattcggcaccagaacggccccgcccccgccccccgaccaaccggatccaaatcgccgcccgccatggatttcctcttcaactcgctcgccgcgcccgacccggcctccccgccgccggagccggaggccgccgcggggtcctcctcgtcctccccgcccgccgactccggcgacgggggcgggtggggcggcttcggcgggctgctcaagaccctcacctcccagtccgagaccgtgctggacgcctaccgccgcgacctcgccgagttcagcaccggcctgcgccgcgagaccgacgcgctccgcgaggccgccgcccaggcggcccgggacctcccctcctcggccctcgcgctcgacggcctcgccgacatcgtcgcccagggcaagggcgccatcgcccaggtcgccgccaccgccgccgcctccgcagcctccccgcccgcgccctccgacgccggcggccccgactccgaccccggccccgcctcgggccacctgcggtactacagccgcttcgaggcgcagctgcgcgcgctccagtcggatccggccaccttcaccgccgatcccgaggacgccgaggacttcgcggcctggggcgcggggtttagcctccaggagaggcaggacgagatcgatgcgctctgctacgagagcgacgccgtggaggggatggtggacaggctcgtccccgacgccgtggagggcgaggtgttctgggccaggtacttttaccgcgtccacaagctcaagcagcaggaggacgccagggccaagctcgtcaagcgggtcatcgcgcaggaggaagaggaggatctgagctgggaggtggatgacgaggtcgaggaggaggagccagcaaaagaggaggggatcaagcaagcgccgatcaaagaagaaccgaaacctgaagtacaggaaagagaaaatgagaaactggaggtagcaggcagagtcaatgcagttgaagaggccggtgctctggataaggaacagaagaatgccgattcaccgcagccggaagttttcggtagctctatggtggtcgtcgacaaggaggagaaggaagatgcatcgaaattgaatgttgaagagtcaagtgacaataaaactgctgctgaggaaccacattctagcactggagatgctgaggtgaaagaagggacaaagaatgagacaagtgactcgagcaaggatagcgattactccatggtgtctagacagcgaacagcaaccgaggaggatcttgaatgggacgagattgaggatcttggggagcatgaggagaagaaggggagcgctcatggctcaagctctgctccaaaggaggagctacgtaagaggctcagtgtggtggaggacgaggtgaggatttgagttgggacattgaggatgatgatgatgataaggcctgaaaagccattctggtatggtagtgtcgattgtattgtctacattttttatataccattactgtgcaagatactatcatgtgaccaataaacattggtttagctgcgctgcttatgttatggatacgtgtgtaaactcaagtttgatgttatcaagtggcatttggcaatgcgtcaatttgctagtaatatgtttgtgttactgtaaatatgttgtttcatttgacaattatttcatttaatggatgttgattac

SEQ ID NO: 18284 - DNA, 439 bp, Triticum aestivum
  unsure (1)..(439): unsure at all n locations
  Clone ID: PAT_TA_18284
ctcggcgctggcgggcaagcaagcaggcaggcaggcaaacccacggcgccggtgccacgcggacaccgagagaagaagcgtttggctcgtcactttcctatagatacagaagcagagggagagagacgccattgatgctgtagcagcacaaggacgggcccaagagagaaggggggaagcatggaggtgctcgccggaggaggccgcggcggcctcctgcatgcggttcttcttgcgggtgcggcccttgttgcattgacaggcggcgcggaggcgtgggcgcaccacggcgccgccggtgcaagggccggcgcggagcggcggtacagggatctcgcggcgggcaggatggatagcgtcagattctccttcggcaaggccaggangggggcttgcaacttcctccgcggggctccgggtggaccacgtgacggactac

SEQ ID NO: 18285 - DNA, 1530 bp, Triticum aestivum
  Clone ID: PAT_TA_18285
cccacgcgtccggaggaaacctctcccttccgtcgcgcatcaccgggaggagtcccgccatcggctaatccgtccaggtccagttttaggagtcgacccaagaaccagtatgggcatcctgtccctcatcaccgggaagccgggcgccagcgggttcggctcggggctccacggcggagcacggtctccgacctcccttccgtcgcgcatcaccggaaccaatctcgccatcgcctaatccgtccaggtccgtccagtttcaggactcgacccaagaaccagatgggcatcctgtccctcatcaccggcaagccgggcgccagcgggttcgggtcgggctccacggcggagcaggtcaccgagggcatctccgccgccggcctcaccgtcctcgtcacaggaggatctagtggcattggtctagagacctcgagagtctttgccctgagaggagcccatgtcatcattgctgcgagaaacacagaggctgcatcagaggcaaggaagcgcatcatggagatacacccagtagcccgtgtcgatgttctgaagcttgaccttagctccctcaagtctgtcagggccttcgctgaccagttcaactccatgaatcttcctctaaacatcttgataaataatgcaggtgtgatgttctgtcctttccaactgtctgaagacgaagtggagatgcagtttgccacaaatcatcttggtcacttcctactgaccaaccttctccttgataacatgaaaactactgccaagtctacgggtattgagggtcgcattgtgaacttgtcatcagttgcccacctccatacatatccaaaggggattctgtttgatcagctcaatgacaagaaaatatacaatgataaaatggcctatggacaatctaagcttgcaaacatactgcacgcgaaagagctctccaggcggctcaaggaggaaggagctaacatcacagttaattgcgttcatcctggattgatcatgaccaatttgatgaggcattcctttgctctcatgaaggcaattcaagttgtcacctacttgttctggaagaatgtaccccagggagcggcaactacttgctacgtagggctcaaccctcagctgaagggggtgacaggcaaatactttgccgactgcaacgaggagaagacgagcgcgcacgcgaagagtgacgtcttggcgaagcaactctgggagttcagcgaggagctcatcagatccgcaaaatgagagctcaggaaaggcgtctttcgggatgctgtcgagtttatggtacagatggttggttagcaagtagcagcagcacaagcagtagctacaagtaggaaactgtcacttggtgaagtgaaccaatattgttcacgaataaattttcgtgcttgttcggtgtcgtggctatgatctaatggtgttcttgtcaatatattcacctcaagtatatttgtcggtcggtttcggattggattaatggatgtagttaatcatctcgcttattttcagattaaaaaaaaaaaa

SEQ ID NO: 18286 - DNA, 664 bp, Triticum aestivum
  Clone ID: PAT_TA_18286
cgtccgctccaccttccctcctcgcgtctctccatgtcgccgccggcggcgccggcgttgaaccaccatgcgccaggcccctcccatccagcccacaccagacccctccccgtctacctcactccatgccccttctcatgcagatcgcgccctcgagctgcggcggctcagtcctgcatctcgagatgatgcggccatggtggcggcggggccgactgccgggtttggaaccccctgatgccggcggcgggcacggatccagctccatccagtggctgagacacacacgcgtgcttctccttgaatggttagtggcaaatctgaggggaacacggacgtgtccttcatgcaggatgatgcaccggccgcatcgatttcaactggtattgctgaagctatccacgagagccatttcctctcctacacaattcctgttataggaactaaatatctcatgacaaagtcacgcacagggggtagtactctccctcacccggctttgcttaactacactctacattttttgcttaacaatttcttctgttggcatcacaaagcatgcatttctcattagagaagctgaacattgcataaacttctgaattttttagccgcatcttggcattattctaaactgaatcatgacaagaacacatgacttgaa

SEQ ID NO: 18287 - DNA, 263 bp, Triticum aestivum
  Clone ID: PAT_TA_18287
cggacgcgtgggcggcgacaagcactacgaccagctttccggagaagccatagtcgccgaagagcgcgtcagcgacaagcactacgacccgctgtttcccttcgggttcggcctcaccaccgaggccaacaagtgagtcgggtcgggtgagatgggatgtggatgtactatctcggctgggctgtgagagatgggatacatacatacattgagttttctggttgatttgttgttagcaataaaagagcgatgcgttcttgcgg

SEQ ID NO: 18288 - DNA, 892 bp, Triticum aestivum
  unsure (1)..(892): unsure at all n locations
  Clone ID: PAT_TA_18288
gtgttgcntgaaaaatggaaaatctgcctccgctccgctgttgcctctcccgaagaaggccggcaagatcctcgtcgccggaagccacgccgacgacttgggcaaccagtgcggaggatggaccatcacatggcaaggacagaccggcaacgacaaaactgccgggacgacgatcctttcggcgatcaagtccatcgtcgaccccagcacggaggtggtcttctcggagaacccggacagcgccgccgtggacagcggcaagtacgactacgccatcgtggtggtcggcgagccgccctacgccgagacgttcggcgacaacctcaacctgacgatccctgccccgggtccctcggtgatccagagcgtgtgcaagagcgtcaggtgcgtggtggtgctcatctccggcaggccgctggtggtggagccgtacatcggcgccatggacgcgttcgtcgccgcgtggctgcccggctccgagggccagggcgtcaccgacgtgctgttcggcgactacgggttctccgggaagctggccaggacgtggttcaagtcggtggaccagctgccgatgaacgtcggcgacaagcactacgacccgctgttccccttcgggtttggcctcaccactgaggccagcaagtgagtcggctgagataactgagatgggatgtatctcggttgggctggagagatgggacacatacatacattgcgttttgtggttgatttgttagcaataaaagagcgatgcgttcttacagatccggtggtgttacagcaagccgtccgatcgccataataatcgtcgttatgacaattttaactgaaaagaccgccctaacaaagccgtcatcctgtccttggtcgccataattttcaaaggtgcttc

SEQ ID NO: 18289 - DNA, 1207 bp, Triticum aestivum
  Clone ID: PAT_TA_18289
ctaagacacgctaaattcagggcttcgtgatctcagattggatgggcattgacaagctcaccaccccttatggggcggactacccctactcggtcaaggcttccattcttgctggccttgacatgatcatggtgcctaagaactacacgcagttcatcagcatcctgactggctacgtcaacagcggagtagtcccgatgagcaggatcgacgacgccgtcacccggatcctgcgcgtcaagttcgccatgggcctgttcgagaacccctacgccgatcccgccatggctgagcagctaggcaagcaggagcacagagatttggcgagggaggccgtgaggaagtcgctggtgctcctgaagaatggcaagacgagcgacgcgccgatgctgccgttgtccaagaaggcgcccaagatcctcgtcgccggcagccacgccgacaacctgggctaccagtgcggcggctggacgatcgagtggcagggcgactccgggcgcatcacggtgggcatcaccatcctcgacgccgtgagggcggccgtggacccgtcgaccaccgtggtgttcgcggagaacccggacgcggagttcgtcaagaagggcggcttctcctacgcgatcgtggcggtgggcgagcacccgtacacggagacagcgggcgacaacctgaacctgaccatcccggagcccgggcagagcaccgtgcaggcggtgtgcggcgccgtgcggtgcgcgacggtgctcatcagcggccggccaatggtggcgcagccgctcctggccgcatcggacgcgctggtggcggcgtggctccccggctcggagggtcagggcgtcaccgacgcgctgttcggcgactacgggttcaccgggaggctggcgcggacgtggttcaagtcggtggaccagctgccgatgaacgtcggcgacgcgcactacgacccgctcttcccgctcggattcggcctcaccaccgaggggacctcgcaaggggacggggtggcgctacacagcagcatgtgatggcggtcaagaacaagttaccatggtggtaatattcatcacttttcaccagacggagcggtgtggtaaatgtatcctcactattatatgatggtactaaaacatacgcaagctgtggcaaatgtatcctcactattatgataatactaaaatatactgaagctatggaaaaaaaaaaaaaa

SEQ ID NO: 18290 - DNA, 2116 bp, Triticum aestivum
  unsure (1)..(2116): unsure at all n locations
  Clone ID: PAT_TA_18290
atggggagtctgcacaagaccacctttgttctcctcatgttctgcttggcggcgttgggaagcgcggattatctcaagtacaaggatccgaagcagcctcttggcgttcgcatcaaggatctgcttggtcggatgaccctcgctgaaaagatcggccagatgacccagattgagagggagaatgccacagcagaggccatgtccaagtacttcataggtagcgtactgagtggtggaggcagtgtgccttctcctcaggcatccgctgcggcttggcagtcgatggtgaacgagatgcaaaagggcgccctttccacccgcctaggtattccgatgatctacggtattgatgccgtgcatggtcacaacaacgtctacaaagctaccatcttcccacataatgttggcctcggagctaccagggaccctatgttgataaagaggataggagaagcaactgctcttgaagttagagcaacgggaattccttacgcttttgctccgtgtattgcggtgtgtagagatccaagatggggacgctgctacgaaagctacagcgaagacccaaaggttgtccagtccatgaccacacttatctctggtctgcaaggcgacgttccggctggttctgagggaaggccatacgttggtggaagcaagaaggttgctgcatgcgcaaagcactatgtcggtgacggtggtacgtttatggggatcaacgagaatgatacaatcatcgacgcccatgggctgatgactatccatatgcctgcttattacaattctattatcagaggtgtctccactgttatgacctcgtactctagctggaacggcaagaaaatgcacgccaaccatttccttgtcactgattttctgaagaacaagctcaaattccggggtttcgtgatttcagactggcaaggcattgatcggattactagccctccaggcgtgaactattcttattcagttgaggctggagttggtgccggtattgacatgatcatggttccttatgcctacacggaattcattgatgatctgacataccaagttaagaacaacattatccccatgagcagaattgacgatgctgtctacaggattcttcgggtgaagttcaccatgggtctatttgagagcccctatgctgacccaagcctcgttggtgaactcgggaagcaggaacaccgcgatcttgctcgtgaggccgtcaggaagtcattggtgctgctgaaaaatggaaaatctgcctccagcccattgttgcctctcccaaagaaggccggtaagatcctcgtcgccggaagccacgccgatgacttgggcctccagtgcggaggatggaccatcacatggcaaggacagaccggcaacgacaaaactgccgggacgacgatcctttcggcgatcaagtccaccgtcgaccccagcacggaggtggtcttctcggagaacccggacagcgccgccgtggacagcggcaagtacgactacgccatcgtggtggtcggcgagcagccctacgccgagacgttcggcgacaacctgaacctgaccatccccgcgcccggcccctcggtgatccagagcgtgtgcaagagcgccaactgcgtggtggtgctcatctccggcaggccgctggtggtggagccgtacatcggcgccatggacgcgttcgtcgtcgcgtggctgccgggctccgagggccagggcgtcgctgacgcgctcttcggcgactatggcttctccggaaagctggccaggacgtggttcaagtcggtggaccagctgccgatgaacgtcggcgacaagcactacgacccgctgtttcccttcgggttcggcctcaccaccgaggccaacaagtgagtcgggtcgggtgagatgggatgtggatgtactatctcggctgggctgtgagagatgggatacatacatacattgagttttctggttgatttgttgttagcaataaaagagcgatgcgttcttgcggatgtacgtcgtgttggttttcttgtgcaacaaaatntagcgatttgcgttctcttaataacngatccccaataaatagagaaggatctggctgagtaaaaaaaaaaaaaaaaaa

SEQ ID NO: 18291 - DNA, 960 bp, Triticum aestivum
  Clone ID: PAT_TA_18291
cgtccgcccacgcgtccgcggacgcgtgggctcatctgtgctctggtcctcactatccccgtgactgacgcgcggcctctcgccgcacgcagcgcagccgccgccgccgcctcgccctcgccggccgtccgtccgtcaccgtggtaactgactggtctacacatatagtcggtggtgatcaataccggacacattgccaagatggggagtttgcgcaaggccacctttgttctcctcatgttctgcttggcggcgttgggaggcgcggattatctcaagtacaaggatccgaagcagcctcttggcgttcgcatcaaggatctgcttggtcggatgactctcgctgaaaagatcggccagatgacacagattgagagggagaatgccacagcagaggccatgtccaagtacttcataggtagcgtactgagcggtggaggcagtgtgccttctcctcaagcatccgccgcggcttggcagtcgatggtgaacgagatgcaaaagggcgccctttctacccgcctaggcattccgatgatctacggtattgatgctgtgcatggtcacaacaacgtctacaaagctaccatcttcccacataatgttggcctcggagctaccagggaccctatgttgataaagaggataggagaagcaactgctcttgaagttagagcaacgggaattccttacgcttttgctccgtgcattgcggtgtgtagagacccaagatggggacgctgctacgaaagctacagcgaagacccaaaggttgtccagtccatgaccacacttatctctggtctgcaaggtgacgttccggctggttctgagggaaggccatacgttggtggaagtaagaaggttgctgcatgcgcaaagcactatgtcggtgatggtggtacgtttatggggatcaacgagaacaatacagtcatcgacgcccatgggctgatgact

SEQ ID NO: 18292 - DNA, 2627 bp, Triticum aestivum
  Clone ID: PAT_TA_18292
tcttcctatcaaccgcgatggcctgatgaacatccacatgccggcgtacaagaacgccatggacaagggcgtctccactgtcatgatcttctactccagctggaacatgcttcaaaatgcacgccaaccaatacctcggcactcggataccttaaggacacgctctaattccagggcttcctgatctcggactgggagggtattgacaggatcaccacccctgcgggatctactactcctactgaggcaaggctttcattcttgccaggcttgacatgatcatggtgcccaacaactaccagcgggccgccacgcgcgggcccagctgcgcatggccgggggccccgcccgcagcgtcccgatccccccggccggcacccgcacgctccgccgcgcggcgcctcgccccgccggccggccgcccccgtgggcgtcaactcgtttagtgaacggtgcttgcgaccagacaacgaggcacgatgcgaggggctgggctccggcgcggcctggctctgctgtggccactgttcgagtgttgatgttctggaggacggtgtcgcgcggggaggatgctccgcaccagcacccggccgaggctcctagtgatctgctcggagcggtggtccttggtgaaaagactcgcccaaaaagtggcagtaagacgaaggagaacggcgcagagcgaggccctgcggacttgacatcaaaggtcgcgtattgtgtggtgggggggcggtgacgtctcctatcggctccggtgtggctggccagtctgtggtggacgagatagaacacgccgtcgactcgccccgcctaggcattgcgatgggctatggtatgtatgccgggtctggtccatagcaacaaaacaaacatctcacctccccacctagtgttggccgcgaagatgcgcgctacggtgctatgaaggacaggataggcgaagaaactggacgtgaagttagcgcaaagggaattcgttccgcctccgctccttgcgctgcggtgtgtggcgatcgcaggggggggcgacgctacgaaggctaccgccaacaccatcaagtgctacgggccctgaagactctcaagtctgtcatgccagttgacgatcggtctggaagtgtgggcagcccttacgtcgttcgacacatgcagctgggtgcatgagccacgccatccagcggatcgtgcagcacgttcatcgcgtccacgtagaatagtcagcgcatcgtcgcctgggatcggtggactattgagaagctgggttcatgaacctgtatcttcttgcctccctcgacttggctgtccgatttcgcttccttgtacctcacggtcatgctcgataatattaaccgactattcatctttcttactttcttggtccatatttgctgaagtacaagctccagattcggggttccgtgatttcagactggcaaggcattgatcggattactagtcctccaggcgtgaactattcttattcagttgaggctggagttggtgccggtattgacatgatcatggttccttatgcctacacggaattcattgatgatctgacataccaagttaagaacaacattatccccatgagcagaattgacgatgctgtctacaggattcttcgggtgaagttcaccatgggtctatttgagagcccctatgctgacccaagcctcgttggtgaactcgggaagcaggaacaccgcgatcttgctcgtgaggccgtcaggaagtcattggtgctgctgaaaaatggaaaatctgcctccagcccattgttgcctctccctaagacggccggtaagaccctcgtcaccggcaagcgccggcgagccacgccgaccacttgggcaaccagtgcggaggatggaccatcacatggcaaggacagaccggcaacgacaaaactgccgggacgacgatcctttcggcgatcaagtccatcgtcgaccccagcacggaggtggtcttctcggagaacccggacagcgccgccgtggacagcggcaagtacgactacgccatcgtggtggtcggcgagccgccctacgccgagacgttcggcgacaacctcaacctgacgatcccttgcccccgggtccctcggtcgatccgagagcgtgtgcaagagcgtcaggtgcgtggtggtgctcatctccggcaggccgctggtggtggagcctgtacatcggcgccatggacgcgttcgtcgcctgcgtggctagcccggctgccgagggccagggcgtcgccgacgtgctgttcggcgactacgggttctccgggaagctggcgaggacgtggttcaagtcggtggaccagctgccgatgaacgtcggcgacaagcactacgacccgctgttccccttcgggtttggcctcaccactgaggccaacaagtgagtcggctgagataactgagatgggatgtatctcggttgggctggagagatgggacacatacatacattgcgttttgtggttgatttgttaaaaataaaagagcgatgcgttcttacaaaaaaaaaaaaaaaaaaaaacaacaaaaaatagccagaacagactccgccaaaaaaagaaacgatatatgttagcaataaaagagcgatgcgttcttgcgg

SEQ ID NO: 18293 - DNA, 1298 bp, Triticum aestivum
  Clone ID: PAT_TA_18293
tgccgttcgcgctctccccccagcccctcccccgcgcctcgtcaccgttccgatctctctctcctctccatctcgttcctcccccacctgcgcagccaagaagttcaaaccctagtccagcctgcgagcgccgacacgccgcgccgtgcggcttcccgcaagcaggggctccggccgaccgcgggggatgagcggcgcggcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggatacatcttggatttcatggttctgtagcttgcgaggcaatgaattcttctgtgagattgatgatgattatatacaggatgatttcaatctctgtggcctaagcagtcaggtgccatattatgattatgcacttgatctcatcctagacattgagtcttctaatggtgatgtattcactgaggagcaaaatgaattaattgagtcatctgcagagatgctgtatggtttaattcatgcacggtacatcttaaccagcaagggtctagctgcaatgttagagaagttcaagaactatgattttggcagatgccctttacagcagggcaatcagacattcttaggtcaagcacagtgaaggtgttttgtccaaaatgtgaagatttacactatccaaggtccaagtaccaaggcaacattgatggagcatactttggtacgacattccctcatctcttcttgatgacatacccacacctgaaaccacagaagccatcacagcaatacgtcccaagggtttttggcttcaaacttcacaagcagtcatgacgaacttttaccagcgggcgctatttgtttttacctagtgttagagatggaacaccttggcctgaaaatgttgtggcctcttgattcgagtactcgcgagctcgaatcttgctgtaaactgctgagcaactgtatctgttttgttgtatgactcttgtgtaatctaggtttcctcacttgatcaatctatgcacatttgcatgttagcagggtgtttttctgtgtccgaatcggatacatctagatccccccccagcaagttagtttcctatgtttttatgctattattttctagagtttttcgttctcct

SEQ ID NO: 18294 - DNA, 1043 bp, Triticum aestivum
  Clone ID: PAT_TA_18294
cgaaaacccgaggggctccgcggaaaagtgcctcctccgcccatccccttcttcctctcctggtctcccccgtcggacggtggtggcgcgagtctcctcgccgcgccggcttgcttcctatcccctcccgggcatcagtttagcgccctgcctatatttaatccagcgggaaacgattgacttaagtcatggaggggaacaaagatgaggccttgaggtctgtcaagcttgcacagactgcgctagcatctggagatagacagcaagcagacaaatttatccgaattgcccaaagattggatcccagccttccaattgttgatttgttgacctcaaccaagaagtttgatcccctgaatctgaatggtactgcttgccaggacaagaccagaagaggccatgaaaacctaaaaacgccaaaagaatttgttggtccttctaatgttgataaaggttacactgaggagaatgttagagttatccgtgatatcaggaagaacaaagactactatgcaattcttggagtggagaggacttgctccttggaggagattaggaaggcctacaggaggctgtcactgaaaattcaccctgacaagaacaaagctcctggggcagaggatggattcaagatgctcagcaaggctttcatgtgcctaggcaatgatcagtcacggaagacctatgatcagacaggcacccttgaggggcatgagtttaacgaccaatattccaatgtcatggggcagaggaccgcttggcgaaggaggcaaacaagaaatggcttctataattatgaagaagatttagatccagatgagatattcaggtctttcttctatggtactcgtgataattcattccgtggtcacaatgtctacagaacaagagaagcaggtaggcaggagcaacagagaagggagcatcctgtacagggtgggtcgttcataaacttaacagtattgatgcacctgtcggtcgtattactttttgtcttgtttgcattcattccagtgcagcagcctcaatatgccctgcacaag

SEQ ID NO: 18295 - DNA, 466 bp, Triticum aestivum
  Clone ID: PAT_TA_18295
cgtccgcggacgcgtgggtcttgatccggtaggctgcacggaccgtgctgcgccccccgcgccgcgctagcgctagtcccctacccccctgagttgcgacaccgcccgccacgcgcgcgtccccggccggcctgatctcccctcgccggtcgttccgttgcgcctctgttggccgcgctctctcccgccccgaccatgggtccgtgatgcgatcccatacatttggtggtgtggtgacttctcgcgttccgtgaggcgctcgcggggacgggaggagacgcgcgttcggttggttcggcgcgacgagatggtgcaggagccgagcaacagcagcaaccaccacctgcagcagcagctggccaagtacggcggcgggaccggcaacggcaacggcaacggcaacggcgcggccaccggcgtggcgcgggcgtcgaggaagaacaagcccaataagatccgcaagcgc

SEQ ID NO: 18296 - DNA, 1195 bp, Triticum aestivum
  Clone ID: PAT_TA_18296
attcggacgaggctttgacctaacgaagcgtccgcggacgcgtgggcggacgcgtgggaaaccaccctaaaatcttccgcaggtgcccctgagctgccgccgccgtagcttggcgtcagcgcggaggcccgctcccgctcccgctcgcccacccaatccctccgcctctcacgcgcgtcgccgccgtcgccgtttccgttctagcccgtcgcgtccctgctgtctccacccccgtccgcagtcctcgacatccatttttgagacctaccatgagcacgaaattgctcaacagcttgagcctgaggaggctcttaggacagcaaagaaacccaatcgacttatacacagcatcgcgagcatggagctctagcacttcattttctggtgctcatgagaagaatggcatgggcgtcgaggcagatggtgatcttgcagattcttggaaagatgctgacttccgtggtgtttaccgggccattatttgtggcagcgttggacaagtgcctgtgcagaaaaaattgaggaacgggcatactggtgactgtatttactgtcgggactggaggcatgtttgcccagaggagggcaggtgctgaaaacttgccaatgccagctcagtggcatcgcatagctgttcataatgagcagcttggtacatatgctgttctattgtgggtgaagttggctccagtatctgctgtgggggcttctgtgaccagggcctacacggacatcagctctgtgcgcgggaaaatcgtacctgagatctgtgtgcggtttgatggcaagatacccgcggttcattcggggggctgtgggggcggctattcttggggcgacctgagggacgggctgctgcaggtgcggccggccggccggtgtgctgcaggcggggctgccctgccggagcgcttgtttcaggccccttggccatagctcgtctggtgggcccattgcccgtgtcggggctggcggtccgttcgcccccgttttggccggcggggcgccccctcccgttgtgggcgtcggggggctcttctgccgctggagagcgacggtctattgagcccccggagggtgccggcggtcttctcagctccctgtactggcgccccgtgctcgcagctaggaccggtcccccgggctcgtcacaatctccgctgctgcggtgcactattcataatacttgaaaaaa

SEQ ID NO: 18297 - DNA, 895 bp, Triticum aestivum
  Clone ID: PAT_TA_18297
gcctgcaggtaccggtccggaattcccgggtcgacccacgcgtccggggaagtcgacatgaaggatcttggagatcctgtcaatttctttggcaggaaccgaatgtttgattcaatattatacaacaagcttgtaggcagacctaaaagcaaggacggaagggagatcaatccgtatcttgccaagatcatcaagatgaacccaagaatggtgtctgaaatatttgcttatgcactgagatcgttggcggttattactgtggaaaaccatcggatgggggttcctttaggtgctgctgtgaagctatctaacctgaggatctcttattctcatggtaagtttgtcttgctcaatatcctgccaaagtcacccggctacaagggtttgactctgcaacagagatgtaatgattggatagcaataagagatcttgtgaagcagttggttgaggaggtttgcgggagtggtgttcaatatcctgtggattttgcccactggcttgagaagttgggtgagcctcagccaccaatattcctgatactataccataccgtgttcctaagatcgaatgcccgtttctattaccatgtttcgctggatcagttctgcaggaaggagccaaggggcaagttcaacatgattatgaatgattctgatttgcgtgagttgctgagggagataggtgaccttagagatctgttaaaccttgccgaactgaatgagtttctaaagtgctgtatagcaggtgacgatggaactcaagcagctgcagctaaatatccaaagggcgggcaaccaagcaatggtacaggccagcagggtcaagcaccaccagccacaggccagcagggtcaaccaccagcagccacaggccagcagggtcaaccaccagcag

SEQ ID NO: 18298 - DNA, 941 bp, Triticum aestivum
  Clone ID: PAT_TA_18298
cacacaattcggcacacgggagaacgccactaatccacaagggccctcgagagagttcttgttgagagtcgcagcgaggccacctgatcccgcccgatccccaatctccgacggcggctatgctggccggaagagaggagggagaggtgcgtggagctttgtatataatccagctagttcttggttgagtcttcccgtagtggagtctggcgttatgccgtggcgtagcgcgccgccggcgcacgcgagctgcgcccggtggctagcggtgtcgttcatcatggttgtggcggtgaggtgctgcgtgcaatcggagagagcgacgccggcgactccttcaataagctcgtcgtcttctctgtgttggtggggggcggctgcttgtctccttcctctgttgccgccatggagacggatggagcgaggatgagaagcagcgaactggatctcacggattgggtaagagctcattctcaatggcttatgtatcagggcttcggcgccagctcagcggtcggctgccggccctcatctcgccattgaccttgctggccgaagggcggccatctatcttcctcccggcctggagccttgaagggaggcagttcatctctggtttggagtccccagcttcttctaatggtagcggatggagcggctgtggagatcccggcgcaccaagtggtagcgtccccggcggcgacgggattggttctgttccagagttgattaggacccgattgagtttcttatttcctgtttggggtcctccatgcaaaaaccagggacctagtggtagtttccgtttatgtttgggtcctgttgtaatctgctttgtactatcaccgtttaagaattaacgcaggttctgggtccttcgggacccaactctcgttcaaaaaaaaaaaatggagaacgcctcgtgccgaattcggcacgag

SEQ ID NO: 18299 - DNA, 760 bp, Triticum aestivum
  unsure (1)..(760): unsure at all n locations
  Clone ID: PAT_TA_18299
cgtccggtcgacccgccccctctcctctctcgcgcaggcgcagtcgagctctctcctgtcgcggcacggcgcctgctccttccttccatgataaaagaagagaaaggaaagccggcccccgttccctgcctgctcagacacaagagcaagcgagcaagcagacatgagaggcgcccgcctcgccccgtgcctgcccttgctcctgctcgccgcgtgctggggcggaggcgccgacggccacggcgtgcacccgctctcgcgggtcgccatccaccgcgcccgcgtcgccctggacgcctccgccgccgtgcgcgcgtcgcccaacctcctcggctcgcggggcgaagatacggcttgggtgaccgtagaattcaaaataccacgtgcaagcgacggcgactggatcggggtattctccccttccaatttcaatgcgtccacatgccctgcttcccatgggtcaggccctggccctgcgatatgctccgcgccaataaagtatcaagtttgcaaactactccgtcaggttataacaagtcacggacaggggctctcaaattccagctgatcaacaancgccaagattctccttcggattcttcaacggtggactctcaaaatcaaacgctcgtgcngtgtcgaacaagatngtctcgcaaacccgaaagcccgnttaccaagcctagcggtcgggaaaaatggaacacatnctgtacangacancgctntggatcagtaaggccacccttcgtaatgggan

SEQ ID NO: 18300 - DNA, 1052 bp, Triticum aestivum
  unsure (1)..(1052): unsure at all n locations
  Clone ID: PAT_TA_18300
gnaattcggccccgcggcccgcccgcgcgcgctggagggcgccccccccggggacgcgcccgcccccccccgcctcggcgcgcccgcctcccgccccggcccccgctgccccgccgcgcccggcggcgacgcgctcgccttcgctccccactccctctccttcaagagaagcatcaaggacatcgccgcattgtacggctgtgaagcctcgcttgacaaggtggaagagttcagaaaggcccaagggttgtcgtctatcagctcaaaatgcttccaagctgccaatatatccgcgatccttgtggacgatggcctagcatttgataaaatgcttgagctggaagcccacaaggaatttgttcccacagtcggcagagttctgagaatcgaatggctggcggagacgattattaacgacgattcattcagtggatcaagctggacgttggactcattcactgaaacttttgtggctaagctcaaatcagttgccagcaaaattgttgggttgaaaagcattgctgcatacagaagtggcttagagattgatccatgtgttagcaagacagatgcagaggatggtcttcgtaaggagctaacagggcaaagacctcttcggattacaaataagagcctcatcgactatctattcgtccgcccacgcgatatttctgtgcagagtcacttaccaatgcagattcacacaggctttggagataaagacctggacttgcggaagtgcaatcctctatatctccgtgctgttcttgaggatgaaagattcgccaagtgccagttagtccttttacatgcttcttatccatattctaaggaagcatcctatcttgcatctgtttactcccaggtctatcttgattttggtttggcaattccaaaactaagtgttcaaggaatggtgtcatcacttaaagagcttctggagctagctcccataaacaaggtcatgtttagttcagatggatatgcttttccggagacatactatctaggttcaagaaaggcacgtgatgtcgtttaccgtgtcctatcag

SEQ ID NO: 18301 - DNA, 1246 bp, Triticum aestivum
  Clone ID: PAT_TA_18301
cgtccgggcggagactggaggcacaacactgcacgcgccggccggcgagaggagctgcgctgccgccggcgcaccgactgcgtctactgcctcgcctccccgttgacctaaagaaggtatattcccacattgaactaaattattgctatattcggttgattcagacatattgtatcttcaatggctttcactgctgggcaaaatcaagcgatggaagatccatggtacattgtgatgttatctgctactgatttacaggccttgtggtgtcccttctcctggctggcccgaccgacacctcctttggtggtcctctcggtgtctctcgaacacgtcgaggtcgagggtgccaggggctactaatgtcacgcagcaaactgggagtaccacctgcatattttaggttgatttggacgatgtataagtgatgatttttgcagaaccacatgccgatggtgcacttgcgtttggaattattgatcagcttactacactaaccagagatcatatataaatactctactctacagcagtatgaagggatttcagggctagcaaatatgttaatgatagatacagagcaaggcgatcaggggagtagattccgatattgatgcgaaaaaaatgcctttgggtcgaacacatactcttgaaagaaaggaagaagcttcttggtaatggagatggttctcttatatttggcaggaggcagaaaaaatccagcatggaaaaaaccacattcaacatgatcctactctgttttgggacatctgattgtttctcactgcgatgaccaatgcgggatgatggtggattcttcaaatatgtgcaaggcactgtgaaatgatcgaatgtcgctaatcattttggaggtttgttgtagggtgctctaccaggtttaaagtttgatgtaggaagggcacacaagtttgatgtttgcagttacagatttttgccaaagcccgctgaaacgaagtttagttcagcagaccatatatgttggaatgtggaggtctcgccaaatacatgttctattgtcgtttattctccactattgttgggcctcgtttctttattgcttcatcggatgtgtaatgttatattggccatgatccagacatttccatcgaccaaatatatattgttagcttattgtatttgtgaaattatactagcctatgtattatggaggaactgtgctaaactgctaatgtagctgcaacagcttgatatatgttctgctacc

SEQ ID NO: 18302 - DNA, 1161 bp, Triticum aestivum
  unsure (1)..(1161): unsure at all n locations
  Clone ID: PAT_TA_18302
ctccaccagccgccggcggtcccgaagtgttccgctctggctctgctgccgccgacggccggagcagtcccccaagtcaggatccgacgactcgggggagcagaaaggaagaaaatccaactgcgcgcaccctgaactgggggagaggacgaggtgccctatgagcgcgattcacaattgtctgatgcgtggaagaatcagcttcagatggatcgaggagatggcctgagctggggtggcgcacagcgcacggggaacaggtacgcaaccctagcaactcctggtagcgaaggtaggagggcggaggtgcgtgggggaagctcggcggaagccgagcgaacagccgtgggcggacggcagggcaagatcaaacgcagaaacacacaagggatcacctacttcggtctcgtatggaagaaaaacaagagcgacatgaatgctatcaacgcggacgatgttatccttggaagcaaggatggtgtaggttcgtccatgaaaccaatctgctgtctctgtcgcaagcgatattccccagacttgatgtacatccggtgtgagaggtgcagaaattggttccatggagatgccttgagacttgaggaggcaaagattgctgaagtcatatcctatagatgctgcagatgtcggaggagggcaataccgggatgtcctcattcagatgattattattataagaggcctgaaccagaacctgtcatccaagaaagtgcagctaatattccctcaagtgaggaagctattggcgcagcagatgaaaatacatcaagtgcttcatttggtatattcgaacaaactgtagaagatattcatgctgattcctcagtgcacatggaaacctttgtgctgggaagtaatcaagagatgaactttgtggatggttcttacaattccgcccatccattccattaaggtgnaaattaancaggctatgaaggaccctcggcatataatgcatgctttgcatggtaagcccctggtantnggtacatgccaacnaattggaccctaanggttccggtgggataatgcccccctgccaattcccaaaaagtnggngaacaacctttntgaaaanaccaaaactgccccccnttaaaaannccttaangggggtttttccgggntttttnctccnggaaa

SEQ ID NO: 18303 - DNA, 764 bp, Triticum aestivum
  unsure (1)..(764): unsure at all n locations
  Clone ID: PAT_TA_18303
ggagtcaagcaaaagcacaccaagcaaatcaccaccattgaagtttcagcatctgtttttcgtagttggactaaacctgattagaaggagatggtgcccagcgatgggggtgcttggccgctgccaccgcctaggatgacctcttcgtcggtgctatcgggagcctagattatcttggcaatcaagccaacaaatcaaaaggagacaaaggaaaatgtgtgaccaaaggagtcaagcaaaagcacaccaagcaaatcaccaccattgaagtttcagcatctgtttttcgtagttggactaaacccgattagaaggagatggtgcccagcgatgggggtgcttggccgctgccaccgcctaggatgacctcttcgtcggtgctatcgggagcctaggctacgtgtccgacgagaactctgcgagcaggtgtagaggagcaagttttggttggaattgaaattcctgaaagcaaggcaactgaatggattaaagcttgaaagctcatacctggatggtttttgtcacaccaaaatgaagtataagaaaaccttataaaagaagaaacatacctgtctgggcgtccttgctatcgtcgtttccaacccgtccgcagggtctgctgctcttgggtgcccttttgggtaatggtctagctgtttccttgcatccatgctgctgcaggggttgtagtcgtacccgtggccatggttattactcatcaacttggtcgtgctcatgtggactatntattttcaacaacgcca

SEQ ID NO: 18304 - DNA, 490 bp, Triticum aestivum
  unsure (1)..(490): unsure at all n locations
  Clone ID: PAT_TA_18304
ccggtcaggccattccgggtccacgcggctagcggtggcgctagggttcgtgcgagagtggaagaagggataatgaccgtggtgaggcgtgtatttatagggacagggatggtactgcgttattacacaggtgcccctggtgattcacatctgaaggacacctggccatcatgcaacatattggaggttgttccacgttcccacgcacgcctggattgtcgggtggtcgttcccacttctccgggtttcaggtgaaggaatgagcattgaaagcggacttaatgtttgtctctgtatcttctgctgacaaggacgcagagaagacattcgacagtttcaatagaatgcatatgatttggagagatagagtttgagatagaaagcatagagaggttaaggtccgatcacattcacttagttcanaagattcaacaagaagacatagctataagtgaatgctgtaaaggacagaacactagtatatatatat

SEQ ID NO: 18305 - DNA, 678 bp, Triticum aestivum
  unsure (1)..(678): unsure at all n locations
  Clone ID: PAT_TA_18305
ttgaatccgtnagctcganttnaaccctcactaaagggaacaaaagctggagctccaccgcggtggcggccgctctagaactagtggatcccccgggctgcaggaattcggcaccagggaatttgaagtcgacatgaggagctagggtgagaagcgaagcaagcaggcgacgcaagatcgacagccctcaccactctcacggtgctaggagggacgatgccgctccacctgctgctcctcctcctgctcctgccgtccgccgccgtggccggcaaggcccgtcagtcctcctccttcgccctcgatttcttccctggcgacggcgccatcgcgcagctcgctctcaccggcgccaatgccacctccgccggcgacatctccatgcgctccccgcgcgcccgggtacagtaccacaaacccattcacttcgcccccgccgccgccggcttctccacctacttctccttctctctccaccctatccccaaatctcacgccgcctccatcgccttcttcctaacgcccgccgcgcccgcgccctcgccctcacccgccgttaacgccctcgccctcgccatcgtcttcgccgccgcggactccagccacatccgagtccaaatcgacctcgccgggtgaaacggccgcccagaccgccccccgcggcatccccaaaaaggt

SEQ ID NO: 18306 - DNA, 755 bp, Triticum aestivum
  Clone ID: PAT_TA_18306
gccgacgagggagttccgcgccgcgagcacgcccacgaatcctgaccctagccccgaaggaggaaaaggaggacgaatccggtcgtctcctcttccctccaaaaccctagccgcggcggaagcgagatctcagggacgatgtcggactcggcgtcgatggcggccgccacagaggcgcgtttcgtcagccgacgcgtgggcggccgtggctccttcggcgacgtctacagagggtttgacaaggaactcagcaaggaggttgcaataaaagttattgatctggaagaagccgaggatgatatcgaagatatccaaaaggagatatctgttttgtcacaatgtcggtgtccatatataactgactattatggctcttatcttcatcaaaccaaactgtggatagtaatggagtacatggctggtggttctgttgctgacctacttcaagctggccctcctctggatgaaatatctattgcatgcattctaagggacttgttacatgcagttgaatatctgcattctgaaggaaagatccaccgtgacattaaagcggcaaatatcctcctgactgaaagcggagatgtgaaggttgcagacttcggcgtctctgcacagctgactaaaacaatggtctaggaggaagacattcgtcggaactcccttttggatggcacctgaggttattcaaaattctgatgggtacaatgaaaaggcggatatctggtctttaggttaactgctatagaaatggc

SEQ ID NO: 18307 - DNA, 446 bp, Triticum aestivum
  Clone ID: PAT_TA_18307
ctggccgcggagtcccaggctgacccacgcgtgtcgagagagctcccaaggtcgcgccgcggctcccccctcccccaccgtatcccgccggtcgctcgcctcgcctcaccgccgccgccggtcgacatggggttcgtgtccttcgccgggagggtcctcttcgcctccgtcttcctcctctccgcctaccaagagtacgcgccctcctcccgcctcccttctccctctccgcttatcatgtccattggcgttcttcttgctccccgcggtcgatcctagcctagtttcgtcagatctgtctccgcgctggcggtatctcggggaacgtgtgggcagggtacgccctggcctttggatctcgtgacggatagtgcgctttgcagaggctcgggtcgtgaggcgcctggatctggcgtcacgcttcgttgtggtccgtgcgaataaca

SEQ ID NO: 18308 - DNA, 675 bp, Triticum aestivum
  unsure (1)..(675): unsure at all n locations
  Clone ID: PAT_TA_18308
ggggctcttctcaacttctggtgatttatgcgatgcatgaggagaatcgggttgttgcacacagcatgctgcagcgatgtcttcttctcctctcttcgcgggtgctcactggtccacgctgccacccatcaatgttgacaagtcaccatctaaaaggttgtccgaggagaaactgctggttttgaacgctagaaagctcctggcatggacaagacagaagtgggaaggctattgctgctccatgctcccggcttgacttaaatatatggacctgattatccctgttgggaattaatcattcttgttgtggcagctacatattaatctagttctagtctctaatctttataccccacatgccttctgtatgttgaattagtttcctatctagttcaatgtagattctgattctagctcctagacttgtgttcaagtgtctttcatttaacagatgagtgcaaagaaggccactggatccgctagaaattgctcgagctgcagggttttgcttgctcgcttgcttactttgctacctctttgtaacctggtcgattttgttttcgtctaccattctcagtgccgagaaaatggagatgcactgcttcacattcgtcaccggattccgggtccattacgccgggcaacccctccgnggtaacaangcnccttcctcaa

SEQ ID NO: 18309 - DNA, 1424 bp, Triticum aestivum
  Clone ID: PAT_TA_18309
ccctcccccccccccccacacgaccccccctccccccctccccccccctcccccccgccccgctctccctctcccctcccctccctccccggcgagcaccagggtcttcagccaccggtccgccctcgccgtgtccaccggggccgaccactacgacgggaacggcggcggcgccgcctccgccaccaccctcttcaccggcggcggcggcatgccctcgcagaccaccgacgccccggcgggcagccccggcggcgtcacccagactcgcggcgccgccgacgctgctcccgctcaccgtcaagcagcttatggacgcgccccagacccacgacgactggtcctggtacgtaggcaatggcagcgaggtgtgcagggtgaggcatgaatgacgcatgatgaataaggcagagcggatcaaatatgtacgatggaatatggatgatggtacaggcaggatagaagtgaatcgctgggcaaatgagacatcggacaatacagaaatgggtttagtcaaggatggtgactatgttattgtcaatggtggactgaaagcctttcaagggaagcgtcacattgttgcttattccgtgcggcttgtaaccaactacaatgatataacacatcactttctgtactgcatttatgtgcatttggatcttgccaaggctaagaaatctgggacgcagccccaagtaactgctaatgcatcaacatggaaccaagctccaccccctaataatcaggccccaacactatctgcatctgggaatgctggtgggcaagatttaactgatatggtcatgaatgtttttcatgacccagtgcttgtaaacctggaccatggagttagtatcgaacaggttgcaagccgtcttaacatatcagatgcacttgccaggtcgactgttacacatcttattgatcttggcaacctctatccaactatcgatgacaaccattacaagtctacactgaatggttgatatggctatgtccacgcgtgtaagcgttaggctcccctggagctatcgaaataatataagcactcttgcaagagttgtttttgcagagtggcttgctggtcctctagacagtcgcaaggagagcaacttaacggctaggttaagttgcatatctaagcacttgcgccttatgtgtaatggatatgagtaggttagatctctaggtgctttgtgtttgctactgcagtacctccagaacatccatgcctgtgtgacctgcaattagtttcgacttgtttgtggttatgaccttggtgtatgcactctgccctgcatattgtttctggattcagttaatgtttgccctaaaaatgcatatcatgcatctgattccaaatgctcggtgcacctcaaaagaatgcaatatcaaaaaggagagaaggtttttggcaccagatt

SEQ ID NO: 18310 - DNA, 1145 bp, Triticum aestivum
  Clone ID: PAT_TA_18310
gcaaaacgatggtttcaagtgcctggagatggaggccaagttcatcggtctgtgtgagaggaacaagataaaattaactgacactgagactgccctgagccacaaaatcaagcagcatgcgcaggacatagttgatggagcgtgtgaatatgctggtgcatatgctgccgctgctgctttggtgtgtatctgcaaagaggctgagttgatgtgcgagagggctatgtgcgggagatacaactctggtaacttgacttgcatgctctgcaatcagctcagagagcatgccatcagtcttatgttgtacaaagggtctggatccatcgccgccgctgctggtgccgccatggtgggcgctgcaaaggaggccaagctgttacgtgagaatctgagcaatctaagctgtgatgaagaaatgtctgtttccattcgggaggaagcctgttgcattctgcaggacatgcacactgaagcttttggtgctaatgggaagaacaacattgctgctgctgctgctgctggagcagatatatctactaggatcagcactgttgggaatttgacttgtactgcagctaataacaagaaagagctaggaagtaatggttgtacagaatggaatgatgataaggaaaacatggagagtagtaatgggaacaacattgttgctgctgctgctggagtagggaaatcttcaaggatcagagctcttggggacttgacttgtactgcatctagtggcaaggaagataataagaggacactaagtaatgggtgtacagaaatgaatgatgctaaggaaaacatggagaatgtgaatcagaagactggggaagaatacatgtggaaaaagaagaccgaagaagaagcttacatggaaactgcataataactgccaaactagaaaagggagagaagtggaagaggatggctaacttgacgtgggctgatggttgtggtggaacttagttgagatggtcttttatagttgtgagattgttcttacggaccgtactactctgtttccttcagtacctatatatatattaacgttggattgatgcgatggaccatattttgaacctgcttggtttgtaatcaaatctgggtaatattagcggtccacctttggaactgaagttatg

SEQ ID NO: 18311 - DNA, 405 bp, Triticum aestivum
  Clone ID: PAT_TA_18311
tggggttcttgttggtattcacacggatcagaccataagttctacacgaggaccacatcgcccaatcatgaatcttcatgagcgaagtttgagtgtcctagcctgccgttatgttgatgaagtaatcattggtgctccatgggacatttcaaaagacatgattacaacatttaatatttcattagtcgttcaaggaacaattgctgagaacatggattttgcaaaggacgagtcacatccatatgctgtcccaatggatatgggtattttccgcagattggaaagccctttggatatcactactagtactattataaggaggatagtttctaaccatgaagcctaccagaagcggaatgaaaagaaggaagccagtgagaagaagtactacgagagtaaaaactt

SEQ ID NO: 18312 - DNA, 2939 bp, Triticum aestivum
  Clone ID: PAT_TA_18312
gcggcgtcgaccggcctcgcctcccccctctcccaccaaaggacccccaaccgggagacacaccccacggcctcctccgcccccagcccccgcccgcctcacaccgacgacacagcccgccaccagcccagccgccatctctccggtggcacagtgattattcattcgtacgaccaccaccaccttccgcccctccccctccacccaaaccccaaatgaggaacaggcccctcggtcgcctccggccatcgccgtcgcgcaccaagcgggaaggaggcggccggcgggaggatgttcgggcgggacccgtggggcgggacgctggagatctcgcacgcggactcggcgacggacgacgaccggagccgggacccggaccggggcgccatgatgcgggcgccagctggacgagacgcagcagagctggctgctggccggcccgggcgaccaggccgggaagaaaaacgaagaagtacgtggaacagtcggtctgcaatggttatatggtcacaaagatcttcattttggaccggacggtcctcattactcggggcgtgcctcttcttcgccgccgcgattatatgacggcaaactcgttccgcacaagaaggccgccgccgccgccgcccggcccactacccccttcgcctagcccatgggctcttatgttcgtcaacgcacctagatgtaaatcacctactgaaccacaacagcgggcattggcggagcaaagcctgtcttgaggaagagatattagagatcctgctaaacaaaaccgaccttcacttctgctactgtttacaagcatgcaattggttcaactactctaaagggtgattgatacaactgaaccatggagggcctctaccgccccagaacgtggccaatgcatctttccttgactagcagtatgctgagaacctagacacggggggttcacatgggtggtatagttgacctaattcctgcagcacagatggcctcagtgagtctgcatagtgagcgtgtgaatatcttccaggcgggcatccacacagaacaagctacgggcttaggtcgaggaacaaatcgcccaatcagggttctccacaggcgcagttcaactcttctgactggtcttgagttgggctgggtaggggttgtgcctcggtggcattctacaaaagcaatgcttactacctttaatatttcaatggttgctggtcgtactatagctgaggacatcgactatacagacgataattccaatcaatctgctgctcctattgctatgggcattttaccataaacctggatagccctttgggcatcaccccatgtacgtagttcgccactggaaaaacataccatctaaccatcaacacacctcatgggatggcaaaccccgccaggcccgtttccggattagccaagcccaatctatggagtgtttacctgggatgccaagcatggaggatcccacgttcttctctggaggatgcagctcttcctaagtccagggaatccttataaatgaactattcagatacactacacaaccatactgacaatgtcatctgcacaaatttaccacgtattcaattcattcaacttcactaaaggaaggattagatacaactcaaaccagtggagggcctcaatccatcttcagtacgtcggtcaatgcacgctttcctttgcctctttgtatgctgcattatctggacatcacggatacatcaaagtgatattgtagacctaatttctataccacagatgtcctccagtaagtttgcaaagtcacagcttgattacatcctaggcaaagaacccacaaaagatgacgcgaactcgtgggttttggaaagaagtacccgaagcgtgttcatcacagaggggcatcaatccctcataacggggtcaagtacggatgcaaaggaggttttaaatggagagagtctaagaaagcaaaccctaatatactggtccgagcaatggttgctggccctgacaagcatgatggcttcaaagatatccgcacaaattacaattacacagaacctacccttgcagcaaatgctggcttggttgcagcattgatttctctagctgacatcgataccggcagatattcaattgataagaacaccatcttctcagcagttcccccaatgttcccgacacccccaccacctccatcagcttggaaaccatgaagagtcagatccctgaacatttcataagcatcaaatggagggagcaacagatggttgtttggtatatacagcgaaggccacgaacagaaagcagacaacataagcttacagagtttctacttctgtatcggtatgacggatcagtataaatcatctgtcaaccatggactggaagttgtgtgcaatttgtgaaactaatttttggggtccttgttgttatccatattccgagttcatgtgtgaagttctttttgtagaaatggtacctttgtaagtcattttgttttataggagtgacttattcgtcccagtaaaaaaaatgtgacattaaaaataaaaacaaatgattggttaccccggccccatttcaaaagacatgattcccgcggggccggttccattccccgttcggggccctatcccccacggcatggtctacaccgggcgggatccgggtccctatgccgctccaatcccttccgccggttttcatagcctggatagccctttggacatcaccactagtactattataaggagaatagtttctaaccatgaagcctaccagaaacggaatgagaagaaggaagccagcgagaagaagtactatgacagtaaaagctttgtcaatggagagtagtggcttctgaatagatcttctcagaagactgttcctggatctttgaggctctaacacaggtcacaaatgaaaccatcaagtgatcttcaattttaccgctccaa

SEQ ID NO: 18313 - DNA, 969 bp, Triticum aestivum
  Clone ID: PAT_TA_18313
ccaatatcgtcctcgggatcccagcgcaggcaagccacccacctgccttctcctcgctttccccatcgctccaatcttcagcctctccacctcagatccatccacagacgcgctcgatccacctcgtggagcgatcttgaggcccgagctcctccaaccttgtgaccccgcggccccggcgatcctgggggccggcaaccacctccagcagctcaacaagatgagcacatgccgcgcccctgctcctttcttctgccctcctacttcgtctctctccctcctctgctctaatctctatctctcctttctcatgcttccgcaggaaccaaagagccctgccccgacgccatggacaggaatcgcggacccaagtccccatggctccttgacggctgcgcgtctggcgtccaagccaccgtcttcttcccgcgcctcttcgctggagtcgccaagccgccgccctgaagcttctccgctgcggcgccaagtccctctgctcggcctcctctgaagcccggtgccgccaagctgcttccccgctggatctcacgccccgccatgaagccgtccatcctcgacctcatgtgcgcgccaccgcttccctgcatcgtctgaagcctcccgcgtctcgcccctctgtctgcttcctctgcatcgagcaagaccagcgccagcggacgggtcaagcccacgttgactgcccgctcgcccgcgccatggacgcgtcgtcctgctgcgtgggctgcctcatcccagcgcccctggcccagctccagattcggcctcaaggcccaatgtgagcagcccccctccagtccctctcctgtacactatcgggccagccagattcggcccgcgtacgtttttttcccagatctgcgattttgctatttatccggagaacatctgttttgtagaaaaaccctctttgttcatgcattaataactcacaagtggtgcatcatatgt

SEQ ID NO: 18314 - DNA, 1752 bp, Triticum aestivum
  unsure (1)..(1752): unsure at all n locations
  Clone ID: PAT_TA_18314
ccccaccccacccccgccccggccaagtcttcgccctccgtcggccccgacaataatatgatctctctctcccccctcgccttcctcggtctcattctctccctgtccaaatatccatccaggacagcgcccctctgatccgccctcctcccctcgcgaggcggccacgccatttttatccagttcttgatccgtgatcctccccgccgccccttgccaagaagccgccgccggtcgccggagaggagggccggcctgaatcgctgccggattccgttcttgtgggctggatcctgtcggagagtgccccggttcttgcggttcggaattggggcgggttgtccgtacgaagggtgaagctgtcgcttcggccttcgggggcttttgatgaattctcgccgatccaggtctgtgaagctagtgtcgtcgcgcgccaagcccctggaggttgacgttgcagaggaggacccgcggatgagctcgtcggccgacaacacggtgtactgctgcattgccaaggggaacaaggtcatatacagctacagcagcaaggatggtgactcgcagaccgaggccacggcggcgctctgcctcgagaacgtgcctccctaccaccggcattacatccacacttcggggtcgaggagctacggctatctgatggcagacgggcacacctttttcgcaatcatcgacccgagcgtcgggaatgtgggtgccttgcagttcctggagcgtgtgcgggatgagttcaggaacacgaatagcaatgggttccatgacgcgctggttccggctgtccagaggtctggttgcttcactggagaagatgccccgtgccccacttgtgcctgggcgtggtgcgcaaaggggagggtcgcatggcagcacgggctgcacatggtggcctggcaatttgaataaaccaagatcttaccatgactgcaatttgagagagacgcgaaagtacaagcctgtggggtcgcttctgcaactggataactagcactgaaaatcgtctttacatcggatggttcggtgttttgatgatccctaccttattgaccgcaacttctatttttattttcgccttcatcgctgcccctccagtatatatttatggtattcgaggacctttttcatggtttttgttttagggaaacaggatttgtttgggggttgttatcccttcttctgcggtgttcggattgtgtttttaccatttttctggttgtagctgctgggggatcaagtaatatcaaaatgcagtgtgtttgggtatgttcctttccagaatggtagatataagccatgaaaagggtagtggaggggatttgatcttcgccttgcaatatgttcatgatcagattatgaaaaattgaggttttttctggtgaagatgtacatattcttcatctcttgtacatgaaatttcaatattattttttcacagacgtgaagtatgctgtctttctgtagtatgagtttatgtttagtttgtgtattcgccggtgccctattcagtgccgtgcctgggtccctgggtaccccctgtgtgtgctcggggactcctctgaatgtgtctccgcttgtgggggtcacatttgggcgtcagggaggaacttacttttttgtggctgcgctgcgctatgggggccgttggcccttccatcttcctagttgctgctgctccaatccccgtccttaaactcctcctggctgctnggcctgtaataagaaccnggtcactgn

SEQ ID NO: 18315 - DNA, 680 bp, Triticum aestivum
  Clone ID: PAT_TA_18315
ccgcgcgtccccgcgcgccgtcgcgcggcgctccgctccacgcgtccgcgcccacctcctgctacgcccctcgcgccgccggccgcctcctgccccgctccgcccctcaccacgcgccgccggccttctcctgcctcccaatcccatctcgcggctttcttcgccgttcaccgctcccctccacctactggtcgcgacctcgtgggaggcagaggatgggagggtgcggcgctggcgtccgactccaggagctccaggagctcgagagggccgatctgcgcgtcggcgacctcgcgggaggcatggcgtggcgtgttgcgctcgagacgagcgggctcgagtaaggggattggagggtggcgccggcgggatcgtggacggggatggagtgggcgggtgccggcaagatcgaggccggggatggagagggcggtcggcgagctggcggctgaggatggaagaggcggcactaattcgctgctacccgcaccgcaccacgtccctagcttcctcctctctgatcgaaccgagtccgttttacaaagggatccggcgactagaggggagctgccaccggtgacgctgccggagaagctggcgagggtcctccagaagtgcgccgaaggagttccagaacgagccccggtatagcggcgaccggtggtaccttcccggctggg

SEQ ID NO: 18316 - DNA, 1388 bp, Triticum aestivum
  Clone ID: PAT_TA_18316
gccgccgccgtctccagcgcaacgggcccctccccaccccgacgcccgccacctcctccgcgcgccgctcaccggccttcctcgcgacccccgccctcgcccccgccgccccaggcggccccgggcaggccgccatactgtatgctctagttgcaggatccactcctggaggaatggcgtacaatgatcccgacaacgagtccttctcgcgcatcctcgagaaggtcaaccaccgccgccgcgagcgctatgcccacctcctggagcctggcgaggtggcggataaacagttgttggaggatgctaagcgcgacagaataactgatggctatggtacatctgggcagccaccgagtacgttggagggtgccaagtttacggccaagaacctgctcatgtaccacccggccgaccgaggggaagcgccgctcactgatgaggagcttgcggtgcggctgaaggggctcaccaaggagatcgacaagtcaaacaccaggttacatgggaaggctctcgctgaagacgggagacccaaagaggaggaggcagctgccatactgtatgctctagttgcaggctctactcctggaggaatggcgtacaatgatcctgacaaaggaaagaagtatgatttggaggatctaaggaagacaccaaacccgttttacattgaatcagggaagaaagcagacaatgggtacagttttgtgaagacaccatcgccagcacctggtgtggatgagtccccgttcatgacatggggtgagattgatggaacaccactgaggttggatcctgacgagacaccagggggtagtgagaggtcacatttcaagatcccacctccacctgttcgagatgtgaaggcacacctgctgtccagggatgctgcgaagaagataaaggcacgaacacatatgtttcacaagccaccactgccatcgcctgtgagaggaggcagtgcaagccccaggaatctgtctcctgcagcacagaagtttgtgaggaatgccattgcaaaatccacacgaaccattgatgagtctctccgtgcaagttacagagggtcgaccccatctgcaggcaccccgaagacgtggttttcggcccacccgggcttggggccccggccgccttcggcgcgccccgcctccgcccctccgtggccctttcggtatcccgcaatgttagatatatccatttcataaactgataaatgctatccatgtattgtattgggaaaaaatgatggtagttttttcagcttggaaatcttagagggcttgccaggtcattaaactattcttgcatttgcatggcaggcgccccccagtgtattgtgatttactgattttgcaaaggcttatctaaaaaaaaaaaaaaaaaaa

SEQ ID NO: 18317 - DNA, 464 bp, Triticum aestivum
  Clone ID: PAT_TA_18317
ggcacgaggactattaaaagaggtcatactagcataatctaagaccagttccaaattacccagtgagactcgtccgatttgtttatccttttgtccttttaatcaagaacaatgtttagagcttacatggttgtcgaaatttagttctgtaaaagaggaatattgatatcatgcaatgatcagtgcagattaggatagttatagagttcttcctcagttttcattgagcaaagattgaatcggtatgatttgttctaataccaagtaaatcttggtctgcgttgtgttagttttcctaccgattttattggctattttcgtttaaattggtagttgatgtgaaaaagtgtgtgttgacatgcatgtaactacatcatgtattaacgtgaggtactacatatacttgcctatctctttccagaagcacaacccttttgatccaactaggaacatcaaaatcaaat

SEQ ID NO: 18318 - DNA, 651 bp, Triticum aestivum
  unsure (1)..(651): unsure at all n locations
  Clone ID: PAT_TA_18318
gcgtccgcgctgatctcccgtgtagcagccagcgacgcatctccggcgagctgcagctccggaggtggtatccatctctcctccccttccctccccccttcggcgggagcggcggggtctccggattctctagccccggtcaccgacggcagttccctccggctccgcccctcacccacgatccgaccgcatcacccggtggcgtcgcggtgaaggttccgcaatcttctggggacctagggagtgagacgccatggtggcggtggatctgatcgcgtcctgccaagactccatccgccagattggagatgagattgcagatgcactagtgtacctggatgcaggcactctggaggcgttccagtttataggagcattccctctgcttctcgagctcggtgctcgggcagtgtgcagcttggaaagcacgtctcctcttgatgctgctgctgagtggaattcaagttttgctcatccagcaaggaagattgtcgtgattacatcacgccttcttagtgatgcacatcggtatattatacgctgcttgggcaaccatggaactgtttcacattgtactgtattgacagcgatttccgagnnnggtcactcagcatatgttgattccccacttggaccnnntgctttccggnn

SEQ ID NO: 18319 - DNA, 692 bp, Triticum aestivum
  unsure (1)..(692): unsure at all n locations
  Clone ID: PAT_TA_18319
gacccacgcgtccggccggcatgcactccacatagcagccacgactcagtagatggcggcatcggcggcccacgtcgcggccctggccgccatactcctcttcatcccttccctcctcgccactgtcgccgcgcagcagggcaaggccaaggccttctgcatcagccagttcgccatcgccagtcaggcttgctccatcctgccgcccagccccccggaggacgaccatcaccaccaccacgacgacgatgatgatgacgacgacgacgatgacgacgacgacgacgacgacgagcaccatggcggcgacggtgaccgccgcctccgtggacgccatggccacgcggcggtcatcaacatctcgtcccttggcctgatggcggcaaacaacgacagcagcgaagttcacgttgcaagaaacggcaccggtcaccatggcggcaaccacacccgccgcgggcgcgggcgcgggcgtcttcgtggtactggacgcggccggcgtgggcgtgtgcgcgacggtgatgaggacccggaccatgacgacgaccacgaggaggaccccgaccatgatgatgaccatgaggaggactccgaccacgacgacgaccatgacgacgaacctgatgacgatgnacgacgacgacgacgacgaccacgagcacaatgacgacgaccacgagcaccaccacgac

SEQ ID NO: 18320 - DNA, 457 bp, Triticum aestivum
  Clone ID: PAT_TA_18320
cgtccggcgcgccggtattataagttaccctgaaagaagctagctagctagctaggggagaacaaagcatactatctatctacctgagggaacaagaaggagcttcgatggccgcgttgcttcggtttgccgcgaggaaggtctgcggccatgccggccttgagcggccactgcagggcagtttcatggcggccaggtcgatcgccgtcgtcaaggaggaggagccgcggaagctgccgtggactattttccatggcaggctgagctcactccagtggttcagcagcacccctgaatcaccatacgatcctctcaccaacaatcacaagcacttccctgtgagcctcggcacacgaggattggaggagaagcggcaggagttgctccgtttgctccgcgagatggacgatcttcaagctgagagatgcaccatggagatcaagaagaacaccaagct

SEQ ID NO: 18321 - DNA, 911 bp, Triticum aestivum
  Clone ID: PAT_TA_18321
cgtccgcccacgcgtccgcccacgcgtccgcctccttgtttctttcctcgccaccccgcgctgcccgtccatccatcgccgatccgtccatgacctcacctcccactgctcctcccactgctcctcccacatctcactaacccatcggcgtcgccttggctgcctgtgtgtatttataggcgcgcgcccacgtacgcggcctgccagtgccaggagcagaccgcgcgcgcgccccgtcgaccgccatggccgtggacctgcagcgcctgcgccacatgctgctcgccaccggcggcggccaccaccagctcgccaaccggccgggcgcctccgcggctgccatgcctgcgagcgggccttgctacggcgccgcggtgacgggccagccgtacgcggacctcttcacgccgccgccgacgatgtcggccgcggaccagtactcggagctgttggcgctggccgcggttgatctggcgaggaagggcgacggcgcccaggaaatgacctccggcaacaagcggaggcgcgtcgacgaggggtcctcgtcggtgctcggcgaagttcttgcggcccacgcgcaacagcaggccgtcgccgtcgaccacatcctgcacagacatgcgagaaagatgtgggctgctctggcggagcagaggcggagccacctgcggctcatcgtctccaccgtggaggccagggcggcgaagccgctcaaggccaaggacgacgaggtccagcggtcccggggcatgaactgggcccgggaggaccccctcgggcgcctcttcagggcggctcggccgtggcccgacgccgcgccgccccccgtctccccccccaccgtgctccgcgccgacctgcagcgggtgctcgacgcgcaggcggtccgcggcggcggcggcggcggcggc

SEQ ID NO: 18322 - DNA, 1111 bp, Triticum aestivum
  unsure (1)..(1111): unsure at all n locations
  Clone ID: PAT_TA_18322
gcttcgcgacgagctcggacccccggagcccgcggcagcgcgggccggcggccggctggcgccggctggctaccccccggcggccccttccccgccgctgcctgcggcgccctgctccccgcccgcccgccgcgcgactcccccacttcgctcctccgcgtctgccactcgggcgggccagcggcggcaaggtcgtcacttctcccggtggcgaggctgctatcaagatgcactacctccggcgccctgcagccttatgctgcgtaggcaatcgtcacccgccctgtctacccttggtcactcggccagttctgatttgagggtcaagttgctgagtgatcaataattttgccgcctaccctgctgtcattgagcttcagactgttactgcacagccttactaggctgcgttggataattgtttcgaaatagacgcctggggtccaatagaaatttccataatgggtacggcattttgaccggcaaggcaaaccaccatatgcttaccatgctcaatacatgtcacaccttctatcccatggccagctcgatggaagtggttaactgcagggatgtgttctgttagattctcttgaggcttcattgtagtccttcagttatttgtaagaaagagatggctcgctgaaatcttgaattgttctggcctgttacgatggatggcagagtcaaaatcgtagatgctgagctgttgcaatatcaacttactagtagtcaaaactgtgccgaatttccccatgaataattatggttgcacctagttgaagcaagtactggcaatctcttatccctcctttttgctattgctgaatgcgaatcttttgtgtgtcaaaaagagaagctttgatcggtatcctgggtgcggatgggccgtggtcacggtggaccctcttcagcatcggctttctttctgtgctgtgtgcgtcccctgttggcgcgtggtcctgggcctttttgttgctgaatgcaacttcgtgaatgccattgttagttcatgtgctcttatcatattgttcccttganccagcaaagattagggaccnctaatttgcactgggagtttttgtanccaacagtancaataaccacacaa

SEQ ID NO: 18323 - DNA, 428 bp, Triticum aestivum
  Clone ID: PAT_TA_18323
ccctccgattctccgccgcgcccgaatcaatcccccggtgaagcgtggagcggctccaaaagtccaaagcccggaggccggaggagaggcaccagagctcaccccgattcatctcgccgtctcaatccgtggccgcagattaggggtccactgttattttcatgcccttatctgggatggccattgctttcaaagcaagcacgagtgcttgtactgcacaacagctgtgggggcatccaaccagggatcagtgtcagcatggtttcactcacttaaatgaacgaaagagcagaaaaggctctgctgcactgcatgccagagctattcctgggaacttagacctggatttcggtgatccttcttggaagcaaaagtatcaggaagactgggataggcgtttagtttgccacatattacagatgtatttg

SEQ ID NO: 18324 - DNA, 1192 bp, Triticum aestivum
  Clone ID: PAT_TA_18324
ccacgcgtccgcggacgcgtgggcgaccggcgcgtccggccgctcgcctcccccagccagacccgaagaatcccgggggcgaagaaggaaaaatatcgcacctcccccgccgccgatcgaagctcgtgccttccccccgccgatcagcgcctccggttccggatccccgcgcgcatccgcatcgccgactctcgagcccaggcaaggtgctactactgtttggtcatttgagttgtgggcactgagtgaagtgctggcatgggaggcgtgtttggacgccacgacaccagcaggcagggctcgcatggcatgaagctagagtcgaagatggtggagtccatgaagcagagagcggcgcatggaacttcggtcaagtcgttcaatactattatcatgaagttccccaaaatcgacgagggcttgagaaaatgcaagactatctttgagcaattcgatgaagattccaatggtgaaattgataaagaagagctgaagcattgttttcagaagctggaaatctcattcacagaggagataggcgatctctttgaagcttgcgacataaatgaagatatgggcatgaagtacaatgagttcattgtctttctgtgccttgtttatcttctcaatgatccgactgcgtcagaagcaaagacaaagatgggattaggagatcttgagtcaacttttgagaccttggttgatgcatttgtcttcttggataagaataaggacgggtatgtgagcaaggatgagatgattcaagcaataaatgagagcataccaggggaacgctccgctggccgtatagccatgaaaagatttgaggagatggattgggacaagaatgggatggttaccttcaaggaattcctgtttgcattcactcgctgggtagggattggcgaaaatgaggacgacgatgaatgaacgatgtggaagcgacagctgaagaatggctgactataaattggttgcatggtggttttatcttcctgttaatagtgactcggcatgttccaaatagaatgactgacatgtctgaacacctgtatcaaacagtgtctgtgactgcttcgcctccactgcgcaagttatgttgtgtaagcaaaatattgacaacattgaaatcccgtgtctaatcaccagcgtaaacttgttcttgcgtagcttatactagttcccatgcatc

SEQ ID NO: 18325 - DNA, 1332 bp, Triticum aestivum
  unsure (1)..(1332): unsure at all n locations
  Clone ID: PAT_TA_18325
gcgacccactcctcgccactccccgcagcgccccaaccgcccgcccctccgccatccctcctccccgccgggatcaaagattcaagatgtcaaacagagccacacattggtgttatgcgtgccgtcggccaattcgtcttcgtggacaagatataatctgtcccaactgcaatgatggcttcatacaagagatcagtgagacacgaggcgctttgaacaactacggtatgtttgggccacgcttcgatgatcgcctagatggacgatttggaatgatggatgctatgtctgccctcatgcgtcgccggatggcagaaatgggcagcaatcctgtgtttgatcctaatgcagcttgggcaagtactacacaaggaaggccatcccctattggccctaggctgatattcggcagcaacatgcctgctcaggggagcgacgacagcggagtaaacgtgcttgtcaggggaggccgaacaatcgtcgcggaccgtccaaacttccgtggcttccttgtcggcggccccagcctggaagctctgcgcgagcagatgtaactgatgccactgcaaccatcaagggcttgcgccagctcaacacttcgtgatcgactccatgccggtggtgaggataacccgcatccatctgagcgatgatccgctctgcccagtctgcacggaaagatttgaaattggctcggcggggttgccggtagccggaaccgaccctgcgcctgtcacctgcatcggcgacgacgatggttggacgcaactcctgccccctttgccccattccgctgccgccgcccccagtcatcggcccttaatgcagcccgtccaccggctgcggcccaagcgcgggtttacggcgacgactcggggttgacggtgccggaccggaccctgggcctgtcgtgaggaacggcgccgacgatggagggagccctttctcgttcctctggccgttcgggtcgtcgagctccggtcccagttcttaccagtacggaggaggcgggggtgagcctgcgcctgcggtttacaacgacgaccctgggcagataacctactctgagtggcactatgatccgtgacactcccctgagctcctgctccaagctggaggcgtggtgtggagcttagatatatatgatgaatctgtgatgggtgcctgtaacgttcacccaaactgtctactgagcagagtgaactactccgtatattctgcagtaaagtaaactagtatatcggactgtaccagttcagttccagctcaactttgtattgtcacacataaggagctgtgtactccctttgttccaaaaaaaaanaaaacaaa

SEQ ID NO: 18326 - DNA, 874 bp, Triticum aestivum
  unsure (1)..(874): unsure at all n locations
  Clone ID: PAT_TA_18326
cgtccggatttcccaactgccacatgtacagcacggagaaagagtttgtgagactaaccatgaaagcactgtgagaagaaccaatcccactgacagaggaactgaggcacgagctttcctgggaggcagcgacagagaggtttgtcagggttgccgaaatcgcaccagccacgcccgccaagcaaactccttccacttcacagcgtttcatgtacatcaacccggatgagctgaagaagaacatggaagaggcgtcggcattttttcacaacaccatctctgggtttgaagccgcccgttgtgtgtttggcgcgataccgaacagcctgcagcccgatgaacagcagtgcaaggagcttgggtggagaccccagggattatagcctttccacctccatgctgttggcatcgaccatacaagtttacaactaatcgcagcccagttggggggctgagggaaccaactctgaaacggaaacatgtgtgctctgaaaaggattaccgcttgacaggcccttgctttgctctctttctggtgtgatgaaactgcagttttccttggtgtcgtccatcagatctgtatctggcgattgtgaagtctaccggcaggtgaggagtgctcctgcaaagttgaagcgctcggcagtgcgacggtctcatcgtcaggtggcatgtatgtatgctttgtaacataacatgcgtggcaactactccactaccgtgtaaagccagcttgtgtttcgcggcagttcggggggctgccgctttaatgggganaggtgnccctnaaaaagggntttnnttgnggggggnncnttttttttttttnnaaaattgggttttttaaggaaananaaggcnttttttaaaaaaa

SEQ ID NO: 18327 - DNA, 648 bp, Triticum aestivum
  Clone ID: PAT_TA_18327
cggcgggtcattgggtgcgtcggatatggattccctttcgactgcctccaccccccgtgccacgaacgatgctgaggtgggatcccaggaagggatccaccatgaggaggaggccccggaggtgccacagggcaacctcccggactttgcactggactctgcaccggaacctgtagtggctccggagtccggcgggcggccccttcgtaagaagggcaagaccgtgacgccggcggcctccatccaaccgggggtgccggatagcttgctggaggcgctcatcggcacttccatcaaagaggaacaccgcaccgtcatgagtgtggtgattcagaaggttcagctcgccaagagcgggctgaccgaagcctgcagcagccttttaacaggctttgaggtaagaattttgatatatgtaaaatagtaccgcatagacagtagccgccgatgctcggttcggtgttcggaaagaaaagccggactaaggatctaaaaagatatacgcatgagtcataaaaatatgtcaatatgggattgctggctagcccgcagcaacaacctcagcaaaaattctggcagtccggatatcaaggaccgcaatggcaggtcgcgtcgcaacaagaacaaatgccgcattaacgggcgtgg

SEQ ID NO: 18328 - DNA, 782 bp, Triticum aestivum
  unsure (1)..(782): unsure at all n locations
  Clone ID: PAT_TA_18328
ggggcgaccccgaataaccctagcttcttcctggtcctcgtcgtcgccgtggccctcctacccgccagccacccggccggcgccccgatcccgccgccatggtgctcggcaagatcgccatcgtcatcggctcagggatcatcggaaccatggtcaccggcggcgacggcagcaagcttccggacctcagggacgtgctctccttctccttcaagttcatgaagcaggacaagaaggaaggctcgtccaacgcctcgccgcagaacgacctcttgttgtctcaggtcaactatctcagggatcagctccaagcattgtcccgtgaggctcaatgcccgcagattatcaacgtcaatggcggaccaggcgctggtgcttatggtttaacttttattgctgttggagccattggctatttatacataagatggaagggatggaaaatttctgatatgatgtttgtcaccaagcgtggcttggctgatgcctgcaacgtagttggtaaacaattggatcaggtttcagaaagtgttcatgcttcaaaaaagcatttggctggaaggatcgaccgagtcgattgtagtctagatgaatgccacgaaattattgaagccacagggaaagaggttacagtgatacatggagatctaagtgcctttcaggaggaaatacantcagttcaccatgttgtccgcactctggagacaagcttggcgccttgcnttactcaagatccacaacacgaggaatcatgagttatgtgaggtcactaaagatgggat

SEQ ID NO: 18329 - DNA, 542 bp, Triticum aestivum
  Clone ID: PAT_TA_18329
cgtccgcgacgctgcctccagtacacctccgcccgcctgcagccgtggatggagatgacgagaaatagatgcaccggaatgaatgaatgacgcgagatctccctccatgtccatccccatccattccgccaccatccttcaccgctggccgcagtgagtgacgcccacctctgcctacattcattcccattcccctctcccacgcccgcgtgacagccttcactccactccaaccaccaccacaatgcagcccctcctcgggctcgccctcctcgccctgctgctcctggcctcgccggcgccggcgctctgccgccaccgcgcgcccgccgccgtcgccgccaccgagacgctcgacgtcgaggcctccctctcccgcgcccgcgccgccgtctccaccgacgcgctccccctccaccagtccctcgccgccaccgacaccgacaccaatgttctcgttaaggacgagccctccggcgggccgagcggccggctcgcgctgcggctccactccagggacttcctcccggaggagcaggggc

SEQ ID NO: 18330 - DNA, 679 bp, Triticum aestivum
  Clone ID: PAT_TA_18330
cgtccgcggacgcgtgggcgccggggaaggccttcccggatgggccgtggatgccgccgaccggcgtgcaggtggggagcacgttcaagggggtgggggaccccacgacgccgatgtgggcgtcgtcggaaggttgcgagcgtgtgagcgtcgcgaaggcgatgtccacggacgacatgccggggataccggcgctgccggtgtcggggagggacggggaggagatactacggctcgtcggcggggacgtcgcgccagaggattggcaaggcggtgacggcgcgccggtttaccgcctcgggcccgggccggcggtactcaatctgacatacacagggaatgagacgatagctactattcagaatgttatttcggtgattgaagggaaagaagaacccgacaggtatgttattcttggcaaccatcgtgatgcgtggacatttggggcagctgacccaaacagcggaacggcagccttgcttgagctagctcaaaggttgtctaagctacaaaccaagggttggagacctcgccggaccatcattttgtgtaattgggatgccgaagagtacggattgataggttccacagaatgggttgaagagaacagggcaatgctaacttcgagaactgttgcgtacctgaatgtagatgttggggtgtctggttctggagttga

SEQ ID NO: 18331 - DNA, 823 bp, Triticum aestivum
  Clone ID: PAT_TA_18331
cgtccgcccacgcgcctgcgcaccctcctcccgcttcctaccaccatcttccccggccaccggcggcggcgacaatggtgcagggacgccagggccagcgcgtcaggctctacgtgcggggcaccatcctgggctacaagaggtccaagtcgaaccagtacgagagcacgtcgctgctgcaggtggagggggtgaacaccaaggaggacgtgtcgtactacgccggcaagcgcatcgcctacgtctacaaggccaagaccaagagcagcggcaccgccgtccgctgcatctggggcaaggtcacgcgcccccacggcaactccggcgtcgtgcgcgcgcagttccgctccaacctccccgccacctccatgagcaagaaggtccgcgtcttcatgtaccccagcagcacctgaaggctatgttgcctattctatttagatctagctggctttgtggatgtctgttatcagtttgatgacaggtttataaccaaagattttgtcggtgattttggaagagtttagttacagactgttagtttcgtctcgtgtaactcaacttggtgacacattttgctctgaaatgaagtatgatgtggctattaacgctttctctgtaggctccgttaacatacagtctgtgttgggtttcccccgtctgtgattgcatcatagaacttttcaagtttctgtgtgcgtttttgccccagacgagaagggttgctccccgtcccgtttctcgcagccttgcctccaaagaccccaatacttgttcaatcataacccttataatcgtggcatggaaagttagcatgttgtgagtg

SEQ ID NO: 18332 - DNA, 1099 bp, Triticum aestivum
  Clone ID: PAT_TA_18332
attaaaaccaatgggttcaaccccggtaaaccttgggccaaaccttaataaaatttaataatctcatatcaagagccaagatatgtaacctgataaggttgtggaccaatgggatgacagtgacactgaaaactcctctggaagtgcatcatatcaagttgttccttacaagaatgcccaaggagaaaacaccttacctgtgctgtctaaaaaaaaggaaattcattattagtacatattctgtgcaatgtagtacttgccagaaatggagagttgtaccatccaaactgaaatatgagcaaacccgagagaatattatacaagttcctttttcttgcaaatatgtccatgggtggaagccacaagttacatgccatgatccaactgatatatctgaggataatggcatggcatgggcaattgatatcccatgcatccctcagacccctcttgggtgggaaaggaatattactctaaggaatgaacagagcacgagattcgctgatgtgtactatatctctcccgcaggcagaaaagtaagtcccttgaaagttgtcgaaaggtatcttgaagacaacccagactttgctgcccgcttacagttatctcagtttttcgttcagggtacctaaccctccaaattgccctcgtcagtcagacgcttattgaaccaactgaagtgccacctccggttcacgaggatcccgtgcacaactacatgccggtccctcatggagaagccaatcatttaactcatataccagttatactagctctacaagtaccagtgatgctctccaaaaagagaaaagtaaaccagtgatgctcctccaaaaagagaaaagtaaaccagtgatgctctccagacagaaagaaaaatgctctatcagtgatgttcaaatttcagacttgaaatgtgctagtttgctgtattatcttgctgttaatgttctaccttagctaagctcgctccccttgtgccgtactttgctccagcttggctggaactgagagttttggggacatcaacatcaacagaggaatgttgttgcagaaagtattgaaactgccacattgcttttacctcaaaaaaaaaaaa

SEQ ID NO: 18333 - DNA, 185 bp, Triticum aestivum
  Clone ID: PAT_TA_18333
caccacaatatctcagattcttcaactaagcaaaacatgcatactttaacacttcagtaatgtctcttccatcatcataatcttgcgtaacaacaaacgagaggaaaactagcgcaaaggaagagcctttttcttggctcggcggtgcggcgcgcctactgctcggcggtgcgcggacgcgtggg

SEQ ID NO: 18334 - DNA, 496 bp, Triticum aestivum
  Clone ID: PAT_TA_18334
ttttaatgactttttttgaactggacaatgcagtgagatttccattaccaacatcacagaaaattacagatacttgattaggtcttcttacttcttagcatgcataccggaacggatcacagctactgacgggaaacaaaaaaaaggagggctggcgcgagaccacctagatctacttctcggacgagttggggccgcgcttcttgccgaagccgacgacggcggtgacgaagcggcggttgtactggatgcgcttgtgggcgcggccgcgcggctgcttcttcttgtcctgcttcgccaccttgggcgtctggccccgcaccttcccggctcgggccagcgatccgtgcaccttacccatggcggctgcggcggtggagcggcggcgcttcggcgaggagacggagtgctcgggcggcggcggcttctgctgagcgcttcggcgacgagaacggggagcgctaaggcggcggcggcggcggtctaataggcagat

SEQ ID NO: 18335 - DNA, 633 bp, Triticum aestivum
  Clone ID: PAT_TA_18335
aactggacaatgcagtgagatttccattaccaacatcacagaaaattacagatacttgattaggtcttcttacttcttagcatgcataccggaacggatcacagctactgacgggaaacaaaaaaaaaggagggctggcgcgagaccacctagggcaacgacaaacaacaagcaaatttaagccatgaacccataccacaatatctcagattcttcaactaagcaaaacatgcatactttaacacttcagtaatgtctcttccatcatcataatcttgcgtaacaacaaacgagaggaaaactagcgcaaaggaagagcctttttcttggctcggcggtgcggcgcgcctacttctcggaggagttggggccgcgcttcttgccgaagccgacgacggcggtgacgaagcggcggttgtactggatcctcttgtgggcgcggccgcggggctgcttcttcttgtcctgcttcgcgaccttgggcgtctggccgcgcaccttcccggcacgggcgagcgatccgtgcaccttacccatgtcgacggcggcggtgggttggagggcgagtgcgcgagggtttgcggcggcggcggcggcggcggttgggagggagaaggtcgaataacggccggc

SEQ ID NO: 18336 - DNA, 744 bp, Triticum aestivum
  unsure (1)..(744): unsure at all n locations
  Clone ID: PAT_TA_18336
taggggcccttttttttttttttnttcnnnnnnnnnnnnnnnnnnnnnnngacaacaacaaacaaggaaatttaagccatgaactcattaccacacattgttgtaataatcacaaacgaatttcataccacaatatttctaacacaatatctcagattcttcaactataggataacatgcatgcatactcataccaccaacaatctcagattcttcaactctaagcaaaacaatgcatacttctaacacttgagtacgtaatgtaagtgaagtctcttccatccatcagctacgtgtcgtaaaccatcataatcttgcgtaacaacaaaccgagaggaaaactagcgcaaaggacgagccttttgcttggcgcctacttgtcgggcgcacctacttctcggagggttgggaggccgccctccggccgtgacggacgcggccggaggagtcggagccgcgcttgttgccgaagcgcgacgacggcggtggcccgaggggccggttgtactggttccgcttgtgggcgcggccgcggggctgcttcttcctgtcctgcttcgccacgttgggcgtctggccgcggcctcttcccggctcgggccagcgatccgtggaccttacccatgtcggctgcggcggtggacggcggcggtgaggcgacggagcggcggcgacggagggttggaggcgagtgcgcgagggtttgcgacggcggcggcggttgttttggagaaccggcctcga

SEQ ID NO: 18337 - DNA, 1625 bp, Triticum aestivum
  unsure (1)..(1625): unsure at all n locations
  Clone ID: PAT_TA_18337
ggcaaggcccccagccaggctgctcttaacgacgagggcgtcgacctgcccaggtgggtgcagtccgtcgtgcgctctgagtggactgcggaggtgtttgacatggagctcctgaggaaccagagctccgaagaacagatgattcagcttctacaacgccccggccgcggcgccgcccgcgtccctggccccccccccgcgccggcccacgtcggggagggggccggtcttcttcgggtctgcggccgccgtccaaccgttcgacttggaggacctgctgcgcgcgtcggccgaggtccttggcaaaggtgccatcgggacgacctacaaggccgtgcctgaatccagcgctaccgtggcggtgaagcggctcaaggatgtcgccatggccgagcctgagttccgtgaccgcattgcggacattggcgagcttcagcacgagttcatcgtgcctctccgtgcttactactacagcaaagatgagaagctgcttgtgtacgacttcatgcccatggggagcctttctgcagtcttgcacgggagcacaggttctggtcgcaccccacttgactggacgataagatcaagcattgcccttgctgcagcccgtgggatcgagtacatccactctacaagctcttcgacttcgcacggcaatatcaagtcctccaatatcctcctgtcgaagacgtatcaagcacgtgtttcagacaatggccttgccacccttgttggttcatcatcatctggaccttctcgcgccactggataccgtgctccagaggttaccgatccccggagggtgtcccagaaggctgatgtgttcagctttggtgttctcttgctcgagctgctcaccggcaaggcccccagccaggctgctcttaacgacgagggcgtcgacctgcccaggtgggtgcagtccgtcgtgcgctctgagtggactgcggaggtgtttgacatggagctcctgaggaaccagagctccgaagaacagatgattcagcttctacaacttgctatagactgcgttgcccaggtcccagacgcccgtccgacgatgtcccatgtcgtcgtgcggatcgaggagatcaagatgtcaggtggaagcaccgaagaaactgatcaacaacagcagagcgccctgaatcagggcgatgagatggtcgagggcccctcctcgccgtgatctctaatggcctgagagaaaggagccggctgcctgtcgctgtagcccacattcattccgttcatagacttgacgaatgctatcttcttcttcgacggcggagccggctgttttttcatctcttccttttagcgaacgtcggatttgtcgtcgtcgtctctgtcttggtgttgttgactgactgtgggtgattgtgtggtgggtgattgcgtggtggtgtttagggatggaatgcatgcccgactgtgcgattgcttaatttgtctagccattgttctagctgattaggttggttctttagctgtccccatgtaattactcagcccgatcaaattgcctggaactcgttggcgaaaaccatttgtcgtgagtttaaaaaaaaaagcagatccagccgacaacccccgcaaagcaaacaatgggncgctccctcccc

SEQ ID NO: 18338 - DNA, 1750 bp, Triticum aestivum
  Clone ID: PAT_TA_18338
gaaggttaatgcaaatattccaatattatctcccgtcctctcttggatagttgcgtccgggaacacacgttcttctgcacaatggggggcaaatctgttggacagtatttagaattgctaggacatcatacttatttgagttgtttcattaaaccagtttccatctctttgctttggcaatgcaaactgaagtgtgatctagtctgaagtaattacgggtgtatggttagctcagtgcctcagtagcaaaacttcatataaatctatgtttataatcttatctagttgagcttgagccagtcctgaagcagttatgtcttcattaagggcatgctttcgaggaattgatgtacaatacaaaaagtatcggtaacagtttccctaccataaggataataccgcgttgcttgattatccatccaactgaacaggcataaaatcccagtgtctctgtatatgatttttttgaacttatgtgtataaatgcattcaacacctctcggtttctttgttatcaggtatacttgtatggaggccaagtaacctcttggaaaaataactctggagaacaacagttatttctcagtaagaaggcttctttcaaaccaccaaaagcgattcgtgggggcatacaaatttgttttcctcaattagggaaccacggagttgttgaacagcatggattcgctaggaaccgactttggagtgttgatgagagtcctcctcttccagataccacttctgattgtcatattgacttgatactcaagcagtctgaagaagatatgaagacctggccacacagttatgaacttcgtttgcaagttgctcttagcccgaggggagatctgatcctcacatctcgaataaaaaataagaatgctgatggcaagccattccaatttacttttgcataccacacatacttttcagtctctgatatcagcgaagtacctgcccgggcggccgctccctccggcgttcgtccctgcctgccggccaacctgccctgtaccgtacaaggcgttgcggttgttgttgagtctggagtggacaggatatatctaagtgccccacccaagattgtgacaattgaccatgagaaaaaaaggacattcgtattaaggaaaaaggaacttccagatgttgttgtttggaacccatgggacaggaaagcaaaagcaatgccagattttggtgccgaggagtacaagtgcatgctgtgtgtaggggctgcacgtattgagaagccaattactttaaggcctggtgaagagtggcaaggaaggcaggaaatttcccctgtgccatccagttacagcagtggactgttggatcctgaaatgattcaacagatgcaacgtatctagatcttttggtggttgaaatgctatgaagtctcttcagtgtcaataagataatctgaatgttcttcatccaacttccagctttcttttttgtgtacaattccaaagtagcctgtggtttctctggagcagcactggagttgaaatctccatcgtgatttaaaggaggcggagaatttttgtctatctttagggactttatgtacattcataatcagtcgctttacattacaccatttttttgccctattataggaggctgatttgaaactgcacaaatagtattgtgtcaattttgagttgcctcgtgccatattgcagcactttacccgtatggtgtgtaatacttcctccgttcactattataagacgctttgattttt

SEQ ID NO: 18339 - DNA, 1091 bp, Triticum aestivum
  Clone ID: PAT_TA_18339
cccacgcgtccaaaaaagagtcatttctgcttgcaatacttagtagaggagatatggcccagaggacaatttcattgtgcctaatccttggcttactagccgcggcagcacctgccaatgcaaccagctttgatttctattacctcgtcctaatgtggcctggagcatactgtgtggacagcgagtacggatgttgcgtgcccaagtacggatacccggcggaggatttcttcgtccagagcttcacgaccttcgacttgtcgctgaacaaagccatcgtgagatgcaatagcgacaaaccattcgacattaacaagctggagccaattgagaacaacttgaaccactactggagcaacatccattgtccgcgcaccgacgggacgagcacctggaagagcgagtggcgtagctacggcgtctgctcgggcctcaaggaggtggactacttcagggccgccctcaacctccgcaagaacgccgacgtcctcggcgctctcgccgagcagggcatcaacccggactacaggctgtacagcacggagcacatcaagtgggcggtgaaccagaagcttggagtgatgcctggggtgcagtgcagggacgggccgttcggtaagaagcagctctaccagatctacctctgcgtcgacaagaacggcgaggccttcatcgactgtcccaagctgcctaaactgcagtgccctgaggaggtcctcttccacccctttcacacgtggatgctcaacgccacatcgcctgccaagatcatgttgccaaccgaggcctgagagccacccgcccggccggtgcctcacctgagtacgtactactgtggcctggagcattatatcgtgcttgttgctccagtgaataaaaatggatggttgaataaataaaagtgtatacatggttgggagttgcgacttgtcataagaacatgaccgtcaaatcgcttctctactagctactatgtatatgcgtatctataatatttgtaatacgtaaagtatatgaatgaacaattttattatgtcaaaaaattaaaaaaaagaaaaaaaaaaaaaaaaaaaaaaaaagggcggcccggc

SEQ ID NO: 18340 - DNA, 707 bp, Triticum aestivum
  Clone ID: PAT_TA_18340
gtcgacgccacgcgtccgctcgggaatccgcggctcctactcctcctgccccgtcgccaccgccgcgaatctattccgctgtgcctcctcatctgctcgtgctcgtgctccggcctgtttgcggcgcaggtgactcccagaatcttctttcgggaggggggtcagggtgagctacagcaagacatcttggcgttcaaaagccatgggctctgcccatccctcgcaaggattgccttcagggatggacccttctatggtggatgagtacgcttcccagtccaagctgttgcaagaatttgtcaagatacccagcattggcaaggcttgggtcttcacttccaaagatgaaaacgcatccagggcaatggtttctgttagccagtcggatcttttggccaacaaaaagaggagtttcctttctaaatactcacatctcaaaggttcctcaaagtccgccagtttccaatgggtctccttcccgggttgaattcagcgggggtgtctgcaggtcgttcccagcacccgtccggcagacatgcttctgctagtacgcgtggggcgccggccgctgcgggatgctgtggagggcgtcccccctaccaggttggggctctgggggccctggctgctggggaatgaaatacatgttgcacgatctgttcatgggtcgctgtacactgatggatggtttgaagggatttcatgga

SEQ ID NO: 18341 - DNA, 722 bp, Triticum aestivum
  Clone ID: PAT_TA_18341
agaaaatccccactccccccgccgccgccgccgccgccgtgcgagggatctccggcgaccggagtccctggcccctaggacgcatcgaccttcttcacctgcgacctcgccggcctgccctgcctcgcctgcggctaagccggacggcagtcacggtcgccgcaccgactaaaggatcatattgctccagctcgaatgtctcaagccgaggctcctcttttgctccatcctccatgctcaccgacaatcaggaggatcatatcctgtaccagcttgtttattcaatgatgttctgaatttctcgggtcgaggcttctctttctgctccatcctcccctgtaaatttcagccacattgttgggtcagctatctcaaaggttctatttggaagtgcatcctcgacaaacttatgcaaatccaatgaatctctgaacgtgccttctgttggcctccttccggtaaacatctcaagcagcaatatgccaagactataaatatcaccagctgttgagactacagagccttttccatactttgcaattatgcaaaggtttgtggttaacatgccatatttgagtgaaaaagtaaaatataaagttagaagaattttagtcacctggagcaacataaccaatggaacctttaattccagttaagctataagaagtttgtgtcccctcgcttgtatttttttgaaggatccttgatatgccaaagttttt

SEQ ID NO: 18342 - DNA, 1694 bp, Triticum aestivum
  Clone ID: PAT_TA_18342
cgcaagccgcgcacgggcgccccggcccagcggagcaggcgaaccacgcggcgatccccaagcgtgcggccgtcccccggtggaccccgcgccccggcgggcccccatcccgcacctgcctgaccgccacaaccccgccgacggccccgcggccgcggtggtgaacgtcatgctcagcagcagcacggtgtctctgcaggcgccgtcgaggccaacgttctgcgtcgacgacatggagggtttttcgggcatgtactcgggtgcgtatccaaggggatcccagtcccagtccaccggggacagcaagccccaggcagcgaactggacgtatcctggcgatgtcactccctctgattgcgaccctgcttcttattcgcgtgtgcgtttgctaatggagaaggagggaatcggcagaaagaatgccgttagtaccaataccctattcagctactaattcagatgacgtggaaagcattgataccatcgtgctccggctatcgacgctgcgggctgcaacagataacttcgccgagagcaacaagcttggggaaggagggttcggtgcggtttacaagggtgtcctctctgaaggtgaagagatagccgtgaagaggctgtcacagagctccacgcaagggatagaagagctgaaaacagagctggttctggtcgctaagcttcagcacaagaaccttgtgaggctccttggcgtttgcttggaaggacaggagaagctgctcgtgtatgaatacatgcccaaccggagcctcgacaccgttctcttcgatgcagagaaaagcagggacctggactgggggaagcggctgaagatcgtgaacggggttgcccggggcctgcagtacctccacgaggactcccagctgaggatcgtccaccgggacctcaaggccagcaatgtgctcctggactcggactgcaaccccaagatctcggacttcggcctggcgaagctgttcggctgggatcagtcgcaggccgtcaccagccacatcgccggaacatacggatacatggcgccggagtacgcgatgcgcgggcagtattcacgtcaagtcggacgccttcagcttcggcgtgctgctcctggagatcgtcacggggaggaagaacagcagcttcgctagcccggactcggagccatcccttgacctcttaagcctcgtatgggagcactggactagcggaacagtcgagaagctggtggatccgtccctcggcggccgttcgcctggaggccagatgctgaagctggtcaacatcggcctgctgtgcgtccaggacagccccgccgaccggcccacgatgtcggcggtgaacgtcatgctcagcagcagcaccgtgtctctgcaggcgccgtcgaggccgacgttctgcgtcgacgacatggagggtttctcgggcatgtactcgggtgcgtatccagggggatcccagtccaccggggacagcaagccccaggcagcgatgtcgccgtcgccgaacgaggtgtcactcacggagatcgaaccaagatgatgagcgcgtaggttaaacccaagacaaactcgccgtctccatcgcatatatagtcctgaacctgcttgtaataacttaatcagttaatctcctggatcattatctatggtggttgtactagcttgcgataatgtttcacggcttactagtagtatttt

SEQ ID NO: 18343 - DNA, 1299 bp, Triticum aestivum
  Clone ID: PAT_TA_18343
ggccgtgcctactgccctgtctccaacagttctgaatgtgaattggatatgtgaaatcattcgaagcaatccatatgtggtgaatgtttcaatcccagtggcgggctacgatccaatcgaattcacgcttaccaaagaatgtggttacacacaagaaaaagagagtgattctatgagagggtgggcaacatttggaatcatctcttgcatattcattgtcttttcgagcctactttgttgtggggggttcatctacagaagtcgtgtagagcatcaggatggtttacatgcactgcctgggatgactaccgtgtctgcctttctggatgctgttggaagaccaagaggctacctgagagcaggtgatcctagtggaaatcattcaagccaagtatcatgggagaacacttctgttaccacaccagcagcacagaggacaaatgatggaagatatgggacaatatgagccatgcttagttttgtggaatttgtcttctaggtctgcccttcttacgcattttacttgacctttctttgttgcattggtcgtgtgcaggtgcaactgtatcagctacctgttcgccgactttgcatccctccatctcaccgcgagttcccagtatggtccacgaccaaatactgttgagcctccggtagttaaggggatagtatcagcacttcagattgtgtgtgggcatgcttcttccagtgcagcttttatctcacccctaacttcaagtccgctaacagatttcttgttggcaggagcgttcttctcgcttgcaactgcctggccgtcatcaagcgcaaccgttgcttcgcatccctgagcaaagcagtcatggaaaaggagcctgagaagggacgcggcgatgcgcggttccttggcaatcgccttcttcaggacggagactacaatctcatcagcttgcgggcatgtggacctgtagaaatgtggcagaaaggcctggctttggactgtgtccaattggatgggcaccctcaccctcatggtgagcagggaagaaggcaagggaggctgagaagtagaaagatgcaacgaggatcgcgccgaggcatctcttggatgatgccaccatcatccagcctgtgatgcactgccgctgtgtcttggcgcttgcacccggcctcctgtgtacgggtcgagcacctcctctggcgtcgctgggtcgaccgcttgcatcgttccatccactccactcgtggtaagattaggaaccatgtatgtgcttcaggtgcacctgatttagagatagcttttgttttagttccttgatc

SEQ ID NO: 18344 - DNA, 1736 bp, Triticum aestivum
  Clone ID: PAT_TA_18344
gcgtgatccctgccgccctcgaaccccacgccgacgcgctcgcggacgcgtgggcaaaaaagccccagcgccgccgaaacccctcctgcgcccccttttcgcaccggagcacacctcgaagcccctccactgcactgggagtggagtcgagatccgccccgccgtgattcctacggctgatcgatctgagtctgtcttcgtggggagaaaggtgcgtacctcacaggtgaaaagatgggtatcctcgagaggatcaaggagattgagccggagaggcccgggacgcagaggaacaaagcaacagaataccttcttagacaactggtgatcaaaatcacaaaagttaagacaaggatgtgaaatatgtgctcgtgtggggaacgagtgctcggcactatccacagcattgtggtcttggccatggtcttgaagacgaggatgtggtccagatagtgaagaagaaggaaaaagaggagggcggacgaggccgtttcaagtcgcacaccaatgcacctgaccgaatctccgacagggtgaagaaagctcctctcaagagacgacgcaatcgcggatcttgatcttgccggtatcattgaaggcgcctctgaaggcaagggctggcatctgcaggttatcgcttgacaaaagtcatcagaatccagatagtatatgttctctcatgcaaaatatgaagggcatcgccaaatattaactagtgaactggaagctgttggcctccgtctgaacaaaaggcctcctcagatatacttcaagaggaagaagactggtgggatttctttcaacagcacagcacctttaacccatattgatgagaagctctgctatcagatactgcatgagtacaaaattcataatgcagaggtattattccgtgaggattctactgtggatgatctgattgatgtgattgaaggaaatcggaagtacatcaagtgtgtttatgtatataacaagattgatgttgtgggtattgatgatgtggataatcttgctcggcaaccaaattcacttgttatcagctgcaatttgcagttgaacttggacaggctattagcaagaatgtgggaggaaatgggtctggtgagagtgtatacaaagccgcagggtcagcagcccgatttcggagatccagtggttctttctagtgataggggtggttgcacagttgaagacttctgcaatcacatccacaggagcttactcaaggatgtgaaatatgtgctcgtgtggggaacgagtgctcggcactatccacagcattgtggtcttggccatggtcttgaagacgaggatgtggtccagatagtaaagaagaaggaaaaagaggagggcggacgaggccgtttcaagtcgcacaccaatgcacctgaccgaatctccgacagggtgaagaaagctcctctcaagacatgatcccatcgccgatttggaactagctgagccggatgctattttgggcgaccatcaagcctggcatctccgcacaatcatatgacaaatgttgcttttttccagatagtatatgtgctctcattctgtataagatgaggcaggcttgtgtacacgcagtgagtgtttttgccagcaaactttgcaaatgagttagttacagatgccaccccttgtgatcgtactgtgtttggaccattaatcacccacgcgattaccccccacgtctcattcgtcgaagaaacctggtgcattaccctaaaaaa

SEQ ID NO: 18345 - DNA, 576 bp, Triticum aestivum
  unsure (1)..(576): unsure at all n locations
  Clone ID: PAT_TA_18345
cgtccggaagggatcgaatcaacgagaagatgcgcgccctgcaagaactcatccccaactgcaacaagattgacaaggcgtcgatgctggaggaggccatcgagtacctcaagaccctgcagctccaggtccagatgatgtcgacgatggggacggccgggctgtgcatgccgccgatgatggcaatgcagcacatgcagatgccgcccatggcgcacttccaccaccaccacctcggcgccatggggttcggcatgggccccttcgacccgcgcctcgtcgccgccgccggcgccgcgcagttcccttacccgatgatgcccggcgcgcccattttcggcggccacgcgatgcctcccccgccaccgttccaccaggcggcggtggcgggcgctcacatggctcccggcccggtcaccaacgatgccgccacgcagcgcaagccgagcacgagcagacagggcgacatcgcaagtcccacgaaaatgttaactaactcaaancgcggangtcaactggtctgtacaagtaagggcgccgcaacaaagtcngtactcnaacaaggtgcgnaaaant

SEQ ID NO: 18346 - DNA, 1216 bp, Triticum aestivum
  unsure (1)..(1216): unsure at all n locations
  Clone ID: PAT_TA_18346
catcgatgactgcagaaaagaagcttctgtacaaaagccaaatagacctaagaatcaggaaaaagaagtctggccagaagaagattactggcttccaggtacatgtccgcacggtgcaagcttggtaggggcctcgtgacttggtttccgctccctgcttgccccccgctggtcagggtgctggggtgggatctcccatgggtcgctgccttttgcttgatacatctgtcatgtgccttctctacaaaagccattcagaccctagtgtcaggccaccgatgcctccccagtagctgtgttccggcctccagtttgctccaggaagctccttggaagtcctgattacttctgcagattcaagaatccgtgttgttaatggcgacgagcttggtcccaatggtactgctcccagcgtccgctccattgtgagatcagcttctgtggctccaacagggaaatacgtagtcagtcccagtgaggactctcatgtgtacgtctggagacatgacaacagttcccatccgagcagaagcaggagtgcagttgctgtaaccaactcgtatgaacatttccactgccgtgatgtaactgtggcaatcacatggcccggtgctgaagcccgtggatcgctcgggtgtcgtagcagcaggcacagcgattcggatggtgcagtgaactctgttcctgaaactcctatacaaaacaaggagcatggatcgagtggaactgctcacagtcagagatacatcgagagcccagtttgcgaaggtggcgcgagcacaagcaccagcaatcatccggtcgaagcagcgtccccatccttgcccgacgaccaattaccgtctgccaaagagcagtcctggtcacagtcatcggatctttgcatcggagctatggatgtccagcgccggccgcgtggggtctggtgatcgtcacggcgggacagggaggagaactcagagtgtttccaattttggtttccccgttcaagtgtgaattaagcatgagagagggcggtggtgttgggtccggtactgccccattccttgactccctgccgcgttcagccacgatttgccccttgttggcccccccccccccgtccttcttcttcgtcactnttctctctgcctcgcatacaactgtgtatgggtggtaacggcaatacattattgtcananctggtgntcnntcaagnacaganaaaaaaaaaaaa

SEQ ID NO: 18347 - DNA, 767 bp, Triticum aestivum
  Clone ID: PAT_TA_18347
ggaagaactcggagttcctggacaggttcggcgtcaagaacaagtccaagctggtggtctccgaggatccggcgagcctggagcggcgctacatcgagcggcagcggaacgccaggatccagaacgccaaccgcgccatcggcgccatcgccctcgagctcgacaagctcgccgatcaggtgacgagcatcgagaagtcgggggccggcgggagcaaggtggcggaggtgcagatcacgacgctgatcgagctgctgatgcggcacgcggtgaagctggagagcatacctgccgacgccgacacctcctcgcagaagaacctccaggcgaagcgggtgcagaagtgcgtggaggcgctggacgtgctcaaggtgtccaacgcgcggctgcagacggtggtggtgaccaccaagtgggagacgttcgacaacagccccccggtcaccaccaagtgggagatcttcgactgatttaagcagcagcagggcagcagcagcagagattttttctttatacagaagagtgtccatttcgttcgtttcgtgccgtcagttttggtgtcttgttccttgcccattattcgtttctgtaatcgcggtgagctggtttaggttagtaggtcgcagcaggaggacccggatcccaccgtttgtttcgtctgtttgtaatcatcgtcgtcgtcgtcgtctcacacccgctcgattgatggacggatcccactccaataaacacacacccacctctgtccctgactctgctctccaaaa

SEQ ID NO: 18348 - DNA, 1897 bp, Triticum aestivum
  unsure (1)..(1897): unsure at all n locations
  Clone ID: PAT_TA_18348
gttcttctcctccgtctctgtggntccccactctccgtccgcccacgcgtccgcacaaatccactccaatccgacacatccaccatctaatcagccaccaaatcatccaaatcgactagcagcagaacgccggagggggtcgaggaggaggccggggccgccggatccatcgagctggccgcgcggcggacccagatccacggccacgcgtgggaggtggggagcggctcgccggagggaggatgaggggccgcatccccggagcaggaggccgtcccaacgggcgcatctcagcgattggttccggctagggttccaaccaacagatcggtctccgattcccggccatggagtcaccgccgcacaagctcaatgtcggccgggatgaggacagaatcagcgcgctcaccgacgacctcctcctcgcaattctcgagcggctcgacctgcgtgaggcggtccgcgccggcgcgctctccacgcggtggcgtgacctcccgtaccggctatcgcgcctgcacctcgacgtcggtcacttccaaggccaaggcgccacgccgctcgaggtcatggacgccttcacgggcgcggcacagaggttgctctctgtggtggttcctctggccgagggcgagggcggcagtgctgccatcattcccatcaaagccctcatcctcggcttttacatgtcaccccctcacctgagctcaataggccgcaccgtcgaggacgttgtgagctaccgcaagactggatgccttgagttctccatatccccgccgcgagggagcaacgccagcctgcttgctgaattcgggcagcagttcatgtccttcccccaggcctacccggtcgccttccggtggctcacgaggcttacactcaagaacctggtgtttggacattccgacgtcaccgcacttattaacgcttgcaataagctcaagcacctcaccctgagttcctgcagactggttgatcagcggttggcgctcaggattgataccccatgctcggggcttcggaggctcgactgcatccgttttcgttgtgaacggatcgaactcatctccgtccccgagctcaggacagtactgtgctgttctcggcgctacgagaaccctccagtgcgcttcggcgacgttccccagctttgccatgtgaacctcggttatcttgccaaggcgtcgcaagcgccactcatgttgagtgagtgcctttcaaggagttccaggaatctgtcgaaactgaatctcaatttcttcagccaaacgatttggattcagccggagcagccgaagcggctcactgctatattcagaaacctgaccgacgtgtatctttttggtatcttccctgagtgtgatctgagctggaccctgtttatcctagaagctgcacctgccctacggaatttcaagttatctcgaactcgacatacatgtggcaaaaagctttacgacactgccgaaaagacgaatgtggtgtgggagccatcgaaggatctgaagcatctgaacttgaagttgctgatgatgttagggttcgaggaggaggtcaaggtgacaaactatataaggctagtcatggcacatgttgtgaggttgaagagaatcgagcttcatggtgaggacccatgcaaggagtgcaatgccattgatccgaggagatcccaggtggatgaagctagcaggcgtcagattaaggagcgactcacacttgaatcttcctcgtctgcgaagataataatttgttgatgggtatggtcaagaaatgataataatctcataaaataagtgctcatggcttctgctagagcaatgatggatattggtttaaaaaatacttattggtgtcgactttacattacagcagggtattattatttgtgcactgc

SEQ ID NO: 18349 - DNA, 1846 bp, Triticum aestivum
  Clone ID: PAT_TA_18349
cgtccgaacagcctcccaccccagtccccatcccgagcccgtgaaaccctagcgcattcgtacgccggcggcgatgtcgggctaccctttttacccatacggccgcggtggcgcaggcgacgatgcgtcggcgatgtcggactaccctttttacccatacggccgcggtggggcaggcgacgatgcggcggcgaggtactcttcctacgagatcgacctcatcgcggcgcgctacgctggcgacccgtcaccctacccctacccctccgcctccggcggattcgacccgcatgtcggcgcgaggcgacccgcagatgttctctatcatcaatctattatgggaagccatagtactattgggcagagtgatgcattttattctccgaacactatggtcaaacgccctaggcttgaaagcagccttcctatttatccacagcgacctggggaaaaggagtgtgctttctatatgaggaccagaacatgtaagtatgaagaaacctgcaaatttgaccatccacaatgggttccagagggcgggattccaaattggaaagagggtacaaaggctggggaatcctatcccgaacgtccaggggaaccaaattgtcctttttttgtaaagactggtgactgtaagtttgggtctaaatgcaagttcaaccattcaaagaaaaaggatgatggaacagtggctggaccaggcgataaagagtctctattttctggtaattccaccttaccggtgaagccttctgagccttgtccggagtctctaatttctggtaattctaccttaccggtgaagccttctaaaccttgtccgcactatgcaaaaggcaaatgcaaattaggaacaaattgtaagttcattcatgcaaaggatatggaggcaccttcaagtggtggaaatgaatctgaaaatacagcaactgctgaagcagcaggacaccatggtgcagcgcatgattcagtttcagcaaagaagtcagcaccagttgctctggagcataactcaaagggcatgcctataagaccaggtgaagttgattgctcattttatattaagacgggcagctgcatgtatggtagaacatgtcggttcaaccatcctggacgacatattcaagcatctgttgtccctggcgagatgctaaatccagctgcgaaattcccgccgagctttgattttcgcgtgacacatgtgccgattgaacctgagccaatcacctaccctcagaggcctggagaaactgtttgtgatttctataagaagacaggattttgtaaattttctgaaaaatgcaagtttcaccatccagttgatcgctctgcacctgattccattgcaaagtgggagccatctcagcaacctgtgacccttactgttgctggctttccaaggagagaggatgctgaggcttgtgcctattacatgaagaccggcgcatgcaagtttggcgtccagtgcaagtttgaccacccgccccttggggaggccattgccaaggtttcgaagcatggagaaggaaaggaaggtggaaagaagaaggcggtaggactgagttatgtcctggaaaattagacccgctcaagttccccgtccccatttcgagctccattcccatttcgagcatgtttccgtcatcagacctgtggtatagtgtggcagcagcactgcaggagataagcagagcacgctgtgcctgtgcgcggttggttaacgttgttactcgtcatggctttacttactagctgacctctgaatctggtgtaccgttggtttctcgcttgcgcgggatagtaccaatggatgttttggttggtccagtcgccatgaggtcct

SEQ ID NO: 18350 - DNA, 2421 bp, Triticum aestivum
  Clone ID: PAT_TA_18350
actctgggcacgtcccatccacttttctctatccttgctggtggcactttgccactcggttctgtcttcattgacctcgcctgcaaccgcgctccccgccggcccgcccggccgcctcccacccttcccccccttcttcttggccgcgcccgtctccctggaccccgccctcgcccgactctttctacctccccggcctcgccccccgcgacttcctgaagctcgtggttctccacgtaactgtcagcaagctctcatccttaaagacacttcgcttatgctactattttttcctggactacgtcaaacctgacgcggttaagaacagggctgagaaattaggggaagtccttcgtggggaccgaatcgaaaactctgtctattatttcaagatgaggagggacgggagttgcgatggtgtttgtcgaataaagttgtctgcagatgctgtgaagaattacagatagaggaacgttgatgattagcttctggacatgatcttggataatctcccagttgtgtttcctaggcagaccagggaagggggtcttcagatgttatatcatggttaaagtgggatatgtgaggtcatggatgagaagtaccatataaatgttcactggtaggattaagagtttttgctacttcgcccagattggcacgaggggttgaattgttggcttccttaggattcctatgagctttcaaaatgtatagagtgcctgtgttcccaacaatcctgcagtgcaaacctgcaacgctaacacgaagataactcctggtagtcacacacctcaagaggtggcccctgatgcatatgttgtgttctcttacgacgttacctttgagtctagtgagatcatatgggcatctcgctgggatgtctaccttctttccagtgacagccaaatccactggttctcgatcattaactccttgatgattgtccttttcctttctggcatgatagccatgattatgatgaggaccctttacaaggacatagcaaactataatcagcttgacaatcaggaggaggcccaggaagaaactggatggaagttagtgcatggtgatgccttcaggcctcctgttcattcaggccttctttgcgtttatgttggaactggtgtgcagttctttggcatgacagtggtaaccatgatgtttgcactacttggattcttatcccctgcgaaccgtggaggactcatgactgctatggtccttttgtgggttttcatgggtgtattggcgggttacacgtcgtctcgcctctacaagatgttcaagggcaccgagtggaagaagataaccctcaaaactgccttcatgtttcctggtataatctttggggtctttttcgtcctgaatgcccttatctggggtgagaaatcatctggtgcagttccttttgggacaatgtttgctctggtccttctctggtttggcatctccgtgccactggtctttgttggaagtttcttgggattcaagcagccagccattgaggacccagtcaagacaaacaagattcccaggcaaattcccgagcaagcatggtacctgcagccagctttctcgatacttgctggtggcattttgccatttggtgctgtcttcattgagctcttcttcatcctcacatctatctggctgaaccagttctactacatctttggcttcctcttcatagtcttcgtcattctcctggtaacctgtgctgagatcacaattgtgctctgctacttccagctatgcagcgaggactaccactggtggtggagagcctacctgaccgcaggctcttcagctctatatcttttcgcttatgctatcttctacttcttcaacaagttggagatcacaaagcttgtttcaggcattctctactttggttacatgctgatcatttcttatgccttctttgtcctgactggcaccattggcttctatgcttgcttctggtttgtgaggaagatctatgcttctgtgaagatcgactgatgtagcaacttccaagataagtttcctgtctgcttctagagactctcccggacaaggttttcttgcaatatcatacatgctgctgttcaagtgacatatatgaaggaaactgggatttgagatgggattccatggttttggtagaatatgtagcctggtaggattaagaatcaccggatattcacggatgttgaagagagaatttgatactcgttgcagattagcatgtcttgtaattctaaagatattgagtgctcctgtactgtttcggatctcaattgaccatgtctgttccatttgtgttttatgtcttacacgcagtacgctggacatggcactatttcttagtgcataactttctcgttggttgaatgatttcaaaaaaaaaaaaaaaaaaaaaaaaaaaactcgaac

SEQ ID NO: 18351 - DNA, 1459 bp, Triticum aestivum
  Clone ID: PAT_TA_18351
ggcgaatcccgacgaatccccgcgaaattttccaaccctccaacgccgccgccttccgcagatttccgacgaggcccatcgagaaatctagcgcgccgtacacagagtcgtcgctgactcgctggtcgcccgccgaggcgccctctcccgggcggccgcttcctggtcgatcaattgtgtcgcggcggcgtgataccgatagctacgagaggaggggagcgatttttgcccccctgagcagtcttttttattattttttgagcatgtctgcctgagatagattgtattgtgagagagttagggtttggtggtctctgctccgccccgagttgaggctgggtgcggatgcgccgttgaatcctgtgctgtaaccgccttcagtgactggcgagaagtgtagggcattggtggttgtttcattgttgtgccggactggatcctgctgctgggaagtgtagatggtgagtggcgcccgctggcatggaccgaggtgagccctcgttgaagccagaatggctggtgcgcggggttgccacaccgacagcggctgccacaggcctccggccaggaacttcgccccgtgcaggtgatcaagacaggggtgcttcatcaagaaaccgatcttcaggccgtgatcgtgaacggagctcccaacagtcctcttcacgcaggggttctggcccaagtgtgtccagacggcatgaccgggatggcacagtgaagtcaagagggtatgctagttttggaaggagcaacagggacaggggttgtgacaaggattctgatttccgtgattgggagagtagattgggtcttgcaggtgacccactgcgtgatggctttgggccctttaactcatgcagacccgaaagcgataggtttaatcgtattcgtccaaagttggacacattgaatcgagcatctggagtaagtttggacaatggtaatctatctagaaaggatgctggcggcatgtcctttgagcgagaattcccacaccttagttctgaggacaacaatggaaaacatgatgtagttagagttccatctcctggaattggctccccaattcagagcataccattggttaccgcgcctgatggctggaactcagtgctagcagaagtccctggacttagtgagccaagcaatacccagacctcttctgcttcatcacgtgctggttccagtcagcagcttgtagtgtcgaactgtgggactgctttaagcatggctgaaacagtaatgcagactccattaaaaatttccaccacacctcagctatcgattgacgctcagaagattgaagaaagaactatgaggcagtgtattctaagacctctgacgccttcatcaaacaaaaattctgtatctactttgtcagataggttaaaaacgaaaggtgcaagagctgggattctaattgttctatcaaactgcacccaactgtcagcacagt

SEQ ID NO: 18352 - DNA, 1506 bp, Triticum aestivum
  unsure (1)..(1506): unsure at all n locations
  Clone ID: PAT_TA_18352
accgaatttcagctgctgcagctagtactaccactaccagaacgggtgtggcttccgccccaactgttcagctagttccaaataaaggacctctgtctgttcctccaactcataatgagaggtcagttccagttgcaagtcgacctctgcaggtacctctgcccaccaaatctgaatctcagaagccaacttctctagtaaatagctctagtgcaaccaaggtcattacagtttcaaggcccttgagtgccccacaagtccccgcagcaaaacaagtggcacctgctgtttcaacagttcagactgcaccagttctttctcgttcgaggagtgcagttggacggttgggcaatgagccctctgccagtgctcctagctacattccccggtcataccgtaatgccatgatggagaaaacttctgttggagcaagcggtctcactcatcagactagttcctcagggcaaggagtttcacactcacaatcagtgtttgcatcatcggcttccattctgtcaccagataactctgctaggacagaaaagtcatcattggaacctggatttacgtttggaacggtgaagcctgagtcactcaatcagtaccagtggagagaagagagctcacagcaggcaagctgcagcagcagcagcagtaatgatcatggtctactgaattcaagtgtgggcaatgagtctgataagctcaatttgaatggaagaccaagaagcaagcagctgttgtctgaaatttcgaccagattcactccataccaaccgcaaggcctggtcggcgacgagtttccgcacctagacatcatcaacgacttgctggacgaggagctcggcgacagaagaaaggttctacagccggggtttgttcggcagttctctatgccgaataacgttcccaataacgccagcacacctgattatggcatgtttaatgatcagtacctgtttgatcagtcggagcaatactatgatgaggagcttgcaccgtactacagtgatctgaacggtggccctcaagggcttagggacaggagttattcacagtttgatctcccctcatactcaaacagtcaatttgatgatatggtgatgggccagtggccatacagccgcgccgacaactccatgccgaacttcggggcagacatcaatgcctacccctatcagtcgagggattaccagacgacctcagcgaacgcagcaagccgctacccatcctatcaccctgggaatgggcattgagccctttcagagatgaataatgattgcaaccgtaataatgcgttgttgtagtccatgctgtttgcttctgagccgagtgtaattgtaatccttcccatagagctagtggcctcttaaagaaatgcttctcagttccttaatagctatgtttctttgcttgatatatttcagtcagttttgccctgtgcctggtaaaaaaaaccaagccactgccacccattcgccctatatgatctantaccccgctcac

SEQ ID NO: 18353 - DNA, 551 bp, Triticum aestivum
  Clone ID: PAT_TA_18353
gacgccgacctcaagctcgcctaccggaagctggccatgagatggcatccggacagatgctcgtcctccagcggcaccaagcggatggaggaggccaaggagaagttccaggagatccagggcgcctattccgtcctctccgacgccaacaagcggttcctctacgacgtgggggtgtaccaagaagaagaagacagcgacgacagcatgcaggggatgggggacttccttggtgagatggcccatatgatgagccagacacggccagcgaggcaggagagctttgaggagctgcagcagctgtttgtggacatgtttcagtctgatattgtgtcatgtggggcacgtcttacagacgtgggccgcgcggccaggagcagccgacggccgcatcaggcaaggcgcaggctggacaggagtcctgatccgggcacattagttcctagactagtttatttcgtataggtttctagtttgttattagcccatggggcctttatatatcagacagttagcacctttagggataagcaataaagttatttccttct

SEQ ID NO: 18354 - DNA, 1387 bp, Triticum aestivum
  Clone ID: PAT_TA_18354
cctcgtgccggcgtccgcaccgccgggagggacccagagagagggaaggaaacgccaggaacctcctcctccctcctctccgctctcctcctcctcctcccccgcgcatcctcgagccccccaggccggcggcgcgggacgcggcatggccaccggcggcgacggctgcggcggcggggagccggcggcgcccggcggcggcgacctgtacgccgtgctggggctcagcaaggagtgctccgacgccgacctcaagctcgcctaccggaagctggccatgagatggcatccggacagatgctcgtcctccagcggcaccaagcggatggaggaggccaaggagaagttccaggagatccagggcgcctattccgtcctctccgacgccaacaagcggttcctctacgacgtgggggtgtaccaagaagaagaagacagcgacgacagcatgcaggggatgggggacttccttggtgagatggcccatatgatgagccagacacggccagcgaggcaggagagctttgaggagctgcagcagctgtttgtggacatgtttcagtctgacattgactcggggttttgcaatcgacctgccaagggccatcatgacccgttccaaacattctcgacctccccttcctcgtcgccatctccaccacctccagtagctacagaggcagaagcagcctcatgtaacggcattaacaagcgtggctcatcagcaatgggctctgggaagcctccaagagctggggaagcgggtgcgggttacggccagcctgagttttgttttgggacgagcgacgccgcgcaagcgccaaaggcgcgaggcatgcacaccaccagcagccggagcttgcttttgcggaagcgggacgccaagcaagcgccaaaggcgcgaggcgggaacaccagcaggagacgaaacgggcagaagcagaagccgtcttcgaagcacgatgtctcgtccgaggacgagatgctgagcccgcagcagcccagagtagtatgaccctcgatgcgaccatctggtcctttgtcaccttatgtcctgaccatgtcaatggtcactcagtatcacactgcagccggcaagtagagcgccagcgccggaagctgttacaacgagggggggttgcttcgtcaaaggctatgtaggccccccttagaaggtttgtaaaagaacctagcgtgtaagactcattgatgttaccgcattcttctttctcggtttgtgccgctgtgttgttgtaattgggcattggattctcgattgattcagtgttcattgttattatgaaaaaagaagtaggctccttgttgtggtaaggtcaggggtatttgaccaaactatgaatggcatggcactcaaagagcaaaaaaa

SEQ ID NO: 18355 - DNA, 733 bp, Triticum aestivum
  Clone ID: PAT_TA_18355
cgagcataatgatagtagcatttgggtctttaggcatgagcatttctttgcctaccggccctgttatgttgacatcggcaccgggcttcaggtcgcacaggaaattggagcagacgcccttgacgacctctccggcgtcgttggtgtagacgagccgcttgacgcacagcgagacggtcttggcgtcgccgaagtcgccgagggcgctgctggcgatggagtagaggcggagcttgtggggcttgccgttcttgtcctggccgtcggcgacgatgccgatggactggccctccttgtagggcacctcgccgtcggtggagaagaccatgtgccacgtctccccgggcgcgtcgtccgcggtgatcttggtgttgagcaggcactttcccacgtacggctccttgggccggaacttgttggtcaccaccccctcctcctgcttcttggacaccttcttctccttcaccggcgccgcatcggtggagacggcctgcgcccggacggtgagcacgccgcggcgggagacggcggtcgttcttgcggcgcacgggaagctgcagtgggagtgctgcggcgcgctggacggggtggaggtggcggcggtggcggcccggagggagacggccgcggccgtgacggcggccatggcgccgagagggagggagggggcgtgggtgggggtcgatcaaggtgggtagcggcgggggagcggacgcgtgggcggacgcgtggg

SEQ ID NO: 18356 - DNA, 1011 bp, Triticum aestivum
  Clone ID: PAT_TA_18356
taggggccttttttttttttttttttggcaaaaactagcaacgatctgtattaatcggcgcgctcagtgtcagtacaggcatttttacaaggaactatacaaacatgtttgcggaaagaacatttttactagatcaatgtggttcctacaacttggaccctcgtataatcacggaaaacatacaaggcacgacaagtcgacttatgcgacgaacagctctgcctgcccgtcgatgaagaggctcatgaacccctccccgtccacggtctccttctcgatcaggaggttggcgagcctgtggaggatatcgatgtgggtgttgatgatctgcgtcgcccgcgagtaggccgtctccacgagttccctgacctcggcatctacgatgtccgccgtggccatcgagtagtctttctggctcgacatctgctggcccaagaaagggtttccaccaccagatgacccgattgcgacttgcccaatcttcttgctgaacccaaatctttcaaccatttgtctggcgacacgtgagacctgcatgaagtcgctggatgccccagttgtcacattgtcttggccaaagataacctcctcggcaaccctgccaccaagtgccacagccatttggttctctaggtagctcctgctgtatagtccagactcgagtctctcttcgcttggagcaaagaacgtgagcccaccagcctgacctcgaggaatgatggaaatcttggcaacagggtcatattcaggcatcagggcaccgacgagggcatgtccagcctcatggtaagccacaagcttcctcttctgttctgaaacaactgcattcttcttctcaggcccagcaatgatcctctccagagcatcagagatctcgtccttgcttatctccttcagatcacgacgagcggcaaggatggcagcctcattcatcaagttctgaagatcagcaccggtgaaaccaggtgtccttctggcaaccttatcaaagtctacatccttcgccaatgc

SEQ ID NO: 18357 - DNA, 1265 bp, Triticum aestivum
  Clone ID: PAT_TA_18357
tgagtgaaatgctgttgggaaattttgagcagacatgagatagtagtgtatgtaatttggagatttaaataaaccaacatgagagaatatcggaagcaatacgccctatatctactctttatgtacgtacaatattcgaccgcacgaataggcgtgcgtgcgcaatatgcacaagaaagtgtcgagaatgaaagccacaagaattagtagacttcgacgttccattgctcggacttcttcaattgcttcctgtaatctatccagtcgattccttcttttgaagccaatgggatcatgatctcatcaatacccttctccatgcccttcagcccacacatgtacacataggtgttgtccttcttcaggagctcccacagctcatccttgtactctgccatcctggtctggatgtacatcttctctcccgccgcgttggtctcctccctgctgatggcgtagtcgacccggaagttgtcgggcgccttcgccttcatcttcccaaactcctctgggtagagcagggagctgctggtcggaactcccaagaagagccatgccaggccattgaacttgtagtcttcgtacttctcgaagaacatcttccacaagaatgaccggaacggcgcgataccggtccctgtcgcgagcatgatgatagtagcatttgggtctttaggcatgagcatctctttgcctactggccctgttatgttgacatcggcgccgggcttcaggtcgcagaggaaattggagcagacgcccttgacgacctcccctgcgtcgttggtgtagacgagccgcttgacgcacagcgagacggtcttggcgtcgccgaagtcgccgagggcgctgctggcgatggagtagaggcggagcttgtggggcttgccgttcttgtcctggccgtcggcgacgacgccgatggactggcccttcttgtagggcacctcgccggacgtggagaagaccatgtgccacgtctccccgggcgcgtcgtcggcggtgatcttggtgttgagcaggcacttgcccacgtacggctccttgggccggaacttgttggtcaccaccccctcctcctgcttcttggacaccttcttctccttcaccggcgccgcggccgcgtcggtggagacggcggttcttgcggcgcacgggaagctgcagtgggagtgctgcggcgcgctcacggggtgcgcgctggacggggtggaggcggcggtggcggcccggagggagacggccgcggccgtgacggcggccat

SEQ ID NO: 18358 - DNA, 1116 bp, Triticum aestivum
  Clone ID: PAT_TA_18358
aattgtgtgactgttttgaaactagcaacgattttcgtattaatcgacgcgctcagtgtcagtacaggcattttttttacaaggaaactatacaaacatgtttgcgaaaagaacatttttactagatcaatgtggttcctacaagttggaccctcgtgtaatcaccgaaaaacatacaggcgagttgacttatgcgacgaacagctctgcctgcccgtcgatgaagaggctcatgaactcctccccgtccacggtctccttctcgatcaggaggttggcgagcctgtggaggatgtcgatgtgggtgttgatgatctgcgtcgcccgcgagtaggccgtctccacgagttccctgacctcggcgtctacgatgtccgccgtggccatcgagtagtccttctggctcgacatctgctggcccaagaaagggtttccaccagatgatccgatcgcgacttgcccaatcttcttactgaacccaaatctttcaaccatttgtctggcgacacgtgagacctgcatgaagtcactggatgccccagttgtcacattgtcttggccaaagatcacctcctcggcaaccctgccaccaagtgccacagccatttggttctctaggtagctcttgatgtacagaccagactcaagcctctcctcgcttggagcaaagaacgtgagcccaccagcttgaccacgaggaatgatggaaatcttggcaacagggtcgtattcaggcatcagggcaccgacgagggcatgtccagcctcatggtaagccacaagcttcctcttctgttctgaaacaactgcattcttcttctcaggcccagcaatgatcctctccagagcatcagagatctcgtccttgcttatctccttcagatcacgacgagcggcaaggatggcagcctcattcatcaagttctgaagatcagcaccggtgaaaccaggtgtccttctggcaaccttatcaaagtctacatccttcgccaatgcctttcctctggagtgaacctcaaggatcctgacacggccggcgacatccggacggtcgacggtgacctgccgatcgaaccgtcctggccgcagaagcgccgagtccagcacatccggcct

SEQ ID NO: 18359 - DNA, 2464 bp, Triticum aestivum
  Clone ID: PAT_TA_18359
acgtggaatgctctaattaactgcaaatttgtaagagctacacatggcaatggcattatctgagtgaaatgccgttgggaaattttgagcagacatgagatagtagtgtatttaatttggagatttaaataaaccaacatgagagaatatcggaagcaatacgccctatatctactttttatgtacgtacaatattcgaccgcacgaataggcgtgcgtgcgcacatatgcacaagaaagtgtcgagaatgaaagccacaagagttagtagacttcgacgttccattgctcggacttcttcagtgcttcaaactatattttgccttgtttaaaataacacgggtgatatcacagttaattcgagactaatgcttcaaactagtagtatgttttgccatgtttagaataacacgcatgggtgatattacaagtacagcctccatcggaagccatgggcgaatccacaagaagaaagtttcaccaccggagctttaagattacaacacatttttgcactgtccacctactcctccacactttgtacatcctcagtaccccaaaataacaattcagaccacctgaaacctccccggtcggtgaaatcgacggatttactggccggagatggtctggatgatggtggtgtgccatgggtcggccaggtgctgctgcaggttctcgaacgggcccttgccggtcacgttgtgctgcaccaggaaccccaggaacgccagcatcgccagtctaccgttggcgagctccttctccttgttctcgagggtgggggcgaagttgagggggttgaagacgctgccggggtagccgcactcgtggggcgggaggctgtagctcttgaagatggggtcctggttgacggagcccgggttcttgatgtcctgccaccgccggatctcgacgtagtggaagaggatgaactcgatgacgaacagcgtggaggaggaggcgaagtaggtctccttgccggcgtcgtaccactcgggcgcgttcaggagccccgccttggtcagcacctccgggatcagcatccccgccacccccagcatcgcccaccgcccgttcaccaggtctgcctgcacgaaccaccgcaggctccttccgggctgaaacaactgcattctcttctcgggcccagcaatgatcctctccagagcatcagagatctcgtccttgcttatctccttcagatcacgacgagcggcaaggatggcagcctcattcatcaagttctgaagatcagcaccggtgaaaccaggtgtccttctggcaaccttatcaaagtctacatccttcgccaatgcctttcctctggagtgaacctcgaggatcctgacacggccggcgacatccggacggtcgacggtgacctgccgatcaaaccgccctggccgcagaagcgccgagtcgagcacatccggcctgttggtcgcggcgagcacgatgacaccgctgtttccggagaagccgtccatctccgtgagcagctggttaatggtctgctccctctcatcgttccccccacccattccggcaccacgctgcctcccgacggcgtcaatctcatcgatgaagacgatgcagggcgccttggccttggccttctcgaagaggtccctcaccctggacgcgccgacgccgacgaagagctcgacgaactcagacgcggcgcaggagaagaagggcaccccggcctccccggcgacggcccgggcgagcagcgtcttgccggtcccgggcgggccgacgagcaggcagcctattgggacctttggggcgtgcgcccggtacctgtcctgcccttcctggccgtcctcgttggccggctgcgcgggcggccgccagtccgcgccggccctctcatcggacccccccgacccgccggcggctcggacccgctccccggccacctggccgtacgcgacccccccgaggcgtcgccggacgcgcccggcgtggcgctagccgcggaggtcgtggcgcgcgcgggggtcgtgccggccctggtcgggctggccgatagtatgcccgtcgtcggagtctccctcgagggccgcgcactagccgtggggccgctcatcctccgcggcgtagacggcgcgtcgcctgcggtcgagcaggcgttgtgccgcgtcctgcccgttgagccgtccctggtccgcctcatggtcgtcatccccctgcactcgtacgtctccgtcccccgcatctgcttcatcggcgccgaccccctgcgacatgccgccgaccccgccccggtggacccgccccgcgcccgtggagcaggcccacacatctacacgtgagcggtgcgcggcgtcgacggcggtcgttcttgcgagcacgggaatgctgcagtgggagtgctgcggcccgctggacggggaggtggaggtggtggttgcggcccggagggagacggccgcggccgtgacggcggccctcgtgc

SEQ ID NO: 18360 - DNA, 1274 bp, Triticum aestivum
  Clone ID: PAT_TA_18360
gcgatttcattctatgattttttttgagtgactgtcgaagtgtcagttgttttttttttttttactaatatttcaaacacgtagtatgttttgccatgtttttaaataacagtaatgtttgattttacaagtacagctccaataaaaagccatgggcgaatccacaccaaaaaactttcaccaccggagctttaagattacaacaccatttttggcctgtccaccaactcctccacactttttacatcctccgcaccccaaaataacaatttaggaccacctggaacctccccgggtcgttgaagaccaccggattcctggcccggggatgggtccggcggattgggtggtgccctaggtggggggcgatgctggatgctcggttcctggttcggccccgtcctcggtcatcgcctgtgacggtgccctggcaccacacggtccgccagaaccgccagtctcccgcgggccgacccgcttgtgcctcgctttgtcttcgggctcgggcgaagtcgagggggttgtagacgggtgccggggtgagcccgcatgtcgtggcgcggtgcctctgtagctcttgaagatggcgtcctaggttgaggtagcccgggttcttgatgtcctgccaccgccggatctcccaccgtagtggaagaggatgaactcggatggacgaagagcgttgaggaggaggcgaagtaggtctccttggccgggcgtcgtaccactgctgggcggcggttcagcgaagccccgcccttggtcagcacctccggggatcagcatccccgccacccccagcatcgccccaccgcccgttcaccagctccagctcctcccacaggaaccaccgccagcgtcctcctccgggtcctccgccagcgccagcgggtcgaacccattgtcaccccccccaaagttgccgtcgaggtaggcaggggagggggaggccggggagccacgaccccttggcctgggacggcgacgtcgcggcgtgtggacttggcgaggccggacgcggccggagtcgcccaggaaccgggggctcgacgctgacgccgccggccggagagcggccacgggagcgcgggcactgaccgacgacatcttggctagagagcacgcgggggggaccgggggagcggaccggcgtggcctcaggagcgccgagtcgagcccgtccggcctgctgctctcggggagctacggcgcaccgcggcaggagagtgagagtgcgtccgtgcgcgcggacgcgcggacgcacgcgtggggac

SEQ ID NO: 18361 - DNA, 1227 bp, Triticum aestivum
  unsure (1)..(1227): unsure at all n locations
  Clone ID: PAT_TA_18361
ggccgctttcgcggccgaagctgtcttccacttcagcaaccaaaccctttcgaaagaatccccaaatctcgcacgctccaaaggcccgaaaccctagctccctgctttcatccccgccaccgtccccatggcgccagggctcaaacgcttcaccgacgtcgccggagacggcacgccccgcctcgacgacgccgccggcgaggagctcgtgtgcgtggagcgcgccgcctcggtcgccctcggcagccgcgcgccggagcccccgggaaccctcttcatcaccaccaggagggtgatttggctcagcgaggcggagaagggcaaaggatacgcggtgggcttcctggacatcacgctccacgcagtgtcgcgcgacccggaggcgtacccctcgccgtgcctctacactcagattgaagccgaagctgactctgatgaagaggatggtgattttgactctgaagcagatggtgactcacagctaccaaaaatctctgagatgcgtattatactggcagatgctgcccaactagattcactttttgatgccttctgccattgtgctgagctgaaccctgatcctactgctgaagaaaatgaagatgacttggtgggggtatgaccaatggtggttggattcatggcgatgaagatgaacacatggttgatggaatcgaccctgagttttttattcccaacccgataggtcaaaatggtggagatgacctcagttcttcagtacttgagcttcaaatcaatgaccagcgtttcgaggatgcggaggaagaggaggcccgtgaaaatgggcattaaagcagctatatgcttgttctagtactgatcatgttccttgagaggaccgtgttctttttaaagtttggttgaagattactgttggtgcagcttggttggcctcatgctgtttcgtccacactttgcttttgcactttctagatgctataggatcgaggactcgggggcggccgtgtagagttgcgttcgatggtaacttatgagagagaaggtcttgcttgctggtncaagaatgtaacttgtagagcttggtgggtatggaattgatggatttcaataacttttgatctaacaaatagaagcgggggatgtgggggtagtaactcggtactctttttgaaagtgttcctctgcactgtatctgagtgggtgcaatgttgtgtgcttttgcattcaaatgttgtttgttgctgc

SEQ ID NO: 18362 - DNA, 1176 bp, Triticum aestivum
  Clone ID: PAT_TA_18362
cgtccgcccacggccctgttggggcgtgggccgagccaaacaccgatgccaccgtcgcgggaagaggggggttcgccgctggcaagtcttccaggatggggtaccaccgcaataggcgcgggcgtggatcctcgtcgtcgtcctcctcctcctcttcgcgccgcaccaagcaagaagcctcgtgcgatgatgctcctgggacatcacttccaaggcaggaagacaacgccgaagaggaatctaatagcccaaaaattcagcttgcaatgtgggactttgggcaatgcgatgctaaaagatgcactggtcgtaagctttcaagatttggcctgttaaaggagttccgagttacaaatggtgttcagaactcctggctcagccgtgcagggacacattcagagtcacctgtagatcaggctaacaaaccacaccgaagaacagaggaggaaggatcagattctgaatctgacgacggcttgccccctctggaagagaacatgaaccacttggaccttagcgaggaggaagaaagcgaagaggaaagtgaaactgaaagcgaagggattaccgcacgcaaaatgatgtttgtttgtccgatcgaaataagatccaggcctcttgcggtgttgctcgtggttccgaaatccatatatcgctgttcactttattgcttgctttgggttccgctgtatgcatgcgccaaccgtgaacacggcaccgagataatcaacgtgcagacgtcttttctgtcaagtgcatcgagtgtttcaaagtcacctgtaaacgtggcagataaaccacaccgaagcacagaggaaggatcagattctgaatctgacgatggcttgccccctctggaagagaacatgaaccacttggacctcagcgagggcgaagaaagcgaagaggaaagtgaaactgaaaacgaagggattaccgacgcaaaatgatggttgtttgtctgatcgaaataagatccaggtctcttgaggtttttatcgtggatctgaaaacaatctatctctgtacacttgtattgcttgcttgcgtcgtgtaccagtcatatgtatttttcttttgagggattcgtgtatcagatcagtatatgtaagtgtagactgtaaacagggtcagtctctgagaacacgagtgcttttatttagactaatacaaaaa

SEQ ID NO: 18363 - DNA, 1310 bp, Triticum aestivum
  Clone ID: PAT_TA_18363
tttttttttttttttggtgtgtttgtggagagtaagattttttgatagaagataatatttgggtattgttattcctatataaaacttttttgttccttttctaacaaagaaatataaagcgttcgtgcgtaggtcttcggatagggtttcattttcacagcgagctgacacctgaaccgaacgtggtaataattaccaggcgtgccactcccaacaatttcagcgagcgcccctcttggagcggcgctacgacgacgccgccgcgccggagtggagggcgacgagggacgcgtacgcgccgcccttgacggcgatcagggcctcgtgcgtgccccgctccacgatcgcgccgtccttcaccaccgcgatcacgtcggcgccccgcaccgtcgacaggcggtgcgccaccaccaccgtcgtccggctcgccgccacccggtccagcgcgtcctgcaccgcccgctccgactccgcgtccagcgcgctcgtcgcctcgtccagcagcaggatcctggggtccttggccaccgcccgcgcgatcgccacccgctgcttctgccctcccgacagctgcgcgccgcgctccccgaccaccgtgccgtacccctgttggagcgagctgatgaacttgtgggcgttcgccagttgtgcggcagatacgatgtctgattccgtggcctccccttccttcccgtatgcaatgtttgcccggatggtgtcgttgaagagggctggctcttggctcaccagccccatctgctgcctcagccacctcacctggaacttctggatgtccaccccgtccagaagtatgtggcccgcgtcaggatcgtagaatctctgcagcagcgctatcgccgtcgatttaccgctgccactctccccgacaagcgcgacagtctttcctgactggattgtcaagcataggtcttcgaagatctggatgtcagggcgggtcgggtatctgaaccgcacgtgccgaaactcaatatcgccccttagtggttctaaattcaccccggcgtcatcgcttgggtcaatcatcgatttacggtccacgatggcgaatatagaagatacagctgatcttgctctggaggaatctgaggtgagggtgctagtgtgcgataccccgattgctgccattgtgagagcaagaaacaccctgaaaactttgggaaatgttgttttcttatcccggacgcgtggggaaaggaacaaaaaagttctatataggaataacatttccctaatcttacgcgttatcagaaaaagataaaaagggcccggtgctctgaaggcgtcaaggc

SEQ ID NO: 18364 - DNA, 2002 bp, Triticum aestivum
  Clone ID: PAT_TA_18364
cctccagcggcccaggtgcgcacagtgagtgcatgtgtcttgcgtccgcaaattttgcccgaacagctggtggtccacttcagataacaagttatgattatgatgctccagttaacgagtatggtttcttaaggcagcctaagtggggacatctgaaagatctacacacagctatcaaactttgtgaaccagctctcattgcagtggatggctcacctcaatatgtaaagttaggatcaatgcgagaggcacatgtatattccaatggaaaagttcaaacaaacagacgcatgacaggaaatggactgattactaagattattcttgcgagctttggaacaccgaaatatgcatcagtctggatctttgaaggatcttgccatgcttcgagtactcttgccttggatactagaggcgtgtgtgggcaacagctatcgctactgctcacgttggtgcacaaacttctgtttttacgtttgaatctgggtccccaagtcattcaagtagacataagcctagtcttttattacctggggttgatgggtcctatttctcgagtacttggtggacttctaaagagatcattggtacatggggtggtgaaagctttgctacgcagggaatattagagcacttgaatgtaacaaaggacacatctgactacctgtggtatactaccagtgtaaacatttcggatgaggatgttggattttggagttcaaaaggggttcttcctgcactaaaaatagaccgaattcgtgatgtagctcgtgtatttgtaaatggagagcttgcaggtagtcaagttggtcactgggtatcactgaagcaaccggttcaatttgttcaaggtcttaataagctgacattgttgtcagaaattgttggcttgcagaattatggtgctttcttggagaaggatggagctggatttagagggcaagtaaaactcactggattgccaaatggggacattgacctgactcattccgtttggacatatcaggtggggctgaaaggtgagttttctatgatttatgctcctgagaagcaggcatgtgctgagtggagtggcatgcagattgacgatatactgtcaccctttacatggtacaagactatgtttgatgcccctaaaggtaccgaccctgtcgccatctatcttgggagcatggggaagggccaggcttgggtgaatgggcatctaattgggcgctactggtcactagtagcgccagaatctgggtgctcatcttcatgcaactacccgggagcgtatagtgagagcaaatgtcaatcaaactgtggaatgccgacccaaagctggtaccacataccacgagaatggctgcaggagtcggacaatcttctggtattgtttgaagaaacagggggtgacccttcaaagatatcactggaggttcattataccaaaacaatctgctcaaggatatcagaaagttattatcctcccctttctgcttggtcacgccttaccagtggtcgtgtcttggttgatactatagcaccagaactgcgcttacggtgtgatgatgggcatttgatcactaagattacatttgcgagctacggaactccatcaggtggttgccagaatttctccgaaggaaagtgccatgctttgagtactcttgccttggtatcagaggcgtgcgtgggcaacaacgaatgcgcaatcagtgtttcgaatgatgtgtttggtgatccatgccgaggagtcctcaaggatttggcagttgaggctgagtgctcgctgtcatcggccaccaaagaacctcgagacgagatgtgatgcgggatgctggtgacaaactggtgtaagggagtgtttcgcttgacccatggttgtgcttggtgttggtgtaaagataatcctacaactgaagaaataaggacagggaaaagtccgcatacgtaccccattgtacattgtttgttactggagattggatttgattaatgctgaacaacacatcggaaa

SEQ ID NO: 18365 - DNA, 1964 bp, Triticum aestivum
  Clone ID: PAT_TA_18365
ccacgcgccctgcctcttccacgaacgccggctcttccctcgtacaccgccgccgccgccgccgccgacagggaccccgaactcccctctatgcaggaggaaccatccaaccagaggacggaggctgaagagggcaagaaggaggagaagaagccgaagccagcggccgaggccgaggccgaggaggcagcggccccacaggaggaactatccaacaagagaaagagggataaaaagagcaagaaggacaagaagcggaagctagcggcagaggccgacgaggcagcggcggaagaagaggccaagagcagcaacaatagaggggtggccacagaggaaccggatcaaggagggggcgtggagaagagcgtggcggtgactgggaaggggttcgcggaccccaagtatgcgccgctcaagtccttcgccgccgcggcgctgccaacccaggtgctcgactgctgcaaggggttcgaccggccgtcgcccatcctggccctagcctggccgtatcgcctcgatggccgcgattgcattggcatcgctgccaccggatctgggaagactattgcgtttggtgtgccggcgctgatgcacgtcaggaagaagctgagtgaaaaaggcgccaagaaggggttgccgcgatgcctcatgctggctccaacaagggagcttgctcagcagatcgcagatgtacttactgaagctggtgcgccatgcgggataaattcagtgtgcctctatggtggaacatcaaaaggaccccaaatatcttcccttaaatctggagttgaaatagtcataggaactcctggtcgtatgaaagacctcattgaaatgggtgtttgtcgtcttaacgaggtttcttttgtggttcttgatgaagcagatcggatgctggatatgggttttgaacctgaggtcagggcgattttaagccaaacatcatcggtgcgtcagatggttatgttcagtgcaacatggccttttgctgtccaccagctagctcaagagtttatggatccgaatccaataaaggttgttgttggatcggaagatctcgcagctaatcatgatgtgatgcaaattgttgaagtattggatgatagagcacgggattcaagattagttgctttgctcgacaagtatcatcgagcacagagcaaccgggttttagtttttgtgttgtacaagaaagaagctgggcgagtagaagcaatgcttaataaaagggggtggaaagctgtttctgtccatggagacaaggctcagcatgatagaacaaaagccttatctttatttaaagaaggaaaatgtcctttaatgattgcgacggatgtggcttcacgaggacttgacattcctgatgttgaagttgtcatcaattatagttttcctttgaccacggaggattatgtacacaggattggaaggacaggtcgtgcaggcaagaaaggtgttgcacatacattcttcactcaagcggacaagggacttgctggtgagcttgtcaatgttttacgggaggctgatcaggttgttcctccagcccttacgaaatttggcacacatgtgaagaaaaaggaatcaaagatctatggttcccacttcaaggaaatcacagcagatgctcctaaatcaacaaagatcacattcggtgattcagacgaggagtaactaacttgctttgctggtgttggtcatacagcagtagaaaattcattcgataccgtagtatcatttagatttaggtcaatcctttccttgttttcctgagggcggtttctatgttctttttggaagtgaagaaaaaacagtaaagcttgaaatgtaccaaaacagtatcggcagcctattatgtcaaagcctagtgattccgtggtgcacttgtttgtttccttggaattgctgcactattatcagcatataaatttgttcacgtgtcagaaatataacccttaagt

SEQ ID NO: 18366 - DNA, 362 bp, Triticum aestivum
  Clone ID: PAT_TA_18366
agtggatataacgtcggtggtgggtgggaaacgaagttcttcgtcgtccgcctccctttcgagctggatgtagttcggccgagagttccccgacaaggagatagatttcaatgagtttaacacatcgcctagaggtgagtgctggaagatgtccacggagctgaactccaagatcggtgcccaatcaggttcgatggacgcggatgcacgcggtccagaacctatggccgagacgagtccgaggttccggtaacacaagcccagcttgatgttgggtctttgtgcggctcgagcgccactaagtctgcggcttccgtggcggggttaagtttcctgtcttcagacgacgcgatctgctccag

SEQ ID NO: 18367 - DNA, 901 bp, Triticum aestivum
  unsure (1)..(901): unsure at all n locations
  Clone ID: PAT_TA_18367
cgtccggttcccctccctcgcgcacgcgcgccgcgcctcctcccgctgcctgctcgccgtcggcgccctcctcgtcttctccgccgtctacttcctcctcctctccccctcgccgccgcgccccgtcgccggcccgctccccaaccctagcagcgctaccacctccttcgtcgcctccctcgaccgcttcctcgactccccgcaccgccccgccgcctcctccgcggcgcccggggacctcgacgccgcgatccggagggaggaggaggcccggctgtacggggacccacggggcgcgtggccgggcgccgctaagggtctacgtgtacgagatgccacgcaagttcacctacgacctgctcaggctgttcagggactcgtaccgcgacaccaccaacctcacctccaacgggagccccgtgcacaggctcatcgagcagcattctattgactactggctgtgggcggatctcattgctcctgaatcacaaagacttctgaagaatgttatcagggttgagcagcaagaagaagcagacattttctacgtgccatttttcacaacaatcagttacttcttgctgggagaaacaagaatgcaaggcactttatagggaacctttgaagtgggtgactgatcaacctgcttgggcaacgttcaagaaggcaagagttcatgttattcctggtcatcacccatggnccttttaagtcagtcccaaggtttgtggaagaaaagcaatatggctccacctgatatgggttccactgggaactggtataacctggnaatttaccnggaaaggntttacctccanantccaaagntgncttgggataaatgggttcagaaaccaacaaaagagncttcgttttcaggaaactaaagaatgcnggggaa

SEQ ID NO: 18368 - DNA, 996 bp, Triticum aestivum
  Clone ID: PAT_TA_18368
cccacgcgcccaaatacaactctcgccgtctgctcgctcgcccgtcccccaaatccctacccccccaccaaccccgcccgaaccccggcggcgtcaccggcgatggagtgcgtcatcggcgtggtcggccgcgacttcgcggtcgtggcggcggacacgtccgccgtgcagagcatcctcgtccacaagacggacgaggacaagatcatgctcctcgactcccacaagctcatgggcgcctccggcgagcccggcgaccgcgtgcagttcaccgagttcatccagaagaacctccacctctaccagttccgcaacaacatgccgctcagcaccgccgccaccgccaacttcacccgcggcgaagctcgccaccgccctccgcaagaatccctactctgtaaacatcatacttgcagggtttgataaagatcgctggttgcatcgatgtactacattgactacatcgcgacgctccacaagatcgacaagggagcattcgggtatgggtcgtacttctgtttgtcgctgatggacaagttgtaccgccctgacatgactgtggaggaagcggtggaccttgttgacaagtgcatcaaggagatcagactcaggctggtcgtcgcgccccggaatttcgtggtcaagatcgtggacaaggatggcgccagggactatgctaggcgtgagatcggaggtgacagtccgccaaccgcaaccgcaacaatagcaacagccgccgtcggtggacttggcgctgtcggtagtcatttggctgcttgacactgaaccctgactgttgactgtttgcaagcacaatccctttggattcgcgatacgttttgcttcgagaactgagttgcaaattctcccagtttttgactatagtttgtttatgacccccatttcaaggttatatgtttcactgtttcttgctaggttatatgtttaactgaaaaaaaaaaacgaaagaaatgactcatgctaaggaacaacatg

SEQ ID NO: 18369 - DNA, 543 bp, Triticum aestivum
  unsure (1)..(543): unsure at all n locations
  Clone ID: PAT_TA_18369
cgtccgcccacgcgtccgccttcccctccccttccttcctttcctttcccccgcaccaccgccgcgacggcgaccccccagccgcacgccgaagcgaacccctccgccccgaccgcgtccgtctagggctagggtttccgcctcctctccgcccccggccatccccacgcggcgcgcccgtccacgccgcggccccgcggattcctcccccacttttcagctcaaaatcgtcgcttttccgctcggttcttgggcacgaatcggccattgatttcctccggttatccgaggtttccccctgatttctcggggcacgactggggctttccgaggtgattggtgctttgtccgccgcgggttcgggtgttgccgctgaaggcctggccgatttttccatgagcgcgggccgcgcgagctgccggggccccggtcgtcggggcgcgcgcgcggggtgctcgtgttaatgcatcggctgacctgcggctgcaagttcgcngaccccgacacggtcgtcccctccgcggcgnnnnnntcgcatcgcgt

SEQ ID NO: 18370 - DNA, 793 bp, Triticum aestivum
  Clone ID: PAT_TA_18370
catcgccatccatagcctccctcgtccgccaagaagctgaggagggaggctgacctccagtgaccactctgcaccgctctggacgacaccctcccccaccagagagaaagtgcaaaagctatgggcaatcctatatgactggcgccatcagtaaggatttatttaaagctagcttacttttgggtctaagcgaaatttagaagttcaagggattcccggagcacattgggacggtgggcacagagaggctgaaaatcctggccggcattataaaccctgaagccctccacctcagcaccctcaagacctgcaatccccctgtgtgtctagatcctagcacaagttctacatgggatccatagtcagcggatttcattgagtcagatctattcctacattggaatgacttggattctgccattgtcaccagcccgaggttgggatatggggcctttctggcacctttggtgcaaaagcacaagcaacagcatctacagctgaccacttatagcctaggatgacctgcagatttgatctattttggatagagacatggaattaaaccctatattgaatgggcattttattttttagggcggaagactgaactaaatgaaactgtggtgctttagattattttttgcttggtggtgcatagagctctaagacactagatacgatattctcttaaaatggggtcctacggttcaaacagttatccggttatgcaactcataagatcattttaggggggacgcctcattgatagaatcatgtagattctgcttcatac

SEQ ID NO: 18371 - DNA, 915 bp, Triticum aestivum
  Clone ID: PAT_TA_18371
ccgatccggcaccgctcgctctccgactgtggatcaagtgcactcgcttcaaaaagaagtccacccgtttcaaacttccccggcggctccagggccgagatcagggatgggagggtgcttctccggcgacgtccgcggcggcatggaggccgtcggcgggggcgcgaggggggcgacggcggcggcggtgcagggccagggccagggcgggcctaacgaggcggtcgaccacttcttccagggccaggcgctgcgcctctacacccttctcgagctatccttttcagcttccaagttgagaaatatggatgctctttctaagagtgatcctatgttggtggtttacacaaaaatggatggaaggctagaagagatcggccgcactgaagtgatattgaattcactggaaccattgtggatcacaaaagctatgataaattaccaatttgagattgtgcaaccgctcgtgttcaggatatatgacgttgacacaaagtaccataacacaccactgaagatgttgaacttggctcagcaagattttctaggggaagcattctgcaatttatccgagatagtcacaaagttcaaccatagcctgactttgaacctccgaaatggctctggacatgcccttcagggcacagtgacagtacatgcggaagaaactgcttcatcaaggatggcagttgatatgcaattccactgcctgaacctggataacaaagacacgttctccaaaagtgatcccttcttgagagtatcaagactctcagaaagtgctgttgccattcctatatgtaaaacagaagtgatcaagaacaatttacatcctatttggaggcctataacactgacatcacagcagtacagtagcaaggatgacccactgctagttgagtgttttgattttga

SEQ ID NO: 18372 - DNA, 673 bp, Triticum aestivum
  unsure (1)..(673): unsure at all n locations
  Clone ID: PAT_TA_18372
cgtccgcggacgcgtgggcggcgagtgctcggaggcagagaggcatggcgagattttggttggaggcctcactcgctgatctctcgaggcgctttggtgggagaaagggagaggcgaagtcgacgccatggcgatttggctgcggtttcttctcgggtctttgattcgtgccgctccttcttttgtggtggtccgcaagccctgcgtctctccccgccccctacctgaggttgttggtttgcaagcaccccctctccccctgttccattttcccttcgtttttctgtgcgatttgctagatctggttgattgtctcgttgtattcttctacttgcatttttcgtatgtggtattttttgttgcacatgtaaatttagcggtggatccctcttgtctattttgatttcttcttccgaatgtagatgtagtttccttgtggcaggctttgaattaaccggtgttgatccattggtagctgctagtgtggtaggttgatgttcgtctggtctancctgtttttgatgtagatgtgtggttttctaatggtaaattctgatgtagatgtatggntgctccgcttttcctctggtggttgattctggactggaatttctacaattaagtaataagttatttgggcctggactattgcaagtgnaaantttgaagtgga

SEQ ID NO: 18373 - DNA, 750 bp, Triticum aestivum
  Clone ID: PAT_TA_18373
catgaagctcttcgtggacaggtcgaggcaaattgttcgcccagacttccacgttaccacgaccttgtttctgatctcagtccaattcatgctaaactttcatgtgagaatgctttggcgaagaaacatcctatgtataaatgcaacgaagttcaggctaaggcatcttggcagttcttaaatgttctgagaacatacttggagtcactttgttctgaattgcgctatcataccatcaccaatgtacagtcagataatgacagggtttccttgcttctgaaggacagttttcttgattctttcccctcgcatgatcgaccgttcatgaagctcttcgtggaaacaccagatgttctctgttctatcagattctcgacttgccacatttgaaatcgagcacacacagggctttgcttcagctggagatcagaatatgaacttcgattgattggacaaatggaaaaagaaagcagggcacacctactgagaatagaggattggactgtgcacaagtggccgagtccgttgaatggtagggcttgcctaatgtaagaagacaaccatcggttgctcccagttaacaaaagtagaatatgatgcaacccaatcttttaaatgggatgtacatataaggtagagagtgagttttcggtagagagcgttctaccttttcgttcacaaaaatatgcgatgcacatgcccttaatgagtatatatggaccaaatagaaatgttacagttgctgtgtag

SEQ ID NO: 18374 - DNA, 1102 bp, Triticum aestivum
  Clone ID: PAT_TA_18374
gcccgagccccccactcccactcccacctccacccctacactccccgcctcccacccctcacgtgcggcgtcgcggccgccgccattccggttcttcctcgccggcgcgtcgcgttcccgccgtctccagtccgtcccggtcttcggccatcgggcttcgaggcacccggcgcaccatctagatccgcccccaaatcgccatggcggggcagtccgacccgcatctctccctcttctcgccctccgaggtggagttcgtggcggaggacgagatcgtggagatcgtccccaacatccggatggaggccctgaacatgatctgcggggatttcggacccttcttcccacaaattccaagcaaggtccctctgtgcctcggtgttgcgctcaagaggcgtgtcaagcgcaccatacgtgcagctgattggatgactgttgatcgcttaacacgtgggggttggtcgcagaaagagagtcacctagagaatttcaaccattaccattccactatattgaaatatctaagcttctgtttgatcatgctcgtgatgacatcacagatgcatacttggtgagatctttgattgaggatatcagagatgtcaggttccataaggtcgaaactggattagagacaatatctggccgtactcatgctgtgaagctcaaaaatctctctgcaatggaggtgaacattgtccgtccttttatggttagaactttgcaagcgttctacaagcatgatagcccgcagatgattcagcaggcagataatacagggagcagatcaacaccagtcacagaccgcggtccgaggagagacctaaggcgcaggtaacgagcatatgcggagacctaaggcgcaggtgatgagcataagcaagatatgcatgtacctgtcacttgtactcgcaaagaattttctgcatagaagcggattgtagtgaacaacggtacctgcgctgttgtggtgtgctgtatgttcctagctgaaagccattttagttccctcagtgtgggcttttctcctactgtatcagatcatgaatggatgtgtgtttatctattaaccacaaggttttagaaaaaaaaaaaaaaaaaa

SEQ ID NO: 18375 - DNA, 996 bp, Triticum aestivum
  unsure (1)..(996): unsure at all n locations
  Clone ID: PAT_TA_18375
nnggntnnntntgnttcctttngattcccttgctcgaaattaaccctactaaagggaacaaaagctggagctccaccgcggtggcggccgctctagaactagtggatcccccgggctgcaggaattcggcaccagatcggcccctcttttatcctttccccttctggcgactaggcttcggcccgcgccggcccttgctggtggacaccggcccgctcctccaccgcgacggcttggcgccgccgtccaccgaccgcctccagatctgtccccgtccgcctgaagatcccctccactctgccaccagggactcttctcctgctgctgccgttacatggggagaggagcaccggctagccaccaccgctggatgcctccatcccccttcctccttcgcccgacgaacctcttcactccgggaacttgctgctgctgctaatccgagctgcaccacctacctcgctgaagctctgtcccggcagctctctgtgagatggaaaaggaaaaggctaattgggatgcacatcacataactatcttctatgagatatgcaaggacgaggtcgatgctggaaataggccaaagggatgtttgaaccgtagagggtacacacatcttgaagataagttctttgataggactcgaaaaagatgttcgcagaatcaatttaaaaacaaacgggacatgttgaagagacaatatgtacaattcatgttgttgaaaaatgcggcaactgggctaggttgggatgatgtgaacaaaaccattatagccgatgatgattggtggaaaatacatcttaagaaaaatcctaagcatgcaaagtacaagaagaaggggctggccaacttggaagaaattcatgtcatgttcgccaacgcacatgtcaccggngctacatcatctattcctggggagatgtcagacaacacaaatgatgatgatatgcctgatgttggagaagagtctgaggaggatggaaatgcattgaagga

SEQ ID NO: 18376 - DNA, 1581 bp, Triticum aestivum
  Clone ID: PAT_TA_18376
ggagcaccttctgcagcagtttgaagcaatgtctggtcatgttaaagaggcggtgtctatgggagcgcgtgctgagaagacatcttcagagaatgcagaaaagattatccagttgcttacggaaatttctgtcactttgagggaagttccgcctagcagtactggttcatttgctgacagattcatgcggatgtcgaagtatccattcgaggcaggccaggtctatgagcagtttcgacagtacttggaatttcttggcggattcttattgcttctaggagttctggatccaaaggatgagcaactgaaggagaggttctttgaaaagttcttaccagacaccacacctgggatttatgaagatatctgccgacagggtcgagacctcatgtacaaggatttcgcctctgacctgagctttcagatgtcaatgcagtgtggtgatggttttgttcttacttcatctgccaagagatctccaatggatgacaatgtgcatggctgccagctgagacttcggcagccccaactgagccttgatttcaaatttgatacaacaaaacatgtgagcgctatagtatctttccctggagtgctaggctgtgatgtgaaccctgtccttaaagtctgttacccattccgggactcttcgtttaatttggatgctctttatcggcaagctggctttcgtgcaattgcttctatgcaccctgttcgtggtgatgcattggtgtctctgtcgggcctttttggatccaggaggttgaactatgggggtcttatgaagatgaatttggggaatgaggtgcctaacttttattcccttggttgttccttcaacactgaagctttctcgtgtggcatccagtgtaatagccatgctcaggtgttgatgctgttaaatcacaagctggagccctgttccttattcagagacgctgtgaggaggaccaacctgggaggggatctgtatgatctgctggcacggaccactccatcgcaaactatggttggcgcgcaagcaattcattgcctggcaactggctcgagtgtggtcatggttggttgcgagtatgctgatccgagcacccgcttcaagctacgtgtgggcagttcaggcatacttagtgctgttgtgaagcacaagttttttgggtcagcatgggttgcgctgaagtcacacttcaacttgaggaatatccgtgccgctcctcgcctcggcctgtctatcagcatcggggaggcatcgtcgtcatcatcttagttgaggaggcaggcatttgcaagaccagagctctggaatgttatagtttagtggagtatcacgctgcaatggttgctggttggtgatggtgccctagtctctctggaagttggttgcaggagcctttaacttgtttggagataggttttgctgtgtcgtaaacagcagtgaaagttttgatgatgatgatgattttgctgtgtcgtaaacagcagtgaaagttttgatgatgatgattttgctgtgtcttaaacagcagtggaagttttgatgatgatgatatgatgaagtggatattttagaaaaaaaaaaaaaaa

SEQ ID NO: 18377 - DNA, 769 bp, Triticum aestivum
  unsure (1)..(769): unsure at all n locations
  Clone ID: PAT_TA_18377
gcactattgagtttttgtattgttgttttcatctagatgtatacagttaatgcccaccttccgttgatcatgactcaattttaatgctgactcaattgcatctcaatttatagggatgatttccttgaattcaaaaatcttctggagctgtacctaaaagaaattaactcttccataaaagtctccagtgctgagaatgcccttgcgattgagaagtgcatcggtgctcactccaaggatatggagcaccttctgcagcagtttgaagcaatgtctggtcatgttaaagaggcggtgtctatgggagcgcgtgctgagaagacatcttcagagaatgcagaaaagattatccagttgcttacggaaatttctgtcactttgagggaagttccgcctagcagtactggttcatttgctgacagattcatgcggatgtcgaagtatccattcgaggcaggccaggtctatgagcagtttcgacaggcctcttggaatttcttggcggattcttattgcttctaggtaagctctactgctccagaaaagctaaagtaaagtcagtaaggtgctattgcttgtactttctacttaaacttagatttatattttctacctgtacttgagagcttgaaagggaagacagattagaagacttncacaccataacttncttcgttggctgactccttcagaaactagaaaaactgtaatgactcacttcactatgataacttatgcaggagtttctggatccaaaggatgagcactg

SEQ ID NO: 18378 - DNA, 1109 bp, Triticum aestivum
  unsure (1)..(1109): unsure at all n locations
  Clone ID: PAT_TA_18378
cccacgcgtccgcccacgcgtccgcccacgcgtccgcccacgcgtccgatttcaactggatttgagataggagatcaagagtcaaattcattcaaccattggtggcctcatcagcgttcaattgtattttgcactctcttaaagatttcagctgatttatgtccctgcttgcgaagagcagctggtttactctcaacttgacgcagaagtatggatgctgggaaccacgtcacctcctggatgaaggagatcatttcacggttcatttaagaaaattggcaaagtgcagagatccttcatataacttcaagaaaataagacaagacaagattgtgtgcagagactggagagccagaataataaagagtagagaagttgttcacgtcagaagaacaatgaggagggaacttgttcatgtttgcttttctgtttaccagtataccgatgaactgttcgtaatgaaaatacaagcacagactaagacagctcattgataactatgtgtagtgggagctaggaaagtgtcattggaatttattatcagcagtaatggatgacacatacaagagaattgatacaaganaatttaccaagcagcggatgttcaagcagaatcaaatatattacagctatgacaatgccgatgccagtgccaattccgatgctacccggccagccgacagcaaggtgagttgcaagggaagagaaaaggccaagatataataacccctagttgcccaaatataatttgccgtcgctgttgcctgaggtatgtgctgcgctgtagcaagtgcccagcctgccctatttacgcgtttaagttgaataaattccactatctacgagctataagctgtagccttcacataaattgtattgtgtctatctatgattatatcgtatgtcgttcatgtctgtcaccgttgctttgtcgagctctgactagttctcggaagtatacttgatggctgggttaagtattgtacgccactggcgccaactctagtgtcgtttgctcctcgttgtaatattaggggcttcatcatgggatattcatggtctgtattcagtattctgtataaaatgggtgcttctgtgctgtcnctagt

SEQ ID NO: 18379 - DNA, 2877 bp, Triticum aestivum
  unsure (1)..(2877): unsure at all n locations
  Clone ID: PAT_TA_18379
cccctccgccggtcccccggcagaggtcagctgatcgcagcacggcatccgcagcggcaccagcgatggcagagttatcgtggctcacggcgctagggttcgtcttcctgaccttcaactccggccatggccgtgtaccgctccaacggcgacgccgggtccgtcatcttcgtcgccgtctcctacctcgacctcgtggccctcttcgcctgcctgcgcctctacgagcgcctcgtccgccactccccccgccgggaccggatcaaggccgccgtctgggcgctcaccacgctgctcaccgtcatgttcacctacaaggtcgccgaggtcatgccgctcgccgtcaagctcctggtctgggcgatggccgccgccaccaactgcggcggcttctacgtcttcttcgtccacgagcgacaagcctgtaccagcatgctggcaaggacgcggtgcggccgccgccgagtcgcggggcacgtcgccaactaagtggctaagttggagggcggctaggcgctggctgccgcgaggtacgtgcttcagtgctaacagcagtggccggcgttggagctgggggcgcactagtcggccggtcgtgtttcttggcgggttatcagccctttttttgccggcctgatgtcgcacaaactgctttggcttgcccggttgcttggattatttgttccggtgttttggctgccggccctgcactattttcccgtttaagttgattatattccactatattcgagctataagctgtggcgttctcataagttttatggcgtgtttgtttatttatttcgtaattacttgctctgttgagaagtgagtttgtgttaattttgattctcgtttgagctatcaatttgggcgtgtgcccgccacgcggcccacaaggaggaagaaactgcgacagcttgaggtagtttgagtggattgcaattgtgtaagggctctatttgcatcaggaggagggtaggggaacggatgctgagggagtagacaagaaaccagagaaatccttagtgtgcaaaagtggatgatcccttggtacagaggtggtgtagaaactgcaaatagtttccttgaatttgtgtgaaaatagtgaattgtcgtgactagccaaagttgagatgatatgaagacagacgaactgcaggacaacatatgagcgaaacaagcagaggcataagtgaagattgcagatacaatggaaattcatctgcacaataagacaacaagctagaaatgttgtacttgttaagttgtctcatctgatgcacccatcagtggtttgcagtatgctgacgggaactatagattgaacatatggcaactggaaatttgataaacaaatggaaaaatattcaactgtatttgaggtatgagaccaagagtcgaaatcatttaaccattggtggcctcatcagcttgcaattgtttctgcactctcttaaagatttcagctgatttatgtccctgcttgtaaagagcggctgggttactgttagccaccttgaatattatactttcttggatatttcaagtaacttggcgaagtgcagagatccttcataccttcctcttgtcaataaaatacaactaagacaataaatggacaattgttcaactgaatttgagatattgagatcaggggtcaaaatcattcaaccattggtggcctcatcagtgtgcaattgtttttgtactctcttaaagatttcagctgatttatgtccctgcttgtgaagagcagctggtttactctgaacttgatgcaaaagtatggatgctgggaatcatgaaggagattggagagccagaacttgatgcaaaagtattggatgctgggaatcatggattcaagaaaatttgcaaagtgcagagatccttcatataccttcaacagaatatgactagacaaggttgcgtgcagagactggagagccagaataataatgagtagggaagttgttcaagtcagaagaacaatgtggagagaactagttcatgtttgctgtttcggtttaccagcatacagatgaactgttcgtaatgaaaatataaccacagactaagacagctcattgataactatgtgtagtgggagctaggaaatggccattggaatatattatcagcagtaatggatgacacgtacaagggaataaatacaaggaaattacaaagctgcggatgttcaaagagaatgaaatatactacagctatgacgatgctgatgccaatgccaattccgatgctaattctttgtcacattatccggcaagccgacagcaaggtgagtttcaagggaagagaaaaggccaagatatactaacccctagttgcccaaaatctaatttgccgtcgctgttgcctgacgtatgtgctgcgctgtagcaagttcccagcctgccctattacgcgtttaagttgaataaattccactatctgcgagctataagttataacgtttctatgaactgtattatgtctatctatgattatattgtatgtcgttcatgtcggtcgagctctgactagttctcggaagcgttcttgatggtcaggttatgtattgcacactactggtgccaactctactatcatttgctcctcgttgtaatgctcatggtctgtattcagtacgttgttcggtatcacgctagcttctttgcagtcctagtaataatgcattatcctggaaaaaataaaaaaacgaaaaaaaacaaatttcgaccctcgaggcggngtcggtattaaaattcaactngggccgtccgnttttanaaacggtcggtggactggggaaaaaacctggggggtttanccaaactttaatcngcctttgcangaaaatcccccnttnccgca

SEQ ID NO: 18380 - DNA, 653 bp, Triticum aestivum
  unsure (1)..(653): unsure at all n locations
  Clone ID: PAT_TA_18380
cgtgcgggcagatcgaatgggtttgcacagcaggcagtattcccgaatcatcgtgtttagtaaggttcccttgcctaattatagatcagaccttgatgacaaaagacctcaaagagaggtatctataccttctggcttgcaaagagaagttgatgcattgcttgcagactatcttgcgcggaagagaacagacagtgggaactttcctaatgctgccttctcaaggtcaagcagcacggacagtttcgcgactgatgaaagcttctatgagcagcaggataatcagacatcaaccaatgttgtgatggaaagaatccaaagaaggaaaagcttacagttgcgtaaccagcaagctgcttggcaggaatcaaatgatggtcagagcatgatggagtttcgtcgcagtcttcctgcccagaaagaaaggcaatcactattggaagctatatctcagaatcaagtggttgtagtttcaagtgaaactggctgtggtaagacaacacagctgccacaatacattttggaatctgaaatagaagctgctcgtggtgctacttgcagtatcatttgcactcaaccaagacgaatatcagctnnnttctgtttctgaaagnnttgctgctgaaagnnntgaaaaaattggggnnntcgnn

SEQ ID NO: 18381 - DNA, 861 bp, Triticum aestivum
  unsure (1)..(861): unsure at all n locations
  Clone ID: PAT_TA_18381
caggaatcngcacgaaaaaatccccctctctctccccaatcttcctctccacatcgcgatggcccgccgcgcgccaccaccacgccgtgcccctaccggccctgctccgccacgcccctaccagccctgatccaccgcgtcgcctcttcctcccccttctctaccacatcggtgacccaatcggaccatcggcggtgggcacgatgtcctcacgcgaatttgactgccgccaccatcaccacctccacctcgagctgctcctcgatgcggttgtccccgacgagcaccgcccccacaggactgtccccgacgagctactccccaacggccacatcctctcctgcactgcgagcactacagcgaggaggacgccatccacttacccgctagatcaagattgcgtccaccacctcgacttcaccccaaagctagcttgccgttgttgcagaatatcagtttgccctttgcaaggtccgctcctgcaggtctactaggtaccaaggaatgtttaaatactacattggtgttttctagcttggagaagcaacatcaacttgggatgtagattcaccagtatatgtgcatgcatctcatagggggagagatcttgcacggatgtaagacgatttttcttctgctatagattctagagggatgctttgcttaaattcatatccatgcataaagtcaacatccaatgaaatatgagacccaaattttatctttttgcccgggtttgggagctatgacaaccatccaaaatgagctagcttattcagaccgcaataatcacttttttgcattgtcattttacccggtatgaatggaatcatgatggttatgcatttttaagcatgatag

SEQ ID NO: 18382 - DNA, 576 bp, Triticum aestivum
  unsure (1)..(576): unsure at all n locations
  Clone ID: PAT_TA_18382
gcaacgttcttgcggccgccgtggccgtggcgtccgccgtcaggagctcggccggcccgtcgaggctcgtgttccacgtcgtccccgacaagacgcgctacgtcccgatgcactcgtggttcgcgctgcacccggtcgctccggcggtcgtcgaggtcaagggcctccaccagttcgactggcgcgacggcgattccatcgcctctgtcatgaggaccatccgacgaggtccaaaagagctcgctnggattaacaaccaacttttgttgaatggttcgggtgggaaagggaagtacaagaaggctccaaagccaccaaagcccaaagcacgaacttcgataccacaaactatctcaaaatcccatcgccccaagagatcttccccgggaggcttcttgagggttgaatactgcaaggaactaacaacttcttgggtgcgcaaaaggattttggccggggctgcggggaaagaaggaaccgtggaaaggggaatatcaatgttcatggtgcggaggctcaaccgacttaacttactgacctgcatgttttgtaggcctgaggtcgactgcgcgggtc

SEQ ID NO: 18383 - DNA, 2833 bp, Triticum aestivum
  Clone ID: PAT_TA_18383
gcccggcgcccgcccgggccggtcctagcatgggtggtcgccctgggtgctcggtcttaattcgacccgcgctcggccgtggccgctctcccttcttccgcgacagcctgtcattcgcgtcgtttggggccatgcagatgggcgtgttcatcgcctgctccgccggcaacgccggcccggacccgataagcctgacgaacctgtcgccgtggatcaccacggtggccgcgggcaccatggaccgtgacttcccggcgacggtgacgctcggcaacggcgcaaacatcatcagcgtctcgctggccaagggcaggaatagacttttttttttttatttcgaaataaaggttcttgtcttgtggggaacgatgcacaaatttttggaatccggtaccaacaggtataatcccccccagaactacgttttctttcaagcctttcaaccaatcaatgcgacctcgtagggcagcttttgctaaaactcgagcagtttcttgaaaacttgcttcagatatgaaaccttgggtgctccggaccgcgccggggctcctcgccgacagccacctcctgccagccggtggccgttggggactcccgaaggcgtccgcggcaaagaagtacaccaggaccgccccaaagccgacggcgacactcagcttcgccggaaccaagctcgggatccggccgtcgccggtggtcgccgcgttctcttcccgggggccaaactacctgactctggagatcctcaagccggacctcatcgcgcccggcgtgaacatcctggccgcatggagcggcgacgccagcccgtcgagcctggccagcgaccgccgccgcgtcgggttcaacatcctgtcggggacgtccatgtcgtgcccgcacgtcgccggcgtggccgcgctgctcaaggcaagccacccggactggagcccagcgcagatcaagtcggcgctgatgaccaccgcctacgtccacgacaacacctaccacgtgctcaaggacgcggcgaccggcgacgcgtctacgccgttcgagcacggggccggccacatacacccggtgcgagcgctcaacccgggcctggtctacgacattgggcagaacgagtacctagagttcctctgcacgcagaacctgacgcggacgcagctcaagggcttcaccaagaactccaacatgacatgcaagggcagcttcagctcgcccggcgacctcaactacccggccatctccgccgtcttcaccgatcagccggccaccccgctgacggtgcgccgcaccgtgacgaacgtcggtcctccgtcgtcgacgtaccatgtcaaggtcacaaagttcaaaggcgcggacgtcgtcgtcgagccgagcaccctgcacttcagcagcgcaaaccagaagctcgcctacaaggttacagtgaggaccaaggccgctcagaagacacccgagtacggtgccctgtcatggagcgacggcgttcacgtagtccggagccctctggtcctcacatggctgccgccaatgtgagcttttctcctagtactgtaccgttgttctgccttagtcgagggcctgggagcagaagcagctgtgccccggcctcttggtaagcgaggttgatgaatcaattgcgtagcagcagccagctgcacaggactagcacttgccggaagaaagatgttgtgaagctccaactcaaaacaagcttttattccacaaatgtattcacgcttattccaaatgttcagtaaatggttgattgtttctacataacttgtgtgtgtacaacatattgggggtgacccagcggtgcggaaaactccatcacggcgaatttagctcgattcccaaatggtgacaccatcgcatgtgcagagtttcttgtagttctccccaacacccgcacttctcgcgacaacggcagctgcaatgcctgggtctgatctgtcctcggttgcatacagcgcaatagagcgaccgatcaagtcgacaactttcagtttctcttttgatcctgaaaactgggcttctccgttctctccagcttctagtgttcccaggtcaccaaggggcttatcagacagataatcctgtggattgtatactttgccagtactttctgcaccttttgtcaaatccccaaattcatttattgaccatccatgtttaccaggtgatagaccactaaaagtagcctcaactctagccaattccatgttaacttgggctagacgaacaacaccaaatataactggccctttgaactcagccacggcagcagaaactaggaaatcatctgggttcccttgcccaatcagacgtgcatctcgtcctgtttgatgcagagcatccaacattatcttcactgggagagacccacgaactctaactacctggttattcaaatccacttcgatgttttgtattccttcaagtgtttgaagcttgtttttcactgctgtgacacagccctcacatttcatgtccaccatgaattcggtcgtgagctccggaagcgcggtgcccttgtcgggagcagagagatcggctgtggcggcggcggccatcggaggggcggcggtcggcgcgcgcacgggggaagaggaggacgaggaggcggcgaacgcggagagggagggaggcagggggaagcggagcctggaggagggggagcgggagggggaggaggaggagcagagggcggccgcggcgacggctgctgctggcacggcggatgcggcggtgaaggcccggaggaagcccaccatttgtgcctctgccttttgtactctccaagtcttcgcttccacagctccggtttggattgagaaccttc

SEQ ID NO: 18384 - DNA, 675 bp, Triticum aestivum
  Clone ID: PAT_TA_18384
cgtgcgcccacgcgtccgcccacgcgttcgagaaccgaaaatcaaaaataaagatctccgctttggccgtcgatctccggtggttgattctgtgagcgtccgctgctgcttcgtccaatccgttcggccgactcctctcttcggtttcctttctcaaggttggatcgagggcattaggcaggagatggacgtggagggcaagatgaatttggagattggatccaaggacatggaggtggagagcaagaacctgaagctggaggacccactgccttcctccgcgatggacatggacgagcctggtgttgctgagagtggcgaggtggatgacagcaatggcagctccaaggagtgccccttgacccccagggattccatggcctccaatgttcctgtggccaaagagccgagatcagtcagcaccgactttggggatgagctggaccttgagcttgggagtggagagccagagcccggcaggcagcaagagaggaagctctcaaggcaagaccggatggagctcagccagttgttccagcatgccgggagctctcatgaatgggagtgcgctgatggcttgctggccaaagctgatgcacaaggactcaatgatgtgctctgcgtggcggtcgatgccatttggttcttgagcgacaaggaggagctgtatgccat

SEQ ID NO: 18385 - DNA, 1762 bp, Triticum aestivum
  Clone ID: PAT_TA_18385
agagaattgccagagagagaagagaggcgagcgtatttcttcttccccctctcggacgtggggggcggctccctccccactcgcacgggcttctcgcaccgccagcccaggcggggctcctcgcacctccgccgctgctacccgcggtccgtcaccgctgccgccggccgctgacgcagactacgtgaaccaatgctttcttgaagctgcacgctatggaagcactgaactcgttcgcatcttacttccgattgctcaaaggaacagcttggacattgatgtggatctagcccttggctttgctgcccactacgggaaactcgaaacgatggggtgcttagttgaggaaggtaatactgtcgccttccttggccctttaatgcgggcagctgagcgtggatgctttcaagttgtggaatggtttgtgaaccgtggctgtcgggtcatggagcttggcctggcccttactgctgccacctctagtagccaggttgaagttggagcctctgtccttcctcgagttccacaacttgtttttccaccactcagcatcgagattgttaaggctgctggcgagaggagcacaggttccctccaaggtgtggattttcttctccggtcggacttcctcaatgggaaacccgcaacatatgctgtagcagagagcagagcgagatgcgctcatgaggctgtagatgcgaagcttaggctgttcatgctcgagcagtggtcagaggaagccttcaacaagggattcgtgtcttcacaagagcactttgtcaacattacaagggataatgcaaaggggcgagtcgccggtcgtcctgagacagctcccgcttcagctggtgatcgccatggcctacctgccactgtacagggaatgcgtcgggtcaggtgggcggcttctgccgcagaggctaagaggccagctcgtggaggctgcaggcaggctggagggccggcaactggacaggggcatgcagcaaagcgagctgctggccatcctggagcaccacctcccgcgttttctcgttcagacttgaatgaaggtcgcaacctgtactcaaaccgcatcggcattggcaccgtcattgtcatcggtcatcgcaagcaagtagcgaagggcgtcgcacccaccatccatcttcatcgtaccctgcttgtcgacatccgcaatgatagcaccacccctgagaagctcacccccccgactctgcccgcaggcgctcttcggagagtatatagttttggtactggaggttggtggcaggtcgtgtgtcgggtgtgtgtataggggcacccagcaaagcgagctgctggccatcctggagcaccacctcccgcgttttctcgttcagacttgaatgaaggtcgcaacctgcactcaaaccgcatcggcatcggcaccgtcatcgtcatcggtcatcgcaagcaagtagcgaagggcgtcgcacccaccatccatcctcatcgtaccctgcttgtcgacatccgcaatgatagcaccaccctgagaggctcaccccccctgactctcctgcaggcgctcttcggagagtatatagttttggtacaaggtgttgtgttgtgtcgtgtgtgtgtgtgtgtcgtctctgtgtgtgtgtcttgtgcgaggcgtctgttgagtatttaccggaaccgcaaccgtcagaaaaaaaatgatataagcgtcgtcgaggacatgtttctccagttttcggtaaaccatacaaaagaaaaaaaaaaaaactcgaaaaaa

SEQ ID NO: 18386 - DNA, 733 bp, Triticum aestivum
  Clone ID: PAT_TA_18386
ctgttgcaggttgggagcatgctgaaggtgaagttagtaacctgaagcggctacttgatgcttcatctctgaagaatgcctctctggaggaccaagtcagccacttggatggtgccctcaaggaatgcgtcaggcagcttcgccaggcacgagaagaacatgaggagaaaatccgtgatgcagttgctaagaagtcccatgaattggagtctgagatgtctgagctccagaacaatatcgctgacctgcaacagcagcttgaagcctccgatctgcgggaaaaacttcaggtagcagagaaagaaagcaaggatctcaagattgagttgctcactctgtccaaggaattgaagatgctcgcactggaaagagacctgagcaaccaagcagcagagacagcgagcaaacaacacttggaaagtgtcaaaaaaattacaagagtcgaggcagaatgccgtaggctacgccatgtgacacatagaacttccctagctaatgattcttctaggcctgttccaaacaatgcttgcatggaatctctgactgacagccagtctgacagtggggagcatatgctagctattgacagtgaagtaaaaaattctgatctgtgggcctcagctcttataggagaactcgatcagttcaaaaacggcaacgagggcacaagagatcttgtaaataatcctgctgaaaatgacctaatggatgactttctcgagatggaaaagct

SEQ ID NO: 18387 - DNA, 711 bp, Triticum aestivum
  unsure (1)..(711): unsure at all n locations
  Clone ID: PAT_TA_18387
ccaatagtccactaaaaagcaattatttttcaacatcaagcattaagaaactgtaatgatacactgcataaaaacagctgcaaatagtgtataacgaccagaagacgatcgagtgagctcgggagaaatgtgtgtcaatatctacattgatcggtcgaccagaggagccaacgattggtttttcaattgattctcaccgtgccactcactcatcgctacatacaaggcgtatatatggccgaagcttgagctttgcacaaccaaactggagtaaaaacgaaaactaggtgggagaaacattagcatatgcatgcaagtccttccatggtaatggcacgatgatgatgatgatgacggcgatgatgatgatcagtatacttcgacgttccactgctcggccttcttcagctgcttcttgtagtcaatccagtcgatcccgtccttggcggcgaggtcgaccatgatgtcgtcgatgcccttctccatgcccttgagcccgcacatgtagacgtaggtgttgtccttcttgagcagctcccagagctcctccttgtactcggccatccgcgtctggatgtacatcttctcccccgccgcgttcgtctgctcacggctcaccgcgaagtccagccggaagttctccccgccgatctccacctcttctcaaactcctncttgtagagcagagtgtcacttgtgggaacccccagg

SEQ ID NO: 18388 - DNA, 670 bp, Triticum aestivum
  Clone ID: PAT_TA_18388
aaatccatgtacgatgcaatccgtgtgaaattaagttatgtatgtatgtatgtacattgatagatagagaatgtctttcatcatcgtaaggtatatgtacatcggtagatagagacctgagtctgacagactcgggcgcggcgacgagccaacgatttgattgatctccgcagtcgtcaacggaaggatggatcagtagacctcgacgttccattgctcgcccttcttgagctgcttcttgtactgcatccagtcgatcccgtccttggctgcaaggttgagcatgatgtcgtcgatgcccttctccatgcccttgagcccgcacatgtagacgtaggtgttgtccttcttcagcagctcccacagctcctccctgtactccgccatgcgcgtctggatgtacatcttctcccccgccgcgttcgtctgctcccggctcaccgcgaagtccagccggaagttgtccggcgccatctccttcatcttctccagctcctccttgtacagcaggctgtcgctcgtcgggactcccaagaacagccacgcaaggccgctgaacttgtagtcctcgtgctcctccaggaacatcttccacaagaaggagcggaacggagcaataccggtccccgttgcgagcatgatgactgttgcattggggtctttgggcatg

SEQ ID NO: 18389 - DNA, 1459 bp, Triticum aestivum
  Clone ID: PAT_TA_18389
agagacgagaagacgatcgagtgagcttggggcaaatgtgtgtcaatatctacattggtcggtcgaccagaggatccaacgattggtttttcatttgatgctcaccgtgccactcactcatcgctacatacaaggcgtatatatggccgaagcttgagcttttgcacaaccaaactggagtgaaaacgaaaactaggtgggagaaacattagcatatgcatgcaagtccttccatggtaatgccacgatgatgatgatcagtagacttcgacgttccactgctcggccttcttgagctgcttcttgtagtcgatccagtcgatcccgtccttggcggcgaggtcgaccatgatgtcgtcgatgcccttctccatgcccttgagcccgcacatgtagacgtaggtgttgtccttcttgagcagctcccagagctcctccttgtactcggccatccgcgtctggatgtacatcttctcccccgccgcgttcgtctgctcccggctcaccgcgaagtccagccggaagttctccccgccgatctccaccatcttctcaaactcctccttgtagagcagagtgtcacttgtggggactcccaggaagagccatgccaggccattgaacttgtagtcctcgtgctgctcgaagaacatcttccagaggaaggagcggaacggcgcgataccggtacccgtcgcgagcatgatgatggttgcgttggggtccttgggcatgagcatctccttgcccaccggcccagtgatcttcacttctgaacccggcttcaggtcacagaggaagtttgagcagacgcccttgacgacctccccggcgtcgttagtgtagacgaggcgcttgacgcagagcgacacggtcttggagtccccgaagtcccccagcgcgctgctggcgatggagtagagccggagcttgtgcggcttcccgttcttgtcctcgccgtcggcgatcacgccgatggactgcccctcccggtacggcacctccccctcggtgctgaacaccatgtgccaggtctcccccggcgcgttgtcgccggtgagccgggtgttgagcaggcaccgccccacgtagggctccttggggcggtacttgttggtcaccaccccctcgtcctgcttcttggagatcttcaccggcttggccggcgccgcgggggccggctccgcggtcggctcggtcgtcgacacctgcgcgcgcacgccattgcggagccggcgggtcgggtaggccaggaagtggctggcggtgcaggacgccgacgagccgccggcggccttggtggcggccggggagtaggatggtagagcggctgtgagctgggcgggcatgttgagtgagggtgggggtggagtgcggacgtgcggtgtgggagtggattgggtggtggtatttgggatgagaggaggcgacggagtgagtggaagggagacgaggtgag

SEQ ID NO: 18390 - DNA, 1523 bp, Triticum aestivum
  Clone ID: PAT_TA_18390
aaattctaatttattttcgaatgagccaatgacaaatctacgtcaagaattacgataatttattgacacactgctcaagaaaagtgtgtaacaatgtctaaattcctggatacaaccgagtagccaagggagggatttgcgttaaaatctccctggatcgctcacccagagcagccaacgaggggtttttatggtggttctttcagttttgctctgccgtgtcaacatacaagctggatatagggaacacatttgaggcctaaacattcaatttcttcgataaaacagacacgacaaggaaatgataaaaaatagtatgctcgcatcgtcagtccgtcgttattgaactactgcttgtaatcatgccagtaaggatgagctttggataaactgaccggtaccacaacgtggatctctttctgcatctccttggcctctaatcggtagacgttcctgtccttggcctggagcagcttcctcaggtattacgtcgtcgtcctcctgccgcggcctgttcagcccccaatctcactcgatagaagtcgtcctctttgtgcgaccccccgaagcacatccatgagattcctccccgcgtaatctccaccttcatctcatcagtcctcctcgtagatcagctgtgtgacctgcgggaagtccccaaggaagtccatgccgacccactgaacctttagtcctacgtcctccttcagaagaacatcgtcccagatggaaggagcggaaccggcgacgataaccccgttcccgtcgtcgagcatgatgatcggttcgcgttcggggtccttgggcatgagcatctcctttgcccaccggcccagtgatcttcacttctgaacccggcttcaggtcacagaggaagttggagcagacgcccttgacgacctccccggcgtcgttggtgtagacgaggcgcttgacgcagagcgacacggtcttggagtccccgaagtcccccagcgcgctgctggcgatggagtagagccggagcttgtgcggcttcccgttcttgtcctcgccgtcggcgatcacgccgatggactgcccctcccggtacggcacctccccctcggtgctgaacaccatgtgccaggtctccccgggcgcgttgtcgccggtgagccgggtgttgagcaggcaccgccccacgtagggctccttggggcggtacttgttggtcaccaccccctcgtcctgcttcttggagatcttcaccggcttggccggcgccgcgggggccggctccgcggtcggctcggtcgtcgacacctgcgcgcgcacgccattgcggacattgcgcggccggctggggtaggccaggaagtggctggacggggacgagccgccggcggcggccttggtcgtggccggggagtaggacggcagcgcggctgtcagctgggcggccatggtgagtgtgggtgggtggagtgcgggcggtgggctgggcggccatggtgagggagggtgtgggggtgaggccctcgtgcggtgtgggagcctcgtgc

SEQ ID NO: 18391 - DNA, 802 bp, Triticum aestivum
  unsure (1)..(802): unsure at all n locations
  Clone ID: PAT_TA_18391
gggtcgacggcatggtctctggcgactcttgctcgaactcgtgggagcttttgctttggtcggggtggaacatcttcttcatcttgtccttcttcttggccttcttcattgttggcgttgtcgttctcttgtcgtggtggagaaggaggttgttgatgttcatcttggtgtacttcctcattttcttcgtcttggtgtgtcccacttgtggatgcttctgtatcaactcttggttcaccttgtcgtgaggtagaagcttccacttggacggacgaggtactctccttcacctccgttggacgaaccttgccaatagacaagtcttgggattgcttccgaaggatctttgtctcctacatcaattgggcaattgctctacttgcgagccgttagatcatcaaacttcacatctaccgtctcttcaaccttccggggtgaaattgttgtanacacggtaagtgtgagagttgagcgcataacctaagtaggaaacctcaatgagactcaaggagcaaatttagaacgacgatgcttatcaagaagtacactttgaacccgaatatccgagaataccaactggggttgttaccgggtgaagactctatgcctctgccgataactgtgaagaacagcgattgttgcttgacaactgtccaacgctcgccaaaatgctcgggtctgtccacaacacgcccccttgcgagtcgtcgccctcaccactgtcgggggcttcntgactncaaccccctaagcccttccgtagggccattctctancgtcattctgactcnataatnatntt

SEQ ID NO: 18392 - DNA, 2037 bp, Triticum aestivum
  Clone ID: PAT_TA_18392
gtccgccatcccccctgttgcagccctctaggtgctgcttggcagcatgctccgcctcaaccctggccggttgccctctgaagtattgggctccggcatgcgtagattggaagcctggtttgccactgacgtggatattatctcgtcgacagattgggaccaggaacatggtcttactgggtggccctgggctgatggtgaatggctacgaccctgttatcttactctctccccggggttttcaggcattgcatctgctcgtgccttgtcaaatgcttcatttaaggtcacattgctagagtcgcgggagcgacttggtggccgtgtgcatactgactattcttttggctgcccaattgcctcgggagcatcttggctgcatggtgtttgcaacgagatttctctggcgccactgattcggcttcttggccttagactatatcgctccagtggtgatcactctgtgctttatgaccatgattgggagacccacgcgctctttgctaaagatggacgtcaaattccccaggagataacaaccaaagttggggaaatatttgagcagattctgaaggagacggtgaaagttagagatgaatatgcaaacgacatgcctcttgttcaagccatctcaatggtgcttgacagaaatccacatctaaagcttgagggtttggcaatatgaagtattgcagtggtgcatttgtagattggaagcatggtttgccactgacgtggataatatatctttgaaaaattgggatcaggaacatgttcttactggtggacatgggcttatggtgaatggctacgaccctgttatcaaagctctctctcgagatcttgatgtccacctgaaccacaggggtaccaaaatcatccaccggtatgataaagtcatcgtatgcatgggactcgggaaaggctcctttgcagatggttctgtaataacggcctcttccggggtcctcaagacgaagatgatcaagtagatgactgagctcctggtcgggatcctgttgtccaggctggagatggcaggaggcatagaccactctaccatactcaccctctttctggtagtatggaagaaggaacttatctgcgtaactgttcaacttccagacggcaaaccatcgttgttcccatctctgcatgcagggccgcagaccaatttgcttaccaataagaaaaacaatatgtagactcaatcttgaactacttcaggagactggcccaagcggccactgcgccgggccactttctggtctctcgcaggggaactgaccctcccgcgctcggatccaactcggccggcagagtcgcataccaaatggacaagctatcacacgaagaagccgtaaacttcgtcatgtcacagctcaggagaatgctgccaagggccaccgatccggtccagtatctggtttcacggtggggaaccgaccccaactcgctcggctcctactcgtgcgacttggtccggaaacccgccgacctgtatcagcggttctgcgctccggtgggcaacctgttctttgctggggaggccgcctgcatcgaccactcggggtctgtgcacggagcgtattcgtcaggcatcggcgctgcggaggactgccgaaggcgcctctcgacgcagctcggtatctccgaccttttccaggtggggaagattgtgatgagggaggagatgactgaagtcatggtccccctccagatatccaggctgtgaaaggaaggaagaacaaacctgtctactattattagcatcgtgttgttctgttaacatcgtagctgtaatttacctccgaaactgtacaatttcgcagcgtctgatctttgatgtactccctccgtttgtttttataagacgttcaaacaacttgcataaagccgttttcgaacagtgtctgaaagtctaaaacatcttataaaaacaaacagaggtagtgtctctcaataacatgcggatttccctctgatttcatcaatattgctcttgttatctttttaaaaaaaaaaaaaaaaaaaaaa

SEQ ID NO: 18393 - DNA, 693 bp, Triticum aestivum
  Clone ID: PAT_TA_18393
ctcttcatcggcagaggcaggccaggggcccgagggagcccaaacaaaaaccaccaggggaagaagggaaagacacacgccactgtgaccaaaccctaggccggccgcgatgcgcaaggcgaggccgccgcagccccagccgcagccgtcgcagcagtcgccggagatccggtaccgcggcgtgcggaagcgcccctcgggccgctacgccgccgagatccgggaccccgccaagaagacgccgatctggctcggcaccttcgactgcgccgaggacgccgcccgcgcctacgactccgccgcccgatccctccgcgggcccaccgcccgcaccaacttcccgccctcctccgccacgcagccgccgccgaggccccctccccctgcggccgcggccgcggccgccacgtccagccagagcagcaccgtccagtctggagcgggcggcgggccccgcgcccccgccagggcccgcagcgccgcccgagcgggcacggccaaggaggggggaggaggactgccgcagctactgcggctcctcgtcctccgtcctcctcgaggagggcgcggacgacgcggccgcctcccgctccccgctgcccttcgatctgaacatgccgcccccgcaggagggggggcttgacgccgagggcgatcagatgacctgccggtacgacacgctgctccgcctct

SEQ ID NO: 18394 - DNA, 1732 bp, Triticum aestivum
  Clone ID: PAT_TA_18394
cattattcctttttgatcagggatatatgaagtgattttcttttgatttttttaccaagtttcaacaacacttttgatttaaaaccaaaactgtctcagaccaacatgacacgacaggcaggatctctaatcagtccacaggccgggccatttggcccaaaccttctcatcctcatcagtctacggattaattaacataacttaaaaacaactgtcgctgccacctcctcccaggagaactgtcttgggagaaagatgctaaaaacggtaaccaactcagaccaactaagtatatctctctctttgtctagacctatcccctcccctctttatttctctcccctctcccctctccactctcagtataaacgctatgttcagaagagacggcaggtactcggacgccatggcctggagctccaacgccaatcgcctggagcttctcaaggtcgggcggtgaggtccaggttggggggagcatgaagccggccccggccgcgagcgcaatcaccagcaggctgcccttcaggcaggtggcgccgcgcgacagcctcccgatgatggctttgcagtacttgtctcgcctcctgtgatggacgccttctccccagagtcctctgcttcctccagttcagagttgctttgagagctgtcagagttgagcttgggagagagtgtcttgccagtcagcagtgattttgcgcaagaccgcaacactggcttggatattctctcgcatgaagcttgtcccacagcttgtaggactctggactctgagtcaggcaccaaatgaacacatcggtggactccttggccacgctctggtggccttccttgcattccccgcaatattctcttgcagggcctgcagtgacgctggcagaagctgctgcgatgcttgcttcacagctttggagccaggagtaccaacaagagccagctcctttattattgggtaggctgcttcaaacctttctgtagccttgacacgtgcattaggcacgggaaatgtgcatctcataaagagatcaagtgttccagcaggaaccaggcgctcccccttcctaactgcaccattcagtagcatagcccgagctttggaagcattgggggtagtcaaaaacctctcgagcaactgcagaacgagatctcttgattgaggattcccacttgactttgcacaaactgtgggaaatagggaatgcgaccaggaaaacattcccgagactaggtcgccttgagatgcctgattaataacccaggcgatgatgggaagcttttcctgtccaagatatttactgttccccactatttttggggagaggtttattagtacatctggcttccttcttaaagtcaaggcaagcacaacaaatattgcaacctgggcttttggagtttgttgaacaaccttcttcgcgcccttaggtccaacagttggacctgacaattccgacatgatgctatctatacaccacaaaacaaattctcccaatgcatcaggagatctctggctgatccaatcacttgcagtcttgcaaactggctcaggaacatgggacaacggtacatcaaccatcttgggcatgggtgactccttgaacatcttggcccaggggaactgggccgcactcacgttcattatctgaacataatacaacagtaagctaactgaatttgtaaaacaaaattaactgactctgtattgcagaatgaacacatttcaactcac

SEQ ID NO: 18395 - DNA, 1345 bp, Triticum aestivum
  Clone ID: PAT_TA_18395
tggccttcttcccggccgtgtcggctcggacgctgcctcaggcgttgtcgctgctgtcgcgggctgtcaccgtggctgctgttactgccttcggggcctcccactggatggtgaagcggctggctaaatcggccatgttgggctcttctgctcagagacaatttagggacacaagagatatgatgatggacaacatgttaagcactttccatacgttggtgactgacgacccacattctcctctgaacttcagagaagttttcaaggacgagctgttcccaatgtccttgatccagagtttagacgtggatgtgggttcagtttatgtgaaggagtttgggagcgagatatcgaaggatgaaatctaccagatcaccgtggttgacatgatgatgtgtgcaatcgatgttgattggagggatttcttcccatacctcagctggatgcccaacaacagcttcgaaaccagagttcgtagctcagaatctaggcgaaccgcggtgatgcaagccttgatccatcaacagaagaagagaattgcggacggcgaggccggggctcccggtcggcgccgcgggctggctgggcacgctccgaccgccccaccgacaagctccacccgctgcacgtgcatctctcgcccagagggaggaagtgaattgacgtccggctgggctttgtatgagctggctaaaagcccagaaaaacaggatcggctctaccaggagatccgggaggtgtgcggcgacgagacggtcaccgaggatcacgtgccacggctgccgtacctcagcgccgtgtttcatgagacgctaaggttccattctcctgtcccactggtgcctccaaggtttgtccatgagaccaccaaactggccggctacgacgtcccagccggcaccgagatagtcatcaatctgttcgggtgcaacatgaacaagaaggattgggaggagcccgaggattggaggccggagaggttcatggatgggaggttcgaggccgcggacatgtacaagaccatggcattcggcgccgggaggaggtcctgcgccgggagcctgcaggcgacgaccatctcgtgcgctgccattgcgcgcttcgtgcaggactttgcctggaggctcaaggaaggcgacgaggacaaggtggacaccgtgcagctcaccagctacaagctccatccgttgtacgtgtatctctcaccgagagggaggaagtgaattaatgccagctttggtttggtaatgaggtgctggatttgctctttacaaacttggccaaacaagatggcagtatgatataagtttataatgcctaatggtttgcttgacccaaaaaaaaa

SEQ ID NO: 18396 - DNA, 757 bp, Triticum aestivum
  unsure (1)..(757): unsure at all n locations
  Clone ID: PAT_TA_18396
gccccgccacgccgccactcccccggctgcggtccgctctcaccttcccgccgacagcccgccacccacctcgacggccgtcgcccgtcggccgtcgcgggtccccgaccgtattccctgccgccccctctccctcgccttctctccgcagctcaccccgcaacttccaatcctccggtagcccaacgccgaccatgggtttcgcgcagctcgtcatcggccccgccggcagcggcaagtcgacctactgctctggtctgcctccaccccgcgacacggtcggcacgaggattcatttggtcggacctggatccagctccacgagcacctcgccgctcctctatccaccgatcttagagagctcgtctcactggagctcgtctttggggaggttgcgatggaggtaaatggcggcctcatctattgcatggagcaccttgaagacaatttcgatgatgggttggatgaacaattggagaactacttggatgatgactatcttgtgtttgattgtccaggccagattgaactcttcacgcatgttccagtcctgcgtaactttgttgagtatctgaaacggaaaaatttcactgtttgcgctgtgtacctagctcaagactaaccacatgctgcctcggacggcaacgtacctgcccgggcggccgcttgttcaattctgcgtaactttgttgagtatctgaaacggnaaaattcactgtttgcgctgtgtacntttggactcacatttgtcagtgat

SEQ ID NO: 18397 - DNA, 488 bp, Triticum aestivum
  Clone ID: PAT_TA_18397
gcgttcgcggacgcgtgggatatgaccctggtgcgacaacagttattgagagcatattcaacttcaatctttcaattcctcttaattttctatttgattcttttggaggtaacgtcttggttattcagggaatgaaagatccgcttacaaaatccgagtcattcatttccatgcttagagatcattgcagcaaggtccagattagagagttaaatgcaggtcatgctccgcacgatgaagttcctgatgaagtgaactccttactgtctgaatggatgaaaacgaacaagactgaacttaaggcagctttggagaagtccaaggcaatttaggtaacatttgcgttttcaggacaccctttctgtcaggctgtttgtataatatcatcatcgcctcgtcggagccatttgataatacatgtatctcatgtatttcccgcaattctgtacaaaacattacctcacagatatggttacctcttaggtgac

SEQ ID NO: 18398 - DNA, 1400 bp, Triticum aestivum
  unsure (1)..(1400): unsure at all n locations
  Clone ID: PAT_TA_18398
ctgggccggtcttgccccccgcgaggtcgctcctggtgaggggtgctccggactgtccgctgggtgctttacgagcttgcctgaacttccggcagcgctcgggaaggcctaggcggcttgggtagccggctaactcgcgattcgctcacaccatccgcgtcattcgcttccatgccttcattgctgcgccgatcgagctcggttcgacagctaagcgcagagcttcccccgaaccgcgcccttccgaaggacatgccatccctcccttcctatcgccgcctgcctactcagtcccgacagaacccggcgttggcactcctccacggcaatttcggtgctattcgcgctgtccagagaactatcatgtctcccttgaggaaaattatcctcttaggttttggagatggaactgttatctcatacagtatacatctgttggccatgaaggtcctgcagttcttctcgtgcatggctttggagcttccttgcagcactttcgtgataatatcagcaacattgctgatgacggacgccgagtttgggcaattacccttcttggctttgggaaatcagagaaaccaaatgttgactattcagaacttnctgtggtcagaattactgagggacttcattgttgatgttgtgagggagcctgttcatcttgtaggcaactctattggaggttatatctgcgctattgctgctggcttatggccttcccttgcaaattctcttgttcttctgaactcagctggttcagttgttccaaattactccttcatcccactgagtaaagaaggacggacctcatggctttcaaggttgcaggcacgcctccttttgctctttttgaggtcaagggcaggaggcattctcaagggatactatcctactagaactgaacgggttgacaagccactcgtggatgagattataagagcttcatatgaccctggtgcaacaacagttattcgagagcgtattcaacttcaatctttcaattcctcttaattttctattcgattcttttggagggaacatcttagttattcagggaataaaagatccgcttataaaatccgagtcattcatttccatgcttagagagcattgcagcaaggtccaaattagggagttaaatgcaggacatgctccgcatgatgaagttcctgatgaagtgaactccttactgtctgaatggatgaaaacgaacaagactgaacttaagccagctttggagaagtccaaggcaatttagaaactggtttacgactgacgcctccaggtgcatgcttacagtcttccatactgaacaatccttctttgctacagnaaggtgtcttcctgggcaatggaccatggtttcatcatcatgagcatgcattacatcattattgcat

SEQ ID NO: 18399 - DNA, 761 bp, Triticum aestivum
  Clone ID: PAT_TA_18399
cgtccgcggacgcgtgggctcctctcgccgcccgtcgccacacaggcagcaccacagcggctaaggcttagcagcggctcggtctcgtgcggccagcgcaactgcggcaagaaccctaccgccttgggttggcttggcttggccctccccgtccagcttcgacggaaggtactaacaattgtaatctagctgcacgtcatcacaaattcaatggcagatcgctggctggagctgcccaatctggccctgcaagtggtggggatcttaccggaggtccagaggcctagcagcatggtccctcgctgccagaaggtggcttacacggccatttccctcctcatctaccttgtcggcagccaactgcctgtgtatggatatggagtccgttctccatcggttgctgactctcagtactgggttgacatgcccgactgcaactccgtcatgtctgctgggatcatgccccttgttctgtctgaggcggtgcttcatttcctgctgtggtgtaaggttcttagagcaaaaaatcctgatgaccggatgctcctgagtcgggtgcagaagttggttgtgaatattttctcctgtgatttctaattctgtaagttgctatgtcatctattttggcatactgtactttggcattctattcttaatttgctttaatcatttctttggagatgtatcgtcatttatttttgaaatcttcttaaaaaggtattggttttttttggtatcccttgttaacgcccctcattttt

SEQ ID NO: 18400 - DNA, 471 bp, Triticum aestivum
  unsure (1)..(471): unsure at all n locations
  Clone ID: PAT_TA_18400
cgtgcgtccacgcgtccgcccacgcgtncgtgaatcgaccgggaaaacccgatagatcacactacctgttttctccagggaccaggactgtcttcttcttcccacacggctaccatgtgggccaaggtcattgccatctttcttcttttgctccaactcgcgctgttgtcctcctccaattccatggtgttcgagctccgcggcaacgtctatcctattggccagttctttgttaccatgagaatcggggagccggcaaagccctactttctccatgttgacaccggtagcggcctcacgtggctggagtgcgacgcccctcgccagagcttccacaaggtgccacatgaggtgtttcagaccacgatcgagcaaccgggtgccatgcgaggacgagcgttgtgccatgatgcacaaggacctggacaccgtgcacgactgcacggtgcatccaaaccaatgcgattacta

SEQ ID NO: 18401 - DNA, 1439 bp, Triticum aestivum
  Clone ID: PAT_TA_18401
gattcggcacgaggggttcttgaaggaagagcttacaagctacaacacccatgggttggaattgttaaccgctcacaagcagatatcaacaggaatgttgacatgattattgctagggaaaaagaacaagagttctttcattctagtcctgaatatgctcatttagccagcaggatgggttcagaatatcttgctaaacttctttcacagcaactcgaggcagttattagggcacgcattccaagcatcacatctttgataaacaaaactattgatgagcttgaatctgagatggatcaccttggtagacctattggatcagacgctggggtaatcaacgaaacttttgagctaaattgcattggactcaaacagacatatgtaacaccattcatgtacttgtgcaggctcagttatatctagtcctggagttgtgccgtgcatttgacaaaatatttaaagaacatcttgatggaggacgacctggtggtgatcgaatttactgggtctttgataatcaactccctgctgctctgcggaagcttccatttgaccgccacctctccttgccaaacgttaaacgaattgtgtcacaagctgatggttatcagcctcatttaattgctcctgagcaacgggaccgtcgactgctgctggcgggccgctgtcatttccgacccccggctgttgctgctggtgagccggtgcctactggcctgtgtgggctcggattacttgctaggggaaaaagaacaagagttctttcattctagtcctgaatatgctcatttagccagcaggatgggttcagaatatcttgctaaacttctttcacagcaactcgaggcagttattagggcacgcattccaagcatcacatctttgataaacaaaactattgatgagccgtccgctgagatggatcaccttggtagacctattggatcagacgctggggctcagttatatctagtcctggagttgtgccgtgcatttgacaaaatatttaaagaacatcttgatggaggacgacctggtggtgatcgaatttactgggtctttgataatcaactccctgctgctctgcggaagcttccatttgaccgccacctctccttgccaaacgttaaacgaattgtgtcacaagctgatggttatcagcctcatttaattgctcctgagcaaggttaccgtcgactgatagagtctggtctcagttattttagagggccagctgaagcttctgtagatgctgtgcataatgtcctgaaagagctggtaaggaaatcaattggggagactgaggaactgagaagatttcccactcttcaagcggagcttgctgctgcatgcaacaaagccctggagagcttccgtcaagagggccgtaaaactactgtgcgattggttgatatggagtcagcgtatttgacggtcga

SEQ ID NO: 18402 - DNA, 795 bp, Triticum aestivum
  unsure (1)..(795): unsure at all n locations
  Clone ID: PAT_TA_18402
cgtccgaaaggttgaaagagagcgaatgcagcagatttctactctaatcacaacttctgtaaacaaggacattcctgctatactggagaaatcactaaagagagaaatatcgttgttgggacccaccattgcacgaacaacaacacctatcattgagaagtccttgtcttctgctgtttcggattcgcttcagaaagttctcggggaaaaggttgcgaatcagctggataagtccataagtacgaaacttgaagctactgttgctaagcagatccaaacacagttccatacatctgccaagcaggcacttcaggatgctttacggtcaagctttgagtcatcaattatcccagcatttgaacaatcttgtaagacaatgtttgagcaagtggatggtgcattccagaagggcatgtccgagcatggtactgctatccagcagcaggttgcagcagcacatagtccattggcacagactttaagggaaacaatcaattcagcatcatcaattacccagggtcttacatcagagttacttgatggccagcgcaagcttttggcactagttgcatcaagggaacccaatatcacataatactgctgcctcccagccccgcaccgggccaactcccgaggcgccccccacgcgcccgatgaaggattaaccagatattnctgacaaaancnatgagcttacaaggcctcaaagatgactcccaaggnactgggtgtcccaggtgattnaagncgttaacganccgtctcgaacaaggtcctcggcctttcagaacggaa

SEQ ID NO: 18403 - DNA, 405 bp, Triticum aestivum
  Clone ID: PAT_TA_18403
gcccaacggggttagtaccattcaaatcatgcaaattagagtccaaaagaagaggaaaagcgttaggaaaagtagatgcgttggagacgtatcaaccaccatggaccgtggtgcttccactctatcgtgggcatacacgctcctcggccggtgtcgtccgcgagcgcgtaccatggggcttccagtggtgcttgggcatactcgctcctgaaccgtgtcgtccgccagcgtggagcatggggcttccactggtgtgtgggtgggagttccctctagggagactccggggcatgtagagccccgcttgtacgcgtggctagcatggcagaaactggagggaggttgtatcctaaggcaattcgttgaacccaagcgcggggacctcacaaagggccttacctccaa

SEQ ID NO: 18404 - DNA, 895 bp, Triticum aestivum
  Clone ID: PAT_TA_18404
ttgctagatgcactttcgttgaagcgttatcaaaagatgtactggcaagattgcaaacacaaccgtctagcagctcggaagacctgaccggtcagctcatccaatctgtcaccagcagcacaaacaacaggtgcaagaaaagatatgcagtctttgatcaatggtcttctaagcaaaagctcagtgtatcaaaaggatttatccggattaaacaaaaggagcctctaccagatttgctgttcgtgtctgaacctactggtggaactttttaaggaagacttggagccaaaatgcggcacaggccaggcactgaaaattaggcacaataaacccatgattgagacgtccggagtgagcaagcaaagtgagaacctcagctggctatttgagatcctggtgaacaatgatatggcagagaatttcgtcgtgctgtgggccgggcaagacgatctcatcaggatgcactagcaagcgtcaccgatgttcaggtacgagctaagccggatatctacaggctaacaagaattcatcttatcttacaatcataaacacactacaaacaccgatataactcacgcggaccctcgtgccgaagcgggcgtgttcgttgccctctggcaagggaaagtgcagtgccccagcgatctgaggagccaactgttccggggatggtttacgcctatgttaactgatttgggctggcttcaaaggagctcgaaaggactggatgcgatagcgcttgatgatagcctggggcaagcccttatcaccctttctgttctggagcagtataacctatttgaggaatggttccagggctttgcatttaggggcgcggaatgcccgaaccttaacctagctcttcaagtattgttgcgtaagtttatcactagat

SEQ ID NO: 18405 - DNA, 1670 bp, Triticum aestivum
  Clone ID: PAT_TA_18405
ctcgcgcagcagccaaaccctccctccctccctccctccccttcgccgccgacgatggccgccgcggcggagaagacggccgaggagatccgccgcgagctccaggagctccagcgccagcaccgcgagatcagcgagcgcctgcgcgatccccgaggcctccgacgcggcgcccccgccaccggccccggccccggccccggccccggaggcccccgcccgctccgcggcttcgcgagacaggctccggagccggtggaccagcccgagcccaagcgccggcttctttctgccgtggttaaagtggatggccctggaactaatggggatgatgcggcggcggaggggcgtgaggatggaccaaatgctgctcaaggtggtgagaggaggggagccagtaatggtgggttcaggagggatgggagccagtgggtatccaggagggagcttgataatcagctgccagagcctctcccgaggccggctcccaaggaagaggatcagagcttggtgaggaggaacaagagaatgctggggaagcttcttgttggcacgctagagaaatttcagcaggagaacaaaaaactttccaactcagaggcttttatgcgtagatcagaggctcagcagaaggctgatcaaaaggctcgtgaggacagtgaaagattgcggcagcaagaacgggagcaagcagctgagaagcgtaggcgtgatatgacgctccgtgctcgagtagctgctaaggcagaagaaaagaggttggagctattgtacattcagtggtctgagcatcacaaaaagctgtccagtttcttaaggacaaaagctgaaccagctatttattacatgccggctaaaccaatagttgatgatccggttattgttgagcaaaacaaggaaaaggtatttgaagaatggaaatctgtacgcagaacggagctgacccagttccaaaagcaagttgaggagcagtatctgtctaatgttgagaggcagctggaaaggattcagaatgcccggaatgctcggagggggaacgtgcctgctaacatgcaggaaatggacaaggagcttgacacgcacagggcggagcatggcccaaaggctcggcggatccccgacggtggcaatgacgaggatgatgatgtggacgtggacgacatggccgcggaagacgacctgatggatgaagtgctcggcgtcaatgaggcgatcaacgaggacccaggcaagccgtctgaggaggccactgatgttgcgcctgtacccgagcaggcacaataggcaaggttatttgcgaggtaggcactcaggcattacgattctatatcgttgtagttgccctcttctgctgtgactgtattgttgttgggtttttgtctttgggaatgctgtgagctgtgtttgctgttgaggccatatacatacttttcattattgttattgtcatttgtacgtactccgcgtaaaataagtgtcaacccgtgaaaacagtcatcatgtgatcaacctgttcttcacctgcgccatcagcgtacaggggttgagctactgttgatgacgttgatcgctgtacattcaagttgtatgcttggtaaacctcttttattgtgccaatggttctattccttttacaaaaaaaaaaaaaaaaaaaaaaaaaaaaaaaaaaa

SEQ ID NO: 18406 - DNA, 608 bp, Triticum aestivum
  Clone ID: PAT_TA_18406
ccattacgaaaatctttcgttgacgtccgcccacgcgtccgcggacgcgtggggtaacttgggaaacttgtacattgacgagcaagcaccatggtcttgtttcaagcaagggggcgagattgctgaaaaggctgcaaaggatctcgtcattattctagagacagtgagaataattgcaatagcattgtctccaatcactccaagcctttcgttgaggatttatacacagcttggtttcacagaagaccagtttcgtacattgagatgggatgataccaaatggggagcccttaaagcaggccaggcaatgatggagccgaagccaatttttgccaaaatagaaaccgaagtcgaagagaaagatcaagcaagcccaaaggaggggaagggcgggaagaagaaagcacgtagcaaagggctcgtggaggcatgagttaagcttgtgactttgtgagtactgactggatggctccaaaactgtagaacccagatgcctgttccgcaaaaccatctcatatctgatggtgtagatagcataaaagctttcgtggcaaagaaggctttgatttttgtagagagaactgaacttaccaattctgttctctcag

SEQ ID NO: 18407 - DNA, 1396 bp, Triticum aestivum
  unsure (1)..(1396): unsure at all n locations
  Clone ID: PAT_TA_18407
tcggacaccacgcccgccccttaccagactcccgtcggcatttatacatccggcgacacacgaatcctgcacacacagaggccgcgggcagcccatcgaccgcacgatcccagatcaggaagcagccttgaaagctgaaaccccagtcgaatcggaaccctagcgccatgtctgccacggcgggggacgaggcggcggtggccgagcgcctggaggcgctgcggaggaagctgggcaagaagcagcacttcgaggaggccgtcgccgacctcgccgccacgctccgcgaccgctacgccggcgcctcgcccgccctccgcgagtcgatgtactctacggtttgccgtgttgcaaccgtccttcagactagatatacagcacctggattctggcgtgctggtctgaacctcttcgtagcgacagagaagctgttaactaatcctgctgaaaaggaacgcctcaaaacctgcattttgagggcccgggagcatcttgatgaaaaagaaaatgaggaggcaacgccaaccaacagagaatcagacgttagatcccattttgagcgccaccttaccttgggacaaagaacctcctcctccagcatggcttgtcgcccagaatttaacacgaggtctggagagcttagcggaaccttctggagatcaaaacgggaacaacactagaacggagttgaggcctgaggagatgacacctgctataatgaacttcttaaacaccttatcaggggacgcggagcttgagagtgccttggaagcatcactgcagggtatcacagcgcagcccaaggtaccaccggcttcaaaggaggtcgttgctaatctcccggttgtaactgttactgaagaagtcattgctaggctgggcagcgagactgagtgtgctgtttgccgggaaaacttggttgtggatgacaagatgcaggagctgccgtgcaagcaccttttccatcctccttgcctcaagccgtggctggatgagaacaactcatgcccgatctgccggcacgagctgaggacggacgaccatgcgtatgagagccggaaggagcgggagcgagaggaggaggaagacaggaagggagcggccaatgctgtcaggggtggggaattcatgtacatctgatatctgaaggggaatcactgtttctgctagcgagcaaatcgtaatgtgaccaatcttcttatctgctcggtcgtcatgcctgaaattaagcatgtcttgtgttgttcccagattcaccgtgtccctagtttgtcaccagcttatcaaccacaagtcattagaatttagaaagcttgccatagttcacatcacatatgaaatggatactcttggggagcggatgcatacctggaaacgtgcnngtantacttccttt

SEQ ID NO: 18408 - DNA, 1583 bp, Triticum aestivum
  unsure (1)..(1583): unsure at all n locations
  Clone ID: PAT_TA_18408
cgtccgcggacgcgtgagcggacgcgtgggggagagttttcagaatgaacgcaattatcctaattctgatctacatcatgcttcatccaattacaaagcggcaggaggatttgtgcgagccaatcgacgtgaagctggagtggctaatgctccgagacagtattctggtcgtccaggttcacagttccatggaccaaatgattcttatcatgcaaatattcaaagggggaattttgcctcagctgggccttctgttcgccgcccatcatttatacctagaaacactcaacccaatcatagacctgcagtagacacagttactcgtggcagatctgttggtagaccttttggtaaccaaaaccacagcaggtatcaccagggtcctgctagcaaccaaaaagtcatacaaccagctaaggaatggaagccaaaatcgacaaataagtcttgcaccaacgacgcggataacagtgggacaaatgcaacatctcctttagatagcaaagctgaaaatgctaatgtgctggatgtgaacagctcgtgtgacaaaagttctcatgctaacgtgcatgagatggagcatgtgattatcccagaacatctccgtgtgccagagtatgagcagacaagattaagattcggcagtttcactcctgggtttgattcgcctgagcatgagcagacaagaataagattcggcagtttctctcctgggtttgattcagaccaattaccgacttcaacttctcccgaaccggaacaaccagaacatgtacaagaacctgttcaactggttgtccaagaggatgagtttgatactgaacatgacgaagtggatgagcaagttggatcacaactcactactatatccacatcggcggcagagagttctttaccaccatctgaggatagtgaacagatgaatggtcaagaagttgaggatgatgacggactgggcttagttcagagtgatactccacttggtgcagcagatgaccataatattcaaagcacctctggtttgactgccttttctgcatatggtcatgaggatcctaatatgcatcccaataatgaggcacagttatacgggctggttgagcctaatgtgcaccaacaagtgttggcttcatcttctcaggggtatacttcggtgaatccaggagcagataatgctgtgcaagtattcagaatgccagaacccagtgttcattcacaagttctcccttctgcatctgaggccctaagttcacagcttgcgagcagcagccctattgcaatgtctacacaacagcaacatatgtcccagcaacaacaagcagcgcagatgtaccctccaatgcacgtgcagcattatccgaatttcatgccatatcgacatcctctctattctccagtttatgtcccacccatggccatgccaaactattcagcaaatgtcccttatccggcaaatggaaataattaccctctggccgtgggggtanatttactgcaggcaatgaataggagttaaatataacatccactgnacctccggtaaggaatanncacanctggtaaaatatcccgggtatgacgng

SEQ ID NO: 18409 - DNA, 764 bp, Triticum aestivum
  unsure (1)..(764): unsure at all n locations
  Clone ID: PAT_TA_18409
cgtccgcccacgcgtccgcggggaactctcttattgttgctgattatggtcagctggagctcaggatcctggcacatcttgctaattgtagaagtatgttagatgccttcaaagctggcggtgacttccattccaggacagccatgaatatgtaccagcatattcgtgaggctgttgaagaaaagagagtacttcttgagtgggatcctcaacctggtcaagagaaacctcctgtgccattgttgaaggatgcatttggtgctgagaggaggaaagctaagatgctcaatttctccattgcatacggaaaaacagctgctgggcttgctcgggattggaaggtacataaaagggaaacatacctctcagttaatctctagaaattaaacttcagttcagttaccagcttattaaggccttaggctactgggttcatatttcatactgaccatttcaagataccttaaatagtgactancatgttcagttagatcactgttgaaaccctcacattttcaaacgattttaatagtatctcattnacataatgcaactattaattactcccaattaaatggacagaccgtggctttcccttggtactttccctaagggaatggtgcaanttttaaccttcaacgcctttgcangttcaaaaaagggagcaaatnatacacggtntccgggtacancgacagaaaagaattaatcatgnaaagggaacagaagatnacgtatgagaatcngaagtaaacttgctggcn

SEQ ID NO: 18410 - DNA, 727 bp, Triticum aestivum
  unsure (1)..(727): unsure at all n locations
  Clone ID: PAT_TA_18410
cccacgcgtccgcatcatccttcctctcactcctctctctcacacagagacacatctctctctctctctctctcatctccgtctctgtcagaaggggaggccaagaaagaagtggaggagggggaaagaggggcaatggagctggacgagcaggccttcttagaggagctcttctcgctgaggagggacgccacggccgcgtgggagtgcaatgccatgggggacttcttctccccggcctgcggcgccggcgccgcaggcatggactgcttccaggagcggcaccagcccaccgtcagcgtgctgcccaccttcacggcctcgttcgagcagccgcacccgcagcagcatcagcatcaccagcacgcggcggtggcttctggggggttcgactgcctcagcgaggtctacggcggcggccccttccccaatgccgtcggcggcgggtacggcgagatggggtttctcgccgcgatggaccncaaggcggcggcggatgggggcggcctccgcgcctgcaaggtggagccccggctggcggccgtggacggcggcgcgttcgggtcgggtcagatggcggcgttggccccggcgcccggcgtcgagggagaaacgnggtggagggcatgccgtccaagaacctgatggcggagcgccngcgccgcagcggctcaacgaccgnctctcatgctccgctccgtcggcccaaaatcagcaagatggacag

SEQ ID NO: 18411 - DNA, 1393 bp, Triticum aestivum
  unsure (1)..(1393): unsure at all n locations
  Clone ID: PAT_TA_18411
cccacgcgaccagccggccgtgcgctcgctcctccgtctcctccctcctcccactacaccacaccacgctccctacctcgccgtcgccggtcctcgccatggacgccgccgcgatggagtccctcatcctggagctgcacgcggtggaggcctacaagttcggcgccttcgtgctcaagtccggcatcacctccccgatctacctcgacctgcgcgtgctcgtctcccacccgcgcctcctctcccgcgtcgccgcgctcctcggctccctcccctccacgcgcccctacggcctcctctgcggcgtcccctacacggccctccccttcgcctccgtgctctccgtcgcccgcagcatccccatgatcctccgccgctaccacgagaccggcgccggcgcccctcccgccatgcgcacccagggctccttccgcgccggggacaccgtgctcatcgtcgaggacctcgtcaccagcggcgcctccgtgctcgagaccgtcgcgccgctccgggacgaggggctcgtcgtcgccgacgccgtcgtcgtcgtcgaccgcgagcagggcgggagggagaacctcgcggcgaacggggtcacgctgcactcgctcatgacgctcaccgaggtgctcgccgtgctcgtcagccacggcaaggtcacccgggagaaggccgcagaggtgaagcgcttcctggatgccaacaggaaggtcttggtgccggcggagcccaaggtggtgccggccaggaaggcgttcgccgagagggcgcggctggccaagaacccggtggggcggagcctcctcggcgtcgcggccgctgtgccaaccgccctcggcctccccgcccttgccaccacggctgggccgctccttggcctgcccaacacccttgggcctgtcttgtccgtgctgacaccccgtgtggggcgcctggctccgttcgctcccgagttgggcacaactttttgatcttcgaagaccgcaaattcactgacattgggaaacacggtaactatgcaatatgaagggagcgagcagactatgctataccaactagggaccttccttacttcacactgccccgagttcctcacaccgtgtgcattccctggtcccgtggaacatccgcatatcagactgggccgatattgtcactgtgcatgtagtcctggacctggaattgtaatggcttgaagctgaagggtttgcaaagggaaaaggtaccctggntgctganataactcactgcaacctgctcatgngatacacgcaacaacctnaattgcgacanatcgattnttaacggntctgcgtaaactnatctgcaatccgggccatccgntnntcaattncatcctggtnattttccgggaatccngcanattacccca

SEQ ID NO: 18412 - DNA, 687 bp, Triticum aestivum
  Clone ID: PAT_TA_18412
ttcggcacgagggcagtctcttgtactggagcagtcaaggtgctcgagtagccagtctgtggaaacaagagttgacaacaatctcgtccatgtacgcgtccgaattgcagattttgtcgtgaaatcctctcgtcttggtcttctaattgacccaaagagtgactcttcagtgtcaaaagttgttcaacagcttgcttttgttggtccgcagctctaccgcgaggggaagttctattcaaggcgtctggtggacgattgcttctcaagttttgtcaatagacacccaccgattgaagatggagttcaacacccaccagaggcgtatggtcttgtgcaaagtgcatattttcatggtctcaatccttatgaggagctagtacattctatatgtacaagagaaactattgtccgctcctcaagagggttgacagaaccaggaactttgttcaagagtctaatggccatcttgcgagacgtagttatatgctatgatggaactgtgagaaacatctgcagcaattcaatgatgcagctgaagtacaaagaagaagatgacacagattttccaagtgctatagctcctggagaaccggtgggtgtcttagctgccactgctatctccaaccctgcttataagactgtcttggactcttctcagagtaataatacttcatgggagttgatgaa

SEQ ID NO: 18413 - DNA, 846 bp, Triticum aestivum
  Clone ID: PAT_TA_18413
cgggccgacgggcactatcatttgatgaaaaagaaagagaaagatgcatatcaaagtgcaagagagaggaagcaaagatcactgcttgggaaaatctgcagaaagcaaaagcagaggcagcaattcggaagttggagatgaagcttgaaaagaagaggtcatcatcgatggatagaattttgggcaaactacgttctgctcaaaagaaagcacaaggcatgcgcactacagtttctgtcagtgaggatcagtgtgctgtcagtgaagatcagtgtgctgtgagggcaaccaagaaggcatccttgagaaggactagcaagcctttcagctgctgtttcacctatcatgcttgctagttgtgatatggttggtatctacaatgattgtagaaactttttttgaacctttgcagctcaagtcagccggcagacaaactgaagttagactgcaaatgtccgccgttgcagctggagatagcaggagtaattagaagaagagagcttagcgcggtctgatgaatcaaagttttggagcaaagcccactcttgtagctgatgatatggagtacttcactcggtactctgtatctgtaaaccaagcaagtgctgtagatcaggaagctcccttctcgagcttttctctagttgaactccggactgatgggccggtcctcatgggctgcccttctctgtgtactctctagttgaactccggacggactgatcgggccggttgctcgtgggctgcctgatgatgtgtactgtatcttttcccgtggaattctgtatgtagtttcaagcattggggcgccaggcccacatgctgggctcgagatgggaagaagtg

SEQ ID NO: 18414 - DNA, 1671 bp, Triticum aestivum
  Clone ID: PAT_TA_18414
cgtccgcccacgcgtccggtaatttggggcctatgctatcaatccctttctcttctttgttacaaggagccatgcccggcaagctatcatgaaaaggcagcttggaacagtggatttgtttttgggccatttagattttattgtaatcttgaaaggtgagaaggtagattatgtcaatggtagggaccatctgagcaaccatatataacttatgaacactaaatataaaatttcatagcttcaaagttgtccattaccctttatcttgattggttgcaggtttgtgtctcatggtagagtacctccttcagattttgggtgttgatgctgctgttctgagtgaatcacaaaatttggacagtttaaatgatagcaggagtctagttttgtaattgcgctaatgtatttctctgcaacaactgcggcacgaggcaaaacaaaactctcgggcgggccacgggtccaagggacgaatcgaatcgagctcgagcccggaggagagcgtcggaggcggcgggcatggaggatctcagcgtcgaggagctcgcctccaatctctccacctacaaggaccagctccgcgaggttaggaagttcatcaaggagaaaaaagatgatgctggaatttctgaatatgttgatatggaaaaggagcttcaagaggttattacattaaccgaagagcttttggcaactgcaaatccaagtgagagtgcgcagaatgatgtaggtctatcaccgccaaattattctgctggagtgcactcagaggcactggatgacctctcacaatcccatgaaaaatttgcagttggtaccaaagtgcaagctgtgtatagtgaagatggggagtggtacaatgcgacaattgaaggtctgacaccaatcggctattttgtaagttatgaaggctggggaaacaaggaagaggtggaccctgctaatgtcagggcacttgacgtggaagctgctgatgctttaggactagctgaaaaagaagctgaagcgacaaaaatggcattaaagagaaaagttgaacaagcagcaacatctgactatcagattcgtagcttacccacaaaacttaagatcgatccaaatgatcctgaagatgtgaaagctgcaaagcgtaagaagatccatgctttcaagtcaaaagcccgctttgagcaactagatttcgcacagaataagcggcaaaatgcatggcaacagttccagactaccaaaggaaaggctaagaaggtgggattcttttcgggtcgcaagaaggagagcatcttcaagtcaccggaagatcacagaggtaaggtgggggtcactggtagcgggaaaggcctgactgacttccagaggagggagaagcaccttcatctcaaggatggttcttctggggatacactggactatgaggaataaatctggtttcacaaagttgccatgtccggcactttattgccggactggcctctgtcagagcttgtactccgtaatttgtatgctgaacttgttgaaagctagaaatcacatatagatattaacattgtcttcctcaatgtttagtctcaattttgtgaaagtcataacttacctgccgtcactgtgcaccacagtttgatcaaaatttttctctgcatcatttgtcagagttcaatactaagtacttggcag

SEQ ID NO: 18415 - DNA, 947 bp, Triticum aestivum
  Clone ID: PAT_TA_18415
ccacgcgtccgcggacgcgtgggcggtcacagacctacaatgtatcagcagtgctcaagccggacctggagctgaggcaacccctttggccgcctgtgactaaaggcatcttgccggctcttgatgccattgtgcgtgaggcctctagctcaggcaagattatcatcggtcagacattttattcacagcagcagcgtcctaagatcagctctcatggggcctttactaccgaagctctggaaggaaccatgcagaccctaaaagccaccgagcaagggctggtgttgtgcgtggactattcagttatggagttttgcggagatggaagcactgttctggatcttgttaagcacttggtgaagcggtttgacgccgatattccctttgacatggaaacaactctagacgagaagcaacggaaatttttggagagtcagctgaaaggcctctgtatcacagtgaattacctgaagaagtcctccaaagggaaagacaatgggaccagaattcggaagtacaaggttcaaggtttgacagctcagcctgcgcaacttatcacattccaggactttgattcaggggagcctcttaagctcgttgagcattatggtaaggagcatggagtagccattcggtataagatgcttccatgcttggatttgagcacgaaacatggcagaccaaattatatcccgattgagctctgtagtcttcatcaacggcagaagtatcccaaggacaatacgctcaagggttccaacctgaagccaagggacaagccacccgaatcaaatgcccggaaagatatgattctggatatggtaaaacctccagaagggccttgcagtggtagcagaggcgagcaatttaacattacattgaacagagagatgacagaagtcacgggtactattcttgctccccccacccttacactcggctcctcc

SEQ ID NO: 18416 - DNA, 1670 bp, Triticum aestivum
  unsure (1)..(1670): unsure at all n locations
  Clone ID: PAT_TA_18416
gcggaactccccccacaaaccatccaccacgcgggaacgcacgcacgcgacttcagccctactccgactcgcacgaaaccctaaccctaggttggccatggccggcgacgggaccgacgccgccttcgtggacgagttggagccgaagttcaccatcagcgagtacatggacggaattgatgacgaggagctggaggcggatttggtgccgggcagggacgacggcaacgagtgcacctacggcgccggctacctcaagcgacaggccgtcttttattgcctcaccttcctacgcgaaagcgtcgccggggtctggacccactggtgtcttggcttgcctggagagcgtgtgccctgctgaactttctgacaaaatgtactattcctttctgctcacgcaattggaagtgtggtagagatatcttaatactgtggccacagcgagatgcttaaactactgtacattcatagcttcagtccttgtagttgtgctagttgtcatgaagtcagctcgtggtagtgcatccggccgaccagcgggttgaaatgatacagtgcttgtatttgtgaggactggtttcttgcagatcatattgggcttgactctttggagaagataccaagagatgaggaaggggagccactgtatgaagaattcatatgccatcaatgctcgcctgtttgttatttcttgaaactctatcctgatacgatctgggcttctagtaagcagagttctgcatcagaagctgttactgctgattcaaatggtatggaaggaggttcttcaggtcatgctgacactgagaaaaatgaaaacggtgctcctgtagaccgtcaaagcattgaaaatacctctgtcgaggagaactgtacaaaagacattgcagcttcagataagtccattttgggtgacaattcaggtggcaactgtaagataggagtggatataaatacaacatcagctgattcagagaaaactatgccctttttcatgtcaaaaggctggagagagaccctgtgtaaatgtgggacatgcaccaacttctatgcgcaacgaggcattgcacatcttactgataaggaggactctattgaggaatatgagaagatagcgaagcagaaaagggagaagaagttggagcagcaggaaggagctgaagctaacttcatcaattcacttaaccatgttcagaagatagagattctgagtggcatcaatgacatgaaaaatgagtttcaatcctttatggaatcctttgatccatcaaaaccagttacatctgatgatgtaaaatctattttcgagaatcttgctaggaagaagcagaggttatcttgagcttcaattgcttcaggtcttgcttgagcgggtgagcccaatgccctgctgctgctacgctgaaatttccaactgttatctggccaccgtcttgtgtgggcactgttaacttatgctgtggccaccacggcgtgtttatctactgtactgtaatgctagcttcgtcgtagttgtgctagaggtttcaaagtcggctccgtggtagtgttccngagcgacccggtggagtgaactgcatgtttgttcccttggatcaaaactctgtggtgattcccattacccaaaaatgtgttctccattgcgctgccctttgaaaaaaaaaaaaaaa

SEQ ID NO: 18417 - DNA, 629 bp, Triticum aestivum
  Clone ID: PAT_TA_18417
cgtccgtggacgcgtggggcaacctgctctgtgtggaaatgctaacacagctatcatttgtaatataacacttgcacaggtccatgcagatgagactaaaagcagcttgcaatttgctagtagggcattacgtgttacaaattgtgcagaaatcaatgagatcgtccgggatgccgctcttttaaagcgccaaaggaaagaaatagaggaacttcgagcaaaactcaagaactctcaaagtgaacacttggatgaagatgttttgcacttgaggaacaccctgctacagagtgaactggaaaaagagagaattgctttagagttggaggaggaaaggaaagctaaagagcaacgcgagaagaggttgcttcagcaagcaaagaagatcgaaaatcttagttcgttggttttaaattcagagagagatgatagggctattgtttctagtaagaacaaaagaaggcaaacatggtgtgctcgacccctgtcgaatgaattcagtgtcgaggttcaagaacctgcttctgaacaaggctctgcaagcagctcagttcgtgaagagcgtaacaatggggatgcccccatgttttgaagagctaatgcaagaaagttacgccagcaatggcgag

SEQ ID NO: 18418 - DNA, 696 bp, Triticum aestivum
  unsure (1)..(696): unsure at all n locations
  Clone ID: PAT_TA_18418
ggatggaatattgcgaggnagagaccttgactgcttgcaaatgcaggaatgggtgctcgactctgtacatactaccagaaaacttcacccactgatcagacagctatatccctgcgaagcaacaatgatggactgggtacagtgcttgctattgagcctgctgataaatctcctttcctaggagatgtacgttctgggtcccagcaatcatgtcttgagacaaacatgtatagagcacctgcatttcctcataagttggcatcgactgattatcttttagttcgttcgccgaaagggatgctttctctacgccgcattgacaagctatatgctgttggccaacaagaaccacacatggaagtattttcaccaggaacgaaaaatctgcagaatcatcttttgaatcgaatgctcgtatacgtatatcgtgaattccgtcttagggagaggcctggtgttctatctcagattcgagctgatgaagtacctattcagcatcctctgacagaagctattgtgagaaaacgattgaagcattgtgcggacctgaagaaaggacccaacggacattattactggacacagagacctgactttcggattccgtcagaggaggaacttagaagattggtgtcaccagaaagtgtctgctgtcatgagagtatgcaagctggtctgcatcgtctcaatcgctta

SEQ ID NO: 18419 - DNA, 369 bp, Triticum aestivum
  Clone ID: PAT_TA_18419
gggtcgacgggcagaagaagaagagtagggtgcccttctgcggctgtgtgcgccccaaaacagtgactgagtcttgattcggagtccgcagcaagcaatgtctttagtatctcttctgtaatgggttgcatgataatgttaacaaggagctcatgcattcggagttttgtccttgttcagaaatgccccctagtttaactagttaatcctactgatacttttatgaatcgaagcattttgtaattccgttgcccttcgctgtttctctgtgtctgcaatgaagatatatgagaatgcttctttcagggatataattttcacccccttttacaaaaaaaagaaaaaaggataaaaaaaaaaaaaataaaa

SEQ ID NO: 18420 - DNA, 1131 bp, Triticum aestivum
  Clone ID: PAT_TA_18420
ttcgggaagagcccccgcgctacggcccgggacccatcccccaccccctcggggacgaggcgcatgcagaccttgatgctgagatgcgccagccttcccatgagcccggagtacatcagtagcagggctcagctgcaggcgatcgagggctctgtcttggaccagagggggtgcagctgcagtttcacgacgatgcctgagaattagcatgaggttgagaccaaggccgacacagacgcgagatatcgccagcggccctggaacctccgcaattagggaccgaagatgtccgtggggagctcgcccccgatgctcaagggctgccagtacgcgctgcctgcagcgcggaggtgagcccgagatccaaaggatcatcctagcgcagatgcgcccgcggctccgagtacggcaccattagggcgcagcggcgggcgagaaagagcccgggcttgggaaggagaggtttcaaccgcactttgacgaagaaggcccagaattatcctgcattcgaggtgagcgccgacctagagggcgcttccagcggtaggaagatctccgagcaggtgcagaaggggtcggagtaggtcgcgaggctgctcctcgggctcgaatgattatgttacgcgctggcgcatctcgtggaggagcacgagttcaagagggtcaaggtctccgagaagcgttcgcggctgctcttgagggactacgtgtacgcaaagaaggacaagaacgacgccggccagaagaagaagagtagggtgcccttctgcggctgcgtgcgccccaaaacaatgaccgagccttaaccgtttcgttctgtaggcggcccaacaggctcgtgctccttctgatttggagctgcagcaagtgatgtctttagtatctcttctgtatgggttgcatgataatgttaacaaggagctcatgcattcagagttttgtccttgttcagaaatgtcctctagtttaactagttaatcctactgataccgttatgaatcgaagcattttgtaattccgttgcccttcgctggttctatatgtctgcaatgacgatatatgagaatgcttcttcagggatataattttcactccccttttacaacacatagatccactcatctttcatgt

SEQ ID NO: 18421 - DNA, 647 bp, Triticum aestivum
  Clone ID: PAT_TA_18421
cccacgcgtccgtgaacttcgagagggcagagcgatcccgtatgagaagaccaccgatgtgatcatagcattttctctgggcgtaccttctggcacgacaccgccatccgacacaagtttggccggtgaagcagctctgcttgctccggcacttactttgacgcctccggtggctgttggtcctcttctctgctctctctcaagctctatgacacttgatacttgttgagcattcttgctggacgcaccttccgggaccatggtgtcatcccacactagtttggctggcgaagcagctctgcctgctctgtcgctcagtccaacgcctcccgcgctgcccctccggtggccgcttcctctttggtcctggcatagatagcaggagggatgtacgactgttaggcccgaagagcacggtgacattgctcatcgttgacagtgagcggctcagccctcgtcatgcaaatagccaacaccatcatcatcagcgagtagctgctgtagtacctgcacctggtgaggttggtggtgcgctactacatgcctctacaacaagacacggtggcatgctaaatggagctttgagcagcagcacatcgtggggagaggacggatgtggtggtctgggagcctcgggctccactaca

SEQ ID NO: 18422 - DNA, 1228 bp, Triticum aestivum
  Clone ID: PAT_TA_18422
gctgcgcaagaaggtacacatactcgggccaggccatgagccgactcactatgatgaagcctgacgctaagttggatcacactggggcttcaatgatatgctctgcccggtggcctccaggatcagcctcgactcatgaagaacacccaaggaatcggagtggtcactgaagatcgtggactcgcatccgccattgctggaagtttgaacttcgagagggcagagggatcccgtatgagaagaccaccgatgtgatcatagcattttctctgggcgtaccttctggcacgacaccgccatccgacacaagtttggccggcgaagcagctctgcttgctccggcacttactttgacgcctccggtggctgttggtcctcttctctgctctctctcaagctctatgacacttgatacttgttgagatagcaggagggatgtacgactgttaggcccgaagagcatggtgacattgctcatcgttgacagtgagcggctcagccctcgtcatgcaaatagccaacaccatcatcatcagcgagtagctgctgtagtacctgcacctggtgaggttggtggtgcgctactacatgcctctacaacaagacacggtggcatgctaaatggagctttgagcagcagcacatcgtggggagaggacgaatgtggtggtctgggagcctcgggctccactacatctgccgctagaagcagcaacagaacgcgttgttcgactgtgccagccttggcagtgatctcgatgattgcatggagtggaagactttgcagtgtagcaaggttgctcaggagctgctgaagggaaacaaccctggatgtcacaggctgaaggaggaggtcttacacatcttcttggttcaggacttgagaaataaggtgaagaaaaaggaaaaagacctgctaatctttcccttcaccgttggatgtcggtcgaatggttgatggcagggggaactcactcgacgtatcgaagctactgtatagactaagagatctttagagataggcattttgttgttaatttttccttgtctgtagggtgtgggccgaatggtcttgttcctgggagtttgtaaaatttggattgaatggcgatattggtatagtctcagtgagtgctacatatgtaccaccattgtaaaatttgatttgaattgtatcgtgaagcaaggagttagtggttagtaaacagattggattgattggctgtcc

SEQ ID NO: 18423 - DNA, 1378 bp, Triticum aestivum
  unsure (1)..(1378): unsure at all n locations
  Clone ID: PAT_TA_18423
gggaacgcgtagcggctcccggcccggcgccgcgcgcgcccccgccgccctccctccagaccccgcaccgcccccgcgcgcccgccccctcccccacccgccccctccggaggcccccccggcaggacatcccgcagccgcccccgcggcggctgccccggcgccccccggggctcgccgccgcggccaaccggcgaggcccctcagcaccagcgcccgccacgccggccagacggctgagggagaggcggcgaccaaggcgaggaggaacaagaagaagaacctgttccgacgtggcgcagttcttgccggactggggcgtcggctcaccgggtcgccaagaccacctggcgagaactctcctaccacttgaccaaaaatcaccctacacgaagatcggcggcaggattaggcacaggggggattcggcagaaaggccggcgtgcatgcagctgaggctcgtgtaaaagtcagtggggttaaaaaaaaatgcatcgaagtacacaaagccggcgttgcaagatacccagacggcagaggcggccgctgccacctctgcttagtcagttgccccgctcgagatttattagacagctgccaaaactatttccgtgtaggagcatagtgcagatgttaagacggtcggttgctgagctgtcttctccaccttttcagatttcttgctttccagggttttaggcatagttgaaagggccccgagttgccatggccgccacgctgtcttgctaaagatgattgtcgccgtcgaagacatttgttttgtattttctatctttttttggattaccacgttttcatggcaaaaaaaaatggcgtttttactttttttacatttttgcaatgcggcacttccaatcaaaaatcaaccgtgtcgccctgactattaaatttggttgggggggatccaatgctcgagaggtcggatcgggcggccgcgcgcccagcgattttccacccgggtggggtaccaggtaagtgtacccaattcgccctatagtgagtccgtattacaattcactggccgtcgttttacaacgtcgtgactgggaaaaccctggcgttacccaacttaatcgccttgcagcacatccccctttngccagctggcgtaatagcgaagaggcccgcaccgatcgccctttccaacagttgcgcaacctgaatggcgaatgggagatccaatttttaagggnataatggggttaaactactggattctaaattggtttggggattttangattcncagnccccaagnttatttnaggcccctcaatcctacaancctggtcatganccataatcagcctnncncatttganaggtttacttgntttaaaaacctcccccncccccn

SEQ ID NO: 18424 - DNA, 1046 bp, Triticum aestivum
  unsure (1)..(1046): unsure at all n locations
  Clone ID: PAT_TA_18424
tctgagagcaaagaatccgtcttgtccctttgccccgcggttgtgccatcccgtgatgccccgcctacctctgccacagtggagtatactagtagtactgagcagagtagagtactagacgacactaagcatatgattccctcccttgacaaacccccaaaactagaaaagctttttcaagctgttccattcacttcactcgtccgattccctcccttgacaaacccccaaaactagaaaagctttttcaagctgttccattcacttcacttgcatgcactcatctcattatcatcattcaaaggtgagttcttcatgcggacatactgtggttaattcctcttgccacttcttcaagaaaggaatgcaaatctggtgatgtttctcgagggagagcatcttgttcttgcttgctttgcggtgtcaaggacggaccactggttatccatcagtcggcccagatccctgtgcctctgcggactgcacaatgtttttctggtgaccagtacctatctccattaactgtacaagctcctctcacattaacttttctgagctctcaaactcagacttttcctcccagtccctgtgtggctgtgtccaacaactttatttgctaatcgcttctgctcctgcactagaattagaatcccacaatcacaattcttggttcctcaacttgttgatcgaggaaaagaagaagctgaaagaaatcttgtaaaaaaaatgggtggaatccatgctctgctcatcttgctgtcggtggcgtccctggcattgctgccgggagccacgccgctgcaggcctcacaggcctggtccctcttcaagctccggcagctcctgggcgacccgccggtgctcggcacctggcacaactacaccgacttctgctacggcggcgactacaagaccgcctccgccttggtggagtgctacgaggacagcgtcacgcagctccacatcatgggcgaccccagcagttagggcacncaaaaatacatcggcaagcatcatcatggattcatggctcaaggcaaggatta

SEQ ID NO: 18425 - DNA, 1627 bp, Triticum aestivum
  unsure (1)..(1627): unsure at all n locations
  Clone ID: PAT_TA_18425
gtgaatctggtgacggcgaggagtgttctcgggaagataacgaggacgaagaggatgctgatcatgatgatcctgatgctaaggttgaaagtgagggtgaggcagagggaaacacagaggcacatgatgccgacggagggatgtcactaccgttttcagagcgtttgcataatacagttagaccactcgccaagcatgtccccacagctttgcaggatcatggcgggaagttttcacgcatattttatggaaatgattcattttatgttctgttcaggctacaccagatcttatacgagaggctactatcagccaagacaaactcttctacagctgaaaagaagtggagaacttccaaggatacgagctccccacaccaatactcaaagtttatgggtgcactttataacttgattgatggctcttctgacaacaccaaattcgaggatgactgccgttcaatcatcgggactcagtcctatgttctttttacattagataagctgatatacaaagttgtgaagcagcttcaagcaatagcagctgatgaaatggataacaagctgctccagctttatatatatgagaagtccaggtctcctggaaggttctttgatctagtttaccatgaaaatgctcgggttcttctccatgacgagagcatatatcgatttgaacggcgctcaaatcctacgagattatctgttcagctcatggagtatgggcatgaaaagcctgaagtaactgcagtctcaattgatccaaacttttcgtcatatcttcatgacgagtacttgtcgagtatttcggattcaaaggtgtctgaagatgtgttccttgagaggaataagcggaaacgcgggagcagcaatggccctcaagcttccttggcggtcatggatggtttcaaggtcgcgaatggccttgaatgcaagataacctgcaaatcctcaaaggtttcgtatgtccttgatacagaagactttttattccgtatgaggaacaggaggagaatctcatctggtgcaaccgccgccgcacctggcaaggccgattttgtcaaggcagctgatgtcgtgaaagcacagcggtttcataaatttcttctttctaggtcctagggccatgctggcagattctgccatggtatcatctaatctggagacgacgctggcatgctttgaacaaatgcggtgggtgggaaaccaaagctgcttttgaactttttggtacagccttttggaagaagatgaggtggtgccgagtagctgggaccgctggagctggtaaataccaagcaatcaaagcatgtaggcagtcttgttgttaagttgttacccgatgctgctgctgggaatgtgtatattattaatgttatgtaatacccagaagagaatgtgacgtcgtgttatccatgagggagggagggaggttattgttattaatctcgccggtggtccgatcaactgatcgttgttagttgttactgtccatatgtttgtttgtttgttgttgtcctgtnctcgctgttacatttgctgtcgtggtgaagcaaatgcagacttgattcaagtctggacattactatatttgttagtgatgccagccatctgcattaaaaaaaaaa

SEQ ID NO: 18426 - DNA, 650 bp, Triticum aestivum
  Clone ID: PAT_TA_18426
gccgtccgcggacgcgtgggctcgggtgcagcctcctctctcgttcgccttcttcactccaactcgcctcctcccctccctccctcccctccaatcccgcgatcagaggaatcccccaaaccctaatccctcccccctccgcgcagccggaaccatccacctgtgtccgggttcctctgcttcttagccgatcctggttccttggcttctagggttcggagatgggcgaccacatgaccgtcttccgctcactccgcgagctcttcccccaggttgatccccgcatgctgaaggctgtcgcgatagagcaccataaagatgccgattccgctgtggttgccgtccttgatgaagtcatgccatctatgataggttcggtcgaagtctccagcctccatcaggaggctgcggtatccaaggacgattttttcagaagcttatctgcgaatcacgatgcacctgaaacaggaagttcatctgctggtccagtcggaatttctgggtgcccatcatgaacctgcggacttcacaatagatttatcatgaattcccgctgctatccgtgcgtcagccgacgcgcgaccccggtcctccgccatttgccgaatcagcgaagcaagctgaggcacccatatgcatgttgatgaagc

SEQ ID NO: 18427 - DNA, 1138 bp, Triticum aestivum
  Clone ID: PAT_TA_18427
cgtccgcggacgcgtgggcggacgcgtgggcggacgcgtggggtggaaccgaaaatggacctatcaaggagatggatgtggttatactagatgcagggtaaccatatggatgcagagatgcctgagaaatttgttaaccaatttatatgcgtcctccaagagtgtgggttgatgatctgtcgcaagtttctggtctttctcaagaagtatgtcttcgggctggtggagagtcaatacatgattaagttcactaggtatacaactgttgcgtgatgggagggtctagaagcagaatttcctttctgcacctatgtcctgactccaattaatcagctcccaaggcctacaaacacgcctgagcgtttcacagatgtggttgggattatcccaggtttctttgttctttcatgttggaatcagtgacaataccttgccggggtgggtacgaggagatgagtctcgtggcggtgtgcggaacggagacaaggatgtcgactgcttgctgcccccgctccccttccggaggtggtggccaaaggcaaatggtacagaacctccatgagattttgaattctgcttgatgcatacaagaaaggatattgtgaacatttggttcattttggttgtggattgacctatgctgtgcaaggaaacatgttgtcacgccttcaaatcaacctgcgatgtgttaagcggatcactgtgtaactgaatgatcaatcagagaagagtattttttccaccaaaagtgagaatgacaacgagatacacctccttgatgaaaatctgtgggcagtcggctactcgtcacccaggaagctcctgttggttgcgttcgccatgtgtggactgccaactcaggtgcacggcgtcgcttcagccggttgccgtctccccttctcctcctgtggagttcccgcccaggttgtgcgccccccacccccgctatatagcagatggagctaccaaggacgtcgtcatattgaccaccgatgacctacatcctttcgcttcccctcatgttttgcagaatagaagtggcctgaaagccacttgaatgaaatcttgtgtcttgcgatgtgtcaatgccatgaattagatgtttgtagtatatttttttaattgaaatgtttacctg

SEQ ID NO: 18428 - DNA, 1327 bp, Triticum aestivum
  Clone ID: PAT_TA_18428
agtactgcaaccagcttcttgaggaagatgtcttcaataactcagcttggaatcagagatacctgctcgtggcgcgggcaccgactcttgggggccttgccgcgcgccgcggcgccccgctaccgcacgccgtcgagcccagccccgtcaacccccacccttaccgcggcgacttccgcgaggtcatggactacttccgcgccctctacgccgccggcgagcgcagcccccgcgccctccgcctcaccgccgacgccatccacctcaaccccggcaactacactgtatggcatttcaggcgcgttgttctagaggcactggatgctgatttattgctagaaatgcattttgtggaccaaattgctgaatctaatccaaaaaattaccaagtctggcatcacaagagatggcttgctgagaaaataggaccagatgctgcaaatagtgaacatgacttcacaaggaagatacttgctatggatgctaaaaactaccatgcttggtcccataggcagtgggttcttcaagcattgggtggatgggagagtgaactgcagtactgcaaccagcttcttgaggaagatgtcttcaataactcagcttggaatcagagataccttgtggtaacacgatcaccaattcttgggggccttgcggcaatgcgcgactcagaagtagattacacagttgaggccattatggtgaaccctcagaatgaaagcccctggagatacctcagaggtttatataaggatgataacaatttgctggtggctgataatcgcatttcggatgcttgcctcaaggtcctgaataaggattggacatgcgtatttgctttgagcttcctgcttgatcttcttcgcatgggtttgcagccttcggatgatcttaaaggaaccatcgaagcaatggagaactctgatcctgaaacgggacatgctgatattgcagtagctgtctgctcaatcctgcagaaatgtgatcccctgcggataaactactggtcatggtaccagaccactctttcttcatagacatctgaaaattcagctgaagatagttttagcagcatgatgtaaactcaatcgaaggggttgacgcagtgtatgaaaaacctttcctgtgatcttggcgcggagcaaaatttgtactgattttaccgggaaaaaatcaatcaatgacagcatgcccaacaatgtcttgtgtgaatatgttactgcctgatattcacatgttagcagaatgagaataaccaaccaaactccaatgggccgattgttaaagtaacagcccactggtggtgtgaaaatcctgaaatctgctt

SEQ ID NO: 18429 - DNA, 1395 bp, Triticum aestivum
  Clone ID: PAT_TA_18429
agagaattgctgaggcttctgagaaaggtgctgttgaggaagcttctgctatcaagaaattggctgaggctctcaaggaggccgaagagagtgagttgtcttctcttatcaaggagatggaccagttcttgaagaccgcggagattccgctagagatgcacgagagattgaagaaggctgccgcagagttgaaagaattgaaaactttaatgggtggattcctggtctcaataggaatgttctttaggggctatgggttttcttcaccttcggtcattcctccaagtcccgtggactccccaccaactccaagtccggcgcctcgtccctttcttaaacttggtgctgggccaactccttttcactcgatcgggaaaagggcaaaagaggtcctctttggtgattacgaggagacgcccttccatggcatcggaaaagctgggtttttgatctgtgacaaacaactgggcgttggcgttgagctcaagtccgacccctcggttgagaccactttgtgctatggcaaggaatatctagactacaagatggaggcaaaggcgaaagttgttctaccctttggtgacacttctaaggctgaaattgatgttattcatcgccgtgcctgtctgagcgcttctgttggcctcagtgctaatccagttttcaacatgtccggcatgtttgggatagctgatgggatttgtggaggtgcaaggttatcttttgagtcttgtggattggtcagggaatttgagcttggattatcgatggacactactgagtttggaagtctgtcgaccagacttaaccgtgagaagctccaggttatgtttgacacggcggttggaagggctacaggtgccgcggagctgacttatttccacgatccagttgcggagaagaggtcagtctgtctgacgggcggcctgtcctacaactatgacaataccctgactctcaaggggcgcttcaactcggatcttcatgtgggcgggatgatacagtttgaagaaaggttggctagtattgtgttgcgggcaacaggtgatgttgatcttcgtgctatgggtcagcagccccgggtcgggttccaggtggtgtttgacccgacctggaagtaagtagcctttgcctttgcagtgttggtgcttgttttgcttttgcttgggaggaacttttttggtaaaacggaaggtcttgattttgggttgtccatgatgattgatgtatggactgaagctttagacttgtcaattcgactatgttggttttgcggaagcttgattgtcctctcatactacattttgttgttgaattgaactgacttgaagcacgttgtaaaaaaaaaaaaaaaaaaaaaaaaaaaaaaaaaaaaaaaaaaaaaaaaaaaaaaaa

SEQ ID NO: 18430 - DNA, 1036 bp, Triticum aestivum
  unsure (1)..(1036): unsure at all n locations
  Clone ID: PAT_TA_18430
gaattggcacgaggccgcctctgcttccttccgcttcctctcccctccagcaccgaacccgcatgataggatacacccttcactcctcgcatgcccgacgcgccggcgcaggctccgggccacccgctgctcgtccacgccgcaaccggcgccatcgccgccgctcgagttccccctcctcccattccagcccgcagaggtgttgattccatctgaatgcaagaccctgcacttatatgaagcaaggtatctagcattgctagaagaggctttgtataagaggcaaaattctcttgtacactttgtccttgatccagttttatcaagctcttccaaggattcgttcgctgtaagatatggttgtttggtgcagatcgtccgcggacgcgtgggggattttggagcattagtgtcaattagaggtgtatgccgtgtgaacatcaagaaccttcttcagatggagccctacttgcgtggtgatgtttctcctatgatggacaagtcttgcgatggcactggattgggcctgagaatttccagactaagagagtccatgtgcaatctgcacagcctacagatgaagctgaaggtgcctgaggatgaaccgctgcaaacaaacatcaagagctctctaatgtggtctgagaaagaaactttcgaagggtacgacgaagaatttatccctgagctcgtagagcgtctctcttttgccgcgtaccaatcagtttcaggtgacaaaagatcattccattttcacccctgatcacttcttgatcacacttatgttttaaatctcaatattacctggaatgaccaactagagagatggtgctgaaacaatgtacgcgagcttcatgtagtctgatctaacattttcaagaatatatgacctccgggttcttggggtaccgcttactccaacacttggcatatgncatcatcatcatccgtcatccgtcatccgtcatcatcatcaagagatgttaatacgtaacttccnaaatctaactgatgctcaangatccacaaaacatgt

SEQ ID NO: 18431 - DNA, 942 bp, Triticum aestivum
  unsure (1)..(942): unsure at all n locations
  Clone ID: PAT_TA_18431
tccgcagnaacccagcccccgctcacctctctctcttccccaggaacaaacacggccgccgtcgcctcgatctgccccgtccgggcatctccggcgacacggcggacacctacagattcccctcatctccctctaccatttcctcctatttatttgatccgccgccgccaaaaacgtcgccaccactcaatcctagccgcctgatccaggtccgatgggcttgccaccggctgcagcggcaacaacgtctccatgcctacatcctccgctagcgcagccacacgcacgaggcgtgcagccatgggcgtcgggcgtgtgcggcttcaccggcgctgctcggtcgccatggctctgctgctaacgatgtggactagccacatcctactgctactgctggtaaatagatcaaggtgaatagatgcttatggactgattcaaaccgaggtggagatagataagaaatcaagcaagaagggctaacacaagaaggtacttgattagtacctggtggcgcatgcaacccaaagatcttcaccgcagtgaaggacagcagtgtggtagaaggtgaaaaggcaagttggtgggggtactccagcgtatgtgtgtgtgaggtagaatggtccagtgaaagggatggctcctatttatagtggggtgaatagctatgtcggtttgaagactcattacatctggcatgcatgcgtggttagtcttgcatgcatacctccacttgtgtctcttatgggctgtactatggacaggtgtaatttgtttggctggcccttagttggcatttactttatgggaaagaaatgagacaagggtctataaaatatatggaggtttgaagaagaatttgttttgcacgactaaatgctatttgttgtaataataaatgtagttgtctctattattttaattaatgttttggcaacgccgttg

SEQ ID NO: 18432 - DNA, 977 bp, Triticum aestivum
  Clone ID: PAT_TA_18432
gacccctcctcctcctccaaccgaccccgccacccacgtcccgctccctccccacgtccagagcatggcccccgccgcctccgcctgccccgtccggccatctcctgccgccacgccggcctcccccagtttcccttcctctccctctcccatacccccctccccattttcatccgccagccgccaaccacggcgccaccactccatcctaccgccgcctgatcacggtccgctgggctcgccaccggctgcatccgcaacgacgtctccatgcctacatacacccccagcgcgggcagccgcacgcggcgggcagccacgggccgtcgggcggtgtgcggcttcaccggcctctgctgggcagcatggctccgatgccaacggcgtggtactacgccatcatcatattgttccaactgaaagataaatagagcaaaggtgaaatagatgatcatgggactgaaatcaaaacgaaggtgaagagaaacaaggaagtcaagcaaagaagagataaacacaacatgggggcgcaatcaagtaccggatggcgacaaaagacaaggagggaagggggggggggatgtacaggcggatggttgtgggtgaccacagtggaggtgatggttcttaagtatagtggggtgagtagggttgttggtatggaaatgcatgacatctgtcatgtatgtttgggtagtcttgcatgcatgccttcacttgtgtcttttgttggatgtacatgcgtgatttggtgtttgcttggccgtccatttgtgggcatttatttggttggagtggggtcaggtgtcattctataaaatgtagagaagttggcataagatttattgtgtataactatatgccattgactatattataaatatgaaaaaaatattttgttttgttttaaattaagttcagcctgcgccgttgctatttgctttatctaattttttattattcctattattattatt

SEQ ID NO: 18433 - DNA, 1825 bp, Triticum aestivum
  Clone ID: PAT_TA_18433
gcaggggccaaagcaatctccttctgaactttataaaaatgatatactccagttatgtgatacaatacaacagaggaacttgctcctcacttggtccatctcccaccgtattcataaggatacaatagtaacaccatgtagtgtgttctgtgtaacaatctgataatggcaatggttgtgacttcctacgaagaaaatatttcctgcaacaacaatgcctgcacacggacagggacggaataaaacaccatgcatgcttattggattagcaccggagagcgatataaatgtatgtcgaacaaataacatcaacataaggctttgtgcagactggtccgtttggtcaagccttggacgtcttctgatttggtttgaacacgtttttaatcaagcgactcctttgattgacaaaagttctagggaactccgtcttcaatttaacagtgtcaagttcattgttgctcctcggtgcgactatgaccttggcttgctcctccaagttgaagttcttccaggagaagtttgggtcgatgtaatcctctgtacatctccagtatctcattgtggctcacctcaccaggattagtcgaagttccagattccggtgaggtttctcttcgccatctcgattgagatgggaagaagttcatccaatattgtcattgagtttgggatatccacaaccttgtcataccgggtgatctttgtgatgaaattgcgattattggacagatcagatgaaataggcatccttacacgaagggtgcacacgttttcgtagtttttcagcagttcttcaaccatggccttggttttggagtagaacgatccaacgaagttgggcgtgtcctcctccttgaacccgacccccgagccgagcgggtggcccgcgtcgtactcgaagatgcagcccgtggcgtagttgatgagcacgaggccccgggcgcggcagacgtcggcgagcgtgagcgtgccgcagacgttggcgcggatggtctcgacgcggtgggtctcgcaccagtcgacgttggggcggccggtgacgcccgcggcattgaagacgtgggtgggcgcgacctcgtcgatgtcggcctcgagctgggcgcggttctcgagccggccggcgccgtaggcgaaggggatgccctgcgcggtgcagagcttgccgaggaggcccccgatccagccggtgcggccgtagatgaggaacttgagcgccggcggcgaggagccgttggtggagcccgccatggcttttggtctacacgtgccagggaagggtttaggtagctggatataatgccgggttcctgcatttctaataatcagtttaatcacctccctccagctacctattggagggcaagtttgtgatttctactgaacctgacatggacgctttttaagtagtacttgggagtgctggtgtgcagcatagatgtagtactcaagaagctatgatcacatgatcttgtggttttactattgatgaccttggtcctactaattcagtttatttgctgaaagcaatgtttgaaaatgatgcaatctgccaggcagcgctaatttctctgctgccttttcttatgagtgttattgtcttgatgtattttctcaccacgggaagcattaggtatatgtgcaattatcggcttgtaatatgttcctagcgctataccttctctaatatatttatatatgtaaatatgttactatttgatcacctctaactagtattggggatgtatctggtgaaccggagcaattggtgctaccgtgcactggtccttcgttgcacatttaaaaatgtttgagaaaaaaaaaa

SEQ ID NO: 18434 - DNA, 462 bp, Triticum aestivum
  Clone ID: PAT_TA_18434
cgtccgggctggcgtctggcggctggcgactgcacacggaccgtcgcgaagctagcggctggaaacgagggttcattgaagatggcaaacgttctgctagctggtctccgcggagcaaagcagctggtgaagaacttagggtctgcatacagatcactttcatcaggatcgtctccaaaatgggtcgagcccggctatgacttcagtcgtaaacgttttgggccagattacggggttaccacctcagttggtcaatacggattgcccaagtctgtggattggagagatgttccttgtggttcaaatcccagtgaaaagtcgtttgaacagtggctcttcctatattcaggcatcccttatgagtatcgaaagccttctttccattacaagtacaattcccatcgaattgtctgcccagcatatccttgatgcgaatacgataactaaatctggatgcaagag

SEQ ID NO: 18435 - DNA, 1488 bp, Triticum aestivum
  unsure (1)..(1488): unsure at all n locations
  Clone ID: PAT_TA_18435
ggggctcaaggtcttcgatacctcagtggagagcatcacgaccggggcgtggcgggcgctccgaagtgcatggaggagtggctcgctgattgttcagaaattggaaacttctggnttccccgggctgcaagctcttgccgaaaccattcggcacggagaactacctgccaaagcatctgaaattgcaccaaccattttagagacagggaagtcatttacagccaaaggaatggaaatgcttgagcgtgttgggaaagagacgatggagttgatcattgaagagactggtatggaaattgaaaaaggaggtactggcgaaggtgaccagcaaacagaagaggagcagtctgaagaagtatcattcgacagatgtttctacatttatggaggacctgatcagttggaggaactggaagcctgtcaagtcactagcgctgctatttaataggaagaaaacaaacttggtgctgagcagaaaacgtttatgatggaaagatcaaagaaatacagcagctatttactcttagtaccaagattgaggaaaatggaccagactctgacaaaggaagaagatgaagcagctgatactgatggtgatgcacaaatgaagaagttatgtgactcgagtgtgagcaaggctgctaaaatggctgcggggttcgcaactggcttgggtggactttctccgagtgatatcatcaaacgaactacagataggctagagaccattcactcggagggcgttcatagattgtcagagatgtgctgccttgcagtttctcagcttctggtgcttgggaaatcagttatctctgctgccaacaaatcaaacgacgaagatgaaagtgatgtgaaaatcgattggcctgaagatctcatctcgaaggcagaaatcatcagatggagggcacaatccatcgctgtggatatcgagaaggtcgccacaagttttgctacaggcatctcagatgttgcggaagcttatgcagcagcgatacagaatgctctggcagacaagcagggcgatgtcccgcatcagtcggtgcaggagaaagccaaggatatatccagccatctgaaatccgaccagacgagtgccatcagcaagttacaagacgccctccagtacctcgcatacgtcgttgtctgcacctcgatgcccagtgtttagccctggagtgcctcctccccactgttgttattgttaacctcttcctgtacattttgtgtgcgcgggtaggcagagttagggcctctagctagttatgaaagctacactggttgtcttgtggtgtgtttgttcaagcgtcgtgaaatcagtaattggctgtgtctcgtttgtatttcttggcacatggcagattgttgctctctactttttcctgagaacaatgagaattactgatatatgcaattgagatagaagtttacctaagcgccttcatttggaactccagacttgtacacaatgttggttgtttcctaatc

SEQ ID NO: 18436 - DNA, 1702 bp, Triticum aestivum
  Clone ID: PAT_TA_18436
gaatgaaatggcatgatggcagatcaatgactagaattgatttgttttaaactaattctcacgccaattccttccaagccaaattataaatagttgtagtacctgctacagtacagataaatcactggcctggtttgaatccattaactatgggttccccgttaatttcacctctgttcttcttgacatatgcagtatattcaccatagtgcatggtgtacagggtactctggtagcgggtgacgcggattttcttcctcaaagactcagtgatggtgccattgtagccagccttcctcatgagcgagtcaatggtctctagttgtgtccatccttcatgggcagcaacctcaggtaaataagttccactccgtcttacattatagtcaggatcggtgaactcaataattaaaccatgctttccaacctcccaatcaaggtggttgagtgcagtttcgtattcagtcaatatagaaactgtgcattccaaatatggcagctctttggactgtatcggagaaaagcgccgatccctcagggcacttgtcagcgcataatccttgaagccacttactaaccctaaattatgtgaatgaacaacttaaatcaattaatttcacgcaattatttgtaatcaaagtgcacaggaccagaggagaaaaaaccaaccaacgtccatcaatggcgtcgtgcagccagcacctcctctcagccgtcgccatcttctccgtcctggccgccgccgccaccgccaccagtatctacacctgctacgaaggggtgggcctccccgtggacccgctccagggctgccactactacgtgacctcgcagacctgcggcttcgtgccgctgctcccaattgaggtgatgaaggaccggtgctgccgggagctggccgccatctcgtccaactgccgctgcgaggggctgcgcgtcttcatcgaccgggcgttccctcccagccaaagccaaggcggtggccccccgcagccgccgctggcacctaggtgcccgacggaggtgaagagggacttcgccagaacgctcgccctgccggggcagtgcaacctgccgaccatccatggcggcccctactgcgtcttcccatgaacgctagcttgttcatgaaaacattgtgtgaatgaataagctagcagcatgtcacatccgtggatgggtgatatggttacatgcataagtgcgcaataaagagaataatcttccaaagcttccaatgcatccccttaggcgtggctcggaaccattggtagccttcttccaggtgacaaacagtgggtggacgccctcctcgaaggcgggcggcggcggctgctcgccgctgtagtgggcgacgagggtgtcgaagcagtagaccgccatttcctccgtggccaccaccatcgtcgatggccgccgccgagagggcccccccggcgaccaccagcgtcggtcggcgcggccgagggggcgcggccgtcgttcagccgaggcggcgggcgcggacggcgcggcggtggggggaggggtacggaggttggggaggggcggaagcgagcggtgcgttcgtttcgcggacgggattccgagtcaagtagagaagggataagctagcagcatgtcacatccgtggatgggtgatatggttacatgcataagtgcgcaataaagagaataatcttcaaaaaaaaaaaaaaaaaaa

SEQ ID NO: 18437 - DNA, 409 bp, Triticum aestivum
  Clone ID: PAT_TA_18437
caatcaaaaaagaggtgcttgatattctcgtcccgatcacagaaactacacctagtagatcctgtccagttgcgcttaatcaaattatcctttgttaaaattacttgtttatgcacaaaccacataaacactttaatcttcaaagggactttgactttccaaacatgtttggaactcggaataacactagagttgatgacattgatatacatcgacttgaccgtgaagtctccagacctagtaagcttccaacgcaactgatcaggctgatgagttagctgaacctccatcagtctactcactagatgaagccatgtttcccaccggtcaccaacaagcaccctccgaaattgaatattaagagggattgagggactcctggattaaggggtgttccgatatccggact

SEQ ID NO: 18438 - DNA, 1028 bp, Triticum aestivum
  Clone ID: PAT_TA_18438
gttgcgatgtgtacttgcacagccattatatgtcatggctggccaagaaataaccggccgtctgcatttggtggcccacagtgcgcaaagctacacaatattcttactgtcagccaaaatgtggggtgtgggtgcggacccaggcggcatccttcagacatccactgccaagctcgaactcaaggagccttactacaggctgtctcaaccacaagcttatatgccacaagaccaacagcagctaccgttgtcatctttgcaggcgcaaggatctgggcagcagatgcaagatggtctcagccctggcatcactgtagatcaggagagggactccgcagccttcactcgacaggtctgaaacctgtgccgcatgctttgcttcctgcaacgagagctcaggtctgtacaacaacgagagctgccaatggctaacattgcgtccagttgcggtaggagatcatcatgtccgagttgtgcagctaaacgtgctcgtccctgccccgctatttgatgtcagaaaacaataatagtgatcgaaccgcaagtcgaagctagaagacatctaacagagaagagggttgtacgttcttatgtataattctacaaattgattgttgcgtgtgggagtagaatattgatagaatgatggtcatcattgtcgtccgcttactcaaacttaataacaagtaaaaagtgagcccagttttctccgttaataactgctaactagaaaaaaaaaaaaaaaaaaaaaaaaaaaaaaaaaaaaaaaaaaaaaaaaaaaaaaaaaggtttcaacagttatcttcacatcgtatactgtgatcgtacatctctgtttatgacggaacatcgacaacacttgaaataccaccatatggctattccctttcaaggcacatgaccctgcattgttctaagtttgcttctatggataatacctttgtatgcgtccccgtgctttaagatttggtttgttccacgttacaacccttacaatcacatttctttgtgtttactgcacctaacat

SEQ ID NO: 18439 - DNA, 1365 bp, Triticum aestivum
  Clone ID: PAT_TA_18439
cgacccacgcgtccgacgacctctccgactccgacgacgacgacacctcctcccgcgcctccgacgcctcctccgacttctccacccctccccccgcctccgcctccaaagccgccagagcggcgaccccggcctccgtcgtcgacgacatcgaccaccacctccgcaacctccaactcaagtactccgagcccatctccccgaaccctagccccgcccccaaccccggcgcctccgcctccgcctcggccgtcaatgcggtcaagctgtacctccacataggcggctccacggccgccgcccgctgggtgaactccgaccgcctcgccgccgtgtccttcgtccgctcaggcgagggcgcctccgaccccgacgaggacgacgagcccaccgggccgtggttcctcgtcgtgggctccaagatccgggccaaggtcgggcccgagctgcagctcaagaccttccccgtgcagcggcgcgtcgacttcgtcgccgacggcgtctgggcgctcaagttcctgcacgccgacggctacggcgacttcagcccccgcgtccggagctgcctgttcgagaacagctacggcgtcgaggccaccgacgagggccgcgccaaggtgtttggaaaggagtttgctgcgtgggcgcgcccagagtgtggcgatgagtccatctgggaggacgccagtgatgctttctcgccaggccccaagggcagcccgatgcctgcacggagcccgatgctgagacctctgatggaggatttcagggaatttgaggagcctgtggaggagggtgatggtagcatacagagccttgcgctgggcgctcttgacaacagcttccttgttggtgattcaggcattcacgtggtcaagaactttgagcacggcatacacggggagggtgtctctgtgaagatctctggagggggaacaaacttcaccacaccaaagaaagcacttctgatgcgtgccgagactaacatgctcctgatgagcccagcaactgatgggaagccacatgccaagggggtgcatcagcttgacattgagacagggaaggtggtctcacaatggaagttcgggaaggatggagcttacattaacatgagggatatcactaatgatagcaagggtgcacagatggatgcgtctgaatccacattcctgggactagatgacaaccggttgtgccggtgggatatgagggatagacatggaatagtgcagaacttggctagttcaatggagtccccagtgttggaatggacccaggggcatcagttctccaggggaacaaacttccagtgctttgcatcaactggtgatgggtccatcgtggtaggctcgttggatgggaaaa

SEQ ID NO: 18440 - DNA, 913 bp, Triticum aestivum
  Clone ID: PAT_TA_18440
cccacgcgtccgcccacgcgtccgggggaactccatccaacacatggccgccgccgtcgccgtccgctcgaagcgcaggctcctaccccacctctaccgtctcctccactccaccgccgccccctcgcccaaccgcttcctccgccacgcgtcgccggtgccccgcgccgccgaccactcccctttcctccgcctccccgccgcgcgcgtctccacgctccccaccggcctccgcgtcgtcacccagtcctacccggccgccacccgcatggcctccgtcggcgtctgggtcgacgccggcagccgcttcgagctgcccggcaccaacggcacggcgcacttcctcgagcacatggccttcagggcaccgagcgccgccccactgcgaacgcgctcgaggtggagatcgaggacatgggcgcgcgcctcaacgcctacacctcccgcgagcagaccaccttctttgccgacgtgcagggccgtgacgtgccagccgcgctcgatgttctcagcgacatccttcagcacccgcgctttccgcagcagggcatccagcgcgagcgcggcgtcatcctgcgcgagatggaggaggtgcaaggaatgatggaggaggtgatatttgatcacctgcataccgcagcattccgagaccatccgctgggggacacgatattaggtcctacggagaacattaaatctatctcgaagaaagatttgcagcagtacatttcaacgcattatacctgtcctagaatggttgtatctgcttctggagctgtcgatcacgatgaggttgttgatcaagtcagaaaattgtttacaggattctctactgatccaactactgcagatcagcttgttgaggcaaatccggctatttttactggctcataggttcgtgtggagaatgccg

SEQ ID NO: 18441 - DNA, 700 bp, Triticum aestivum
  unsure (1)..(700): unsure at all n locations
  Clone ID: PAT_TA_18441
ggacgcgtgggggatcagggaattggctcagttgatcttccaagcacaagagattgagtcggcacatcaattgctggtgttgatgattctgttgggtttgggattgtcaatgcttgtgtcggacttggtctattgaacaaggctcataacatacttgatgaaatgactgctcaaggagcttctgtgggactagctatatacaccccaatcttgaaagcatattgcaaggagcagaagactgcagaggctgcacagcttgtggcggagattagcgcagcatggctacagcttgatgctggcagttatgatgctcttattgatgcttccatgacagcccatgatttccagtctgcatttgcacttttcaaagatatgagggaggcgaggctaccagatcttaagacaagctatcttactataatgacaggcttgacggagaacaaccggcctgagctcatggcatcattcttggacgcagtggttgatgacccgagaatagagattgctacacatgattggaaactctataatacatgccttttgcaaggttgggaggttaagaggatgctccgaaagaacatacccgaaggatgctattccctgtttatatgaaccaaaacatccaacatacctcctccactttaccaatgggtnctcctccagccagagaantacttttaatgtgctccatactatgatg

SEQ ID NO: 18442 - DNA, 579 bp, Triticum aestivum
  Clone ID: PAT_TA_18442
cccacgcgtccggtggccaacgactccttcgtcgtgcaggagttcgacgaggagttcgcgacggggccccgcaccagggacttcgtggccgcgctgcagcgctgggggctcgaccccagggagaaggccatgttcttctccacggagcttgatgataatgtgcggctgagcggcaggaacatcggcaccctcaaaatgctaactcccaggacgctcaacctatacgacatcctcgacgcccgcaagcatttcttcaccccggccgctattgactacctcaactcgaggtacggtaccaccggttttgatgaatatgagggcgatgatggcgacgacgacggtgaagaggaaggggtggaggagcaagaggagggagaagaaatcacagaggaggctgcccaagatgagactggagaggctgaggcagacagcatttcctaggtaattattatggtgtttcttgtttgttggtttgggaattgcctctccaatgaagaagcctttttggtttgcttttattgtaatttgataatgtatgttacacactgatgcgatatattagattttcagttctcccat

SEQ ID NO: 18443 - DNA, 1973 bp, Triticum aestivum
  Clone ID: PAT_TA_18443
gcccgccgcccccggctccccctccccctccggtgtggtgtggctccacaccccgtccccgcacccccaccgcccgcgccaccgcctcccgcttctccgtccgccccccagcgcagcgcagccgccgtagagccgccacaatgccggtctcctccgtggcctcgcccctcctgctctcgctctccgcctcttcctcctccttcctctcctcgccctcctcggtctccttcctcccctccccctcctcctcctcctccttcccgcacgcctccgtcagggggaggccgtccgcctccatcctccgcgcgctgcgggccgaggccaccaccctcccggtcatcaacttcaccggggagaaggtcggggaggtcgccctggacatcaaggccgcgccgccctccaccgcgcgcgcggtcttgcaccgcgccctcatcaccgaccgccaaaacgcgcgccgggggcacggcctccaccctcaaccgcggggaggtccgggggcggcgggacggaagccctacggccagaagaagaccgggaaggcgcggcgcgggtcggtccgtacgccggctccgccccggcggtggagtcatcttcggccccaagccccgggactggaccatcaagatcaaccgcaaggagaagcgcctcgccacctccaccgcgctcgccagcgccgccgtcgccaacgactccctcgtcgtccaaggagttcgtcgacgcagctcgcgacggggccccggaccaaggacttcgtggccgcgctgcagcggtgggggctcgaccccagggagaaggccatgttcttctccacggagcttgataataacgtgcggctgagcggcaggaacatcggcaccctcaaaatgctaactcccatggactctcaacctgtacgacatcctcgacgcacgcaagcatttcttcaccccggccgccattgactacctcaactcgaggtacggtactaatttgcccaaattctataaatggtgactcaacgtgtttagcacctaattgcattaatactaagaagttagcaacaaatatgtaaaatgtgatcttgcttaaaggtctaaattgtaatcctctacttctacctaaatcggtaattggcattatcattataatcaatatagcagaaaacattgcgatcacacctaatagtttgttaggtattgatcttagtatagcgtagaaaggtaataaatatcattcaggcactatagcaggtggagtttgcatagggttagccataacataattctcgctgtcacctaaaacgttaggcataaagaaaacaaatattgataacactataatgaataaaaatattgttattaaatctttgaatataaagtaaggggcgaatggtaatctatcgtagttacctgatacacctaaaggatttcctgaacccgctgtatcgtgtaaagctattagatgcattaaaactaatgcagctaacacaaacggtaaaacgaaatgtagagcaaagaatctgttcaatgttgcattgttaacagaaaatccacctcatacgaattcaactatgtcttgtccaactcaaggtattgcactcaataagttagttataactgttgctcctcataaagacatttgaccataaggtaatacataccctaagaatgcggttgccatcatcagaactagtattatagtacctgcccgggcggccggttgatgaatatgagggcgatgatggcgacgacgacggtgaagaggaaggggtggaggagcaagaggagggagaagaaatcacagaggaggctgcccaagatgagactggagaggctgaggcagacagcatttcctaggtaattattatggtgtttcttgtttgttggtttgggaattgcctctccaatgaagaagcctttttggtttgcttttattgtaatttgataatgtatgttacacactgatgcgatatattagattttcagttctcccat

SEQ ID NO: 18444 - DNA, 1126 bp, Triticum aestivum
  Clone ID: PAT_TA_18444
cccacgcgtgcgcggacgggtaggttcctcttccgatacgcctctccagggcgcgattttttccgtcccctctggcgcacccatggcttctccgtatctccttcaccgtctcaccgccgacgagatcttccaaactctagaggcttcctcctccacgtcctcctcatgctacgatgccttcgtgccggtgttccgcccagatccctcgtcctcctccctgtcggtgtcggcggccgaccgcgtccggagccagttcctctctgtggagcgcgacctcttccacgacgcactcgtcgcaccccggaatgacgacctcggcttccccgaggagaacgatgaggaggaggaggcctcgatccggtgggattgcttccaattggacgaggaggaggagccagatctgccgctggaggcttccgtatcagccgaggaattcgactgggaggaagtcgcgttcgcctccggacccttggtagagaatccggagcccgattgggagatgctcggcgacatgccgcccagcgctcccgccggcgccaacgagggtttcgtgtacacctctgacagggaggcctatgaggtgctcgtcgctgttggcgatgggcttttcctcaccaacaagccgccggcagccaggtcggctgtcaaggcgctcccatccgccatcctcgccgccggcgaggaaggggagggagaggagtgctccgtgtgtaaggacggggttgtggcgggggagcgcgtcaagatgatgccttgctcccatcggtaccatgaggactgcatccttccatggcttgaggtgcgcaactcctgcccgctctgccgctttgagctgccgacagacaatcccaagtacgagacctggaaggctggacgagccatggctacctgaatgaattgtgcggtaatggtaagctttacccctatggttttatatagagttgtatgatttggtttgggattgatcggtctaattaggaaactatacccagttgtatgaaggaaaacatagagtttgttgcagatatggttttgtgcattttgatccgttactgttcccaagagagatttctgttatttcgatgctgcaaggattatcatattaaatgctattaaaaaaaaaaaa

SEQ ID NO: 18445 - DNA, 847 bp, Triticum aestivum
  Clone ID: PAT_TA_18445
cgtccgctcgagccccgcgtcatcccgaccctcatcccctcctgcatcgtcgccttcccatcgcctcctcttctctcccttgattctcgtcgcgcagccgccctttccttcctccatcccgcgcctgccgctgagcccctcctcttcccagttccgccagcctcatcctctgccgcgcgctcaattcgatctgcaggggagagagtgaagatgagagggagaaggagggagaggagggtgaaatttcggaaagaggatagggaggtgcgacttcgaatgggagagggtctccgctggcgttggcccgcgccggcgaggtcgggcgcgacctggccattggtggcggctcgattctctcctagatcggcttgtgcagtgcggtggtgcggcggacggccgctcgtgtagtggcctcagcgggtgggcgacgacacctgcagctggtgcacaatggcgacggcatgcagctcctgtgccccgcaacactctccttccacgcacagcaggagcgggagcaaggatgctgaggcagtagttcaggattgccatgatgagctgctgctgtagtgctttataattttttggccccttcctaaatgttcgcagcctgatagttctgcacaattggtaggagcagcgaatgtgctcgtggaagctcattaccttgattagcgacggcgccgctcctcctcatggccacgggtgaagcagcagcggcgccgctcctcctcatggccatgggtgaagcagcagcggtgccgctcctcctcatgtagatggtcgcatcctcctcacgcacctcctttgcacgcgcttcccgcttccgcttgctcgttctccgggtgtt

SEQ ID NO: 18446 - DNA, 636 bp, Triticum aestivum
  Clone ID: PAT_TA_18446
cgtccgcccacgcgtgcggttcaacaggatagcagcttgctggatatagctaacacatcactcatgagtgatccgcccactgtcgaaaagcttaaatcccggacgaaatgaatcttcggccacttcctacgcatcagcctgctcaatcagtttctatggcacctaaggtacccagtgtaacagatgacgatatgttcaatgatggcagagtatacgaaaacttctgtgtggatgataatgacctgacatttgagaattatgaagaactgtttgggactccacacgttcagacagagcaactatttgatgatgctggaattgacagtttctttgaaatgaaggaaatgccagctgctgattgtgaccagcagctcaaccccgtgcgacccgaatgtagcaacgcggtatctgctgattccagtctttgtgttcctgcaaggcaggccatatctactatttccctctcgttctctggtttgactggtgagagcaatgctggagatcaccaagattgtgaggtatcaccactgctccttatgggcgagcaaccctggcttcctcctggttctgaaggatcatctgccggtggtagcagaggtagcgctctctcacggtacctcggccgcgaccacgcta

SEQ ID NO: 18447 - DNA, 1738 bp, Triticum aestivum
  Clone ID: PAT_TA_18447
cgtctgcctaggcgtgatcgctggtacgtcccacaactcattgcgcccaatctcacgcccgttgccccatcgccaagccttcctcggcgttatcgccgtcgccgtcgtctcgccggcgtcggccgctgggaggagatggcgtcgtcgctggacgcgcccaacctcgacgattacctcaccgcggactcgctcccgcaggaacccccgaggagtctcaccctgcgcgatctgctggacatctcgccggtgctcaccgaggccgcgggcgccatcgtcgatgattcattcacacgttgctttaagtcaaattctccggagccatggaactggaacatctatttgttcccattatggtgcttgggagtagtcataagatatggactactgtttccgctaaggttcttaacacttatactaggatggatggccttctttactgccttttttccggtgcgtttcctaatgaacgggaaaaataggctaaaaagtaaaatagagagaaagctggttgaaatgatgtgcagtgtttttgttgcttcttggactggagtgatcaagtaccatggaccacgcccaagctcacgcccttatcaggtatttgttgcaaaccatacatcgatgatagattttattattctggagcacatgacagcatttgctgtcatcatgcaaaagcatcctggatgggttggatttattcagaagactattctggaaagtgtgggttgcatctggtttaaccgtaatgatctcaaggatcgtgaagtagttggaagaaagttacgtgatcatgttcagcatccagacaacaatcctctcttgattttcccagaaggaacttgtgttaataatcagtacactgtgatgttcaagaagggtgcttttgagcttggctgtgctgtatgtccaatagctatcaaatataataaaatatttgttgacgccttctggaatagtaagaagcaatcttttacaatgcatttggttcgtcttatgacatcatgggctgttgtttgtgatgtttggttcttggaacctcagtatctcagggaaggggagacagcgatagaatttactgaaagagtgagggatatgatagctgctcgggctggtcttaagaaggttccatgggatggctatctgaaacataaccgccctagccccaaacataccgaggaaaagcagcgcatgtttgctgaatctgtgctgaggagactagaggaaaactaaatagctatcaatcaactcaggctctcctggttagttgagggatttccccttagttgccttgtaatctgttaatcacccaagtgagacctgggacatgtggaaatgaccaccgcagttttgctgtaaatttgtttgcagtttgacagaatcagtagcatgtgcttggcaagaaagaactattgaatcaaccttgctatacatacgacactgcttgtccgatttgtgtacgacgcattagatcaagccgttgatgcgctgaacaaaactgcagtggacatcagattttgcgtggtacacaaattgaaccatgaagcattgtacgcatagtggttccgctattgaatggatgcgtgcctatagatcttttaatatcttatgattggttagtgttaacacgtaagcattggtgttcttatcagtagatgctgtattggtatttgacctctgtttcatgtggacagtcagtcctgatcattcttatatccttaatcatgtgattatttgtttg

SEQ ID NO: 18448 - DNA, 478 bp, Triticum aestivum
  Clone ID: PAT_TA_18448
cgtgcgcggacgcgtgggcaagtgttctggtggcgatgatgacagtcgtcgagaggttcgtggacttgacggtgtcgtggctgacaggtcgacgagtgcggggagcggggcacgtgtgagcgggcttactccgtgcgttggtggcaaggcacgaggacgacatcaaccgagccagctggagctgggcgcccgagcgagggatgtgactgctgcaggcctccgggtggcggccgggtgtccgccgcacattggggagtgagatcattccgggcaggcgccataacatgacgagtaggtaaattcttatatcgctgtgtgacaacttggaattatacatgcttatctaactcagggacgaacgtagttgcttaattaactgcgacaaaatgaaattatacatgagttgctgctacaatgaggaagtgtagatgatacgacaactgtgtgatagaatgaatttggttgtttttttaaaaaa

SEQ ID NO: 18449 - DNA, 894 bp, Triticum aestivum
  Clone ID: PAT_TA_18449
actagttctagatcgcgagcggccgcccgcgatctagaactagccccgcgtccgcttctcgtccactccaaaccctagcctcctcctcctctcgccgccgccgccgacgccgacgccgccgcagccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgtattgaggatgttaccccggtcccaactgacagcacccgccggaagggtggtagaagaggaaggaggctgtaattccatgctcgttcaaggatggaacaataccaagctatcgatatcctgtgtcttgcaacttgttctgtactactccgtttatgatgttaagtcagatcttgtggatttatagattttgagagatattgtgttgcatgtttagaaaatgaccctttcccggctttgaatcaagtggttgccatctattattacacttcgtttgctatggatttacttttgcgtcttgttgttgcttgtttcaatcatgtgtcaaaaaaacttgacacgctgttgtagcttctgtgtcaactaacctgcagtttgcttgct

SEQ ID NO: 18450 - DNA, 836 bp, Triticum aestivum
  unsure (1)..(836): unsure at all n locations
  Clone ID: PAT_TA_18450
ggccgggccccgggaattaaanaaaaaaaaaaaaaaaaaaaaaaaaaaaaaaaaaaaaaaaaaaaaaaacccgcaggggcctggccggcctcatctcctcgtccactccaaaccctagcctcctcctcctctcgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtgaaagctgatcgtgatgaatcatccccttatgcagctatgcttgcatctcaggatgttgctgtaagatgcaaggagcttggaattactgctctgcacattaagctccgtgctactggtggaaacaagacaaaaactccaggtcctggtgctcaagctgcgcttagagctcttgcacgttctggcatgaagattggacgcattgaggatgttaccccggttccaactgacagcactcgccggaagggtggtagaagaggaaggaggctgtaattccatgctcgttcaaggatggaacaataccaagctatcgatatcctgtgtcttgcaacttgttctgtactactccgtttatgatgttactccgtttatgatgttaagtcagatcttgtggatttatagattttgagcgatattgtgttgcatgtttagaaaatgacccttttccctgctttgaatcaagtggttgccatctattattaccctttctttgctc

SEQ ID NO: 18451 - DNA, 988 bp, Triticum aestivum
  unsure (1)..(988): unsure at all n locations
  Clone ID: PAT_TA_18451
gccgtcggcacgcctcacctttcgcctcctccaaaccctagcctcctcctcctctcgccgccgccgccgacgccatgccagggcggccgtccacccccgaccccagcctccacctcctctcgccgcggccactccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaagctccgtgctactggtggaaacaagacaaaaactccaggtcctggtgctcaagctgcgcttagagctcttgcacgttctggcatgaagattggacgcattgaggatgttaccccggtccccactgacagcacccgccggaagggtggtagaagaggaaggaggctgtaattccatgctcgttcaaggatggaacaataccaagctatcgatatcctgcgtcttgcaacttgttctgtactactccgtttatgatgttaagtcagatcttgtggatttatagattttgagagatattgtgttgcatgtttagaaaatgaccctttcccctcttttgaatcaagtggttgccatctattataaccctttctttgctatggatttttacttttgcgtcttgtaaaagcttgtttcatgtgtctaaaattgacacacggttgtagctccaattcgccctatagngagtcgtattacaattcactggccgtcgntttacaacgtcgtgactgggaaaaccctgcgttcc

SEQ ID NO: 18452 - DNA, 984 bp, Triticum aestivum
  unsure (1)..(984): unsure at all n locations
  Clone ID: PAT_TA_18452
ccttcccttcttaggagaaaccaatttactgaagggtggcaattccgaagttattgcctttctacttcaaacttgaaataattcctctttgtctttaatatggagatgggcacttgaactttaaaaaacagtatgaactcaaccccttctgtaaatcaaatattcgatttgcggggacgacttggggctcatgtcgagcacttcacctgcaatgggtgtggccttcttcgtctgccaaacatgctacaagtacgagcaccatgagggaactgcctggagtgcaagacccgccacaagctccttaagggtcagtcagcctccacccacggccgaattcacttgcagatgtgaagaataaccatgttcgattacatcgccagacagcaaaaaccatgagagcccactctcgatctcagggatttttgaaacgagcagaagattagtaacttttgcgacatcaaagatctgaccttttagagtatgcaccatattgatttacttattgatttattcacactatatcagatttgtcttgaacgtgatactttattgactgtactggacacgggaagttaactgttttaattatataggattagtctgcaccaattgctgcataagttctccttgataccaatttacatacttgtgctactaggcctttggtcagtttgcaactggtattttagacatgtacgagtattctcatggtatttctatatgttttaattagtaccagatggaatttgcgaattagtcttacaaagagaagagacaaggaaacattattcacgagtttgcaggaatatggaaactcaaggtagtctgttagcataagtaaaaaatgtttttcattttatttcttggttcgaccaaattatattttatccgaacgtatggatgatcgacacaatggacgtacgtagtttctggntagcactactcagataacaattatgcctactattaccatttttgtgcatt

SEQ ID NO: 18453 - DNA, 893 bp, Triticum aestivum
  unsure (1)..(893): unsure at all n locations
  Clone ID: PAT_TA_18453
tcgagnggccggccgggcccgggatcctaacaagcaaaggcaatactaaagctagctacgagctacgagtagaagaatccaacaatggcgccgctcgcaccccggaggccagcagcctgcctcctagcccttctctcggtcgttgccgtggccctatccttggccgcgccgggattggcggcggggaagaccggccaggtgacggtgttctggggacggaataaggccgaggggtccctgcgcgaggcctgcgactccggcatgtacaccatggtcaccatgtcattcctcgacgtcttcggcgccaacggaaagtaccacctcgacctctccggccacgacctctccgccgtcggcgccgacatcaagcactgccagtccaagggcgtccccgtctccctctccatcggcggctacgacgcccgctactcgctcccgtccaaccgctccgcgctcaacctcttcgaccacctctgggactcctacttcggcggttccaagccgggcgtcccccgccccttcggcgacgcgtggctcgacggcgtcgacctcttcctggagcacggcacgccggcggaccgctacgacgtgctggcgctcgagctggccaagcacaacatccgcggcggcccggggaagccgctgcacctgacggcgacggtccggtgcgggcacccgccggcggcgcacgtggggcgagcgctggcgacggngatcttcgagcgcgtccacgtgaggatctacgaggagagcgacaaggcgtgcaaccagtacggngcgtgggaagaagcgtgngacaggtggacggcggcgtacccggccacccggttcttcatcgggctcaccgcgacgacnagtcgtaccagtggatacaccccaagaacgtctactac

SEQ ID NO: 18454 - DNA, 1649 bp, Triticum aestivum
  unsure (1)..(1649): unsure at all n locations
  Clone ID: PAT_TA_18454
ggcaggacaggnaggccagttgtggcgtgggtggcgtgtgtgcgtcttcctcctcctgatcccctctttctctcaaaccagatgtagctcgaattcatgttcatggagtaaattcgaagactagtcctaacaatctgcctccaaaatccactatatatatgcccccttcgagctaaataacccttcatccaaacaagccaaggcaagcgaacacaagctactagccagtacttggagaaaccaacaatggcgccgctcgcagcccggaggcatggcgccgctcgcagcccggaggccagcctgcctcctggccctcctctccgtcgccgcggccttattcctgaccccgacggccttggcggcgggggggaaagaccggccaggtgacggtgttctggggacggaacaaggccgagggctccctgcgtgaggcctgcgactccggtatgtacaccatggtcaccatgtccttcctcgacgtcttcggcgccaacggcaagtaccacctcgacctctccggccatgacctctcctccgtcggcgccgacatcaagcactgccagtccaagggcgtccctgtctccctctccatcggcggctacggcaccggctactcgctgccgtccaaccgctccgcgctcgacctcttcgaccacctctggaactcctacttcggcgggtccaagccgagcgtcccccgccccttcggcgacgcgtggctcgacggcgtcgacctcttcctggagcacggcacgccggcggaccgctacgacgtgctggcgctggagctggccaagcacaacatccgcgggggcccggggaagccgctgcacctgacggcgacggtccggtgcgggtacccgccggcggcgcacgtggggcgggcgctggcgacggggatcttcgagcgcgtccacgtgaggacctacgagagcgacaagtggtgcaaccagaaccttgggtgggagggctcgtgggacaagtggacggcggcgtacccggccacccggttctacgtcgggctcacggcggacgacaagtcccaccagtgggtacaccccaagaacgtctactacggcgtcgcgccggtggcgcagaagaaggacaactacggcggcatcatgctctgggaccgatacttcgacaagcagaccaactacagcagcttgatcaagtactacgcctgagctcctgtacttccacaagccacgcttcttgcatcaccgtcggtttgatcctgatgtactgttgcaaacgagaacaaagtgaggcttgtacttggatataataaataaataattgaacagttggtcgtacagatatctggtttaatcaaaaaaaggaacacacaccatcatctccatgtctttctttgacgtctgcggcgccaacggaaagtaccacctcgacctctccggccacgacctctccgccgtcggcgccgacatcaagcactgccagtccaagggcgtccccgtctccccctccgtgggcccctccggcgccgcctactcgctccccgccggccgctccgcgctcggccgccccgaccacccctgggactcctacccgcgcggcgccttgcctcgcctgccccccccctctggcgcagcgtggctcgacgggtcaactctcctggagcanggaac

SEQ ID NO: 18455 - DNA, 438 bp, Triticum aestivum
  Clone ID: PAT_TA_18455
cgtgcgaagcaagcaccgcgcgtcgtctctcggtggcctactggccgcatacgatggcagcaagagcctgtacactgcaggcgagctgccattccaggcgatggatttctccatcaagctggggaaaccaccaagagaaactgagtacaaggtcaaggttcaattcgccgcgcgggcaaacttgtaccacctgcagcagttcctcagtgggaggcaacgtgattctccacaggacacaatacaagcgctcgacgttgtgttgagagagtcaccttctctgaactatgtcaccgtttctcgatccttctactccacaatatttggccaacgtgacatcggtgatgggctggagtgctggagacgatattaccaaagcttgcgccccactcagatgggcctctcactgaatatagatatatcatcaatgccattttacaa

SEQ ID NO: 18456 - DNA, 1265 bp, Triticum aestivum
  Clone ID: PAT_TA_18456
tcgggccgagggcccaaccccgcaccccaccccccccatccgccccccccgatgccgcggcgcgccctcaccctcctcctcctcgcccgcgccgtctccgcccccttcgtcgccgccgccgccgcgccccccctccactgtcccaacgacgccgccgccggcaacgccaccaccacgcgccgccttgaccgccgcaccaagatgttcgtccacacggcgcgcggcgtcatcggcggcggaggcgacgccggcgtcgagcaggagtccgagctgggcctcttcgacgccttcttcgccagcctctccatgatcctcgtcagcgagattggcgacgagacgttcatcattgcggctctcatggcgatgcggcaccccaagtcgacggtgctctccggtgcgctgtcggcgctggttgtcatgacggtactatcaactgggcttggcaggatcgtcccgaacttgatatcgaggaagcatactaacagcgcagcaactgtcctttacgcgttctttgggctgcgactgctttacattgcttggagatcagattctagggcatcacagaacaaggaaatagaagaagtacaggaaaagctggaagcaggtcaagggaaatcaacatttagacgcgtcttctcaaggttatgtactcctattttcttggtagtcatttgtgttgaccttcctggctgagtcggggcgaccgaagtcagatagccacaattgcgctggctacgcacaagaatgctgtaggtgttgccattggcgcaaccttggggtcacaccatctgcacgtcattcgcagtggtccgccctggctgacgtggcgccaccggatatcacgagagccactatcgcactgggctacgcctcctgtttcctgtacgtctcgcctttcgtagcacctctggcccacccttgctacacatcccctgtgcttcctgcatcatttttttttgcgtctgttggataagatgacactcccgtaacgccccgtcgcctcatcctacttagcagcattattatgcccggacatacacttttcatcggttgtaccacgatactcttatatatgtattgtgttttgatatttgttgggtaagatcacactcccgtaagccccgttcgcctcatcttacttagcagcatgtgatgcctggcatacagtttttcgttgcaccacgacaccctgatatatgtatggagtagggatatgatcactgctaatatatacaagttgacccgattccaagaaaaaaaaaaaa

SEQ ID NO: 18457 - DNA, 1400 bp, Triticum aestivum
  Clone ID: PAT_TA_18457
ccacgcgtccgcggccacggggcccgcgaggaggcctggtggaggcgctgagcgacattctccgagcgccgcctgtcgttcagtttggttctgtcacgagaacaagcgcatggcttcgtaatgtacgaccagacttcgctctgacacaaaggtaaggacacctgaagaagctctcgtgcatatttttggggaagcaaggagaacaacaccgtccatactctacttgccacagttccatctttggtgggatacggcacatgaacagcttagggcagtgttattcacccttctgaacgaattggcatccacccttccagtattcttgctaggaacatcatcagtggccttcgatgatcccgaagtagactgcccttccatttttgcttctcgtaagctatgtctagtcgatcgaccgagtgatgatcatgcattaagatacttcagtattctgtttgagtcactgctcgcacaccgtgggctacggggtgccgccactcgagaggctctactcgcggataatgaaaggcgcgatagagtggacagagaaaggaaccaacaaggagaacagacagttagttcttaggctgatgaaggcgctggtcgagggcagcgactgtttttaactgatgctggagatagcgctattacccaatcgtcgctgggtgcattcttttttccggttacgaaaacacgcggaagggctgtccatgcacaaccagaagttgatctgtcaccaagttatgaggtgctaaagcggcacaagaacagcatcgagaacgaagttggcacctctgccaaagaatcgacagcaagagacggaatgtctcctggtgatgtagatctgtcaaagccaacttccccagaggaagctccaaaaggaccacattcaaatggccctttgaaagaagctgacaaagcaccagctgaagcacctccaattctacctggttctcctcccgacccaatggagactgacaatggcgaagattctgccatgcctactagcgatgacacgcttgaacagctggaaggcttgaaacagcgcttcatggagctcaccgtgggctacggggtgccgcagctcgagaggctctactcgcggataatgaaaggcgcgatagagttgacaggtaaagaaaccaacaaggatcatagacggttagttgttaggcatttgttggcatttgttgagaacagcgacaatttttaactctagcaggaataagaggttttactggttttccctgtgtacattctgttgtctgttggagcaacaaccctgaggagctgtccatgcctcctgatgtagtgatgtaacaacattttctgaaatgctcagtggcattacaacagttttgtgtaccaagttctgttgtggtctttgaggatttgaatctccc

SEQ ID NO: 18458 - DNA, 1140 bp, Triticum aestivum
  unsure (1)..(1140): unsure at all n locations
  Clone ID: PAT_TA_18458
cgacccacgcgtccgaccgttcgcaccctaccaccctccaagctccaccccaagctccctccgccttccgcgccgccaccgcaaggctctcccgcctcgcgccgtgcccaggacgatacgatggtggggctctccgagggggagaagcacttcatccgcggcggcatcgcgcaggacctccgggccgacggccgcacgcggctgcagttccgggccctcaccgtcgtgacaggaatcgtccctcaacgcgtcggctcggcgcgtgttaggatgggtgcgaccgaagtcatcgccagcgtcaaggctgagttggggaaaccaaccattcttcatcccgacaaaggaaaagtttccatttatgttgattgtagtccaactgctgcgcctatgtttgagggtagaggttcggaagaattgtctgctgagctctctgttgcgctgcaaagatgtttactgggtggtaaaagtggggcaggggctgcaattgatttatcgtctctgattgttgttgagggaaaagcctgctgggatctgtacattgatggacttgtggtcagttctgatggtaatttgcttgatgcactggcagctgcgataaaggtagctttgagtgatacaggtataccaaaagttaatgtttctcttaataatgaaacggatggggagcctgaggttgatatcagtgatgaagaatttttgcaattcgacacttctggtgtgcctgtcataattacattgaccaaggttggtaagcactacattgttcatgccacctccggaggaggaatcgcacatcagttctgcggtttccgtttcagtcaacagccatgggcaaatatgttgggttaancaagaagggaagcgcaaggttggttcaaacctcattttganatataccgtggcaagaatttaaccaacngtacaataccctacgggaacaacaatcncaactnctnaacacacgggcnatttangaaaagaacnttnagatccgtgttacncgaacnccntaatnaccttgcaancccaaaaaaatncaanctggggcccaatgcaagtttgcaaacctttggttgggtagtttgncattccaacntgggaaantttccgaaaanattgtgncctgtcgggtggttagtt

SEQ ID NO: 18459 - DNA, 466 bp, Triticum aestivum
  Clone ID: PAT_TA_18459
ggtcagaataccgggtcgacacaagcaatgagaacgtaatacaaaaagatgatggtatgatataattcacatacatgacgcttgcctaaacagcatgacattgcataattcacatatataatgcctttgcaacaagatagcattgcataattcacatatataatgtcttgcaacaagatggcaatgcataattcacatatatgataattagacactaaacatgtggcattcacacaaagcatgtctaaactaagcaaatgacatagcaatgcaagataccatacacacgatatgagcaacataaccctgccaagttagggcatgcacctcgggggggggggatatgactggtcatctatctctgaatcctcctctgaggagctatctgtaaccagcgagacatgcgcttcgtcagatagcatagtctgctcagaagaccttttttcactccagaatttgccatcac

SEQ ID NO: 18460 - DNA, 920 bp, Triticum aestivum
  unsure (1)..(920): unsure at all n locations
  Clone ID: PAT_TA_18460
ggnaattgctgctatagtcaagaagtatcctaggctcctggttctatctgatgagatctatgagcatattatctatcatcctgctaaacacacaagctttgctgcattacctggaatgtatgacagaacattaactgtaaatgggttttctaaggcttttgctatgactggctggcgacttggatacttagctgcccctaaacattttgtctcagcttgtggaaagatccaaagccagtacacatctggtgccagtagtatatcacagaaggcagggcttgcagccttgaaccttggttatgccggcggtgaagcagttgcaaccatggtcaaagcattccaggagcgccgggattaccttgtaagtagtttcagggaactgccaggagtaaaaatatcagaacctcagggtgctttctatttgttcatcgacttcagctcctactacgggtctgaggtagagggttttggcaccatcaaggattctgagaccctctgcatgttcctgctagagaaagcacaggtcgcgcttgtccccggagatgcatttggagatgacaagggtgttcgtatctcctatgctgctgcactgtcaacgctacaatctgcgatggagaagataaaagacgcaatggctctgctcaaggcccctgccgcggttcaataaaaatagcgtgctgaaggcattttcgccagcattatattaaaagcatgcccattgggaaaataggaagcatgccattgttgtacaacagatagttcaccatttttttggttgcaaacttgcgagcgatttgctttgtttcaaacttttcatttggtgtaatgtaattgtctttacctgcaggtcagaaatgaaaataatatgttgcttcgacaacctaagatgggaaataattgatgttcactgatttgggtgg

SEQ ID NO: 18461 - DNA, 1305 bp, Triticum aestivum
  unsure (1)..(1305): unsure at all n locations
  Clone ID: PAT_TA_18461
cgcctcgcacaacagctgtgctgcactacctgcaaggacccccaccttaccctctgcgcatccccaatataaagcctttgcaaccaccgacttcccactccgccaccgtccgcagacagctccaatggcgttctcctccctctccaccccttcctcctcctccccctcctcgtctttcaccctccccaccaagccctccccgggcgctggctccctctccttctggaggtcgtccacggggaggtttaggatagcggctgcaagggcggaggcggtagacacgacgatgagcccgcgggtgagcgcgctgcggccgatcaagaccacggccatctctgacatggtccgcgggcttcagcacgtcgggctgccccccatcaggactaggcgctggggactcatcctgggacactcgggcgctgttcgcatgatcctggtaagaagaacgcacagggcgcgcgtctactaggtacacaccttatggtggggacaaggggagtctgaagatagctatgcgccacaaacttccaaacgatactggttgcaattgcagcacggtaaaggacgtagtgaccattctcgataggcagtgctgtacttcaattgaactagcgggctgaacgcatgttcatcaggtattacatccaacacaagtccagttgggaaaataggaaagcatgacgttggctggtccaaaaccagtgacactcccgtcatgcatatcaaactttcgcccgattaagccagagtcacttgcctcagtgagcactgagaaatcaaggctcttgattctatgctctccatctaatccaacaggctctgtgtatcccaaggagctgcttgaggagattgctgctatagtcaagaagtatcctaggctcctggttctatctgatgagatctatgagcatattatctatcatcctgctaaacacacaagctttgctgcattacctggaatgtatgacagaacattaactgtaaatgggttttctaaggcttttgctatgactggctggcgacttggatacttagctgcccctaaacattttgtctcancttgtggaaggctccgcagccagtccgcggctggggcctctagtggagcgctgaccgaacctcgtgccccctgggaccctggggtaccccgccggcgcagcaaccgcatccttggtcttngggtcaaggancccgggataacttgtaatatttcanggaacncaagantaaatacaaaactcaaggngcttcattgtcatgacttacccnaaangtccnaggaaaggnttggacataagatctaac

SEQ ID NO: 18462 - DNA, 452 bp, Triticum aestivum
  Clone ID: PAT_TA_18462
cgtccgcccacgcgtccggtcccggtggagatcttcgcatgtatctggagaaactcgtttttgcagatgatgttgagtgctacgttcgcaacagtccatttggtcaacctttgcgtacacatagtgatccacattgggacttctatgctgaaatagctggtaaagagtatggcgcattgacttgtgcctgaacttcccaatatgtagtgaggcggactagtagactgatcttgtgttgattcttcagacatgaggggaagttatggcatgtttgttgtatacctgacctccaaactaattttatcgtgggttatggaaaaagttggtgcatcgaagattggattttgggcaccagcagttataacttgtacggatggtttcaagtgaatatgaatgaattttgagatggtgactcaactttttaaaaaaaaaaaaaaaaaaaaaaaaaaaaa

SEQ ID NO: 18463 - DNA, 575 bp, Triticum aestivum
  Clone ID: PAT_TA_18463
cttgctttctggtggctcgtcatcaatcctgcagataaaagaacgcctagaaaaagaagtactggaggagtcccctcaaaatgctcgcgtaaaggttttggcaagtggaagttcaatggagaggcgtttcagtgtttggattggagggagcattcttgcatctctcgggtcgttccagcaaatgtggttctccaaagcagagtacgaggagcatggcgtttcctatatccagaggaaatgcccatgaaatggttcaacatgctgcctgagcagaggtttgtgctgccgaaagatgtagtatgtgggcaacagttaggtgcaccttgttgtatctggggatgtttattcttgtgatgactaaattagttttgaggcgtgcgcagcgcaagttgaggacaagctcagctgatactttgccattgatggtagatagtagcagttcatgtgctgatttttttcgtccgcgatgtaccgagtactgtattatgcaactactcatgtactctccgggagtgaaatctttaaccatctttttttcggaccttgataagtgccacacgtgtggctgtgacacg

SEQ ID NO: 18464 - DNA, 1810 bp, Triticum aestivum
  Clone ID: PAT_TA_18464
gttgccgaacagccccagcgtcaggcagtccgctcgacgcctcgacccggacgtgtgcgcaccacccgcccccgcgcccccgcccctgctcgtcgacccctccctccccggacctgcagccctgtacggcggcgacgaggcagcgtctacaggggtggacgtggcccagcgatcgtgatcgacgtgggctcctacagctgcaaggcgggctacgctggcgacgacactcccaaatgcatcttcccctcggttattgactcaactgaacaaacgagagatactgatgaagctaagccagaaaaggaggcctggatctgatcctatgaatggagacaaagccaagaaaaagcgcaaattttatgtaggtcaagaattagaattcaggagggatcatatggaggtgatctcaccgatgaaagatggaacagttacggattgggaagttgttgacaacatatggaatcatgcttttagacggcggctattgatcaatcctgaagagcatcctatgctaatagcggaaccatctataaacagtggacagcaaagagagaaagcagcagaacttatgtttgagaagtacaaagtgccagcgctgttcctagcaaaaaatgcggttctcacatcttttgcatctggacgtgctacatctctagtggttgacagtggtggtgggtctactgtggtttctgctgtgcatgatggttatgttttgcaaaagtctgtggcaacttctccgataggcggtgaatttttgactgactgtatgatgaaaagcttggggcggtgtaactaggtgtgatgttcccagtattcagtaaagaagaaggaagtgagcccttgatggtggcacgtcgtaaaccttgcttttcagagaaccacgggatagttacatgttgtaccacatgagagctattgctagcgacatcaaggagacggtttgtagagttccagatactcccttcgatgaagtggcatatgcaaatgttcctacaacttcatacgagcttccagatgggcaaactattgaagttggtgcagagagattcaagattcctgacattttgttcaacccattcctttctcagactattcctgggatcgatggatttggagattccacttcgattcgtggacttccacgaatggtccttgaaagtgtaaataggtgtgatgttgacattcgcaaggagctactcagcagcatcttgctttctggtggctcatcatcaattctgcagttaaaggaccgtctagaaaaagaagtactggaggagtcccctcaaaatgctcgtgtaaaggttttggcaagtggaaattcaacagagaggcgattcagtgtctggattggagggagcatccttgcatcccttgggtcgttccagcaaatgtggttctccaaggcagagtacgaagagcacggcgtttcctatatccagaggaaatgcccatgaaatggcgaagcatgcatgcagcccaagctttgtgttgcccaaagatgtgtgtgggcaacagttagatgcaggcgaccgactatctttaggtccgtgagtgcagctctagaacaaactcagctgatacttgtacgtgcgtgccgaaagatgtgcgttggttgccacctttgttatctgggggatatttataattgttgtcgttaccgaattatctttagctccacgagtccaacttgagaacatacacatcgggttctggcccttgttcggtgccgcggccagttcatgtggtgatttttctcgtctgtgatgcagaatgtgcaacagtttactctccagactccaaaaaaaaaaaa

SEQ ID NO: 18465 - DNA, 906 bp, Triticum aestivum
  unsure (1)..(906): unsure at all n locations
  Clone ID: PAT_TA_18465
cccacgcgtccgggaaagcttcgtgtcggtttcagagttaccggtagagtttacagatcatcattttttcctggcatcgttcgttcgatcctcttccacccctgatccatccattccggccatggactccaacgccaacggcgggcgcagcacgatggtaggggagatggagagcagcttggagcgggtcaggcggcagctctcctccacctccacccgccatatcctccagggtccctctcttgaagcgatccgatacactaaggaaatggaatgagcggtgggttatacttgatccagctactggaaagatggaatacaaggttcgtagaagtgatacaactgtgaggggaataattgtgttcgattcaacaagcaccgccactttgtcacctaccaactttcatggactgccaaaatatgaaggatgtcgtgtatgaatggaaacattgtattcgaaggaacactcaccgtcactttgtcccctaccaactttcatggactgccaaaatatgaaggatgttgtgtatatattgggactccacaaaaaaaggagtactttctttgtgcagaaactcccagcgctgcaagagcatgggtatctactttacatgcaactcagttggtcctacaggctcataaacaggcggtggattcattgggtgaaatggctgaaactggggttcaaacagttgctactgttgtggctgtggccaatgcaactgcgattgaagcatccaaagaggtagaagcagcgatgaagatctccctgcgggcagcttaggctcaactacaaataaacttagtaaaggcaattagatatctcacaatcatgatggaaccctcgattaaagagataacgcacaactatgcangataccgtgcacgagatccacatcagggaga

SEQ ID NO: 18466 - DNA, 676 bp, Triticum aestivum
  Clone ID: PAT_TA_18466
cgtccgcccacgcgtccgggcagatgctatcatattcagctgcagaaaagctaatagattgacacgaagtgttgggctctctcttacacattcctcaaaggaaccggctgcgatgacatattagtgccagtggttgactatgaatttgatccttcatcccgcaatttcaagaggttaatggaccgtggtgaaaaacatttttcttccaatttgtccactcttttgaggtggtctaaattttctacagaagatgatttattgaatcaatttgaggacatgggatgccatggcacaaaaattgttgtattcaacttgtggctcaatgatgtggatgaaatggagcttgactttacaactgatgatgaggatattatgatgtcaggagcgcctaagataccataagaacgcgcgaaagtgaaaaggttgaatcatatgcatattgcaaatcgctttcgatattcacttcgtgtttatgcatctatactataccttcgtctaccacaacactttaaagtcatcttgtgtggacgaactgttgaacctcatcatattataaaggacctcatataccgtgaatgtatcaaatatcgaccacaagttggaacaagcgtacaggttgatgtcattacttcaattggcttcttaaaaggagctccacacctggatatctatggat

SEQ ID NO: 18467 - DNA, 1792 bp, Triticum aestivum
  unsure (1)..(1792): unsure at all n locations
  Clone ID: PAT_TA_18467
tagcgtggtcgcggccgaggtacaagtcatcatacaacnnnnaagcatttccagaagctttgtatcaccagcttctcttagcaatgatgcacccanncaataacacaaggattggctcacaccgtgttttatccaccattggcgcgccttcgttgttatgcccatggtcagccataggttttcctgtcccaatgaaggnnnatgggtcgcagagtgtgcttttgttggcattgtcagctttctcttctgagnccatnatggatgaactgcagantnnnagtaggaccaannaatccttgcaggaaaacgagaaaccagaagctgtgaactcaaagttaatgaagttgaacaatggccaacttgnncttcttctttcatctatttggagtcaagcatccccggaagataactcgnnttcaaattttgaggcaatgggccatacttacaatgttgctttattgtgttcgaaagcaaaaacctccagtcatgtggcactagttcgatgtttccagttggccttttctctcaggaggttgtctctgaaccaagataatgttgtgcaaccatctcggagaaggtgtttgtatacaatggcatcagcaatgcttattttttcagcaaaagttgctgatattcctcagataacccatcttgtcaaagccgcagtgccagaggaaatggttgatcctcatctttgcctgattgatgactgcagactcactgttacttctgcacaatcttcgaacagtggaatgctttacggttctgaggaagatgaaagtgatgcacaagtttttctttcagctgtaaataaggatgatacacagttaaaagacattgtgatatcccacttcaagagaaaatttgaaaattcaccagagaagtttgacgggatagaagaacagcttcttcaagagttctccctagatgattcgtttcctcttggtgctccattattcatggagacgccacactcttgttcaatgtacgctgaaaaggatgatcactgttttgacgaggatgttattccttgtgagatggatgatgacgatgacatcgtctttgaacatagtggatcgcagtctgacaggaaaacatcaggatctatggcttcatccgatgttctaaatgtgaatcaactgatggaatctgtccatgagacagcaaggcaagttgctaacattccagtctccaccaatcctgtgtcctatgaccaaatgaagagccaatgtgaatccctagtaatggaaaagcagcagaagatgtctgttctcatgagcttcaagcactcgaggaccgattcgcgtagctcaatcggggaaaacggaccagaaacaaatgagtcatctgctcaatctgaaccagagtcacatttgacaagaaaggactacatgcggcgcaacgattcaacatccagcgatgaccgctccttcaggttgccacctgcaagcccgtacgacaagttcttgaaggcagctggacggtagatccgtgcaatggtgtggaacctgacaaactggtttccaaatctgtatacagaactgtttgcaaattaacatgtcttttaagttgattctttctgctgtttttttgttctctttctgggttttctattctttgagtgtacaaattttcgacaaggtgtacaaatttctgttaccgttgtagggtcccagaataaatggaaagtgtagtgtctgagtgtatgtactttttgcgggccagaaaagaaaatgaccacattgttgtcatatatttttaaaaaaaaaaaaaaaaaaggcccctaaaaaaa

SEQ ID NO: 18468 - DNA, 1679 bp, Triticum aestivum
  Clone ID: PAT_TA_18468
gcgtgcccccacgcgtccgcccacgcgtgcctcctcatgcaaatgatgccaagaagtgataagcagcaggcgcgagggtgatagatcagcgagagccgaacgccgctcgaatctcagcttgattagctccgtggacttgcaaaaaggcggcgcgtttgaggagattcggcggggccctggtgccgggaagatgaacaaggacaggtcccggatctcggcggacggcggcggcggcgacggcctgccgccgcagccctcgcgccgctcgtcgactcccccgccggagtacgacatcagccgcatgccggacttccccaccaggaaccccggccaccggcgcgcgcactccgagatcctcagcctccccgacgacctcgacctttgcgcgcccgggggcggcgacgggccctcgctgtcggacgagaacgacgaggagctcttctccatgttcctcgacgtggacaagctcaactcgtcgtgcgggccgtcgtcggaccaggcggagtcgtcgtcagccgctgctgccggcgggggcgaggcggccagggcgggccacgtgatgaggccgaagcaccagcacagccagtccatggacgagtcgatgtcgatcaaggccgaggacctggtgggggcgccggggattggaggggatgtccactgtggaggccaagaaggcggtgtccgcggcgaagctggccgagcttgctcttgtcgaccccaagagggcaaaaaggatttgggctaatagacatctgcggaactatcgaacgaaaggaaattgctctatattggtgaacttgagctgcaaggtacaaaccctgcagacagaagcaacaacattgtcagcccagttgtcattgctacagagagataccagtgggctaacaagtgagaatagtgaattgaagatacgtctgcagaacatggagcagcaagtccacctacaagatgctctaaatgacaccctgaaaacagaggttcagcggctgaaggtggcaacaggccagatgggcaacggtggggggatgctgatgaactacggcggcatgtcgcaggcgccacaccagttcggaggcagccagcagatgttccacagcaacccggccctgccggccctccgtgcggcgctcctgctgcaccagcgccgcctccatcagcagccccagcagcaccaacagccgatgcgccctcaccaccaccaccagcagcagcagcagcccctgcacccgctccagccgcagcagctccagctccctccgcgccccctccagctgcagcggccgatgtggggcgacgggaagtcgtcgggaagcggcggcatctgaaacaactaggtctggagatgatgatgatgatgataatgcgcaggtgtagtggctttggtgttggcttttttagtttcaattgaacagttgggacgatcgatcacaggtgttgacagtgtcgtgggaagcgtttgtctgtagttgttgaaggaagtcactttgggaattctaggttgaaccttttggttttggtccggtagaagatgcattgttgcgtccagttatgggcatactccatgttgttgttgttgttgttgttgttgttgttaacttaaactcagacactgatgggtttgcccgttgggcatgttagggaaaatgaacaggctaattgtatggctgttaaaaaaaaaa

SEQ ID NO: 18469 - DNA, 1072 bp, Triticum aestivum
  unsure (1)..(1072): unsure at all n locations
  Clone ID: PAT_TA_18469
cgcgccggaccgcagcgcagcgcagtgcggccgtgccatcaatccaccatccaccctcggcgctcaggcgatggcgggccgctcgtcgtcgtcgtggggcccgagccccgcggcggtgacggcgctggtggcgctgctcgggctcggcgtcgcggcatggaatgtcaatctacaccggaatcagtaataaacaatggaggatggtgatggatatagcatgccaaccaatagagatctcatcacaaacacccttctatagggatagaggtaaggaaaaagggttccaattctggtgaccttgtctcactttgcaccatgacgggctccctcgtccatagttaatttactctggctgtgtgaggaggatgcaacagaagctcagcaacaagccgatgtaaagttgctcgaggctaaaaaactagcttcgcagtatcaaaaggaggctgacaaatgcagttcaggtatggatacatgtgaagaagctagggagaagtcagcagagtcgctgctcggtcaaaggaaattaactgctttgtgggaggaaagagctcgggaacttggatggaaacccgggaatgtcaaaccacaccggaatcagtaacgaacactggaggatggtgatggatacagcatgccaaccaatagagatctcattacaaacaccctccctcggtgatagaggcaaggaaaaagggtttcacttctggtgaccttgcctcactttgtgccacgacgagttcccttgtccataggtaatttatattgggtttgtcaccaacgtccatagctgtttgtcagcattgcgttaaaatggccatagaatgacactcatcacctgtaagtctttaaagggtgaccaatttctggggtgttgtttatgaattatggttataaagaaggaattcctccttatttctacaaaatgtgggatggtagttgttaatgattgtcgacatccgtttcccccaattgcaaatgatatttggaaggaaatgggttatatatattaattngagagaattccattaatggtactggaaaaacgtccaaagaaggaancccacaactcccc

SEQ ID NO: 18470 - DNA, 983 bp, Triticum aestivum
  Clone ID: PAT_TA_18470
cccacggacgtcctcctcgatagagccggcaggcgcacaggcgacggccccgagctgcgacagaaggcgccatggggctctgggactcgctcctcaactggctccgaagcctgttctttaagcaggagatggagctctccctggttggcctacagaatgctgggaagacatctctagtcaattcaattgctaccggtggctacagcgaggacatgattccaactgtaggctttaatatgcggaaagtcaccaagggaaatgtcacaattaaactttgggatcttggagggcaacgtagattccggactatgtgggagcgctactgtcgtggagttactgctattttatacgttgtcgatgctgctgaccgggatagcgttccgattgccaaaagtgaattgcatgacctgctgacaaaacagtctttatctgggatccccttacttatccttggcaacaaaattgacaagtcagaggcactttctaagccggcattagttgatcaactaggcctggaatctataaaggaccgcgaagtttgctgctacatgatctcttgcaaggactcggtgaacatagatgttgtcattgattggctcatcaagcattccaagactgcaaattagggtcgctgtgtgtttttgccccttcacttgtgccgagatgaatttagtttgcacatcttcgttctcatgatctggaaggggaaggtaaaaggtgacagccttgtaatctatgttacatcttgggtgtcactgagttacagtatggagtttgacacttgggcgtcaaaatctgtaatgctctgtaaattccttaaatctttgattgttcttttgtgtgcagtcacagacgaacactatggagttcgacacttgggcctcaaaatctgttgtgctctggtgtgcccttaaatctttgattgttcttttgaaaaaaaaaaaaaaaaaaaaaaaaaaaaaaaaaaaaaaaaaaaaaaaaaa

SEQ ID NO: 18471 - DNA, 885 bp, Triticum aestivum
  unsure (1)..(885): unsure at all n locations
  Clone ID: PAT_TA_18471
gtccgatatgttgcagcagtccgcgtgattgtgattctcgtgtcgttgatagcttggagcagtcggttccggtccatctactactcgtgaccgggaatgaaggatcatgtcgctgatagttcaggtataaaatgtatcttctcatatagcattatttctaacggcaagtgtattttggtctacaatatatcagcttcctagtaaggccttactgcaaaaagataataccaactacaatgcggacgcgtgggcggacacgtgggccggtgcgcgcaggggggtgacaggacaacgtgcgctcgccggtgccacccactgactggagaatccaggagcacccactatgacaacctcccgggcatgacatcgctggagaagaaatgagaggaagtggaaggatataaggtagcttctgcagaatccaatatacttggagtccacatccaagatcaaagcatctagctctgttcactcaggttctcaggagtatctcacaaatgagtcatcataggtgagagatggctcatccagccggacgatattattgaccatttaatagcagctgaccaacaattttggtaattagagaagaagacaattccacagaagcaaagccagtgcattggtagggagctaaattagcaggcacgctacctatactaaatgaagatagaagtgaaatttgagggccaacaaatatagatgaagatagaagtgaaatttgagggccaacaaatatgttgtatcgtggatgtccccctttacatcattgttttatgaaatgcactaacgctcctggaaggttgttctgagtatatttgtatatttttttacaacaagtatgatttggtgtgaagttnaaaaaanaaannanannnnnnnnnn

SEQ ID NO: 18472 - DNA, 1033 bp, Triticum aestivum
  unsure (1)..(1033): unsure at all n locations
  Clone ID: PAT_TA_18472
aagctgagctatctggtgtggctgcaaaaaggtacctttttttttttttttttttttttttttttnntagtcgcaaaccactgttatattatttctcatcaagtcgacaatgtgtgcacgatgcgtagtcatctctatgactcagagaatgcgatgaccacggaccattcagaaaaacgcctcatctcaacgcatgttttggcaactaagcataaggcaaacttggtggcgtggtctcaaactcttaacagagaccgtgtgctatacatatagccctattcttcacatgggaatgagatgcccaagaaatggagatccttacaagaaaatgggatgagcgctgatatcagtcgtaatgttaggcaacctaaactgcccaaactaccaagccatttgactagaaacgcaattgcacaggagtctcgatatgctctccttccaacaaaaaacacacgcagctaggattaggtcaatttggagctttgtccttccagcagatcagatccatcaccgccgccatatgctcttacgttgcttcgcttgcttgtgcctctccagttctttgctacgctttcggaactctttagcaacgtcatgaccttgataggaagcaagcactgcccgaatatcagaaggccttgctatggcaagatactcaagaaatggaatcagatccagcaactcagtgtcatcagtttcaagtttccagggtttgactgtaacacaattttcaggttgcaggcaagattcaagagcatgtgcgctgacgtaaagaacttgcgcaggatttctgttcaactttgacaaatcccgataatgtttaccatcttggtacttagttgcaggccttgataatttgcgtatctgacccgttgagtccaacctttcaactacagggtccacatacatttgcagttgatcagaatatacaacaacttcatacatgtttgccatatgttgcagaaaagcttcaactcctggtctcttgaatgtcttccaacctctctcacgctgccaatcattgcatacaagc

SEQ ID NO: 18473 - DNA, 1178 bp, Triticum aestivum
  Clone ID: PAT_TA_18473
cagccgcctcgctgtcgccgtcggctgtgggcacccgaaatgctcagcctcggcgcccatcccttcttgcttccttcctcctccccactccacactcgcctccgatcgagacccctctgctcacccaccagctccgcgccgaccgtctcctcctcctcagcgccgccctccctccgcttccgcttcggcttcccccgccgtggctgcgccgccgaccggagccggagggcgacgacgatggccgcggtggtctccccgggggatggcggcctggtccacgacctcgtgtcctcgggcgtcaccgcggccatcgccctcggcctcctccgcttcttcgaggagctcgccaagcgcggcgtctgcgaccagaaactgaacaggaaacttgtgcacataactattgggatggtattcttgctcttttggcctcttttcagctcgggaaggtatgctcctttctttgctgcacttgcaccagggattaatattataaggatgcttctattggggctaggaataatgaaaaatgaagctatggtcaaatcaatgagccgatctggagaccacagggaacttctcaagggaccactgtattatgctactactataactttggccacttctgtattatggagaacatctccaattgctatagcacttgtctgcaacttatgcgctggagatggtatagcagacgtagttgggagacgctttggaaaagaaaagcttccatacaaccccaacaagtcatatgcaggaagcatagcgatggctgtcgctggtttcttggcttcaattgggtacatgcattacttccacagtttcggtctcatggagaaaagctggtacatgaccttgggcttccttgtggtctccgtagccgcggcacttgtagagtcacaccccatcagcactgaactggatgacaatttaaccgttcccttgacatcattcctagtcggtagcctcattctctgatgtttagcgccaaaggaagaatactgtgacgtttcttttcgccacgtgaacttccgacatgtaacaagattatcgacaagcatgcgatatttttgttgttgtaaatgctgctgaaccataggaacagttttctagtgtcaaaaaacgtcttacattatggggcggagggagtaactatttatccagccgtttacatactg

SEQ ID NO: 18474 - DNA, 1188 bp, Triticum aestivum
  Clone ID: PAT_TA_18474
atcagcctatctgggaaacctgggaactttctccttccagagctccggcagctagatccacccagcttatctatctccatcgccatcttgctctgcaccgggtagcttagcttgtcctctgcgtgtgggaggtagttgaagatggggcgcggcaagatagtgatccggcggatcgacaactccacgagccggcaggtgacgttctcgaagcggaggaacgggatcttcaagaaggccaaggagctgggtattctctgcgatgccgaggtcggtctcgtcatcttctccagcaccggccgcctctatgagtacgccagctccagcatgaagtcagtgatagatcgatatggacgagccaaggaggagcagcaacttgttgcaaaccccaactcggagcttaagttctggcaaagggaggcagcaagcttgagacaacaactgcacaacttgcaagaaaatcatcggcagttgacgggacaagatctttctggaatgggtgtcaaggaactgcagactctagaaaatcaactggaaataagcctgcgttgcatccggacaaaaaaggaccaaatcttgattgatgagattcatgaactgaatcacaaggggagtcttgtccaccaagaaaacatggaattatacagaaagattaacctaattcgtcaagaaaatgctgagttacaaaaaaagctctctgagacggaggcagcgactgaagttaaccgagattcaagaactccatacaattttgcagttgttgaagatgccaatgtttctgttgatcttgaactcaattcaccgcagcaacaaaatgatgttgagcatactgcgccccctaaactaggattgcaactacatccatgacgatcgtggggtatgggattactcttgttgttattattctcaagggatacaattcagagcagccagaatactcttggttgtaaagaacctaaacccatagcaagacataagtggttcgcatgacgaccgattgataaacggtagtgtaaatctgttacaaataaaatgtactccatggaaggattaatctgttgtgcaaatggttgtattagaactatttaacacattctgcgagtttgttcaactgcatgagcggctagcttattgacaaaaggtgtgaagtgtggattgagcaaaattcagttaccacttttttctgtcttc

SEQ ID NO: 18475 - DNA, 492 bp, Triticum aestivum
  Clone ID: PAT_TA_18475
ataccttctcttctttatctttagttttatctacttatcaatagtatctaccggctcgaactcgaatttgatcgccttccatacttcacaagctgcggctagttcaggactccatttgacgtatatttcccgacaaaccggttacactaagacccacagaagcacgtatgggctcgggaaaggggtcccccgaatattgggtatccgttgttaaacctggtcgtatactttatgaaatggggggagtatctgaaactgtagctagagcagctatctccatagctgccagtaaaatgcccatacgaagtcaatttattcgattagagatatagaaccctaaaaggggtatggaagataaaaaaaaaaatgcccggtttttctttctggaaagacaatatttctttcatccttttgcattgaaataacaaattgaaatcaaaataatatgattcaacctcagacccttttaaatgtagcagataatagtggagc

SEQ ID NO: 18476 - DNA, 677 bp, Triticum aestivum
  unsure (1)..(677): unsure at all n locations
  Clone ID: PAT_TA_18476
ggactcactaccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttggtatgcctgtggttttccatccaaattatcactgaaattgcttgcactgtttggaatgtcttgcttaattgttttgctgctacataaagacccctttgccgaggcgaatgctggggacgctggtgcagctgccggatcaaaagactacgttcatgtacgcatccagcagcgtaatggtcgcaagagcctgaccactgtccagggcctgaagaaagagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgaacaactgccagctccatatcagagtctacatgcaaagcagctatatattggtggtgcagtatatttagttgtgtgctagcgcaagcnnnngttaccagcttgcgcgctctgagtat

SEQ ID NO: 18477 - DNA, 818 bp, Triticum aestivum
  unsure (1)..(818): unsure at all n locations
  Clone ID: PAT_TA_18477
ccccgggctgcaggatcggcacgagggatgaaccgatgttgaaatctttgtgctatagggtatagtttaatgagatgtgtaggaagactagttgatgagtaacaatatgatttgaggctaacacttttttgtttctgaacatctgatttagtacgaggttgataattgataggtacaagacggtctttgcaagacatcaggctctgctccagctattgatatccattttcaggtgaaaagaaatgtctaagatggtaacttagtatccaaggttatgttttggggaacaatttgttatcaaaaacatctctgctaaatttgtgatcatgtggagcacatttgatttcgtacaaaatacaggtcacgggattctgaaagttctatcggacgaaccaatgctagtgcaatatagttgtattactgtttacagatgtgatcgtcccggttgtagacttaacatgattttaaatagctaaactgaagtagctagctcggtatgcacatatagttaggaaactgactagctatctgacatgtgttccctatacatttaatgtgctccgttagctactaactggttccagctgatttacttcgttttgtacacaagaaatactatattattatagataaatcgcaaaacaaatgataatgcaatatttgcccatccccttcttatatagctgattggttcacagagataacaatcttgtcgtcanaactgccctgaagaactgagaagtgtcatggaacttacatatttcttttttatagaactgttgtttgctctataaataccacattatcttgcaattctt

SEQ ID NO: 18478 - DNA, 563 bp, Triticum aestivum
  Clone ID: PAT_TA_18478
aactgcctttgacccctttgccgaggcgaatgctggggacgctggtgcagctgccggatcaaaagactacgttcatgtacgcattcagcatcgtaatggtctcaagagcctgaccactgtccacggcctgaagaaggagttcagctacagcaagatcctcaaagacctcaagaaagagttttgctgcaatggtacagctgtccatgacacagaacttggacaggtcattcaactgcagtgtgatcagaggaagaacgtctcacacttacttgtccaggccggcattgtgaagaaggaacacatcaagattcatggtttctgaacaactgccagctccatatcagagtctacatgcaaagcatctatatattggtggtgcagtatatttagttgtgtgctagcgcaagcaggcgttaccagcttgcgcgctctgagtatacggataatctagcatagcccacctctctgcgtgtatgcttgttaccctcgtgttgaaactttgttaggagcaccatcgttagatggctagttaccctctgccatcaagggtgaataataatata

SEQ ID NO: 18479 - DNA, 465 bp, Triticum aestivum
  Clone ID: PAT_TA_18479
ccacctccaaccacgtacgccggtggccacacgcacacttgcgccggagctcagctcaggtgaggcgttccaatggcggcctcgccgacgggggtagcgtgccccgtctacccgtggccgagcgacgcggcgcagcgcggggccaaggtgttcatgcagagcgactgcgcggcgtgccactccgcgctcccctacgccggcctccggggcgcggcggtgccgggacaggacgcgggagccaggacggccgagatcctcgtcgccgaggaggcgcggccggccggggtgacgacgacgccgctccatggcggcgccgccgcgcagacgccggacctcgccaccgtcgccacaagaatccagggcgggctgcggtgcaatctgtactccaccgggacggcggcgcccgtcagggcgatgctcgccggcggcgccgcggcgtgccaggagctgaagaagagccccgtc

SEQ ID NO: 18480 - DNA, 534 bp, Triticum aestivum
  unsure (1)..(534): unsure at all n locations
  Clone ID: PAT_TA_18480
gagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcaagatcccaactgccttcgatcccttccgctggaggccaatgctggggactctgggtgcggcagcagggtcaaaggactacgtacacgtgcgcatcccagcagcgtaatggtcccaagagcctgactaccgtccaaggattgaagaaggattcaactacagcaagatctcaaagattcaagaaagattctgctgcaatggtacaatggccaagaccaaaacttggacaggcattcaactccaagggtgatnagaggaaaaactctccaatttcctcgtcaaacccggattttnaaaaaggacacnccagatcaaggttctgacaaccccggtcaatacaaacaacctnatcanggcaacttataaaanaaaccgaggggncaaca

SEQ ID NO: 18481 - DNA, 894 bp, Triticum aestivum
  Clone ID: PAT_TA_18481
tcatgtctgatcttgacgttcagatcccaactgcctttggtatgcctgtggttttccatccaaattatcactgaaattgcttgcactgtttggaatgtcttgcttaattgttttgctgctacataaagacccctttgccgaggcgaatgctggggacgctggtgcagctgccggatcaaaagactacgttcatgtacgcatccagcagcgtaatggtcgcaagagcctgaccactgtccagggcctgaagaaggagttcagctacagcaagatcctcaaagacctcaagaaagagttttgctgcaatggtacagttgtccaggacacagaacttggacaggtgtgttgaaacaacgagcaaactcgtcatcccttatcatgttcatttctttcgcaattttctcatgcaagctagttgtcttgatcattgttgctcttttccattccaggtcattcaactccagggtgatcagaggaagaacgtctcaaacttccttgtccaggtaaacatctctcttcatcttatgctcggtatggttgcagttcacaaacatggatgaagatgtctaatatgatgtgtcgacacaggccggcattgtgaagaaggaacacatcaagattcatggtttctgaacaactgccagctccatatcagagtctacatgcaaagcagctatatattggtggtgcagtatatttagttgtgtgctagcgcaagcaggcgttaccagcttgcgcgctcctgagtatacggaaaatctagcatagcccacctctctgcgtgtatgcttgttacccttgtgttgaaactttgtaaggagcaccatcgttagatggcttgttaccctctcccatcaaggttgaataataatatatgctttcttaaaaaaaaaa

SEQ ID NO: 18482 - DNA, 827 bp, Triticum aestivum
  Clone ID: PAT_TA_18482
cgccccgcctcctctcccccctgttgatggacactggaccttccgtcgtcttaccctgtccaagaccaaactcgtcttctcatctgaagccgatctagatcttgctctctgaccggttcccaggcgggcgtccctctgcttcctgtcccttgcactttgacgggtacccaggtgcgtgtccctgttcttttgctccgacggccagctgcccagaagttcccctgcttcctcttccgattgggcaagccaaacggcacataactgcgagcatggtagcgtgtgaaggtacaagacggctttggcaagacatcaggctctgctccagctattgatatccattttcagcacttgaacccgcttggatcacggcaagacagatagaagcaggatgaagagcaataacatgatatgcacgtcgtggtggaaaaatatgggaacatattcttacgggtggtcatggtctgctggttgatgggcacaaacaagtaattgaggctctcgctcaaggtcttaatcagagttgtagatattgtagatacttggcctgaccaactcaaggtcttgacacccctcttaatcagaggtgtaaatattttgccttactagagtagcagataattgtcctgaccaacaacacatgtacatgctgacttaggtgttctgctagctgtacgaaacattagctatgtttacttgaattctggcttgaaattgaccatgagtctgtaattgaacaagaatctgatgtgtacattgaattttagcagcaatttataattttgaattatggcacagaatttaattattggaaaaaaaaaaaaaaaaaa

SEQ ID NO: 18483 - DNA, 654 bp, Triticum aestivum
  unsure (1)..(654): unsure at all n locations
  Clone ID: PAT_TA_18483
gatttaatgaaaattgataaatcatttaatataattgctatgcttagtcccaaaagaaccagatttcgcaaacaacatagaggaagaatgaaaggaaaatcctgccgaggcaatcgtatttgttttggtagatatgctcttcaagcacttgaacccgcttggatcacggcgagacagatagaagcaggacgaagagcaataacacgatatgcacgtcgtggtggaaaaatatgggtacgtatatttcccgacaaaccggttacactaagacccacagaaacacgtatgggctcgggaaaggggtcccccgaatattgggtatccgttgttaaacctggtcgtatactttatgaaatggggggagtatctgaaactgtagctagagcagctatctccatagctgccaagtaaaatgcccatacgaagtcaatttattccgattaagagatatagaaccctaaaaggggtatggaaagataaaaaaaaatgccccggttttcctttctgggaaangacaatattccttcaaccttttgcattgaaataacaaattgaancaaaataatatgatcaactcaagaccttttaatgtncaaatatantggactcnnaaattgantgtatcnaancataggactgctggaacaaccatat

SEQ ID NO: 18484 - DNA, 584 bp, Triticum aestivum
  Clone ID: PAT_TA_18484
cccaaagaggaggaagaacaccaaggactcactaccagcgcctctccgcgatccaaatcctcccgggaaagatcttggttgatctcttcctcctcgaccgcctcccaggttcttggtgcagcttttgccagtctcagcaggagatttcatgtctgatcttgacgttcagatcccaactgcctttgacccctttgccgaggcgaatgctggggacgctggtgcagctgccggatcaaaagactacgttcatgttacgcatccaagcagcgtaatggtcgccaagagcctgaccactgtccagggtctgaagaaggagttcagctacagcaagatcctcaaagacctcaagaaagagttttgctgcaatggtacaagttgtccaggacacagaacttggacaggtcattcaactccagggtgatcagaggaagaacgtctcaaacttccttgtccaggcccgcattgtgaaagaaaggacacatcaagatcatggttctgagcactgcagctcatatagagctcatgcaagcagtattattgtggtgagatattagtgtggctacctgcagcgtacagctgccgct

SEQ ID NO: 18485 - DNA, 829 bp, Triticum aestivum
  unsure (1)..(829): unsure at all n locations
  Clone ID: PAT_TA_18485
tatggaagataaaaaaaaaatgcccggtttttctttctggaaagacaatatttttttcatccttttgcattgaaataccaaattgaaatcaaaataaaaaataatatgattcaacctcagacccttttaaatgtagcagataatagtggagctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagagttcaaatgcgaagacggtataataatccgctatgatgacaatgctgcggttataattgatcaaaaaggcaatccaaaaggaactcgagtttttggcgcgattgccgaggaattgagagaattgaattttaccaaaatagtttcattagctcctgaagtattataaatactagtaggcgaaattgagaccaaagaattaatttagtagattgtgttttacgtatatgttttaaaatccaaaatgaaaaaaaaaaaaaagaaaacatgttgattatagaaaaattaggaggaacctagaattagagtcttatgggcaaggacactattgctgatttactaacctctataagaaatgcggacatgaataaaaaaggaacagttcgagtagtatctacaaatattaccgaaaacattggtaaaatacttctacgaaanggntttattgaaagtgttcggaaacatcaggaacgtaacagatatttcttggttttaactgtgcgacatcaaaagagaaagac

SEQ ID NO: 18486 - DNA, 1273 bp, Triticum aestivum
  Clone ID: PAT_TA_18486
gatttttttcttttttccatgatcattattctatttattctgacctccgtacttcgatcgagatattggacatagaatgccactctttaaaaaggaaaaaaggagtaatcagctgtgacacgaaaaaaaacgaatccttttgtagctcatcatttattggcaaagatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtgcctactcggcatttcacgagttatgaaaatgcaagaaaggatactaaatctcgtcgttaactgaattctgaatagaaagattaagaagaaaaaaaagattcaaaataaagtaaaggtaggcggggaataaccttatttatgacaagtttcaaactagtaaagtatatccctaggataaagaagaagaaaagtgggctaaggaaactcgcaaggaaagttccaaccgatcgtctacttaagttcgagagagttttcaaagcacaaaaacgtatccctatgtctgttttcaaagcacaaagagttcttgacgagattcgctggcgttactacgaggaaactgttatgatactgaacctcatgccctatcgagcatcttatcccatcttaaagttggtttattcggcagccgcaaatgctactcattatagggatttcgacaaagcgaatttatttattactaaagccgaagtcagtaggagtactattatgaagaaattcagacctcgagctcgaggacgtagtttccccataaaaaaaagcatgtgtcatataacaattgtactaaatatagtaaagaaatcttaagatttcgattcccagtaaaaaaaaatatagaatagaaaaatatgggacaaaaaataaatccactcggtttcagacttggtacaacccaaaaacaccattccttttggttcgcacaaccaaaaaattattcggaaggtctacaggaagataaaaaaataagggattgtatcaagaactatatacaaaagaataggaaaaagggctcgaatagaaaaatagaatcagactcaagttccgaagtaattacacataatagaaaaatggactcaggttcaagttccgaagtaattacacatatagaaatccaaaaagaaatcgatacgatccacgtcaaaatccatattggattccc

SEQ ID NO: 18487 - DNA, 804 bp, Triticum aestivum
  Clone ID: PAT_TA_18487
cttcagtgtgcttccacgtcatcccaatccagagcccaacgagctccgccacactcccaccgtccccacgacccactcaccacaccacatttatctgcagagagtgagccgcgcagcagcagcgcataatcacagacatatccacctccaaccacgccggtggccacacacagacacactttcgccggagctcaggtgaggtgttccaatggcggcctcgccgacgggggtcgcgtgcccggtctacccgtggccgagcgacgcggcgcagcgcggggccaaggtgttcatgcagagcgactgcgcggcgtgccactccgcgctcccctacgccggcctccggggcgccgcggtgccgggccaggacgcgggagccatgacggccgagatcctcgtcgcggaggaggcgcggccggccgggatgacgacgacgacgctccatggcggcgccgccgcgcagacgccggacctcgccaccgtcgtcacaagaatccagggcgggctgcggggcaacctctactccaccgggacggcggagccagttagggcgatgctcgccggcgcgtgccaggagctgaagaagagccccgtgtggctgcagtttgcccaggccttccaggcggcttgatgggatggacccatctccagcgacacgacctgctatgcccaagcttgcctcatctctgtgtccaatatgtgtctgtaacatatgtataaatcacatcacactgcaccttgtgctggatcaagtagcatcgaaataaagcactcctgtgcagccgttccatgttaaaaaaggggggg

SEQ ID NO: 18488 - DNA, 799 bp, Triticum aestivum
  Clone ID: PAT_TA_18488
ctcgtgccgaattcggcacgaggtgagccgccgcagcagcgcccgctcgcagacacgctatccacctccaaccacgccggcggccacacgcacagacgcacttgcgccggagctcagctcaagtgaacgttccaatggcggccgcgccgacgggggtagcgtgcccggtctacccgtggccgagcgacgcggcgcagcgcggggccaaggtgttcatgcagagcgactgcgcggcgtgccactccgcgctcccctacgccggcctccgcggcgcggcggtgccgggccaggacgcggtagccaggacggcagagatcctcgttgccgccgcggccacggaggaggcgctgccggcgacggggatgacgccgacccagtacacgccggacctcgccaccgtcgccacaagaatccagggcgggctgcggtgcaacctctactccactgggacggcgacggcgccggcgcccgttagggcgatgctcgccggcggcgccgcggcgtgccaggagctgaagaagagccccgtgtggctgcagtttgcccaggccttccaggcagtttgatggggctatgccaaagcttgcctcatttctgtccaagatgtatgtctgtaacatatgtataaatcacatcacattgcaccttgtgccggatcaagcagtatcaaataaagcactcctgtgcagccgttccatgtcaaatgtacacatgcattccagacaggccgtgagctcatgttgtcttgtgttgctcataggccatagcagcctatatatattgtgacagtaatgccaat

SEQ ID NO: 18489 - DNA, 760 bp, Triticum aestivum
  unsure (1)..(760): unsure at all n locations
  Clone ID: PAT_TA_18489
ccaacccaaagaggaggaagaacaccaaggactgactgccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgcccgaggcgaatgctggggacgctggtgcagctgccggatcaaaagactacgttcatgtacgcatccagcagcgtaatgggtcgcaaagagcctggaccactgtccagggcctgaagaaggagttcaagctacaagcaagatcctcaaaagacctcaaagaaagagttttgctgcaatggtacaagttggtccaaggacacaagaacttgggacaggtcattcaactccaagggtgattaagagggaaagaacgtctcaaaacttccttgtccaaggccggattgtgaagaagggacacatcaagattcaagggttctgaacaactggcagctccatatcaagatctacatgcaaagcaactatatatggtgggcagtaaattagtgtgtgctacgcaagcagggttacaacttgcgcctctgaatatacggaaactacataccactctcgcgtgtatctgtaccctgggtgaaacttgtagganacacgtanatggnntacctcccacaggtgatatataagcttctaaaaaaaaaggggncgtccatccccaatggtctt

SEQ ID NO: 18490 - DNA, 498 bp, Triticum aestivum
  unsure (1)..(498): unsure at all n locations
  Clone ID: PAT_TA_18490
gaattcactaagtgatttcgagcggccgcccgggcaggtctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagagttcaaatgcgaagacggtataataatccgctatgatgacaatgctgcggttataattgatcaaaaaggcaatccaaaaggaactcgagtttttgggcgcggattgcccgaggaattgagaagattgaattttaccaaaataagtttcattagctccctgaagtattataaatactaagtaggcgaaatttgagatcaaagaattaatttaagtaagattgtgttttacgtatatgttttaaaatccaaaatgaaaaaaaaaaaaaaaaaactcgagggggggcccggtanccaaattc

SEQ ID NO: 18491 - DNA, 860 bp, Triticum aestivum
  Clone ID: PAT_TA_18491
cgtcatcgcaagaaacccagaggcgtcctcctccgcccgtctataaattcccctccttccctcgtctttatataggaggcatcaaacccaaagaggaggaagaacaccaaggactcactaccagcgcctctccgcgatccaaatcctcccgggaaagatcttggttgatctcttcctcctcgaccgcctcccaggcttttgccagtctcagcaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcagtatatttagttgtgtgctagcgctagcaggcgttaccagcttgcgcgctctgagtatacagaaaatctagcatagcccacctctctgcgtgtatgcttgttaccgttgtgttgaaactttgtaaggagcaccgtctttagatggcttgttaccctctcccatcaaggttgaataatatatgctttgttaagcgtggtatccttcgaaaaaaaaaaaaaaaaaaggccccta

SEQ ID NO: 18492 - DNA, 837 bp, Triticum aestivum
  Clone ID: PAT_TA_18492
agcgtcctcctccgcccgtctataaattccccgtctttatataggaggcatccgacccaaagaggaggaagaacaccaaggactcactaccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcggtatatttagttgtgtgctagcgctagcaggcgtcaccagcttgcgcgctccgagtatacagaaaatctagcatagcccacctctctgcgtgtatgcttgttaccgttgtgttgaaactttgtaaggagcaccatcgttagatggcttgttaccctctcccatcaaggttggataataatatatgctttctgaagcgtggtatccttaaaaaaaaaaaaaaaaaaaaa

SEQ ID NO: 18493 - DNA, 881 bp, Triticum aestivum
  Clone ID: PAT_TA_18493
ctcgtgccgaattcggcaccagatcaaacccaaagaggaggaagaacaccaaggactcactaccagcgcctctccgcgatccaaatcctcccgggaaagatcttggttgatctcttcctcctcgaccgcctcccaggttcttggtgcagcttttgccagtctcagcaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattggtggtgcagtatatttagttgtgtgctagcgctagcaggcgttaccagcttgcgcgctctgagtatacagaaaatctagcatagtccacctctcttgcgtgtatgcttgttaccgttgtgttgaaactttgtaaggagcaccatctttagatggcttgttaccctctcccgtcaaggttgagtaatatatgctttgttaagcgtggtatccttcgtatcatccattttggtttgacattcgctgttccagccggtgtcgatacatctagttttgaaccgtatctgcttgatgactaattaagttgcc

SEQ ID NO: 18494 - DNA, 809 bp, Triticum aestivum
  Clone ID: PAT_TA_18494
cgtccgcccacgcgtccgcggacgcgtgggccaacccaaagaggaggaagaacaccaaggactgactgccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggcctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgaacaactgccagctccatatcagagtctacatgcaaagcagctatatattggtggtgcagtatatttagttgtgtgctagcgcaagcaggcgttaccagcttgcgcgctctgagtatacggaaaatctagcatagcccacctctctgcgtgtatgcttgttacccttgtgttgaaactttgtaaggagcaccatcgttagatggcttgttaccctctcccatcaaggttgaataataatatatgctttcttaaatgtggtgtccttcgtatcatccattt

SEQ ID NO: 18495 - DNA, 3950 bp, Triticum aestivum
  Clone ID: PAT_TA_18495
cccacgcgtccgaaccgatcgtctacttaagttcgagagagttttcaaagcacaaaaacgtatccctatgtctgttttcaaagcacaaagagttcttgacgagattcgctggcgttactacgaggaaactgttatgatactgaacctcatgccctatcgagcatcttatcccatcttaaagttggtttattcggcagccgcaaatgctactcattatagggatttcgacaaagcgaatttatttattactaaagccgaagtcagtaggagtactattatgaagaaattcagacctcgagctcgaggacgtagtttccccataaaaaaaagcatgtgtcatataacaattgtactaaatatagtaaagaaatctaaataacctttagatccatctaagatttcgattcccagtaaaaaaaaatatagaatagaaaaatatgggacaaaaaataaatccactcggttttagacttggtacaacccaaaaacaccattccttttggttcgcacaaccaaaaaattattctgaaggtctacaggaagataaaaaaataagggattgtatcaagaactatatacaaaagaataggaaaaagggctcgaatagaaaaatagaatcagactcaagttccgaagtaattacacataatagaaaaatggactcaggttcaagttccgaagtaattacacatatagaaatccaaaaagaaatcgatacgatccacgtcataatccatattggattcccaaatttattaaagaaaaaaggagcaatcgaagaattagagaaagatctacaaaaggaaattaactctgtaaaccagagatttaatatttctatcgaaaaagtgaaagaaccttatagacagcctaacattcttgcagaatatatagctttccaattaaaaaatagagtttcattccgaaaggcaatgaaaaaagccattgaattaactaaaaaagcagatataaggggagtaaaagtaaaaattgcgggtcgtctcggaggaaaagaaattgcacgcgccgaatccattaaaaagggtagacttcccctccaaacaattcgcgctaaaattgattattgctgctatccaattcggactatctatggagtattaggtgtaaaaatttggatattcgtagacgaagaataagtaatcttgtcttcggattctgtccattgatagaatcaaaaatgacaagagacttttttcctgaaatccctgcaaaagaagaaattatacctctttctataagatttaatgaaaattgataaatcatttaatataattgctatgcttagtgtgtgactcgttatttttttcttttttttaagaaaaaaacttagtaattatagaaaattaactaataaccaacctattgcttcgtattgtcgagatcctaactaagaaacagtcactatatgaataaatacctctatcataaatgagtagatgtgtcatatagttgtagcaactgcaattttttctctaaaaaagaaaagggattctaggttgtgaagcaaaactaaagggatgtggataaagggagggatgatagaaagaaggaagaggaaataaataagatataggattccactatgtatggtctatgaattacatcataaaaggcaatgtgataaagcatcaatataataaaaataatagagaattaaaaattttaacttgaaacaagaactacaaatttaaagcaataataaagagccgcccgggttaataaaactgagaaaattaactcggaaagaaattttttggaagctccgttgcgggattcagacctaaccattcaaggagaagcagtgggaacgacagaacctatgattccataggattttattgaaaagaatcctaacacttcattgggtgggatggcggaacaaaccaaaaaaattgtcttatttggtaagtttataaattaacaaataagacaggaaagagtaaatattcgcccgcgaaattcttattgaattaaaatactttaccgcgattcaataagagtcaaaataagaatttttttaagaaggattacattatctataaatatagaatttagataaatatacacacacatctggatatattctagatcttcttttttgactatatattatatttttctgttttaacaaattcaatataaaaaaaaccgaactttttctattatctattaatgtgtatctatccgtaccgtaatattttggaatattatgaattagataaatttacatgctttctcattccattcgcgaggagctggatgagaagaaactctcatgtccagttttgcagtagagatggaactaagaaagagaaccatcgactataaccccaaaagaaccagatttcgcaaacaacatagaggaagaatgaaaggaaaatcctgccgaggcaatcgtatttgttttggtagatatgctcttcaagcacttgaacccgcttggatcacggcgagacagatagaagcaggacgaagagcaataacacgatatgcacgtcgtggtggaaaaatatgggtacgtatatttcccgacaaaccggttacactaagacccacagaaacacgtatgggctcgggaaaggggtcccccgaatattgggtatccgttgttaaacctggtcgtatactttatgaaatggggggagtatctgaaactgtagctagagcagctatctccatagctgccagtaaaatgcccatacgaagtcaatttattcgattagagatatagaaccctaaaaggggtatggaagataaaaaaaaaaatgcccggtttttctttctggaaagacaatatttctttcatccttttgcattgaaataacaaattgaaatcaaaataatatgattcaacctcagacccttttaaatgtagcagataatagtggagctcgaaaattgatgtgtattcgagtcataggagctgctggtaatcagcgatatgctcgtattggtgatgttattgttgctgtaatcaaagacgcattgccccaaatgcctctagaaagatccgaagtaattcgagctgtaattgtacgtacatgtaaagagttcaaatgcgaagacggtataataatccgctatgatgacaatgctgcggttataattgatcaaaaaggcaatccaaaaggaactcgagtttttggcgcgattgccgaggaattgagaggattgaattttaccaaaatagtttcattagctcctgaagtattataaatactagtaggcgaaattgagaccaaagaattaatttagtagattgtgttttacgtatatgttttaaaatccaaaatgaaaaaaaaaaaaaaagaaaacatgttgattatagaaaaattaggaggaacctagaattagagtcttatgggcaaggacactattgctgatttactaacctctataagaaatgcggacatgaataaaaaaggaacagttcgagtagtatctacaaatattaccgaaaacattgtgaaaatacttctacgagagggttttattgaaagtgttcggaaacatcaggaacgtaacagatatttcttggttttaactttgcgacatcaaaagagaaagactagaaaaggaatatatagaacaagaacctttttaaagcgtatcagccgacccggcttacgaatttataccaactatcaaggaattcctaaagttttgggtggaatgggaattgctattctttctacttctcgaggaataatgacagatcgagaagctcgactaaacagaattgggggagaagtcttatgttatatatggtaatcgccccgcctatagtgctcgaattctatctcgcccttcctatttttaaaataaaaatagaaaaataggagaaaaaaaatatgacagaaaaaaaaaaaaaaaaaaaaaaaaaaactcgagacacctcggccgcgaccacgctaatcactagtgaattc

SEQ ID NO: 18496 - DNA, 784 bp, Triticum aestivum
  Clone ID: PAT_TA_18496
attcggcacgagggggaagagcaccaaggacttcccggcgcccgttcaggatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcatttgtgaagaaggaacacatcaagattcatggtttctgagcgaccgccgggtccatagcaagccctgcatgcaaagcagctatataatctgaggtggagcatatctatctggctgtgtacaagcaggcctactactacgcctgcgcgttctcctatactacacataacacatagcccccctccctgcgtgtatgcttgttaccgttgtgtcgaatcttgtacgaagctccatcgaacttcgatggcttgcttctttatcagaacaagattgaataaacgatatttggtatgctgtgtgtcaaaaaaaaaaaaaaaaaaaaaaaaa

SEQ ID NO: 18497 - DNA, 753 bp, Triticum aestivum
  Clone ID: PAT_TA_18497
tgatggacttcgacggcggcattggcgatcagagtgagatgtgggactggcagagtcaagagtttgatttgcagaaggatctgttaccagtcgcatgtacctccctgtgggctgaagcaaaccacaatgaggttgattcttggagcctgttcgatgagcaaaccccaattaaagaatgtacagacatagatttgcccttctgtgatataggagatattattatcaaggactttgatgaaggaaaggaaaccttacaagctaaacgaaggcgtatgctgcagttctgtccagacaattctgagatcgactgttctctgacagatgggctcttggaaaatctgcaagtggatttggatttctctagtgacgagcatttgttacagtgtgatgggacagaggaactacctgaacaatggctggttgattgctcacaagatagtgagaatcgttcgcccccggaagaagtgaaaagtcctagtgctgctgtggaagtaaatatctctgttcttcagaattcgttggtcgagctcgaggagcagcctatcatgaaagttgagaagaaacctccgcaggctaaacctacacctctgaaagctggaagaagcgtcttcagagcatagaagctgaaagtggcatcggtggcctacccattcgagctcatcaagccgtgcgggttccgcggagacaccaccctgagggacataaaccggaagatcctcgctcctccctcgtacaggatcaagcacaagatcg

SEQ ID NO: 18498 - DNA, 1028 bp, Triticum aestivum
  Clone ID: PAT_TA_18498
gtgccgagaatgcgttattaaacctatttccagaaacataatacaggataattacattgtttaatttacagttgaagatccctacacatactccacaacatgtgcaatgcactctttgggttccaccccccagttcccgagatggcttatataaacctatttccagaaacgtaatacaggataattacattgtttaatttacagttgaagatccctacacatactccacaacatgtgcaatgcactgattgggatgaaccacttcttcaacagatccatcagttaattgcatgaattcagtggaattctttgggcttgctgcttgaggtttttccacatttcatctttaaatatgtgcaacagatgatgtcattatgtattagccatggtatattttcgaacaagctgctcatataatggaagatgattcttagaaacgaagaccctgaacccttcaagaagtgtgagtcgccctggagaagaaaacagtttcgctattgcttctagtgagtctttgatgtgcatggttttcaattttaaggccttcataaattcaacatccgcgcaatcgtgtgcagtactgagcttttctcgagccagcttcaagaaggccggtccagtagtagattcctggcctccacatctttcttgaatagcctcattcttttcacatgcttgttcaatggtacttctttttgatggaggtgtagattgttgacctcggtttccagtcaaagctctcgactcaacattatgtttcaattgtgaagagacatctgctattttagccttcttaagcctcatagactttaaggtatgttccttcaattgtccatgcatggtcgcattatcgatcaaatcaacaacctgagaattctgagaaaattggccctttgaggatgtgagctgtgaaaaagtggaacagccatgttttatatgaagggtagtgcgattggcaagagtgatctgggtaaacttcatattgttggttttttttggtggttgcattcaatgatcctgtagtttcc

SEQ ID NO: 18499 - DNA, 997 bp, Triticum aestivum
  unsure (1)..(997): unsure at all n locations
  Clone ID: PAT_TA_18499
cggacgcgtgggcggacgcgtgggctcaaacttataaccctagagccgctcccctcctcggcggcnaagcgctcgccacccgagtcgccagtccccaatccctccagggaggcgcttccgcgaaggtccgctgctgcggtcatggctcgcgtctacgtggggaatctggatccgcgcgccactgcgcgcgagatcgaggacgagttccgcgtgtttggggttctcaagagtgtgtgggttgctagaaagccaccaggatttgctttcattgactttgatgagaccagggacgcaaaggatgcaattcgtgaattggatggtaagaatgggtggagagttgagctgtcaaccaaatctagtagtggccgtggccgagaacgtgaacgctctggaggttctgatatgaagtgctatgagtgtggtgaaagtggtcactttgcacgagaatgtcgcctacggattggttctgggggcctgggtagcggaagacgccgcagccgaagcccgaggcaccgcagccgaagcccgaggcaccgcagccgtagccgtagccgtagcccaagataccgcaggagcccaagctatggcagaaggagctacagcccacgggatcggtctcccaggaagcgaagttacagcagatcaccaccgcctccccgggcgcggagtatcagcaggtctccaccgcctgcccttgcgcgaagcatcagcaggtctccgccgcctgcccgtgggcgaagcaccagcaggtcaccgccgcccgcccgtgcgcgaagcatcagcaggtcaccaccgcctcctcgcgccataagcatcagcaagtcaccaccgcctgcccgtgaacggagctatagcaggtccccagcgcagccaccccagcgcgaggagtccccttatgctgataacgcgtgagcacttggttccacaatgctggaagtgttggggggtgggggcctccgcttgtttccttgaatgttttggtatgactattgaatgg

SEQ ID NO: 18500 - DNA, 1342 bp, Triticum aestivum
  Clone ID: PAT_TA_18500
ggtcgacgcgtggctcaaaccctaagacgccgttcccctctacgccccagaagcgctcgccaccccgcggcggctcaaacttaaaccctagagccgctcccctcctcgcctcctcagcgctcgccatccgattcgccagtccccaatccccccagggaggagcttccgcgaaggtccgctgctgcggtcatggctcgcgtctacgtggggaatctggatccgcgcgccactgcacgcgagatcgaggacgagttccgcgtgtttggggttctcaagagtgtgtgggttgctagaaagccgccaggatttgctttcattgacttcgatgagaccagggacgcaaaggatgcaattcgtgaattggatggcaagaatgggtggagagttgagctgtcaaccaaatctggtagtggccgtggccgagaacgtgaacgctctggaggttctgatatgaagtgctatgaggttgtggtggaaaggtggccactttgtcaccagagacctgtccgcctacggattggttctgggcggcctgggtagccggaagacgccgcagccgcagcccgacgccgcgcacccgtagccgtagcctaagcaaccccaggcgcccaacctatggcagaaggatctacagcccacggcctcggtctcccaggaagcggagttacagcggccccccaccggctacccgggcgcgaagcatcagcaggtctccacagctcaccaccgcctgccccagcgcggagtatcagcaggtctccaccgcctgcccgtgcgcgaagcatcagcaggtctccgccgcctgcccgtgcgcgaagcatcagcaggtcaccgccgcctgcccgtgcgcgaagcatcagcaggtcaccaccgcctcctcgcgccagaagcatcagtaagtcaccaccgccagcccgtgaacggagctatagcaggtccccagcacagccaccccagcgtgaggagtccccttatgctgataacgcgtgagcacttggttccacaatgctggaagtgttggggggtgggggcctccgcttgtttccttgaatgttttggtatgactattgaatggccaggcggccgagtattgttcttcgttggcatttgtgttcttttgctgctgatacaattgcggaagcgggatttctcttgactggatgactctagcgtatgtagttggtcttaagacaagatatgttttctttttctgtaacatttgtactgttggattattcggatgccgtgcatggatttttatgtgctgatgaaactgtttcttgaaaaaaaaaaaaaaaaaatcccccacctgtcacttttttgttccccccccccccccccc

SEQ ID NO: 18501 - DNA, 1099 bp, Triticum aestivum
  Clone ID: PAT_TA_18501
gaattcggcacgaggccaggcgcgttgggcgctcgcactccctccttggccgccctcgcccccccgccgaccgccaccgcgcgggaggtagctcacttctcctttgcctgctcatgctcatctcgcccgactcgcgtcgttttccgatggatgccacagcggcctgagcagggccgcaagctgttcctctgagccgctgcaccgcgcggcctgactgagccgcgggaggcagccagcggggtcggcgccccggagggaggcccccgcggtgctggcctcccaggctaggaccacccacctctcgagcaacacgccggccacgagggccaccgccaactcgcccgcgcgcaccaacgtccccaccggcgggcgcaccgtgccgctggccccttccggctcgacctcctgccgcgccggctgcgtgtggcccccgccgcccatggccaccgccgcccccaccgacaccgtccccgcctgggcccgcacctcctccacccccccgcccccccccgccccccccgccgccgccgaccccgcccgcccctccacccccgccccctccgcggccgtcttcatcgcccgcctccgcctcccccccggcgccgccgccgtccacccccgcgtgcccgcctgcgccgccgaccgcgtcggcgagcccgcccccggccagcccgcggccgtctgctccgccgccctcccgctctacttctccatcaacatcggcgcgctggtggcctcgtccgtgctggtgtacgtgcagacgcatgtcggcgtccggctggggcttcggcatccccgccgtcgtcatggccatcgccgtcggcagcttcttcgtcggcacgccgctgtaccggcaccagcgccccggcggcagcccgctcacccgcatcgcgcaggtgctcgtggccgccacgcgcaagctcggcgtccccgtcgacgggtcggcgctgtacgagaccgcggacagggagtccggtatcgaggggagccgcaagctggagcacacggggcagtcaagttccctcacaagggcgggcgtccaggcgacggcggcaagcacggcgtcacctggggttgcccggaaccagggaggactaaa

SEQ ID NO: 18502 - DNA, 485 bp, Triticum aestivum
  Clone ID: PAT_TA_18502
gaagagagagccgcccttcgctccccccagaggccagagacggacacgatggcggcgcccacctcctccgcggcatccaccctcgcccccttctcccaccccaaaaccctagccgccgccaccgccgccggaggctcatcctctgtcgccttctctccggccgcctcccaccccgcatgcgccctatcagtctcgggcgcccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtgaggggcgggcgcaacctcttcccgctgctcccggaggccttcaagggcgtcaagcagatcgggcgatcggatggggctcccagggtccggcgcaggcccagaacctgagggattccttggtggaagccaagtctgacatcggcgtcaagatt

SEQ ID NO: 18503 - DNA, 1087 bp, Triticum aestivum
  Clone ID: PAT_TA_18503
aattccccccctttttacaggggatgcttgaggtgtacaactctttgagtgaggaaggcaaaaaggagttcaacaaggcatacagtgcatcattctacccttgcatagacatactctacgaatgctacgaagatgttgcctctggaagtgaaatccggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccgctccaccccttcacggctggagtttatgttgcacttatgatggcccaggtcaggctcctcctctccactcgttacatattataccagtgcactagaatacgatggcttgacatcttattcgagtcgattgcgatgtgtaagctgtagattacacttcctgaatgattgattactctacatgaaccgaaagcaattactgatctggcctgtttccctttctaaactgcagatcgaggtgctgaggaagaaggggcactcctactctgagatcatcaacgagagcgtgatcgagtcggtggactcgctgaaccccttcatgcacgcgcgcggggtggccttcatggtggacaactgctcgacgacggcgcggctggggtcgaggaagtgggcgccccgcttcgactacatcctgacccagcaggcgttcgtgacggtggacaaggacgagcccatcaaccaggacctcatcagcaacttcatgtcggaccccgtccacggcgccatcgaggtgtgcgccgagctgaggcccaccgtcgacatctcggtgacggccgacgccgacttcgtgcgccctgagctccggcagtcctcctaggctcctcgcccccttgcacctaagttaagtaagctgcgccgggccggtcggggcctggcacgagagttggtttttgatggatggacattcatggactgtaatgtatgtgtgcgactggctgtttgaactcgtgagctgctgctgggtagagtgagtcgtcttcgtttccggaataataaagttagttcgtccggtt

SEQ ID NO: 18504 - DNA, 1208 bp, Triticum aestivum
  Clone ID: PAT_TA_18504
ggcatcaacgctagctttgctgtccccaggatgttgatggaagggccactgatgttgctcttgggtggtcggttgcactaggatccccgttcacctttgctactactctagaacaggagtacaagagtgatatctttggggagcgaggaattttgctgggcgctgtccatggcatcgtggaggctctgtttaggagatacacggagcaaggaatggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagcgcatcattctacccttgcatggacatactctatgaatgctacgaagatgttgcctctggaagtgaaattcggagtgttgtgttggctggtcggaggttttatgacaaggaaggccttcctgctttccctatgggcaaaatcgaccaaactcgcatgtggaaggttggcgaaaaggtgcgctcgacccggccagatggtgaccttggcccactccaccccttcacggctggagtttatgtcgcacttatgatggcccagattgaggtgctgaggaagaaggggcactcctactctgagatcatcaacgagagcgtgatcgagtcggtggactcgctgaacccgttcatgcacgcgcgaggggtggccttcatggtggacaactgctcgacgacggcacggctggggtcgaggaagtgggcgccccgtttcgactacatcctgacccagcaggcgtttgtgacggtggacaaggacgagcccgtcaaccaggacctcatcagcaacttcatgtcagaccctgtccatggcgccattgaggtctgcgccgagctgaggcccaccgtcgacatctcggtgacggccgacgcggactttgtgcgcccagagctccggcagtctgcctaggtttggggccgaagagttgttttttgatgggtggacaattcatggactgtaatgtatgcgtgcgactagctgtttgaagttgtgaactgctgtcaggtagagagaggcccctgttggtggtggactcagtgagtcgtcttcgtttccagaataataaaagttggttcgtcgggataaaaaaaaaaaaaaaaaaaggcgccgtctaaggtccaagctacgacgcggctgcga

SEQ ID NO: 18505 - DNA, 2224 bp, Triticum aestivum
  Clone ID: PAT_TA_18505
gcacgccctcgcctagcgccgctgcagcagagagccagccgcccttcgctccccccagaggccagagacggacacgatggcggcgcccacctcctccgcggcatccaccctcgccccgccctcccccccccccagacccgagagccgccctccgcccccgcccgcgcctcctgccatccacccggccgccccccaccccccccgcgccatacccccgcgcccccctcccccgccccaggcccctacccggtcccgtcgccgccgccccctgccgccgctccatcgccacacccccgtcttcaacacgcaccgcgtctccgtcgccggcctccacgcggcgccgatcggtgacgggccgggcggcagccccttcccgctgctgcccggccctgccttcaatgggctgtcaagccgacggccgtcatcggatggggctcccaggggccggcgcaggccaagaacctgagggatgcccgggtggaagccaaccctgacatcggcgtcaggataggggtgtcgaaggattccgagtcctttggggaggcacgtggtgctggatccaccgacggagaacggaacgttggcagacttatgggagagtctctcagggtagtcatcttgtgcctgctgtagattttagattctgcccaggcagacaagtattgcgaagattattctctcacatgggaaccaaacaggatacatggtttatctcatgggtttctccttggtcatctgcaatcacatggccttgatttccccaaaaacatcagcgtcgttgctgtgtgtcccaaggggatgggcccgtcggttcggagactgtatgttcagggcaaggaagtaaatggtgctggcatcaacgctagctttgctgtccaccaggatgttgatggaagggccactgatgttgctcttggatggtcggttgcactaggatccccattcacctttgctactactctagaacaggagtacacgagtgatatttttggggagcgcggaatttttctgggcggggtgcatggtattgtggggatccccgttcacctttgctacgactctagaacaggagtacaagagtgatatctttggggagcgaggaattttgctgggtgctgttcatggcatcgtggaaggctcggtttgggagaaacagaaagcaaggaaatggacgggaggctggaataaaaaaaacctggggagggcatacctggattctatctttgaccatcacatagaaggggatggttgcggtgaacatacctctgcttggagaaagcgaaagcgaaaatgatttcaacatggcgtgcatgtgcatacttttacccttgcactgcatatactctagggcaagatcgaccgaagctcgcttgtggaaggtgggctaagaggtgtggtcgaccggtcctgagagtgaccatggcccgctcgacttccctcacggctggattgtctaaagcacctatgatgggctaggtcaaggtgcctgaggaggaccggcgaactggtaatctgggatcattaacccgctgcaccgctcgagtcggtgggactctgttgaaccccatgatggacgcgctcggggtggcgtggatggtggaccactgctatgacgaaggcgagtctgggggagtaggaagtcgggcgcgcacttttcaagtacacgctgaccgagcacgccatgggtgaccggtggtagaaggacgacgcccatcagaccaggagctgaggacccactgctttggcgctaccctgttcgactacgccactgacccgtccgccgttgctgacggcccgagccgatcaacccggtgacacccgacgccgacttcgtgacgtcctgacgctcccgcactgcgcctacgctggcgtccgctgcgcttagacgctcagccgagatctcgctgaggccgcgaaggcgacttcgtgcgcgctgagctctggcggtcgtccatagacgcctcggccccttgcacctaagttaagtaggctgcgccgggccggtagggtcctggcagggtagttggtagttgttggaagttacaatcatggactagaatgtatgtgtgcgactggctgtttgaactcgtgagctgctgctgggtagagtgagtcgtcttcgtttccggaataataaagttagttcgtccggttaaaaaaaaaaaaaaaaaaaaactcatctctctcgaaataaaccttcaagactccactcgttgctaaaaaa

SEQ ID NO: 18506 - DNA, 1031 bp, Triticum aestivum
  Clone ID: PAT_TA_18506
cgtccgagagattagtgtattcccttcaaaagaattctatgaaggcatcctagaagatggggaagggctcaacaaaaaacgtccatggcattcctacagctgctttggaccattttgcttctttgatgttgatggggttgaatctcagttgtctggaagtggttcgacggtgaacgaggatgaagtggaattcataaccctcctatattaccaattggccatgcgctatccagaactcaaatctagttctcaagtagctgttatatcaccatacaggggtcaggtgaaactcctgaggaccattttcggtcgacctttggcgaccaatcaaaggaagttatagatgtaaacactgttgatggattccagggccgtgaaaaggaacttgtcattttctcatgtgttcgatgcaataaggagcaaaatattgggtttgtttctgattttcggcgaatgaatgttgccatcaccagagctagatctgctgtacttgtaataggttccgcttcaacattgaagaaagataaacactggaccaaccttgttgagagtgccaaagagcgaaaccgttatttcaaggtgccaaagccattcactgcgttcttcaccgaggatagtttcaaatccatgaaggtggagagacctgttccagacgcgaggatatcacaggcagtagaagccatcaatgaagtggttgcaaggcaagaagtgatggacgcagacgatgctggggaccatcaagcggatggagatgattatgacgccatggaggctgatgatggaggaggtggtgatgattaattgttgcctgcaatgtattgctggagggggagctttatcagaggccaggtacataacatagaagagcaaaaagctttgcaagttagaaattctgctattcttagcaaattttaggggggaagaggctggtgcatgcccgccttgcccaacgaatcatctacgcgagctccatgcatacattatggaacaaaaaaagttagaccgcagaactgcagcagctcggcttctgc

SEQ ID NO: 18507 - DNA, 656 bp, Triticum aestivum
  Clone ID: PAT_TA_18507
cgcgttcctacggccccgtccgggcgccgccaccccatccctgccgccccgcctccggctccccgccgccgctcagtcgacctccgccaccgcagttcgaccccgattttgcctggcatcaagcgtcgccgctgccagccgctagggttgcgccgcctcccttctcccgcgctccaacttcgtcgtcggctccccccaccccgcagcgcctgttccgcgaccagaggctgggaacttcaaagaacaggatccatggagggtggagacgcaagaaatggtttgactgggacatcacagacaacgggaagtggggttgagagcccagcaaagccactgcctccttgctgtgtcaaggcgagggctgcagcacctgaatctgaggccaagtgccatgccactgtggtatcgggatggttcacggaaacccgctcacgatgtggtaaagcgagcaaactgcagtattacaataatccaatgtggccaggagagacccattccttgaaagtggataagatcctgtaccaggggaagtcaccataccaagaagtcttgatttttgagtcgttaacctatggaaaagtccttgtgcttgatggtattgtacaattgactgataaggatgaatgtgcctaccaggaaatgattactcatctccc

SEQ ID NO: 18508 - DNA, 2306 bp, Triticum aestivum
  Clone ID: PAT_TA_18508
ccacgcgtccgcccacgcgtcccccacgcgtccgcccacgcgtccgagccaacatccatccgccgtcgcgatccgtccggcccgacgagacccgaaagcccatccacccacccggaccgggccaggcggcgggcgacgaccggggcggaggaggcggcggatcgggggacggacggacggatgggcggcgggcagtaggacggcggcgagacgcggcgcgaccgggaggaggacgagggcggcgccaccaccatgtctgcggtagtctgcggcaagaggtcctcctccatcttcgcggacgacctactgctccaacaggcctcctcctcccctccctccccccgccacagccccgcgcccaagcgctcccgctacgcgcaccaccaccaccgccgggacggccgggacgcgctcctccaacacctccgggccgccttccccgccatggatccccagctgcttgagagagcccttgaagcgtctggagatgatttggatgatgcaataaagagtttgaaggagctgcacctcatggagtcaaatcaggctaacctgccggccactggttccacatttgaaaacgggccgacagcagttcagccatctgttgaaggcattgttaccagcggcggtgtggacacagctactgaacaccaacctgctgcagatggccaacagccaagtaatagtggccctgaatgggttgatctttttgtgagggagatgtcaaatgcttctgacatggatgacgcgcgggcccgtgcgtcaagagctcttgaagccttgacgaagtccatcctggagggtgcaggagctgaagcagcgcagagcttgcatcaggaaaacatgatgctcaaggagcagatgacggccgtctccaacggcgcgctgtagctgcgcctactgccgcccctcccgccccacccaacgcccgtccgccgtcgccatccgtccggcccgacgagaccagaaggcccatccacccacccgggccgggccaggcggcgggcgacgaccggggcggaggaggccgcggatcgggggacggacggacgaatgggcggcgggcagtaggacggcggcgcgacgcggcgcgaccgggaggaggacgaggtcagcgccaccaccatgtctgcggtagtctgcggcaagaggtcctcctcaatcttcgcggtcgagctactgctccaacagccctcctcctccactccctacccccgccacagacctgcgctcaagcgctccagctatgggctccaccacctccaactggtcgtgagggagccgacgctcgcttctcgacatggacgatgcgcgggcctcggacgtcaagcgccctggaggccttgacaaaggcctctgctcggaggtttgcaggggcggaatcagcgctcagcatgcagctgaacgtcatgctgtcgcagaacgcggtcctgaagcgcgcggtggcgatccagcacgttcggaacgaggagttcgacgagcggcgccaggaggaggaagtcttgaagcagctcgtcctgcagcaccaggagccgctgaggactctgcgggaccaacaactacgtgctggagacgcatatgaagcaggcccagctgagcagctccatgacgcgggcgctacaaccgggccctctcccgagcgggacctcatgggcgatgattatcagcctcggccctgggggatggactgttgaggcgagtgggcgccctgccgtattgctcaggtaacaatggatagaagttgttttggacaagggagtcttggagtgggcgttggttagccggcacgacggttcagaaggagtttgacgagcggagcaacgaggtgcagggcctgaagcagctcgtcctgcagtaccaggaagcagctgaggactctctagaagatcaaccaaactaccgcgctgcagatgcatctgaagcaggcccagcagagcagctccatgcccgggcgctacaacccggacgtcttctaatttggcttgagggtgatgatggtgagccctggcccttggggattgagagttgagaatagcggtgctctgccgtatgatgatgatgaagatgactagaaaatgttgttgtctgggatttgttgggtggatgttggcttgctgaccaccccgttggccgtgggatggggcgcaaggctcccatgatagatgatgtgctggttcaaacgtgctgcgtttaaacggtttttcgtatttaatatatgagttaataccactattcataaataaaaaaaaaaaaatgggacccgtgtcatacaaaacaatcccgaattcgacaaaaaaaaaaaa

SEQ ID NO: 18509 - DNA, 1502 bp, Triticum aestivum
  Clone ID: PAT_TA_18509
ccgcccgcagccaacctacctccgcccgcttgagctcgagcgcatccgccggaaccgagcacgactcttctccacgcccccaccgcccccagggccactccccccccggccgccgcctcctcttcggccaagcggagaaccggtgcttaggttcaaaagggtttaaccttcttttccatgaatatgtattttgaaggctatggttaccgtggaagtacttttgagcagacctatcgctgctaccctgcatcttttattgacaagccacagcttgaatctggtgacaaaattatcatgccaccttcggcacttgatcgtctcgcgtctctgcatattgagtaccctatgctatttgaagtacgcaacacagcagcagaacgcacttcacactgtggtgtcctagagttcattgcagaagaagggatgatctacatgccatactggatgatgcaaaatcttcttttgcaagaaggagatatggtgtttataaaaaaggccaacctcccaaagggcacatatgtgaagctgcagcctcatacaacttgacttcttggatatttcaaatcccaaagcaatcttggaaaaaactttgcggaactactcttgtctaacctgctggtgacagcattatggtggcctataataaccagaagtactacattgatatagttgaaacaaagccttccagtgctataagtaaaagccttcctgtgcgtgaggttgactttgccccaccacttgactataaagaacctgagcgaccaaaacctactgctcctcccagcgctgatcctgctgcagaggctcaagatgaggaggaaccaaagttcagccccttcactggtcctggaaggcgcttggatgggaagcctgctaaagatttggatgcatcatcctcttcgcctgcaaagcgacaagctaatgcaaccaacagtgttcagccctcagcagcctccacaccacagatcacggcgccacgtaaaaccacaggaaagcttgtctttggctctggtggaagccagtcatcaaaaggaacagaaaaggtgcccgacaaggatgcaaaggaggatccgaagaaagaggagccgaagttttcagcattcacgggaaagaagtactccttgaagggctgaatgccagagtatgtatttatcagcacttcctgtcacaaacatcatcagggctaagagttcagtcagctactgtttagtttcctgatcccttgggagctggggcatctttcggtggactaccaatgcttcttttctgtcaactgtgatccttatgtcagccgccgtgggtcagtttggctgatgtgtacaaagtatttcaatgtctgttcatggattcttagcgagttactacacattgcatttgtttgcgctgttagttcctgcaccagcacgtttctagttgatcagacttttccttgtttgatggaaatagcttcttaactttattttgcccccaaatgtattagtgccacacgtggtaagtgccac

SEQ ID NO: 18510 - DNA, 1365 bp, Triticum aestivum
  unsure (1)..(1365): unsure at all n locations
  Clone ID: PAT_TA_18510
gggctgcaggttctaatgncagtccggtggttctcctgctcacatcagaatcttgatggaacaaattcagcatttctgaactatgggctcagtggatatccactcaatccgggtttcaactctatgatgatgaataacatgggttcaggtagcatgcctcctctgtttgaaagtggtgcagcagcatctgctatagcttcactcgggtcagattcaaggaacctcggtagcaatatttcatcaccacctgccttaagtctatctgatctgcataaccttggtaggtccaataatcaaacagccactggtcttcagtctcctctctctgatcctttttatgttcagtatttgaagacagcgccgtccgcccccgcgtccgcagccgagtacagtgacgcgtacttggaaagaggtttcatgggtagttcgtatgctgatttaacaccagttcagaaagcttatgttgaagctttgcttcagcagaagcaatatgggatgccacttggtaaatcagtatcctcaaatcatggttactatagcaatctgggttacggcatgggtatggcataccctggaagccctttgggaagtcctgttgcttccccatcaggtcctggcagtccaattaggctcggtgagcggaatctgaggtttccttctaacacgagaagcttgactggttggaatgttgatccaagtggctatatgaatgggaactttccatcttcacttttggatgaattcaaaagcaataaggccagaagttttgaccttgctgagattgctgggaatgtggtggagttcagcgctgaccaatatggaagtcgtttcatacagcaaaaacttgaaactgcgacagttgaggaaaaaaacatggtttttgaggagatcatgcctcacgctctctcattgacgactgatgtatttgggaattatgtagtgcagaagttttttgagcatgggagctccacacaacgcagggagttggctaatagaactatttgggacatgtactaaactcttaagcattcaagatgttatggttgtccgagtttatccaaaaagccatataggtgttgatctggaccaagaagacaaanatggtactgagcttggatggcatatcatgcgatgtgtgcgnnatcaaaatggaaaccatttatcaagaaatgtatgannttncccaanagatncaatccctttatnacncnacatccanggtgaatcntnnactgtcnatcacccntanggtngagancatcagagatactggacntgganggtnaagaaacagaaatgtnnggatgaanatgaaccgtntcancgggaaaanccttggaaatagttncnacagtntccgacgga

SEQ ID NO: 18511 - DNA, 914 bp, Triticum aestivum
  Clone ID: PAT_TA_18511
cgtccgcccacgcgtccgcccacgcgtccgtgagagagagcagaggagaacagagcagagcaggatgagggtggcggtggtcggcggcggggtgagcgggctggcggcggcgcatgagctgctcgccgccagtggcggagacggcgtgcgtgtgaccctgtacgaggaggaggaccgccttggagggcgtgccagcacggtggccgtcgacgatggcgccggacgcgtccacctcgacctcggcttcctgatcttcaaccaggtaacatattcccacatgatggaatggttagaagggctcggggtggagatggagagatcagacatgtctttctcagtgagcacacaatcggacggcggcagcagaggatgtgagtggggcaatggcaacggtatctcgagcctcttggcgcaaaaagccaatatactgaaaacaagtttttggcgtatggtccgtgagatactgaaggtcaagaacgatgctctgacgtacctggagtatcatgaacataaccctgacgtggactgtaatgagacattggggcagttcattcagtcacatggacgtccgctactattccaagaggcttatcttattccagtctgtgcaggcctgtggtcatcttcatcagaaggtgttttgagcttgtctgctttcttcgtgctatcatttttccgcaaccatgaccttcttcagctgtttcgttacccccagttgcccactgtgaaggctcgttcgcagtcctttgtagacaaggtaaaaggagctttggaaagcatgggatgtcgaattaaaaccagctgtcgggtcaaatcagtttcaagttttggtggagctggctacagagtcttggagaatgatggttcagaggaaacaatgacagtgttatccttggcattcatgcacctaatgc

SEQ ID NO: 18512 - DNA, 1039 bp, Triticum aestivum
  unsure (1)..(1039): unsure at all n locations
  Clone ID: PAT_TA_18512
gcttgttcagcaactgcccaactacagaaaatcctcaaatccggcttctcgatcgcgcgtgggtcattgcccaaccgcgtactgtgcagtagccaccaccttcattgcccaaaacgatcaactcagcacgcggggttcccaggcggaggaggcgaggagcggcgccggcggcgaccgatggatccaggcggcgccgccgccgccgccgccaagcgcgcggtgtggtgctggatgtgggggatgcacgacaactcggacgacgcgggcgacggccataagcagttccatctcgtggcctccgccgatttcagccacgacacgcgtatgcccggggagtttggaaaccacttgacgaatataacccccgagtctgatcttgtcaaacttgtagctcacgacgaacctatttctgactctaatcgatgtgaagcaaatggcggttcagcgagcgatactgatatgcaacttgaagtgaccttgagcaccttggctattcaattcttttgccgcttttatgagaatgtccacatgcgtggtttgacttggcaggatgatgagtatatgcaatgggtctctggataccatcacatagagcgaaccaatggcctttctgccaggtttatgaatgagctcattggagttggatgctactcttatttcccctttggaccatttgggccgggaagcaccgtgatcactattcctgaaagtgcatgggctgaaatttctgttgggcttcagagcatgctcataactaggcttgactcttttcttcagcccaaacattccaatgctatgggcttgaataattctgcttgcactttaccacctgaatctgtatgtgtgttggctgatgctgcagtgtcttcaagtgtgttggctgatgttgcagtgtctgatacttctatgtttgaggctgctgtgccggaatttgctacagtgtctgaaggtgtgctggctgctgctgtcctacctataccgcagtcttnanccanggggcgantnacgaancaaacccggcaaagttnaaggngtttgg

SEQ ID NO: 18513 - DNA, 760 bp, Triticum aestivum
  Clone ID: PAT_TA_18513
cgtccgcttcaatcccaagagcgcagctgagttagaagaactgatcaaggctcacggcgagaagagtgatgtcaccgtccatgtccccaagaagatcgccgttctgcttgaaggcaagcagatgcttgacctcctcgaggacaagatggagacaaacggatgggtcgtgagccgctacgacaagctgaagaaggttgtccacatccacaacgccctgctcaagacggacggcctcctcagcgaggcaatctccctcaccgacgccgccaagatcaagcccgcccgctacgctcgccatcacgttgggtcgcccgttcgagtcggcaagttctccccgaccggccgccaccaccgtcgccgtactcggcgtcgccacaagcttcctcggatcgtgcccgccaagatcgcgggcgacctcgtcgacaccggcaacgtcctgcagcggttccctcttctacaagtgcaacatctgggcagatcggtcgccgcagccgggatggggctgcttcgccagaaggaggacatgtccgtgctccatgcccaactcctgaaggtggaggaggactcggtgatgtgtgggtcagtgagttcaagcctgatgagctgtagaataccgctaggaggcatcgtataatttaagcatgtgttgcgtgaaccgtgtccagtatctaggacgtactatgatatacgtgtaatttattttatatatccaagtactattcatcagtggaatatatgaaatataaagttaaaaaaaaaa

SEQ ID NO: 18514 - DNA, 1302 bp, Triticum aestivum
  unsure (1)..(1302): unsure at all n locations
  Clone ID: PAT_TA_18514
gttggattctcatggtggacggcgagctcggaggaaccagcgcgtggggtcagtagccggaatcccaggtttcgtgtatccccgccatgccggagtcgagctcggatccgggcaatggcaagggcaagaggagcctcccttcctggatgggctccggcgacggcggcggcggcgggggaagtccgggcaagaagaagcacgcggaggcggcccgcgagagggccccaacagggccggatttctccaaactcttggatggggtggtctttgtgctgtcagggttcgtgaaccctgagaggggcaggctgcgctcccaggcgctggatatgggggcggtgtaccggcccgattggtcgtcggattgcacgcttcttgtttgcgcgtttacccgtacgcccaagtttcggcaagtgcagtcggagaatggaaccatcgtcgctaaggaatggatctcagaatctcacagccaaagaaaactcgttgatattgagccttaccttatgcatgctggaaatccatggcgcaaaaataaagtgccagttgattccagtcaagatcagaagaagccacgtaaagagcatgaaaagcaacctgagaagactcatgctaagacaccgccctctgctgccactaaggcaggacgttcagatgctataaacaaacaattttcgccttcaaaaattaaacaatgggcaatggatgattttgcgaagacaatatcatggttggagagccaagaagagaagccagagccaaacgaattgaaggcaatagctgctgaaggggttatcacttgtctgcaggatgccattgaatccctcgagcaaggcaatgatatcagtggggtggcagagcagtggagctttgtcccccacgttgtggacgagctagtgcggcttgacggagagggatcgtcgctgtctaaagaacagctcgcccaactagcaaccaaatgcaagaaaatctaccaggccgagtttgcccagatggacagtggtggcaagaagggcaacgagcgtcctgggaagaccggagcggacgacgctcagtacgacagtgatgatacgatcgagatgacggaggaagagatcgatctggcttgcagacagttctcagggattagtagctaggtcaggaaaagttctttagcagaggagagaaagggctatgtatcactgagcatggtatcgccgacagtgatcggaacacacttattatcactgagttttagtggagtttttttattgcggggaagagtttcagtgagtttgaccctgttctnatcaggcctctttttttttg

SEQ ID NO: 18515 - DNA, 1165 bp, Triticum aestivum
  unsure (1)..(1165): unsure at all n locations
  Clone ID: PAT_TA_18515
cgtccggcaagtgaaaaggctgcagttgctgagcggaaactcaatgaggctgaatctgaaacaaaagccttacgcacaatgacacagaggatgatcttaagcaaagaagaaatggcatctatccagacatctctatgtcaaaatatgaatactggtcttcgtttgctcctcttcccctcgagtatgtgacatcagctggactgagagctaaggatggaggtagtaatgatttggaagaaacagacatgcttgttcatgatttgactgtcgcacggccccccaggcccgtgcgggagaaggcaacatagaaacaatgcttgctgttgataagggacttaaagaacttgccttcttaaaggttgatgatgctgttcttattgctcttgcctaacagcatcggcctaatgttgcagagctatcagatccagattttaaatcgtctcgtgatgaaaaattcaccgaggcgtctgacctaagcaaggaggaagaggaaggtgtgtggtgcaagcaggctgggctcatgtatttcgggagaagggctaagatccatcatctgggagaggattcccgccagggacgagtgcgttgccgaatttgtcttcttcgaccctgacgatgttctcatcatggtgtctcggtcctccaagggcgacaaccatggagcgctctcagactcctacatcagatctcggtattatcccgaaaccacgggactgtgtccgaagatgacttgtcttggtctgggcttccgagtacctacgcgactccagctctctggcgttatcctttttttgcacccattctgctcagtgacacctctgtagggtaccctaaccgcaggacattgttaagatatttctggttttgggttggactcccgatttccagctcccggacagttccttggttgtattttatttctgtacataacctgcattcaacagtgttatgaaagcggcttgaaaggataaaatcattattataaaaagtgatgtacttccataagctaagagaagctgaagagtcctggtattaactaatctgagatggttctactnaacctacccgtaaaaaaaaaaaaaaactgaggggggcccggcccaatgcctaagggaccgatacatactggccggtttacacgcggactggaaccctggtacaacta

SEQ ID NO: 18516 - DNA, 697 bp, Triticum aestivum
  Clone ID: PAT_TA_18516
ggtcgacccacgcgtccgcggacgcgtgggcttgattgaaggtgaaggagcttgaaagccaactagactctaagatgcattctcaaattacgtcggaaaagagtcagctttctggaaaacttaaggagaaggaagaagcatgtactgcgctacagcacaagatagtggagttggagcgtaagcttggacagcagcagcagtcagactctgaggtcgcagctcttaagcaaacgattgaggaggtggagctgaaactaaaggagcaggaagagcaaagatcagctgcagaatcaaaggcaatggaaatggggcaagaactcttggaagcacagaaaacagagtcaatgcttcagagcaagctgctcgacctcgagaagaagctgcaggagatgacaaaactcaaagacgcaagcacgatgcctgacccaaaacctcaagacgctagtagcacgatgatgcctgaaccaaagcctcaaggcactagtagcacgacgatgcctgaaccctcaaacaataattagtcacaagggttcttcctgccacccctgtggagacaaacgtggtgccggcttgttgtgcgagggaggaggcgatgagcgagaaggcgcagcagcaccgccgcatcctgaggagctccgactcggccaacaagcgctccctgtttgccccggaggcggccgtcgtgaacgagaggaag

SEQ ID NO: 18517 - DNA, 503 bp, Triticum aestivum
  Clone ID: PAT_TA_18517
attcccgttcttagtgagatgcatttactcgatgcaaagtatgagcattgcagactctggcgagctgctgaaggtcgacgaggagggcgccgccaccaccgtcatcaggctggtccgcatccacgcgctgctcggtgtcaccaggtcaccggcacaactcttcatgcccaggtcgttcaacattttcttctgcttttggtgcagtcacatttagagtgtttgtttcccattttactgtgttttcatggtaagatgttaggttggatttgaaggttcatagacttggctccaaagcatcaatctcttgtagaaattagaactgagggccttttaaaatgagtcctgcataatagtgttgttcagtgggatgcagaatttttgtttgtactgatttacgtactgatttcatcatcatatgactacaatgaagaagctgtgtgtataaatattactaacggatgatactttgcatcagtgattttacaccagacggttcagggaaa

SEQ ID NO: 18518 - DNA, 551 bp, Triticum aestivum
  Clone ID: PAT_TA_18518
aggcagagcatgccaaaggcgatgctcattcctgttcttagtgagatgggtttactcgatgcaaagtatgagcattgcagactctggcgagctgctgaaggtcgacgaggaggcgctgccaccaccgtcatcaggctggtccacatccacacactgctcggcgtcgccaggtctttcgcttttggtgcgtcgcatttagagtatttctttcccattttaccgtgtttgcatgttaagatgtttggttggatttgaaggtttgtagccttggctccaaagcttcaagctcttgtagaaattagaattgaaggccttttaaaatgactcctgcataatagtgttgttcagtgggatgcagaatttttggtagtctaatcggctatccttggtgctgatttacgtactgatttcatcatcatatgactacaataaagaagttgtgtgtataaatatcactaactgctgatactttgcatcagtgatctcaattcaaaaaaaaaaaaaaaaaaaaaacaaaaagaaaaaaaaaaacaacaaaaccaaagaaaaag

SEQ ID NO: 18519 - DNA, 2686 bp, Triticum aestivum
  unsure (1)..(2686): unsure at all n locations
  Clone ID: PAT_TA_18519
ctcgtcctcacccgccgccgctccctaaccctagccccaatccacagccccgcgcccctcgctcctccctccctcgtccgcgcccctcgctcctccctccttcgtccgccgccactccctcccacctcctcctcctgcgccctaggagccccgccgccgactgctactcctccaccgcctcgcctcttcctcctcctcgccttcccatcgctcacgcgcaggtcgcccgacggcagggatggtcaggaaggcttcccagcccgactgtgccgtcatgggagctgcagggaggaggaggagcagaaggggccacggatgaggaggaaggagactagcaggaggagaaggagatattcttgttcgatttggttctcatgctggcatctccctgctgtctgctttccttttggtttccaactttgatgcttggatttgttgtcttggccagcangagtgggaggagacagggaggatgaggaaggagacaagcaggaggaagagaaaatcttgctcgccttatgggactcgcataaacaggtccacgcgtccgcccacgcgtccgcagacaacagagctcgttacctcaacatgtgatgttagaggctcggaaaatcaacaagttcaatgcacaaatatggttgttgatcagcctacatgggctgggaatcttgtgagcaattctggtgatgtttctacatttcttagaaagctaattgaccaaggaaaagttagtgttggtgatatacaatcagaactgagtctctcatctgaatcgttggaagctgctcttgagaaaattgggggcgccggtagccgcggcgcctggaggattccgctccgaccatgcacagtgccggggcgtggggttgctgcgccgttgcctgcgcccctcccctccctcgcgcaggcattggaggattcgcaccggggtggtggggccccgggcgctgaagtggctacagcgagctcccgccttacaatccttggtcatgccctcccacctaccgtcacaggtcgctggcgatggtaccccggcggtgaatgttgcgtgaaaggcctataatcgggcctttgcagccggtggtgtcgcgatcaaggccaaagggacgagcgtggcacaggggacgggcattcccgttcttagggtgagatgcgtttactcacatgaaagagtatgatcttggcctggtttggcaaacttgtgaaggtcgatgatgggggccaccgcaccagcgtggtcctgctggtgctgcccccatgcgctgctgggggtggcgtggtcaaagaagggaacgttccgcatctagatcgatcaatatgtgccttcacctagtggagattaacaatttaagagtataaattcctcgacgatttcggtttctccaggtgtgatttccccgtgaattgatacgtgcgaaatcttggctcgcaagcttgtgaatctggtctacggtcatttattcaggagagggaactacgacggcaggagaaaaatgcaacgaggtgaggtcttatgttcgatgccaagggcctatccggcagcgatttcctctgtacatttagaagtcacaatagagaaggttcgtagccttggctccaaagcttcaagctcttatagaaattagaactgagggccttttaaaatgagtcctgcataatattgttgttcagtgggatgcaggatttttatttgtctgatcagctattccttggtgctgctttactgtatcgtgttcttccatcttatgactacaatagagaagttgtctgtattaatttttccatgatgttagacgatgcatctgaaattacactgcagcaggcagtcgcatccatcagcgaggctgcgaacaactcttggtgcccctgttaacctcctcaatgtttgcgttgtttgcctgtcggtcaaatgctcactattcagcagacaggaagcgggtgctatccagatcatgccaaaggcgatgctcattcccgttcttagtgagatgggtttactcgatgcaaagtatgagcattgcagactctggcgagctgctgaaggtcgacgaggagggcgccgccaccaccgtcatcaggctggtccacatccacgcgctgctcggcgtcaccaggtcaccggcacaactcctcacgcccaggtcgttcaacattttcttccgcttttggtgcgtcacatttagagtctttctttcccattttaccgtgtttgcatggtaagatgtttggttggatttgaaggttcgtagccttggctccaaagcttcaagctcttatagaaattagaactgaaggcgttttaaaatttttcgtgcataatagtgtttttcagtgggatgcagaatttttgtttgtctgatcggctatccttggtgctgatttacgtactgatttcatcatcatatgactacaataaagaagttgtgtgtataaatattactaactgctgatactttgcctcggggctctccggtcgcccccccctcttaagattgcttgggaatgtgaggcttaaaagtttcaaccatgtgcaatgtgcttctcgggtgtggatttgtgtctgattaattaatagttttgttaatattgatatgtcccccaacattaaaaaaaaaaaaaaaaaaaaaaagggcggccgttttaaagattccttgagggggcccaggttaaggggacccgggttttt

SEQ ID NO: 18520 - DNA, 884 bp, Triticum aestivum
  Clone ID: PAT_TA_18520
aacggcagcggcgcgcttgccgcggcgtccgctccgcccgagcccagtaatggggcgaggcgtcgcggcggcgttcctgcacgccttgtcggccttggagctagccttggcgggggcgggccgaggcgtcgcggcggaggacgttaagcagacgggcacgcgccgccggcgcgcttgccgtgggcgtccgcttcgcccgagcccaggagtggggcgagaggtcgcgccggcgttcctacacgccttgtcgcccttgaagctggccttggcgggccgaggcgtcgcggcggaggacgacaaggcggccggcgtgctctgttggggcgacgcgtcgcggcgctccggctccagcagatgacggcagagagccaggtgtggctttgtgtcgccaacagccacgaggtcatcggcgccggccaccgtgccaggctggaccagctgctgcagcccccctgcgccgttgccgtcgccgtggcacaaaaagcgcgagttccccctcgctatcggaggctgggtgtcgttctctagtgcagattgtctaattgagtttttgaaagcgtcgtccacgtctgcacttcatgggtccatacactgggaactcacgcctgaaaacttcctgctcaccaaattggtttcagtttttctgtttccatcaaaaaagtggcaagcatggttagggcaaccaacaagggttcctgtagtgcataaccatttcaagtcgcccatgttttaaaaaaagatcaaaagtgccagctacttaagcaaaaaaaaaggccctgatacccattgtaatcatggactgctaaaaaacctaatgcattttttcataatggtcgatttctgttccccggatcttacatgtttaattatgtgtgcccggaccc

SEQ ID NO: 18521 - DNA, 738 bp, Triticum aestivum
  unsure (1)..(738): unsure at all n locations
  Clone ID: PAT_TA_18521
aaaagattagtgggtattacatttagattagttacatttgggcaaataaatgagtagaagtcaattttgtttgcttgatgtttcacttctttgatctcttcatcattctcattttgtttcattgcttaccatttgttcgaaaaaatttctagcagtggcaagcatggttagggcgagcaacaagggttcctgtagtgcatatccatttcaagtcgcccaagttctaaagagagatcagaagtgccagctactgaagcaaaaaaaaggacctgatacacattgtaatcatggactgctgatatacctgatgcatttcttcatgatggtcgatttcctttcaccggatcttacatgtttaattatgtgtgctcggaaccaaaaactgattgagatcttcagttcttacttgcagatgttctgttattcagagtaattcagtttccagtctctgtttattaatctaattatggattattttcaaccatataggcttttattatatgttcagttatgcttccatgggttttgcatatgtattaacaaaacaaccagactgctattctgtatatacttggatcaaagggtgtacaattaatttgctcttacgaaaggaatgagtaggcagctagcagaatgggaggacactcatgacaagcgaaggaacaaataaatagtaatcccacaatttttacaactgcattncactttaatttggtatggacatgcatttttatcctt

SEQ ID NO: 18522 - DNA, 919 bp, Triticum aestivum
  unsure (1)..(919): unsure at all n locations
  Clone ID: PAT_TA_18522
tccgtccgcggacgcgtgggcggacgcgtgggctttttttttttttctcttttgtttttttttttttgttaccatattgtagaaaagaagtagcttattactgacaaacctatcttggtgtcaacggaaacacaacatgacaccaactttcatgtaccgaataccaacaaataagtaaaaaaaacaacgcttctgttcccgttagcaaacactactagcattttcgcgtcccacgtacttaatcaactccgttagtacaattaaagcatcacatctcaccgtagcaagggatgtccttcggaaaaattaacaatcacacgctaaggcccaaaagccctgagaacaaaaaaaaacattacaacctacttggtgacccggaccgacgaccgccacgccactgccgagaaacattcaacctgttgtgaatgactcgacattcctaaatctcaacaatcatgggggcaagggaagatcattcttctcggtaggaattaggagctggagccggggctggggcaggggctggggcaggattccgcttgacaaagtgaccaccaggcgggcggtggcccctgttgtggccgcgcctccctgtacaccggtcctgggagctggcagcccctgcactttgtccatcggcacttgggattctgctggaacgtctgatggtttgttggagccaacttggctggctggttctcatccacatttgtcatgtcacctttaccttgattactactatgattgctgctgtcttgcagagtagcactgtccacctgaccttcagtggtattattgccctgtgagttactctgggaatgtgaagattttggttccccccgtgctcttctgcgtgctccgctccccctcccctctggttctcacctgcttctacctcgtgccgaattncctgcagncc

SEQ ID NO: 18523 - DNA, 1150 bp, Triticum aestivum
  unsure (1)..(1150): unsure at all n locations
  Clone ID: PAT_TA_18523
nnngagcnnnngnnnnngcaggtaccgtngnnnnnnnncatctcctgtgacatccgtnnnncagatatttaatagtgaggatgatagtgtttccggtgccgataaagcagagaagcatcttactattcttgaaacaacagttgtggagttacatttacagattgtggacatcaagaatttaccgtcttcaattccagagaaaagcgtgtatgtatggttcaccaagactaaaccagatgcattcatccgtgatggcggcaggttggatatttttacgaaaacagggaagagcatcggagctggtttccaatgtgaaccgactggcgatctcattcttacagtaatgattgatcaggcctattttggggcatcatcatcatcgaagaaaccagaaccgtgcgcgagggtttcgatctctcttcaagagcttacgcggcatgattccaagctttcctttgagaggtggtttgaactgaaaactggtggtgcgtatgccggttcccctcctgtcagtcttcgtgttgctgcatcttgtaccgtcccaaggaacgctccacacgttcttggcatggtcaatgtgaagccttgctctctgaaggcctgtctattgccacattccatcagggatcaaaatatgagctcctggactcgcttcgtgtatgattgtggtactgaactcattcgcgttcagatacgcgagcgcaaggccaagagtggcatggctctcattcgagaattggtcggagtaacaaagtcatcaaagcagccatttcagcttgcagaattcacggaaaacaaatggtcttttaacaactccaactcatccatcactcttgacctgaaaccaagcaaggatggctgcataaacgagctcaaatacgacaacaaactgatcaaactatacaggggaaggagactagcatatgaactcaaatgctgcagtcagcatgctgaagatactgcagcagttactgctgtgaagttctcagctgaacacccctatggcaaagcagtcgcgctagttgacactgaatcggaatttatctcggtggatgaggattggttcctgcttccctggatcgcgatatcattcttgttcctgaattccattgggaatatagggttcgaaggtcaatcgatgggccatggt

SEQ ID NO: 18524 - DNA, 282 bp, Triticum aestivum
  Clone ID: PAT_TA_18524
tcccacgcgtccgggccatcttcgccgccccggtgaagctcggcttcgccgcgcccatcaacttcaagcagctggtttcttcttgatcgggtcagaggcattgcaccgtacggagttgtgagtgttcactgtttgattgagggagggaaaaagatgtcgtgcaccttttgattcttttgtagatcggtggagatgcaatagaatcatagagagggtgtcgtgatgcatgcgattttatgttcaaacaaagcggccaaatggcccaaaaatacactattgaat

SEQ ID NO: 18525 - DNA, 457 bp, Triticum aestivum
  Clone ID: PAT_TA_18525
ggaccttcattctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctccaatgttggtgtcagtaactgtcagatgttgagtgtcttgaaaactttctgataattgtgggatttgctttgtaatggtaatcgtgaaattggtgtggttgtgttttggttgaatcaagagattctgccctgttattctatcggattatcttgtgtcttttgtatttggtcattttttgtaacacagtaaatgcaacgttgagcaaagcaaaatgatcaaccatcgtttgatataaaaaaaacatagaattaaagaa

SEQ ID NO: 18526 - DNA, 1534 bp, Triticum aestivum
  Clone ID: PAT_TA_18526
attccaagcacatattcccgcgggcatcccgccacctaaccgcctaccttgcaccgcaattcatcccccattcagcaaacccatccgcaaatagtggagcagccccgatcggaatcctgttgcatacatacggatacgggcgtagccggatacagctagctagctgcaggcgccatgatgggggtgagggtgtgcaatggaaaggccgtggcggcgctggctgcggtgtttgtcgtctgcgccgggcgtggtctcgccggcggcggcgagcgggcgcgaggaggcccacctggtgccggcggtgtacgtgttcggcgactccacggtggacgtgggcaacaaccagtacctgccggggaacgccgcgctgcagctcccctacggcatcgacttcccgcagtcgcggcccaccgggaggttcagcaacggattcaacgtcgccgactccatctcgaggctgctgggcttcaagaggagcccgccggcgtacctgtcgctgacgccggagacgagccgtcagatcgtcagaggctaccgtggcgtcaactatgcctccggtggatccggcattctcgacaccaccgggaacaccctcacgttgaccaagcaggtggagtacttcgcggccaccaagtcaaagatgacggagaagagcagtggcatcgacgcgctgctgtccaagtccctcttcctcatcagcgacggcggcaacgacttcttcgccttcctccggcagaacctgacggccagcgacgcgccgtccttctacgcggacatgctctccaactacaccaagcacgtccagacgctgtaccagctgggagcgcggcggttcgggatcgtcgacgtgccgcccatcggctgcgtgccggcggtgcgggtcacctccccggacggcgagaccgcgtgcgtcgaagccgccaacgccctcgccagggggttcaacgacgcgctggggagggcgatggccaagctcgccgccgcgctgcccgggatgaggtactccgtggggagctcctacaacctgataacgttcatcacggtgcacccgcaggccgccgggttcaaggacgtggccagcgcgtgctgcggcggcgggaggctcggcgcgcagacatggtgcggggcgcccaacgccacctactgcgccgaccgcaacgacaatgtctactgggacgaggtgcacggcacccaggccacctccagcaagggcgccaaggccatcttcgccgcccccgtgaagctcggcttcgccgcgcccatcaacttcaagcagctggtttcttcttgatcggcgatcgaggcattgcagcgcacggtcacgatttgtcgtcagctcttaatttagttgccagtgttcactgtttgatagagggagggaaaagaatgggtcgcacactttttgattcttttgtagatccgtggagatgcaatagaatcatagagagggtgtcgtgatgcatgcgattttatgttcaaacaaagcgggcgaatggcccgaaaataccctctagaataaaagaagtgaagttgc

SEQ ID NO: 18527 - DNA, 817 bp, Triticum aestivum
  Clone ID: PAT_TA_18527
tcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtatggttgtcagtcgactctccaatgttggtgtcagtaactatcagatgttaagtgtctcgaaaactttctgataattgtggtatttgctttgtaatggtaatcgtgaaattggtgtggttgtgttttggtcaatgcctcggcttttactcaatagttgaaacaagagattttgccctgtgaattttgtgtcttaaaaaaaaaaaaaaaaaaaggcccct

SEQ ID NO: 18528 - DNA, 869 bp, Triticum aestivum
  unsure (1)..(869): unsure at all n locations
  Clone ID: PAT_TA_18528
ttcccccagagctggttagggtttctccttttcgggggagaaatctcaagaggcggccccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcgtcttcagtatttttgctcttatctatggttgtcagtcgactctccaatgttggtgtcagtaactatcagatgttgagtgtcttgaaaactttctgataattgtgggatttgctttgtaatggtaatcgtgaaattggtgtggttgtgttttggttgaatcaagagattctgccctgttattctatcgcaaaaaaaaaaaaaaaaaaggcctgttcattttttgtaacacagtaaatgcaacgttgagcaaagcanaatgatcaaccatcgtttgat

SEQ ID NO: 18529 - DNA, 1232 bp, Triticum aestivum
  unsure (1)..(1232): unsure at all n locations
  Clone ID: PAT_TA_18529
gcctgtgccggccggggtgcgctctcgccgtccgccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtattttgctctgctctatggttgtcagtcgactctccaatgttgtgtcggtaattagcaatgttgagttctaaaaacgtgctggtgattcgaatgttgctaaaatctatgctgtcttcagtatttttgctcttatctatggttgtcagtcgactctccaatgttggtgtcagtaactgtcagatgttgagtgtcttgaaaactttctgataattgtgggatttgctttgtaatggtaatcgtgaaattggtgtggttgtgttttggttgaatcaagagattctgccctgttattctaaaaaaaaaaaaaaaatcaaatgagctccgccagcctcccaaacaccgccactgcaatgatgagctacccaaaaacagcgcaactcacccggcccgtgccctcgaacgcacccgtgacccggggaaaaccccgggcggtttcccccaactttatgtcggncttggngagnaacatccccccntttnggcaacaggcncaaataaaatacaaaaagcccgnaanncggatngccctgtcccacacaagttggcaaaccggaaatggnncataggacacatggnan

SEQ ID NO: 18530 - DNA, 670 bp, Triticum aestivum
  unsure (1)..(670): unsure at all n locations
  Clone ID: PAT_TA_18530
cgtccgcccacgcgtccgcggacgcgtggggtctacatcaacaaaccattggcgagcatgttgagaccatgaacccacgtgggacctccaaagaacttgaaaattaccgacattgccagcaaggttgcggtgaattaacgagatttaatcaatccagagatgttgtaaattgatacaattgaaccacatacttggagagacgatgccgttgacttccgcaacgatgagcaaggtggcgaatacccgctagagagtggagaacttctagcaccactcgatagccagatcatcaaccatgtaaggtccactgggtccagatgtgcaaggcaaacacgcagaggtcttcgagaggcttgtgcagacggagcttacagccagatccaagcggatacaccatccatagctggcctatgctgggtggcggcatgtatgagcctgagcttgacatgaacgtgagggatagatgattgacgaagaacgacttcgttgtatccgtcgacgccatacccctttccaaaacaaacgaccttctcttgtgtccatgaacttttgttagcgtttagtgaatcatgcaatagctacaagatagcttgttgggggagtttccccggtgcttggtgttaccttgtatgtacttntgtgtctgaaatggatggatggggtgggttgt

SEQ ID NO: 18531 - DNA, 675 bp, Triticum aestivum
  unsure (1)..(675): unsure at all n locations
  Clone ID: PAT_TA_18531
cgtccgcggacgcgtgggtgcagttctgcagcgctgcctgctatggagagttgaagttgacctggtggtagatagatcgattaagttacaggtgcaacacttagcagaggtttcaataggggattaggaacacttactgcaggagggcttgctctagcaattgctgaatcggccaaaaacctgggggaaatggaagaagtgattattattataagcactttcactgttggtttttgcacaaccttggcaaagctgcacccaacgatgaagccttatgaatatggatttcgtgtattcttgttgacattcgtttatgtcatggtctctgggtacaacacagggaagttcactgatacggctgtaagtagatttgtattgattgctcttggtgctgctgtcagtccggggaatcaatataggcattcacccaatctgggtctgggagaggatttgcacaatttgatcgcaaagaattttgctggtgttgcaaaaccttanaagntgtgtcnatggatatctgaaatgcatggagtatgaaagatccctcaaaaatctgtatacaagctnctgatgatcctctatatatgggtcaaggcaactgtcgangctcagcacaagaggaaaccgctaggtttgcatatgggaaccgcccatggtccgtaaaaacaggaacta

SEQ ID NO: 18532 - DNA, 1014 bp, Triticum aestivum
  Clone ID: PAT_TA_18532
cgtccggaaggtagatgtcagatttgccaaggaggcgccagttttgggcatttttgggatgaatgtctaccataaaaaccgctaataatgcccttctggaaggttcttcaggaaggatctagcagagggaggagtgttgtaggtgtacttgaggcaaattttattgaaccggcacatgacaaacaggattttgagaggactccactattcattcgtttggaaacaaaacttagacaaattatcattgagtactggaaaaacaactgtcatttgataggttaccagccaatgaattcacaattaaaaacacagtataaggctgccaaaggttcaggtggtcctggacatgagtttcagcagaaatcatcgactgctcagaggattggagcgcattcatcatcgactgctcagaggattggagcgcattcatcaaatttgctaccggaaacatatgatgatgcagcagtctttggactgagaactaatggtgcaggttctggtttgcaattttttggccaagcacaagaaaacggtacgaattcagcaggcttggaagaggatctagtcaatattgcctctgatggtgaacttgatcctaatttccttgagaagctgagtgatgaaaacatttctctgttcacaaggcgcgaggagcttaaacaacgagatacacaattgaagcagacgattttggagttggagcatgaactagaggaaacaaaaaggaaatgctctcagctttctactgagctacaggtgcggaagagccagcagcagctcccgtacatgtgaaggttatttcattaaggatgcagagcagcgaccaaggctaatgaagaaaccacggtgtcaagtgctgacgttgttcatattcttgctagtaccaaactgggtccacgcttaggaacattaggaaggaaactaactgcgcgtaccaacagcatatggttatcagatgtgtatatgtcgcgatgtctggttgcaactgctgtttcggccgggatcaaagacaat

SEQ ID NO: 18533 - DNA, 754 bp, Triticum aestivum
  Clone ID: PAT_TA_18533
ttcgagcggccgcccgggcaggtgtggatcgcaacctgagctactatactgtggttaagagggccgagaaggatttcgtggagaagtatatatgccctcacaaggaagctgcaccacacctcgcagaagactatgcaactgcttgcaaaggggaagtgcgaaccaacttcggatttacttgatccgaaaacgggccgaggaaataccggcgtgtgtatggcgcagcccagctttccctctgtatgacaaggagggtagctcggcccccacgtcccatgttatcaagttccttaaggcaaatggattgctaggtcagtaccgggactactataatatagtcatgctgagcgacaaagtatttatggagaggttcatacgtcctcacaagaaggctgcaccacgcctcgctaaagactatgcaactgcttgcaaaggggaagtgccagctaatttcagatttacatgaaccaagaagaggctatggaaatttgtaacatgtgtatggcgcaacaaagttttcactctgcattgtatgctggtaactcttgtcccagtattcattgcctaacttgatgttggctatatttgatagtataatatccatgacatgccagtttcgtcattgctaattcttgatgtaactgacaacttgattccaaaaaaaaaaaaaaaaaagcttcctattccttagagttgatttttgaaaatgagaagtctcatatgtttgtgtttctaaaaaaaaaaaaaaaaaaac

SEQ ID NO: 18534 - DNA, 363 bp, Triticum aestivum
  Clone ID: PAT_TA_18534
tagcgtgcgtccgcccacgcgtccgccgaagcgagctagagaacctagagaagaagattaaaacatgcttgcggaacgtcagtcagctcaggcagatattactaatggattggagttcaagtttgaactttgtcaggcggcctgtcaagaaggtatacaacacttgtgtgagacgactgcttacaaggtcacctttttcgacttgggccatattctgtgggacactctttacattggtgatattgcatcgagcagggtggacttattgttgagagagcttgatcctatcctggagacaatatcaggtacctgcccgggcggcgtctcgaaccgtgtcataacggtattgatgaaagccacatt

SEQ ID NO: 18535 - DNA, 1054 bp, Triticum aestivum
  Clone ID: PAT_TA_18535
cgctcccgcccccaggccccacacctctcgctcgcagcccttccctgcccggagacgcctgaaccccagcacgcgcacggacacacactcgaccccggagccggcgccggcggcggagatggtcgacggggagaaggacccggccccgctgcggctggagacgctgctggcgctcggcctcgaccagcgcacggcggagaacgcgctggtcaacagcaaggtcaccgccaacctagccgccgtcttagccgaggctggtataaccggatgcgacaagtccgttgggaatcttctgtatgcagtggccacgaaatacccaaacaatgcactcgtccatcgtcctgccctcattagctacatcgctgcggcggctggtgacgctcccggcgctcgcccgcgacctgcgctcggccgagaacgcgctggtcaatagcaaggtcaccgccaacctagccgccgtcgtagccgaggctggtataactggatgcgacaagtccgttgggaatcttctgtacgcagttgccacgaaatacccaaataatgcacttgtccatcgtcccgctctcattaactacatccgtttcgacgaaggtcaagaaccctgcacagctggatgctgctctgtcgtttcttaccaacactggtcctgaatctttggatattgggaagtttgaagaagcctgtggtgtaggtgtggttgtttctattgaagagattcagtcaactgttgctgaggttctaaaggaaaacatggaagctatattagagcagcggtatcacataaatgttggtggcctatgcggacaggtcatgaagcggcacccctggggcgatgctaaggcaacaaaggaggagattgagaagaagcttgctgagatactaggtccaaagacggaagctgacaatgtaaaaccagtggaaaagaagtaggaaaaaccagcaaaaggtgaggggaaaaagtgtgcagggaccactggtgccccaccatctgaggggggacttgatgcttatacaatattttcccaggcagggggaaacaattaggggtatacag

SEQ ID NO: 18536 - DNA, 1192 bp, Triticum aestivum
  unsure (1)..(1192): unsure at all n locations
  Clone ID: PAT_TA_18536
actagcactcctctgtccccctggcccaatcgccgtgatccagctagcttactacacaggcaagggcgattcgaccgaggccgccgccgccgccgccggagacgatcccgctgccttcagttagttaagatacaaaaatggcctcactggacaccgtcagaggagatcttggcctggttgttttgtacctaagcaaggctgaggcaagagataagatctgtagagctatacaatatggatccaagttcctgagcaacggacagccaggacctgcacagaatgtcgacaaatcaactagtctagctcggaaagttttccggctgtttaagtttgttaatgatctccaagctctgattagcccccctgccaaaggaactccacttccgctgatcttacttggaaagtcgaagaacgcgatgctgtcaactttcctctttctggaccaaattgtttgggctgggagaacaggagtatacaagaacaaggagcgagcagaattccttggcaggattgcattttattgctttcttggatctaatacatgtactaccatcatcgagctagcggagcttcagcggctttccaaatcgatgaagaagttagagaaggacctcaagcaccaagagctgtacaagaacgagcagtatcggatgaagctgaagaagtccaatgagaggctgcttgccctcatcaaatcgagccttgacatagttgtcgcagtggggctgctgcaactggccccgaaaaaggtcactcctcgcgtcactggggcctttgggttcgctagctctcgcttgctcatcgcctgttaccagttgcttccagccccagccaaatccaagtgatctgcctgcccgcctcgggccaggcagctggtgcatcgattggtgaaacggcggtcgctgttgctgatacttgataagaaataaatctggaccaaattgtccgtcctgtaggatataaccgaggattactgttgtgcatgctggcattgcccagggccatctcatagcctggttgatctgccttgccttagacttgatcatgtagcacgcttgtatttggagggtccggtgtgccactatcatactacaactgttgcaaaataatgagatttcacatactagaaaaaaaacggatgccgtaaaaaaataaaaaaaggtaccattcgccnaaggagtctataccnccc

SEQ ID NO: 18537 - DNA, 1116 bp, Triticum aestivum
  Clone ID: PAT_TA_18537
gatcccccgggctgcaggagatcacggaacaaatttgtataatctttcctatgcacaagggtgccaacaagattacccagtaaaccatgattacccggttaatcaagtttactatcaaatgcctgctccaccacctgcacagtatcagaacaatcgatcaccaaatggccatggcagaaaaaatggttatggctatgccggtagaagtggaatatcccctggttcttatccatctggctatttcgttgtaagaccattttatcaaccggatgactatgcgagctcgtggaacaggcacctactttcctgacccaactttgtgcaaggacaggccacccgctggacgaggggaaagaggaagacatagttttcatccaaatcactatcacagggctcaccgctatcccagaatggatatgcctgcagatatggtgctgtcggaggaatggaggcaagtgccagtgccaccattgcagatttacattcctggtgcaagtgatcatggaattccctccccgttgaatataccattatcatctccatccccccgggctccaagggatggtattcatcgcaatggttttattcacccacaagacaataaacttgaatttgggactttgggggcattgcctttggaagttaagggtacttctcaagaccatcctaacaaagctagttctgccgccaacagtcaaccttctgcacctgtaagccctgtgtcttcagcattaaatcccggaaagggttctaatcggatgaggaatggtgggccatatcatcttaaggacaacggcgatttcccgccactctccagctgacgcaagacatagttgaccattgtgtaccaaagacatgtcaagccaagagaaagatgccgatacatcgtgcacacccggtgcggcaatagcagagggttaatctaccaaataattcaccatcatgtacatcctgactttaacttgtcgttcccaagtcgtcatcagagtttcaccgtgccgccggaacgcagcctgcgctgctgtgactggaatctcatggtgaccccccatttccctcaaaaaaagaaaagaagaggaaaagaaagaataagcacagcttaaaaaaaaaagtgca

SEQ ID NO: 18538 - DNA, 2169 bp, Triticum aestivum
  Clone ID: PAT_TA_18538
ctttgctcggcccggcccggccctgaatagccctccctcgatcaagttgtaccggccagacctccttcccctccaagagtcaatctcgacggggtaccatcgttttcctaaatccggcgccgccgaaagtgcctctccgccctacctcgccgcgtcgtctcctctccgccctccctgaccggtgttcaggccgccgtcatgctcctccggacgcgccgctgcctgcctgccgctctttcccgcgcagccgtccacccacgcgtctcccctgcgctgccctcccctggagccccgcgacaacatggccccgtggccgtggcgaaccagcggagcgcactcgagccccgatctggaccgatcgattgggttcggagctccacgatggcccgagcgaatccggcaacgctgttcccagcatccactgggggacattacagggttggtatgcaggcccgatggttctcgtcggcagggcttccgccacacatggtgattgggatgccagcgctgtcccctacaatgaatcaaggtaacatcacaaaatggagaaaacaggaaggcgataagatagaggttggtgatgtgatctgtgagatagaaactgacaaagccacgcttgaatttgaaactcttgaagaggggtatctggccaagattttagtacctgaaggtccaaaggatgttcaggttggacaacccatttatgtcacggtcgaagaatccgatgatattgaaaagatacctgctgatacctcctttggaggtgacgtgggggaggatgagtcaagtggaagtgcagcacaaactgtcgaagttgatgcagctgaacaaagcccagtaatgagccgcatcagccctgcagctaagatgctgatcaaagaacatggtcttaatgcctctttactgaaggcatcaggtccccgtggcacccttctgaaaggtgatgttttggctgcgttgaagtcaggcactgctttaagttcagccaaagaaaagacagctccagctgcaccttcgccccaaccagctcgtgattcccaagttcactctcagacaacttcaccaaagagcgacacatttgaagatataaccaatactcagatacgcaaggtgattgcaaaaaggttgctggaatccaaacagactactccacatttgtacctatccaaagatgttatactggatcccttactcgcattcaggaatgaactcaaagagcaacacggtgttaaagtttcagtaaatgatattgtcataaaagctgtggcacttgccttaaggaacgtccctgaagcaaatgcttactgggacaattcgaaggaagaagcccagaagtgtgattcagtggatatatctattgctgttgctacagagaagggcctgatgactcctataataagaaacgcggatcaaaagactatatcagcaatatcttcagaggtcaaacagctagccgaaaaggcacgtgctgggaagcttgctcctaatgagttccaggggggtactttcagtatctcaaatctaggaatgtatccggtggaccacttctgtgctatcattaatcctccgcaggctggcattctcgctgttggtcggggtaacaaggttgtggagcctgtgatggacaatgacggaacagagaaggctgctgtagtaacgaaaatgatgctgacactgtctgctgatcatcgtatatttgatgggcaagtaggaggcaagtttttcacggagctggcattgaacttcagcgacatcaggaggctgcttttgtaaatgaaaggtgctgtgttatcgtgtttccaagaattctttggaggtggcccaagaaaagacactaggtgcaaatttagtttcagttgcttgatcaccagcgcataagaagtaaccagttttgtaaattaataagagagttggcaactccacggcgttttttcctccttaatttgggagctgagccccgagaggttacggccatttcatgtttgatgtggttacgcaaacatcaactcttgaggctgaggtttgttgccacgtttcctgaggatttctggcaacataagacgtttttgcccatgacttcgatacatggcttgatggcagtaataagtaatgattctttctacaatattgatatacatacttctgagcgtctcagattgtttgtcagtt

SEQ ID NO: 18539 - DNA, 663 bp, Triticum aestivum
  Clone ID: PAT_TA_18539
ttggccggtgcatgcccatctccgcggacggccacatatgggcggtgtccgcgatccagctttctgtctccagtttccacctggtcatgcaacgcctcttcacccaagaggaagaggatgcagcgggaggtcgttgggagctggttggcagacccttcaaggacgattgcaaattcgaccgctccctccccacctgggatggtagcttcctccagggctacgtggtgctccctggccatggcctggatgggggcacgctgattttgctcttccttcaaaatggccttttcttcaccttcgattgttcggccaccccggagatccagtggacctaggttacccacacttcagacgagtactacctccctatcaatggccgtggcttgtacgcacaagaaagcaatgccatctacatgctctggaacaacgtggtctacgaatacaagctcacggtggtagatgaagaggaagagagagggctgtcaaggctcaagctgcatccacctgcgaggattgactctgtttgtcctttcattacattgaaaggagatggcttcctcacccatctgggctggggggtcatgtgctctgtgtggatcagcctcgacctctcatgcgggtgtgactacctacatgccattgttaccaccttccaaattggtc

SEQ ID NO: 18540 - DNA, 634 bp, Triticum aestivum
  Clone ID: PAT_TA_18540
gcggctacagaaagtggaaacttggaagtaacatatacacacaaagaggagaacggtgcacttgctcttactggcatgctgatgcacaatcaaaacctgtgctagtatgttcattaaatgacaacactgtccgcctctatgacctgccatcgttcagtgataggggcagaatattctccaagcaggaaattagggcaatacaaactggacctggtggtttatttttcactggggatggaaccggtgagctgaaggtttggcaatggattattgatgcctcccaaacctgatggatatagtgtactctagattagtttcccaatgtatgttatgcgggatttctcaaggatacacataatgagttgaggtgtggttggcgatcagttcaattttcggttatatcctacatttattctcccaaggatatgagactccgctggatcggattgcagttagaacacatgcagagggcccatgtagtatcagtatgaaagctagtcttgttctggaatgggttcgacgtcgggggaataattccttgtaatttgcagagcaccggaacatggaagtgtctcattgcttttctccgatgtgctgataaccctcaggggatgtattaatatgaggattttgt

SEQ ID NO: 18541 - DNA, 595 bp, Triticum aestivum
  unsure (1)..(595): unsure at all n locations
  Clone ID: PAT_TA_18541
gcacgaggccctggccagcatcagccgcgcccngagcaactccagtgctcgcagccgccggacgctgccgtctgcgcgaagggccgccgcccgcgcctcctaccgcagcacgccgattcgtcgggatccggttggatccggatgccagcgccccgttccgacctccccgcctcgcttgggtcgtcggccacctcgacgacgtcataccgcttgcgggatccaacgccaccgctggccggccacttcctcgcctgcaggagacgcccccacatcggcaccttccaacacgagcagcagcagcgaacgcctcgctaaggcgtctccagtggtgtcttttgattttacattgttttaaagaagtttgccagatccgtgccagaaaaacaatggcgatgaactccgattgacatcccgcgaagggtcggcggcgcttgatgtggtggctgcagaatagcttcgggcaaaagtagtaggccagatctggaaaaaaatctgtaattccaagttttttgttgtgtatttcttccttttggtaaaaataaaatttagttatctgataaaaaaaaaaaatttttcttnnnacctataaaaannn

SEQ ID NO: 18542 - DNA, 1604 bp, Triticum aestivum
  unsure (1)..(1604): unsure at all n locations
  Clone ID: PAT_TA_18542
cgtccgcggacgcgtgggctcgccaaaccacaccacgcacacaccaacacgcggccatgtaccgggcggcggcgcggccatttcgcggtcctcctcctcggcgctgcggcggcagctcgcgcgcggcggcggcggggagcagcggcagtgggcgcgcgggtacgcggcgaaggaggtcaccttcggcgtcggcgcgcgcgccgccatgctgcggggcgtcaacgacctcgcggacgccgtcaaggtcaccatgggccccaagggccgcaatgtggttatcgagagaccgaacagatcccctaaggtcaccaaggacggggtcaccgttgccaagagcatagagttcgaggacagcgccaagaatgtcggggcgagcctggtgaagcaggtcccggatgccactaacaaggcagcaggagatggtaccacttgcccaactgtgcttacacaggcaattctcacggaaggctgccaaggctgtggcagcaggggtcaatgttatnggttttgcggaaaggcataaacaaggctataagcgccgtcactgctcacctcaaaagtaaagcatggatgattgattccccagatgaaataaaccaggtagctacaatttctgcaaatggcgaaaaggaaattggagatctgatatcaaaagctatgggaatagttggaaaggatggcgtcattactattgctgatggcaaaacattggataatgagcttgaagcagtccagggaatgaagttgactagaggatacatatccccttactttgtaactgatcacaagactcagaaatgtgagttgaaagatcctctgattcttattcatgacaagaaaatctcaaacatgaattcacttcttccagcagtgcaaatttctatccagaaccgcagacctcttctcatttttgctgaggatgtagatggagaagctctatcaatgcttgtactgaacaagcatcgtgctggactcaagatatgtgctgtcaaagctcctggatttggtgaaaacagaagggccaatctggatgatatggctgttttaacaggagggcaggttattagcgaggaccaaggtcttgatcttgataaagtcgaactacaaatgctcggcacagctaagaaggttactgtatctcttgatgacactatcattctagatggtggaggtgaaaggcaacagatagaagagaggtgtcaacagcttagagaatcacttgagaacagcacctccatgttcgacaaagaaaaggctcaagagcgtttatcaaaattatctggaggcgttgctattctcaagattggtggagctagtgaagctgaagttggtgagaaaaaagacagggtaacagatgctctaaatgctgcaagggctgctgtggaggagggtattgttccaggtggtggagttgcacttttatatgccaccaaggagctcgacaacattagcacatcgcatgaggatgaaaagattggagttcaaattatcaagaatgctttgaaggcccccctgatgaccatagctgcaaatgctggcgtcgatggtgccatagttattgggaagctactggaacaagataatcttagtctgggctatgatgc

SEQ ID NO: 18543 - DNA, 1643 bp, Triticum aestivum
  Clone ID: PAT_TA_18543
aaaactgagaaagctgaagctgtacagccatcatcaggtgaacaagttgagactgtcaagaaaacatgccaagctgaacctgtaaagcaatcatcaggtgcacaagttgagactgtccagcaagcatgccaacctgaagctgacgctgttaagaaagcagaaaaattaatggaaaatcaagctccaaaagtggcccatgaacatcagctgatgtagctgagcaaacaatggaaaatcaagctccaaaagatgcagttgaaattccttgtgatgtgaagctggaggatgaagcattgactgaagaatctgtagatcaagttgtaactgagcaagtcaaagttccatcagatgctgtacctgacacttgctaaagacaaaaagaaacaccaggcgaacacggctggacagaaaaagaaaacggcacaacccaagacctaacagatgggaccggaccaggtccgcggttgaaaaagcaatgcctggaacccagaactgctcaatgcgtcccggggccacaccgctgtccccagcaaaccggtcaagtggaaaatgtaaactgatgcatcaggtggacacaccaatgtggacagaaaaactgcagaagagataactatgactgaagtcgtgtttgagggagctgtggagtcagaagctgtagcaccagttgaggaaactgtagaagataaagctactgcagggacacttggggaggcaccaggtgatgaaatggaaaacacggatgcagctgaatcactgggtggggaggttggtgtaggtgaagccacaggcgattcaccagatgagagagttgctgttgaagcacttgccggtatgtccacccaaggtgaaacggctgctgaagcagctgatgctgaaattgcaacaactgggaaaacagcagagggtgtcggtgttaaaactcgaggtaagaaggctacagcagccaagaaacctgtagagagtgccacggctgaagcagatggtaaggatgctacagcagcgaagaaaccagtggagggtgccactgtcgaagcgagggatgagaaagctgcaagccgaggaggacgccctggcagtgccacatgataagcaggtggtgagactgatatgaaaggctaggtagctcacggcgaattcttgtttctgtcggtattaaggtaatttatctgcccgaccggttctcccccatcaggatgccatgttttgtataggaaaaggcggcagtctgtctgacccttgcatcgcatcgctatgtcatgttctgtagaggaacaatatagagcctgtctgacccttaaatcgcatccatgttaggttagcttaggcagtagcatatatttggcccctttcacatgagctccatcaatcatcatcggttttgttatgaatccagaatcgggtagttaaagccatgttctttcggatgcacattctagtggcgggttgtcatgctggccccggtcggttgaatctgctgggacatcatatgcttctttgtgatgggtttgccgctgccccgtcggtgaatctgctgggacgttatatgattcctgtatcaattgtcatttgtaaacggttctgttctggcctcgcccctcccgcttgcgtgttggaaaaaaaaaaaaaaaaaaaaaaaaaaaaaa

SEQ ID NO: 18544 - DNA, 653 bp, Triticum aestivum
  unsure (1)..(653): unsure at all n locations
  Clone ID: PAT_TA_18544
cgtgcgcgcacgcgttcgaggacgcgtcacgcacgcatgtacccgagctttagctgcccctagcttgcgccattagagtggctcgatcggccgtgtaggtcgaaatggggcgagggagaaggagaggcatgagagcagtgccgttgttcttggtcctgctggtgttggtgttcatggccgtggcgagggtggccgcggcggagggaagcgacgttgcagaaggtgtcgacgttggcggaggggaaggcgaagacaaggcttttgagaagaggttcttgaagctgtggacggacggaggcggcggggacggggaagatcacctcagatgttacggtgatgacgaagatgattatggtgatatctatgacgacgaaaaagtcaaagagatgacggaggaggaggaggagggcgaagatggcatcatgttgggtgcgacgagatgcccgaatccgaacaagaaaaagaagaagaagaagnnnaacgtcgtgaaggtcgacagcttcggcgccgtgggggannnntgcgccgacgacacagnnnnacgctcatttcttaatagtcgttcatgccaacgccgtgatatatatatgatacgtacgtacctaccgactnnnnatggcgtgannntannnnctgcnnnnnnnntnnnannn

SEQ ID NO: 18545 - DNA, 639 bp, Triticum aestivum
  unsure (1)..(639): unsure at all n locations
  Clone ID: PAT_TA_18545
agctccggcgcggtgctctgctctcctccccgtgcccggcagcggcgatcggcaagcgacgtccctcgcgcgccgcagccgagcgttcgtcggagggcgtcgtgcggcattggcactcctccccaccgcagccggcctcgccgactacaaatccccatcccctcccgtccccgccccacccatccaacccccctcccaggcgagcccccgagaagtttccgatcgaatcgaagccaagcaagcttccctcctcctcctcaaggatactattgaatacatttgtgaagaggacttgaacacaggttcgtcacgatggcgaatacaaacataaccggcatattggagaagatgacagggaaagataaagactacagatatatggctacatcagatctgcttagtgagttgaacaaagagagtttcaaagcagatcaagaccttgaatcaaagttgactaatattgtccttcaacaactggaagatgcttcaggagatgtttctggtttagctgtgaaatgcttggctccacttgttaagaaggttaacgaggaaagagtagtggagatgaccgacaagctttgtgataaattactcaatgggaaggacnnncatcgtgatactgctagtatagctctgaag

SEQ ID NO: 18546 - DNA, 1176 bp, Triticum aestivum
  unsure (1)..(1176): unsure at all n locations
  Clone ID: PAT_TA_18546
attaatccggcagatttcttttacccaaccggatcgccagttcccaaacaaggttcagcttttgtaccaccggacgaaattcagctgcctccggccaccatcgccttcgactggccctcccggcagggccaaccctgctcaatggatttcatggccttcggngccaaccgggataagatcgtcgccgtggacagcatagggtgctcctacctttacgacgctcccgtacgcagtatcagcaccaatatgcccatgatgcccacgcgcatgctacaacccatgtccattgctgtcggtgacaacggcctgttagttatgagtaaagccgatcaccagttcgtggctctgaatgatggctgcgaccccaattccaagatatttattaccaaatgtctggctgngtactggcagtccctcaagccgcctcccttccccagccgctcctaccaccagaacgagaaaggcagtcaccatccatttgaagtcagctcttacacggtagttggcaattcacagttctgggtgtccacagtgggtgcaggcacgttttcctttgatatgaacagcggtgcgtggatgaaggctggcaattgggagctgccattcagaggtcgtgccgagtatgtccccgagcacaatctctggtttggcatgtttggcaaagacgaccagctttgcgcatctgacctcattgccgtgtccgcagtgagctcaccagtgccacatatactttggaaagagctggtttggccgaaagattggaagctcaggtcgacccacctcctgcctcttggttctagcagactctgcattgccaggttcttcctaacttcagatgatgacaaggaagagaacatgtcagactataagcgcagcacaacaaataattttggggtgctcacgggggtggaagtggtgtctgatgaaggaggactgcgcattatccatcacaagtccattcgcttcgatttcggcctcagcattgctagtgtgctgtgatacgttgactcctctagtgcaggtgagtttatttatatccggaacctgctgtagcacacctttcttttccatcctttgctcaaacgcactacaaaagcttgtccttttagcactatggaaaacgctttcttgctggaacataatgcctcaatcaaataaaaagttncttagacanac

SEQ ID NO: 18547 - DNA, 665 bp, Triticum aestivum
  unsure (1)..(665): unsure at all n locations
  Clone ID: PAT_TA_18547
ttttttttttttcttagcaacagacttttgcattcaaccttcgtactttacatcatggttgtacaaacgaaacccaggtgcatgcatgcatgcgcacgcttcatcgcgtacgtacgtacgtgcacggtcgatcagtttctagacactcgatcgttgctacaagacctagcagcttacttgccgggcacaaagttggtggcgaaaggcccaggcgttgttgttgacggggtcggcgaggtggtcggcgaggtctccgaagggggccttgccggtgacgatggcctgcacgaagaagccgaacatgggagaacatggcgaggcggcgttcttgatctccttcaccttgagctccgcgaatgcctcngggtcatcggcgagnccaaggggtcnaaagctgccgccggggtaaagcgggtcgacgatctcgccgagcgggccgccggcgacccgtaccctcgacgggccaataacacnactggcaagccaaatggaaggatctctcgcgtggacnagctggggtnccgagtatcaaggcgcccnctaagtttggaacggctnaacanaggctcccgaatnaccnttcggcnacantcnggaaaccaccaaanncanatgccacggatgtnactcaatccgtctggaagccggcgcnancccggtcactt

SEQ ID NO: 18548 - DNA, 794 bp, Triticum aestivum
  Clone ID: PAT_TA_18548
ctagttctcctggcagcgggagggacaatagctctttcaaaaagcctggtcaaagcagtactgtctttgtcagaggatttgattcatctcttggggaggatgagatccgaagctcacttcaagatcattttagctcatgtggagatattagaagagtttcaatcccaaaggattatgatactggcgcaagcaaagggatagcgtacatagaatttgatgacatcagttctttgtccaaagcgctcgagctgaacgggtctaacattggagaaggcttaagcttgtttgttgatgaagccaagcctagggcagataacagagatggcgccgatagtggtaacaggagcggaggaagatttaacgggggcgggggccgcggaggaagatttgacgggggcgggggccgcagaggtggaaggtttgacgggagctctggccgcagaggtggtggaagattcggctggggtgacagaggcggccggagtgacaggggccgtggtcggggtggtgcaccccccaggcagagtgctggcacacctagtgcagggaagaagataacattcggtgatgactgagcttggtgactccgcttgaaatcgcgcagaaactccaacccacccctagtgaaatgtcgaacctttcgtttttgcctggagactacttgctgtttttaatattatcttattattattatcattgtggaccgtggtggttatctgccagactatgtcgtctgtttgggagatttatactcgtgatgaattttggtcagatatatattacctcctggcttc

SEQ ID NO: 18549 - DNA, 649 bp, Triticum aestivum
  Clone ID: PAT_TA_18549
accagcactacttttcactcattaagaaggaaccggcaaagccgggaaattacagaggaatacagggatgagaggaaatagattacacctgacacaatagaagggaaaaagaaaaggaccggaatgccatcatcttccatagtcctcgcgaacggaaggctgcatgagaacaccaccattgtagaccaagagctccaatcaaccgagaccatccatgatgcctcaaagctattggtgtagccgaagggcaatgagcgaccgagtccacacccggacgaagagtcacacacatccgagtctacaacacaacagcggcaccgctggcaaagccgaagggcaacaaggagccgagtgtacacctagatcgcttcactgtgctcaccgaccactgtaatcacagaaggaaaactccggcagcacggaaccacacccgaagaagacaccacaagagaagaagagcaatcacatcacaacaaacaatccacttgaccctcgacaatgtcagcaagcaggcaggtagaggggctccccaacgctaattgtatatacaattcgcatccatcattcctgtcttacttcccgggcacgaagttggtggcgaatgccccacgcgttgttgttgacaggggtcgcaatgtggtcggcaaag

SEQ ID NO: 18550 - DNA, 669 bp, Triticum aestivum
  Clone ID: PAT_TA_18550
ttttttttttagatcaacttcatcaccaacatttcataacacacttatatcatcctgcattcccacaaggttaaaggttttgttaccgcacatcaacctaaggcatggcacgccacgatccacatatggttccatataagttcataataatacggcatgcatcatattagacagtactctaagcaatagctagcaaaccacaaaccaccaccagcttcaaagttcatgccggcaaagccaactgctagttgtcagaggcagactggccttgaagaagaccatcgcggatctgcacgaaagcatcatccaggttgagctttggaacacttgccctgatcacatcaaagacataggcttgaatctgggatcttgtgttggtcagtttgtagtatgcgtcactttctttgccagccagaggtcggtactgaatcgatgcaacaacagtgacaaacacattgtcctttgtcttggtttcacagcgcacatccagctgctgcaacctgagtgtgagatggccaactacacgtttcccaaagatccaaggcaggcagtggcatcctggctcaagcacactgtcaaacttcccaaactgctctctgatggccacggtagactggtcaacttgaacacagcagcacagattgcccatactgcaggcttccgatcacc

SEQ ID NO: 18551 - DNA, 1071 bp, Triticum aestivum
  unsure (1)..(1071): unsure at all n locations
  Clone ID: PAT_TA_18551
tgcaagcgaagcaggataatgccacaatcttctaggaattcatggccccacatagctagtatcaacaaacgccaaaagttggtgatccccatgaatctctactcctaagggagcagttggtagtctcgcttccaggtttttttagtcccacctcccacgggtttttttcgtcctaaaaaaatctacgaaattttgtaggttaaccagggacaactccccacctcncaggttttttttcgtcccacctcccatggttttttttgcacctcatcccacctcacactaagccgccacgaaccgcaaaaaccgcctaccttagccaaatcaacaaatctctctcgttaatgcaattttctttaggaaacaaataatagattcttttctaccttaaccaaatcaacggatctcttctattaatgcaattttctttagcaaacaaataatagattctttcctaccttagccaaatcaacggatctctcccattaatgcaatttgctttagcaaacaaataatagattctttcctaccttagccaaatctacgaaatctctctcattaatgcaatttatattaggaaacaaataatagattttcaggaaacaaataatctctaatctcatctctaattctccaataataataattaatataatataataataataatacctaaaagaaacgcagcgttccgtttcccgtcttacgtcgtcgaacccttcgtcgagcctccctcccgtgcgctgttggttttccctgcgtacgttccaccccaaacgtgattcgttcttcttaattacgtggtcccacccccatgcgatccggccaaagaaccagcaaaaccgtcatacccatgcacgcaaggaacgaaaaatccatgcaagttgtgtctcctcctccctcttcaaaccctagccgccccttcccagttgacgccgctagcgagtagcgcgtagcacaggcacccgtgcggcccttctgtggtcccccttgacctcgcaatgaaacagctcgtcagcatcgacgacgagccgatgcgtctgctgttgattcctgtggatgggtcaagca

SEQ ID NO: 18552 - DNA, 578 bp, Triticum aestivum
  Clone ID: PAT_TA_18552
acgtcttttcttggtcccctaaaaccgcacctgacaggttggacctcggccaccatgacgatttggaggctggaactcgaccccgaggctgagggctagcaggcatgtgggaattatgatggatgctgtcgtcatggaaataggttctaaccagtgagaaacccacatataacctcaacacttggttcctgttgtagtatttgttatctcatgttttatcctcctacttgctttagttccttatatattctttctctatctagcaattgcttgacctgcactgctgaattgtaaccacagccaaaaaagagtacctgcccggrcggccgctcgagcggcgccgggcaggtacacgcccttcttgccgaccttcctgccgttggcgtcgatgtcgactgtcaagtcgcctccgagtccgaggggcttatcgaccttgatcttcttgccaccgctgcagacgacggcgaaggaggagccccggcgggagagggacggcacgctcgtcggcgccacaatcggcgaggtgatcatggaggctgccatctcgcgtgcgctctctcaagttctgtctgtctgcg

SEQ ID NO: 18553 - DNA, 302 bp, Triticum aestivum
  Clone ID: PAT_TA_18553
gatgcaacaatcgtcatgatatcattgttcaagggttcaaacattatcgtcgtcatcacgggacgaggaaaatttgccagacgcataccaataatgaccgaggacatctggtctctctcttctactacatggagctacaagccggtaatggtgagactaacgtaacacacccaagaggccaaagggaaagtgggggtaaactgcggcaatcctggaataatgacacaagaaccaaaaataacagcagcgcacaacatacgaacggtggacgacggacctgcccgggcggccgctcgaaatca

SEQ ID NO: 18554 - DNA, 737 bp, Triticum aestivum
  unsure (1)..(737): unsure at all n locations
  Clone ID: PAT_TA_18554
cgtccggttttctccaaggtcctttgcaggttccttgggtaaagcttgctgattgtcaatgtgattagagggccagtggtcgaatgatgcatttcctataggtctatccagtggagatggcgtcacctgccggagaagcgagggggctatccctcgaaggggcggtgtgatggcggtggtagacaccccaggttgtgcccatcgacgcagcaggcagtgtgtgggtgaacttctataagtttctcaaccgcaggccgaaccaccgctcgaaagccgccatcctcttccactccatcaacaggacaacgtctcctgcgttctcgatccggcgccaccacatatcgtgattcttgatcgggcacaggccgccgccataagagagcttctctggtgtggtcttcatgcttggtctggagaagcaggggaggatgagtaggacgggcatggggaaggagcagccaggccggagctccggcatcgctcgcgtcatggtcgaatggagccggccatctctatgggctgctgctcgccggtcgtcgttccccaatcagagttgctcatcttnggcttcaccatcttcctccccngatcatgcatctattttagatcatataattatgctatatcatatatgttgtttagttgagacttgngcatgcatnggcattatttagacagagatatngcatattgtacataaaaggagtacgganatctaagaataagctcgaataaag

SEQ ID NO: 18555 - DNA, 579 bp, Triticum aestivum
  Clone ID: PAT_TA_18555
actcttgcttgtgtgtctcgcgtgaaaaagtaagctacctggcacttgctctactctgctttagcaggcgctcgcagaggaggccaagggatacatgatactggtaatttactaatgatccatcttagtggaatgcttttgttgtagatattttcattggttgtcctttcattttatttatattcatggctggatggtgccttccactatgcttcttcactgaaaaggtgtttcacatatgtgtacttgcttgagaatggaataatctcagaattctgttgaaaacaaaacttagttatttcagcatgcatagtgtttggctatagagattgagtgcttcacatatccgatgccatctcagaataatctcagacctgtttaaataacttagtgtttggctaaggagtccacattgaacgccacatatccgatgccaacacaccgaggtgagcttcagcaaactctctctctctctctctccaatcagacatgtgaatatttaccagagtgcttcaagatcgatctgacgaaagccgtccactgccgctctgctgtttctctctctctctctctctctct

SEQ ID NO: 18556 - DNA, 652 bp, Triticum aestivum
  Clone ID: PAT_TA_18556
tttttttttttgagacatgaaacatggagtagaattcaagtgtgagtaatcagagacatatatatatatgtatcagtatcacatagtctgatcgatgaacatccatctttttccttccttccttccttcctatgattgaccaaagtgaaaaaacgagacccaacttacgtacatgacaagaacggttcatctgccgacgcagatgaaggacatgaacatgaacagcacgaatgaaaactcaaaaagaaaaattattaacaccgacatcggcttgcttccctaaccttgcttattatcaacacggaatcaacggaatttcaattaaaacgtacgtgcgccggccatggatgcgcccgcgcgcgcgcttgggttaccatggtcgccacggcgcttggctccatggatcgagcggtgcagctgctagctccatgccttcaggccacgcgtgcgtgtaccttggcatggcgcgatcggtgcgtcgaacgatcacaaggccagggctccggccaccgtcaaagccgcgagggccgccgcgcgccatgacgcggagaggcccggcgcggcgttgggccggaacccggggtcctgcgggtagagcgggccgggcggggtgaggtaggacggcatgtgggcggcgtgaaccacccggacg

SEQ ID NO: 18557 - DNA, 588 bp, Triticum aestivum
  Clone ID: PAT_TA_18557
gttggggacagtaaaatgcacttaatacatgataaacattgggtacaaaagaatggtcaattacatcctataattcggttatatacaaaaggaaatttcctcttttgtgtacatcctaaagaccacccccttgtgatgaacgctttatccttcgagtcaaatggcacagctcctgtcctttgtggcaaaataatacccatcaatgtccagagcaaaaatattatgtaatgcatcgcaactgattgattgtttcatctccgcaactacaaatcatgtcttcaaaaggttgcagaagctcgaaacttctccggaatagcggaattttaatatgagtagcaaagaggttgagaaccataatccttcttcaggcagagacaacaacggacggcttgttgcctgcaggcagccgacagcgtctccggttgtactgcttggtgaatccggacactgggcaggctgtcgatggacgtactcggcctttccaatggtgcgctcgatcttgaagagtccagtgcattcacctaactctctctttctccctcctctccttccttctctctctgcccctcatctctctctcctgcaggg

SEQ ID NO: 18558 - DNA, 491 bp, Triticum aestivum
  Clone ID: PAT_TA_18558
gggctccaaaaatccacccttttacagtttccaaagtaggaagtaggagtatatgggaactgggttacgtacatacataaaccatttggtcgaatcaattactttgcatcggtggatgacatacattcacaggagggagctacgtagattacagagacgtgcatgcaagcagagacccggccctgtgttacacgtagatgctcttttaaccggcgagagcgctggtgttgtaaaccaggaggacccccccccccaggaggccggcgagggtgaccgcccaaataaaaaacccggtcgttcccccggcgtagcggtcaccaaattcaaaccattcctccggcgtgtaaattgggctgtaaccgtcgacgttggcgccgtacttgtaaacaaactggtacacgccctttttgccgacctttctgccgttggcgtcaatgtcaactgtcaaaccccctccgaatccgaggggcttgtcgaccttgatctttttg

SEQ ID NO: 18559 - DNA, 565 bp, Triticum aestivum
  unsure (1)..(565): unsure at all n locations
  Clone ID: PAT_TA_18559
gacgaaatgtagcagcgctacttttcattcattaagaagaggaaccggcagagccgggaaattacaagggaaaacaaggatgagaggaaaagatacaccagttattaacacaattaaaggaaaaagaaagggtcaagccgacaaggcaagctcggaaaagaaaagaaaaggaccggaatgccatcatcttccatcgtcctcacggacacaaggctgcacaagaacaccaccaccatagacgaagagctccaatcaaccgagaccatccatgatgcctcaaggctattggtgcagctgaagggcaatgagcgaccgagtccacacccgaacaaagagtcacacgcagccgaggcaacaacacaacaacggcaccgccggcaaagtcgaagggcatcaaggagccgagtctacacccggatcgtttcaccatgctcaccaaccaccatgatcgcagaaggaaaactccggcaccaccgaaccacacccgaacaaggtaccaccangagaagaagagaattacaccaccacaaacaatccacttgaccctcgacagtgtgagcaagcc

SEQ ID NO: 18560 - DNA, 497 bp, Triticum aestivum
  unsure (1)..(497): unsure at all n locations
  Clone ID: PAT_TA_18560
ccactatagggcgaattgggtaccgggccccccctcgagtttttttttttttttttttcaagtctaacaacagtcttttgcattcaaccctcgtactttacaccctgcatggttgtacaaacgaaaccagctgcatgcatgcgtgcgcacacttcaccgtgtacgtacgtgcacggtcggtggctacgagacctagcttacttgccgggcacaaagttggtggcgaaggcccaggcgttgttgttcacggggtcggcgaggtggtcggcgaggttctcgagggggcccttgccggtgacgatggcctgcacgaagaacccgaacatggagaacatggcaaggcgggccgttcttgatctccttcaccttgaagctccgcgaacgcctcggggtcgtccgcgaggcccagggggtcgaagctgccgccggggtagagcgggtccgacgatctcgcccgagcggggccgccggcgaacncgggtatgccctcgacgggc

SEQ ID NO: 18561 - DNA, 934 bp, Triticum aestivum
  unsure (1)..(934): unsure at all n locations
  Clone ID: PAT_TA_18561
ggcacgaggtatccttgtatgcaaactactttttgtttcttatacacaacgacctatgttctatgttgggtacatatttttgcacttcttttgaaattattatggtgcatctgtgatatacctagcttgtattaatttccagggtatattccagtcataatggagatgcttgtgataagtttggtaccttcctctcctacatcgtttggtgttatgggccgttcctagatctctatattttgcaagaggccatgttattttggtatgcaagagcaggcctgacaggtatgtacaagctatttaaaagggccaagaaggcggaatagcctcgcttatacagtttctgactactaacagtgccatcatcaatgagcttcactctaaagtctgttcatgagagggttgtgcttccttcaatgctagggctgaaattggagaataattaaacaaggggttgacatgcttgtgaagttctattaggacagcgtctccccgtgttctcgatccggcgccgccacatatcatgattctggattgggcgcaggtcatcgccataagagagcctggctggtgtggtcttcatgcttggtgtggagaagcacgggggatgagtaggacgggcatggggaaggagcagctaggccggagctccggcgttgttcgcgtcatggtcgaatggagccggccatcactatgggctgctgctcgccggtcgtcgtttatccaatctcagttgctcatctttggcttcaccatcttcctcccctgatcatgcatctattttagatcatataattatgctatattatatatgttgtttagttcagacttgtgcatgtgcatgcattggcattgatttagacagagatattgcatgatttgtacatagaaggagtacgganatctaggaataaatgttnaataaagttagtag

SEQ ID NO: 18562 - DNA, 683 bp, Triticum aestivum
  unsure (1)..(683): unsure at all n locations
  Clone ID: PAT_TA_18562
attctgtagggggaggaactaaaaaagttaataggcgcaccctactacatcgaatgcagctcgaagacccaactagtatagctatcttcttacatgtttgcttattgcataatgcaatgtgagatgctgacagagtttgtttttctggtccttgtcgattttcagaatgtcaagggtgtatttgatgcggcaataaaggtggtacttgcgccaccaaaggcgaagaagaagaaaaaggcgcagaggggggcttgctccatcttgtgatctaatcatcggtagacaaagaacaagggcgaagttgccgccatgctatattattgttacgtcttgcttcagcggagctgcactctcatggtcgtcgtccctccccataccccaccctaggttacccaccggcagctgcagcaaggtctctttgtcgaggcatcgggcgattcaattgttttgattctcttcctccctgccttgtgattattccgtgtgactgacaagtcctggcaatttaagtaacttgcttaagtaagacngtatttccccgtgttttgagaccccgtttaaaaaaatancccgttgttatctccgttccataagtnanagacatgatgttatccaccaatttatcnatttttgcttgtaatttcacttcaatgggaattatttcctttccnaaaaaaaaaaaa

SEQ ID NO: 18563 - DNA, 664 bp, Triticum aestivum
  unsure (1)..(664): unsure at all n locations
  Clone ID: PAT_TA_18563
tttttttttttttttttaaccagaagaacagagatgccttgattaatctgagaaaatagccagatattacacaaacaccatcttgtagtgtacacacaccaactcctcatctcgactcgccctcacatgcaacatctatcagtccggactactcaatctcagaacgggaagaagcagagatcgacgacgacacacatgcagcagcatccatcagccatgaagttgtcggcctagagcttggagctgacggcgctcacttgccggggacgaattgggtggcgaaaggcccaagcgttgttgttgacggggtccngcgaagtgggtcggcgaggttctccaagggggccttgcccggtgacgatggcctgcacgaaagaacccgaacatgggagaacatggcgaagcggcgtcttgatctccttcacttggactccgcgaaggctcggggcctccgcgaaggccaagggtcnaactgccccggggtaaacggtcaacatttcgcccancggccgccgcacncggggggcccgtaccattccctanatgatcntatacngcccacggcgtcgtttaaantcngacgggaaacctgggtnccaattanccctgagaanccccttccancnggtatacaaagccnacgtgcctcaaattccncnaagga

SEQ ID NO: 18564 - DNA, 581 bp, Triticum aestivum
  Clone ID: PAT_TA_18564
gcaaatgcttgtcgttggcataagaatatactgccaccaaaagtcccaaagccaaccattccaggaccaacctcaacatctatgacatccaggaattaaaatcattagttttccaaaaatgaagtatggaggcggggaggataggagcacactgccacagataaccacataatcgtcctcaacatatagggaggtgccacgaggggagagggagacggcggcgctatccctgcagtgacagcacgcaggtggatcggccgcttctcgctgatggatgcaacctcgtcctccctgtccttggccgccgccgcatcggccctctccgcgcccgccccagccgcctccatacctgggcccagccgatccgcctcatggctcgcatccgctgcttccctcctccggccgaagacgcgttggttgagctcctcctccgtacctatctcgcaccgaggtcactcctcctcccgcggcttcctcgcaacctggggcagatgagaacctcatgaggtggtggatctcatcgaaacggacggcgaagcctctagttgcggctgtggtgaggggaggaggggggagaaggg

SEQ ID NO: 18565 - DNA, 623 bp, Triticum aestivum
  unsure (1)..(623): unsure at all n locations
  Clone ID: PAT_TA_18565
tatgcacctggtgtgccaattattctcgtagggacaaagcttgatcttcgagacgacaagcagttctttgtggaccatcctggtgctgtccctatcactactgctcagggagaggagctaagaaagcaaataggcgctccatactacatcgaatgcagctcgaagacccaactaaacgtgaagggcgtcttcgatgcggcgataaaggttgtgctgcagccgcctaaggcgaagaagaagaaaaaggtgcagaggggggcgtgctccattttgtgatctaatcatcggtagatgaagaaacaagggcgaaggtgccatgggctttatcatcgtcgcgtcttgcttcaagtgggaacagcatgaatggtccccaacccctctaggttactgggcggctccggtgcagcgattctcactctttgtccaagcattgaacgatatgtttgttcaattttcctccttcctgccttgtgataactggtgtgtggtgtgtgtgactgacaaatccccggcgattaggtaccncntagaagnatcccgtgttgacaaaaaaanaccggtacccgtccnaattaacangatgtatcgacaagttatttctattactgatggaagntgtcatt

SEQ ID NO: 18566 - DNA, 565 bp, Triticum aestivum
  unsure (1)..(565): unsure at all n locations
  Clone ID: PAT_TA_18566
ttttttttttaatcagaagcataaatatgtatcagtatcacatcgtctgatgaacatgtagtgaccctttcccttcctatgattgaccaaagtgaaatacgagacccaacttacgtacgtacatgacaagaacggttcatctgccgacgccgatgtacggctgaacatgaacacagcacgaatgaaaactcaaaaaaattattaacaccgagatggatcgacctgcttcttcccctaaccttacttattatcaacacggaatcaacggaattcatcaattaaaacgtacgtacgtgcacggtcgatcagtttctagacactcgatcgtggctacaagacctagcagcttacttgccgggcacaaagttggtggcgaaggcccaggcgttgttgttgacggggtcggcgaggtggtcggcgaggttctcgagggggcccttgccggtgacganggcctgcacgaagaagccgaacatggagaacatggcgaggcggccgttnttgatctccttcaccttgagtcgcgcgaacgcctcggggtcgtcggcgaggccccagggggtcg

SEQ ID NO: 18567 - DNA, 664 bp, Triticum aestivum
  Clone ID: PAT_TA_18567
tcgcggccgcgtcgactcaatacacacatacactaatacacagacccaacaaaatcagatcagtggtttcaaatagttgagcctgcaattagaaagtccaaggagttatgaacttgtgcactaaaaaaagtaaacatatttgacaataaaatgtacttaatacatgataaacattgtgtacaagagaatggtcaattaaatcatataatttggttctatacaaaaggaaatttcctcttttgtgtacatcctaaagaccacccccttgtgatgaacgctttatccttcgagtcaaatggcacagctcctgtcctttgtggcaaaataatacccatcaatgtccaaagcaaaaagattatgtaatgcatcgcaactgattgattgtttcatctccgcaactacaaatcgtgtcttcaaaaggttgcagaagctctaaacttctccggaatagctgcaacagaaaagaataagctataccatactcaagttgaccactgcaacaaagatcgttataaaacagaaacttcaaaggccatatcaggtaatgtgttgataggatttagaaaacaattgctggaaaacgaatatatttctcaacaccaaacaaactaagaaaaacatttcaacactaaaataaaactcgagactagttccctcgtgccga

SEQ ID NO: 18568 - DNA, 872 bp, Triticum aestivum
  Clone ID: PAT_TA_18568
gcccctcatctctctctcctgcagggaccgggccatggcgcaggatcgaatcgaacaccccagtcgttgcctcttgcctgcaggtcaccaccaacatcaaggagttaattttacatgagcatcaaggagtataactggttcatgagatattccgaagtcgacatctgcagtacaatgctttgctgctttggtttcctcagtttgtgtagcaagcagaggatgcatccctgagcgtcatagattctaactcgtccttgagatatcctgaagtcaacacatgcattcaattgctttgccactttgatttcctcggtttgcatagcaagcggatgatacactcatgggagtcaaggagtataactcatccatgaaatatcctgaagtcaacaactgttgtacaatgctttcccatcactttgatttcctcagtttgcatagcaagaggaggatgcattccttgatgcctccaaacttctgcaacattaagaagacgtctttgccttaacatcactaaaagaaggagcttgcctaggtcaaggtcggaggacgcgctaccatggttgctgaaacacgaactccgtccagatctccttatcctactcgaagctgctggtggatccacctttcttcattcttcactggtttccagcggctgtagcttcaaaatgtgtggaactcacactgctgctcaccgtgtaccatggccccatggggaagatgtgcgtcagatggggaggtggccggcatgcctgcggggaggtggacggcgcacggcggcgagaccgggccacaggtatgagcgcatccgtcaccaccggcaagcagccgagctgctcccatgtgaccatgtcactcctggcctctcctgctcc

SEQ ID NO: 18569 - DNA, 515 bp, Triticum aestivum
  Clone ID: PAT_TA_18569
gcatacgggctccaagaaatccacccttttacagtttccaaagtaggaagtatatcgttacagcgttacgtacatacacataaaccatttgttcggatcaattactttgcatcgttgattgcatacattcacaggagggagctatgtagattacagagacgtgcatgcaagcagagacccggccctgtgttacacgtagatgctcttttaaccggcgagagcgctggtgttgtaaaccaggaggacccccccccccaggaggccggcgagggtgacggcccaaataaaaagcccggtcgttccgccggcgtagcggtcaccaaactcaaaccattcctttggcgtgtaaattgggctgtagccgtcgacgttggcgccgtacttgtcaacaaactggtacacgccctttttgcccaccttcctgccgttggcgtcgatgtcgactgtcaagccgcctccgagtccaaggggcttgtcgaccttgatctttttgccaccgctgcaaacaacggcga

SEQ ID NO: 18570 - DNA, 961 bp, Triticum aestivum
  Clone ID: PAT_TA_18570
tggcacgtggaggagaatgttccgctgtcgcaggatgatgggaagcacagaagagaggaagatctccgggatagaaagcgtgaagatagggatgtttcatcaagcagggtagatgacatggatagggacaaaggtaatactatgaaggaagatagtgaccctaatagtgcatccaaacggcgaaaaattaagagagatcagtctgctttagaagctggggaatatgcaccttctgctccacagcctccgagccttggagctggtaactcgcaatttgaaatacgagagagagaaagaaagggtgttatttcacagcatcggccgtcacatgctgatgacctccctaggatgcatgccaaggattcaataagcaagacaagtcgtagagagactgaccaaacgcatgatagagaacgggaagaggaaaagaggccaagaactgaagcaagaagaaagcatcggaaataggttcttgcaggacttttgatcactgccacatgacatggtttcacctcgaggatgtgcatgatcacctgcgaacaagagtgctttgttgtagcaggaagatctatctggacatatttgaaacattcagcgtgtatgtctcaatccttcttcagctgtgtccttcagccgtacttcatcgatgctacacagtgtcgctgtccagatgcactgttatgaaaaatgtcattgtgcaaggaacaggcatctgggccatatggtcgattgattatacaagctgttataacattgtaacgtagaatgacgagcaacaaaactgtgggccatattatcctagacgaatttgctgtaaacaagcatgaggagatgtgttcatcctacagtggcagaaaacgatgaggagaatgttttgtagcaaagtacttcatctcatattttggaatggtttgattatcaatttcatctgcggcaacataaaaaaaaaaaaaaaaaaaaa

SEQ ID NO: 18571 - DNA, 1117 bp, Triticum aestivum
  Clone ID: PAT_TA_18571
ttttttttttttgtagaaacatgtggcagttttttcataacgaatgcatcacaaattattcgttcacaggaccgcggcacattcttcacggctgacgcgcacgacaccagcgagcgtcaacagttgatccaatgactttattattatatttcctataatccctatgctcatatggccccagcgccatatgatatgtcctatagtgtatctacgcacgcccgatcttctccaccaggcgtctctcgatctccatcctcttcttcatgagcacggtgtacttcttcaggagctccctgccctcatcccccggcgccggcaccgccagctttgcgccgagcgaggtcttctccaggttgcccgtatacatccgggagatgggaacaaagcctccttcctccttgcacagccacccgtgggcggctctcagggctgcgcccagcgaagccgaatcgggtctctcaactgtgaagacggggcagccaaagattttcgcgatcaacttgaggatgctctcattggaggatgctccgccggttgctatgatccgctttggtgggttgggcatgccaaaccgctcggcatgacctctcatcgacaacatctggccctcgacgatggcacgaacttcagattctggatcaaattcttgcacctcacactccttcagattgtcagatgaggcgtcactgaaattctcgacaatgtatcggtggaaaccaactggaagaggaggcaggatttcatggtctttgtagtagaatcctaacctaccaccattcagagggggtgttttctctagatagttgttgaaaatatcccatgatttttctgcgcactgattccgcacatcttcccgggtcaatgagccatttttgtaacatagcatcaccatgtaaccatctggttcaacagggttgggaaaaacatggccttcaaggcttggtttagcttcggcagtaatcccaaaaaccgtgtcactggtaccaaggctgatagcaagatcgccaggtgtattcagtgttaaacctgcaaggctattgggattgtcacctgaccactgaataacgaaacagttcttgtcaaactgatgcctttctacaaaatatgaagaaatccg

SEQ ID NO: 18572 - DNA, 642 bp, Triticum aestivum
  Clone ID: PAT_TA_18572
caagagttgtcctggcattcgcgtaagtcgcgatcttcattccaaggaaaccagacaccagagaggtgaccgcacccagcacacaggcaattgtgctgaacgcggcgttagcaagagcaggcttgcacgtcttgcccacgctgtaatggcagggatgactcttggtgctgaacccctcaatcgagccaaggaagacgaagatcaggaccgcgaaaacggtcatgaaccctccagcatacttgtactcagtgaaaaggaaggaggttgccccttcggagatggcggtctggatctcggcgcacttgaggacgacgttgtggtcgttgaggccctcctcctcctcgatgaggtactcgctggcgccgtccttggcccccgcgccggttcctcctccggccgccgacccgccctcgccgcgcggctcgggggcgaccttgaccttggacaccagcacccactgcagcaccgcgaacgcgatgccgaccgccgccgccaccggcaccaccagctgcgtggccagctccggcaggatcgccgccgccaccatctccgcctacgccggacgcgcccaagaccggttcttttccgttccgctcacccaccttcagcggaggattaggtagtacgagagcgaggcggacg

SEQ ID NO: 18573 - DNA, 1011 bp, Triticum aestivum
  Clone ID: PAT_TA_18573
tgggtaccccggggcccccccccgtgctagtgaggaacaaaacctaattcggacaggagaaattaaaagaaaagtttgatgataaatatgacagagatcgtgagagaaaaagcagatcggtcttgagaggcgccgtggagaagacgtggttgaacgaccaacagacagatcattggaaaggagagagcgttctattgaaaagatgcaagacagagttcctgaaaaaggaagagaagacaggaataaggaggagaggaacaaagttaagcatgaacccatagatcgagcacatactattaagaatgaacccatagatcgagcatatactattaagaatgaacccatagaccgagcacatactgttaagcatgaacccatagaccgagcacatacttctgatgaacgcttccgagggcaaagcttgccaccacctccacctcttccaactagttttgtaccccaatcagtcgctgctaaccgaagagatgaagacagtgaccgaaggggcagcagcaccaggcatacccaacggtcgtctcccaggcgtgatgagaaagaaaggtggcacttggaggagaatgctccgctctcacaggatgatgggaagcaccgaagagaggaagatctccgggatagaaagcgtgaagatagggatgtttcatcaagcaaggtagacgacagggatagggacaaagttaatactgtgaaagaagatagtgatcctaatagtgcatccaaacggcggaaggttaaaagagaacagtctgctttggaagctggggaatacgcgccttctgctccacagcctccgagcgttggacctggtaactcacagtttgaaatacgagagagagaaagaaagggtgctatttcacagcatcggccatcacatgctgatgaccttcctaggatgcatgccaaggattcaacaagcaagacaagtcgtaaagaggctgaccaaacacatcatagagactgggaagaggagaagaggcaaggactgaagcaaaa

SEQ ID NO: 18574 - DNA, 358 bp, Triticum aestivum
  Clone ID: PAT_TA_18574
acatacataaaccatctgttcgaatcaattactttgcatcgttgatgacatacattcacaggaggtagctacgtagattacagagacgtgcatgcaagcagagacccggccctgtgttacacgtagatgctctcttagccggcgagagcgctggtgttgtagacgaggaggacgccgccgccgaggaggccggcgagggtgacggcccagataggaagcccggtcgttccgccggcgtagcggtcaccagattcagaccattcctccggcgtgtagattgggctgtagccgtcgacgttggcgccgtacaaaactgtctcagacaacaagtttaatgagtctacaaggcaaattctcg

SEQ ID NO: 18575 - DNA, 882 bp, Triticum aestivum
  Clone ID: PAT_TA_18575
tgggcagcgtgctttacatgggtggcgtcccatgaccccataatgattcaagcccaagaacatgtgagaaatcattgatgcgcatgactgatagctttcgcacaaaattggagaaaaattcatacatgttattgatgcattagtaagaaggctcgccggctgggagatggcgagcgccagtgagcactgcgcacggtgtatcaagctggacaagatcacaagagcgtgagcgacagtcaagacatgagctatccagtggtcaaactgggctatatttctttcattgaggcgagggtgattccagtagattttgcttggcgtacttgccttttttcttgaagttgggtgtcagtcgtctctgcggcaagcaaggattctggatcgggcgcaggtcgtcgccataagagagcctggctggtgtggtcttcatgcttggtgtggagaagcaggggaggatgagtaggacgggcatggggaaggagcagccaggccggagctccggcgttgctcgcgtcatggtcgaatggagccggccatcactatggactgctgctcgccggtcgtcgttccccaatctcagttgctcatctttggcttcaccatcttcctcccctgatcatgcatctattttagatcatataattatgctatatcatatatgttgtttagttcagacttgtgcatgtgcatgcattggcattgatttagacagagatattgcatgatttgtacataaaaggagtacggatgatctaagaataaatgttcgaataaagttagtagtgagatttaggtagaggttacctgcactgttctgttttatgtagattctaagctgcaaaatcatacatagtcctgttagtaaaaaaaaaaaaaaaaaaa

SEQ ID NO: 18576 - DNA, 714 bp, Triticum aestivum
  unsure (1)..(714): unsure at all n locations
  Clone ID: PAT_TA_18576
ttttttttttggctccaagaatccacccttttacagtttccaaagtaggaagtatatcgttacagcgttacgtacatacacataaaccatctgttcggatcaattactttgcatcgttgattgcatacattcacaggaggtagctatgtagattacagagacgtgcatgcaagcagagacccggccctgtgttacacgtagatgctctcttagccggcgagagcgctggtgttgtagacgaggaggacgccgccgccgaggaggccggcgagggtgacggcccagataagaagcccggtcgttccgccgacgttggcgccgtacttgtcaacgaactggtacacgcccttcttgcccaccttcctgccgttggcgtcgatgtcgactgtcaagccgcctccaagtccaaggggcttgtcgaccttgatcttcttgccaccgctgcagacgacggcgaaggaggaaccccggcgggcgagggaggggacgctcgtcggcgccacaatcggcgaggtgatcatggaggctgccatctcgcgcgcgctctctcaagctctgtctggcgtgtagattgggctgtagccgtcgacgttggcgccgtacttgtcaacgaactggtacacgcccttcttgcccaccttcctgccgttggcgttgatgtcgactgtcaagccgcctncaagtccaaggggcttgtcgaccttgatcttcttg

SEQ ID NO: 18577 - DNA, 627 bp, Triticum aestivum
  unsure (1)..(627): unsure at all n locations
  Clone ID: PAT_TA_18577
cggacgcgtgggcctgcttcttccaccttcccgctctctgctccacttcatctgctgcgccccgcccatccatccttgaaacatcaagttgaccctctggctgggccacagcggttgcagagacaacaagtctcctccacaaaaggggtgagatgtcctcgctgaggccgctcaacacggaaccaagttttctccactccccgaagctgcagagcccgagggatgcctgcgccgcgccgctgaggtcgccgtcgccgagggtcgtcgccggcccgccaaagaagaggatggcgcgcgccgggaggcctcctcgagaggtcgctcagcttcaagaactgggaggcggaggttggcgccgatgagccagaggcggcgacccggtccatcaacggcgcgcgccccgggaccctcctgctccacagccccggaagcaagcagcagcagtcgccgtccaaggcgcacttcgtctctccaagcctcnnnccgagctggacgacgcggccaccaaggtccagaagctcttcaagggccaccggacccggaggaacctcgcggactgcgccattgtcgtggaggagctctggtggaaggcctacgattccgcatcactcaacatcaagtccatct

SEQ ID NO: 18578 - DNA, 734 bp, Triticum aestivum
  Clone ID: PAT_TA_18578
cgacgcaaaaacatagtccgcacaaagtcatattgcatccatccagtcacccacaaaatgataagagtagctcccattgaattcaaaacatgaaatctgcaatgtgcatacaagattcatcatcatcgtcatcatcatcatcatccatctacaggcacaatagaacccccaagacactctagtccaaacctgtcgaatggccattcatttcgctaccctctgctaccactactacatctaccggaacaaaaactagacaagttcaacatgatggtgaaagaccaaggaacaacggaatgtaaaacacaagagggccatcatctgaaggagctccatgacatgtagatgaagtagcacgctccccactgggcaaaactagatagtcaatcttctcgctctaaagatacttaaaggaggatgcctccataggtggcgaagaagggggcaaacacgagggactcggaccgccatgagcttgatgaggatgttgagcggaggggcccgaggtgtccttgagagggtcccccgatggtgtcgccgatcacagcagccttgtggcagtctgagccttttgggcccaggctctttgcgtgctcagatgcgccagcctcaatgtatttcttcgcgttgtcccaggcaccaccagtgtttgatgctgaaatggcaatctgaacaccagaaaccagagcaccggcaaggacaccagagagggtctcaacaccgaagaaggtccc

SEQ ID NO: 18579 - DNA, 1064 bp, Triticum aestivum
  Clone ID: PAT_TA_18579
gcgttacgtacatacacatgaaaccatctgttcggatcaattactttgcatcgttgattgcatacattcacaggaggtagctatgtagattacagagacgtgcatgcaagcagagacccggccctgtgttacacgtagatgctctcttagccggcgagagcgctggtgttgtagacgaggaggacgccgccgccgaggaggccggcgagggtgacggcccagataagaagcccggtcgttccgccggcgtagcggtcaccagattcagaccattcctctggcgtgtagattgggctgtagccgtcgacgttggcgccgtacaatcaagatacacagaacagagtctacacagcagcagccaccccctgctgggtggggtgggtagggtaggaccaaggggcaagccaagtcgcacttatttgcagaacgggagcaagagagatgagctgtaggtagcaagcgaagggctacaacaccggtgtattatgacggatggctggggggcggtatcatcagcctcttccatatgaaccgcctcccccgcgctgagggtacgagtcttcctgcccgccacccctcccatagcctcctctgccactgccgccgccgccaccatagtagttatcctgcccgccgccaccccttcccatgtttccatggcctcctctcccaccaccgtagtagttctcctggccgccgccccttcccatgtttccatagtctcctctcccgccgccgtagtacgacccacgggaacgcccaccgcccccacggtaaccaccacgtccaccgccacggtagggctggcgatgccttgggaactcaccaaaagtctctgtgtccattttcctcagttctgaaaaccttggccttccgttttgcccgcctcgtccaaatgttccaccagaaagggaatcgaaaaaatcatccttgacgtagacaggcttgacatctagctctggattgtctgtttcctcgtactccaggtcttcatcaaatacatcatctccttgctcaccatctttgtctctagactgggatttcctaccaagatggccccatac

SEQ ID NO: 18580 - DNA, 609 bp, Triticum aestivum
  unsure (1)..(609): unsure at all n locations
  Clone ID: PAT_TA_18580
taccgggccccccctcgagttttttttttttttttttttttttttttaagcagaagaacagagatgccttgattgatctgaaaaataaccagatacattacacaaacaccatcttgtagtgtacacacaccaactcatcatctcgactcgccctcacatgcaacatctatcagtccggactactcaatctcagaacgggaagaagcagagatcgacgacgacacacatgcagcagcatccatcagccatgaagttgtcggcctagaggttgagctgaccgcgctcacttgccggggacgaagttggtggcgaaggcccaggcgttgttgttgacggggtcggcgaggtggtcggcgaggttctccaagggggcccttgccagtgacaatggcctggcacgaagaagcccgaacatgggagaacatggcgaggcggccgttcttgatctccttcaccttgagctccgcgaagggctcggggtcctcggcgagggccaaggggtccaagctggcgccggggtaaagcgggtccacgatctcgcccaacggggncgccggggacgcggtagccctccanggggcccaagagcacaactggnaggncagatgg

SEQ ID NO: 18581 - DNA, 1488 bp, Triticum aestivum
  Clone ID: PAT_TA_18581
tgaaaaaaatttcaacactaaaataaaactgatcaagcacaagggttccactacactatgtcgacgcctaatgctaatttacattttacgatgatggaacaaacaacatataaagaatcacgttgaagtatatcaaaagcttgtagctgggaaagcgaaaacaagacaagacacatgagactgtaggacatatatttctcaaagaacacaaccgaaccttagtgtgcaaagatcatagtgctcgaccaccaatccttgaacagaattttaatatgagtagcaaagaggtggagaaccataatccttcttcgggcagagacaacagcggacggcttggtgcctgcaggcagccgacagcgtttccggtgtattgttggtgaatccggacactgggcaggctgtcgatggacatactcggcctgtccaatggtgacctcgatcttgaagagtccactccctccctctctctttctccctcctctccttccttctctctctgtccctcatctctctctcctatagggaccgggccatggcgctggatctaatcaggcaccccagtcgttgcctcctgcctgcaggtcgccgccgctgctggagatgcccgccatcgcccccgcatccgcatgcctcggttggtacatgaaaacatatgaaacattaaaaagcagagaagcaagatctgtagtgttcccatcaaccattgaaagatttaattaggaatgaattagttgtgcacacagtaaagagtcaaagcttaaaaacaatcaaaacatatttagtcaaatcagcagcaatctgaaattataactaccaagatatttttagaaaccaatcttgcaagcgaagcaggataattgccacaatcttctaggaattcatggccccacatagctagtatcaacaaacgccaaaagttggtgatcccatgaatgtattaagtgattgtcttaaaagtttgtaccagacctcacacaatatccctgcaaaaattggacaaactgaaactactaatgctttgaacttgcacaaaactgaaaggtaccatttttattcaagctacatttacaggctgctttttagttacagaaagttgggagacacataatcaaagcaagcccgcagatagtgatagatgaggcagaacaactactacgatccagtctcaacatatcaattaagatggatgggttgtacagtggttgcaatacatttgaaaatatcagcagcgagatgtttagctcaaccgttctattatgcaattgcagagagcaaaataagttaattttacgtgagcatcaaggagtataactggttcatgagatattccgaagtcgacatctgcagtacaatgctttgctgctttggtttcctcagtttgtgtagcaagcagaggatgcatccctgagcgtcatagattctaactcgtccttgagatatcctgaagtcaacacatgcattcaattgctttgccactttgatttcctc

SEQ ID NO: 18582 - DNA, 860 bp, Triticum aestivum
  unsure (1)..(860): unsure at all n locations
  Clone ID: PAT_TA_18582
ctccgtccctctgtcctcgccgtccccaacctctcgctgcaaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggtggtgttttcttaagtgaacattcatttccctccggattaccccttcaagccaccaaaggattatgatactggagcaagcaaagggatagcgtacatagaatttgatgacatcagttctttgcccaaagcgctcgagctgaacaggtctaacattggagaaagcttgagcttgtttgttgatgaagccaagcctaaggcagataacagagatggcgctgatagtggtaacaggagcgcaagaagatttaatgggggcgggggccgcagnnnaagatttgacgggggtgggggccgcanaggtggaaagtttgacgggggctcaggccgcagaggtggtggaagattcggccggggtgacagaggcggccggagtgacaggggccgtggtcggggtggtgcaccccccaggcagagtgctggcacacctagttcagggaagaagataactttcggtgatgactgagctcggtgactccgcttgaaatcgcgcagaaactccaacccacccctagtgaaatgtcgaatatttcctttttgcctggagactcgtacttgctgtttttaatattatcttattattattattattgtggaccgtggtggttatctgccagactatgtcagctttttgggagatttatactcgatgaattttggtcagat

SEQ ID NO: 18583 - DNA, 1634 bp, Triticum aestivum
  Clone ID: PAT_TA_18583
gcaggatgggcttctccttcttcgcctctcgcgctgccgccaggttcctgcaggacatccggcgcccctcctccgccggcgtctccaccgcggcgctcctcctcacggccgccagcggcggaggcatcgtggcctatgccgattccgccagggcggaggaggctccggagccaccgcccaggaagaagaaggtggtggttctcggcaccggctgggccggcacctccttcctcaagaacctcgactcctcccgctacgaggtgaaggtcatctcgccccgtaactacttcgcgttcacgcccctgctccccagcgtcacctgcgggaccgtggaggcgcgcagcgtcgtcgagccgatacggaggatgttcgagaagaaggggaaggatgtcgcgtattatgaagcagagtgcttcaagatcgatccgacgaagaaagccgtccactgccgctctgccgttgggactaatttggatgggaatggcgatttcatgcttgattatgattacctggtcgtcgctcttggggctactgtcaatacatttaacactcctggcgtgatggagcattgccactttctgaaggaagtggaggatgcccagaagattcggaagagtgtgatagactgctttgaaagggcgtcaattcctaacatcagcgaagaggagaaaaggaagatccttcactttgtgattattggtggtggacctactgggggttgaatttgctgcggagttgcatgattttcttgtcgaagatctggtgaagctgtatcctgcaattgcacaatttgtgaagataacaattattcaatcaggagaacatatattgaatacgtttgaccaaaggatagctgtgtttgctgaatcaaagttccaaagagatggcatcgagttgagtacaggattcagagtgataaaggtctccgatgattcaattacagtgcaagtgcaaatcatctcggtgtagaaacattggtgcctgtatgggatggctgtttggtctgctggcattggtactcgccccgtcattacagacttcatgagtcaagttggtcagggcaaacgacgtgccttggcaactaatgaatggttaagagttcctgagtgtgatagtgtctatgcaattggtgactgttcttcaataagtcaaaggaaaataatggaggacatttcaacaatatttaaagtagcagacaaggataactctggcaccttgacactgaaagaaataaacgatgttctagaagatatttgtataagataccctcaagtagaactgtatatgaaaagtatgcacatggttgacattgctgatttgataaaaggtggcgtaggtgattccaacaaggagtcgatggtggttaacatagaggagttcaaaaaagctctgtctcatgtcgactcccaagttaaaactgttccggcgactgctcaggttgtctctatttccagagaatacatgggttgatgatattttagaatagataatgttttgatccgtgaacaacccatttgtgtttgtgcggatactccctcattgtttctctgatatttgccaggttgctgcgcaacaagggtattatcttgctgactgctttaacaaaaaggatcactgcatagagcatccagaag

SEQ ID NO: 18584 - DNA, 328 bp, Triticum aestivum
  Clone ID: PAT_TA_18584
tcgagcggccgcccgggcaggtctcgagttttttttttttttttttttttttttttatggaaaatgaaaaccatgcatttctcatatagacatttcatgttccagacgggccctatttgtaaacatctttgatagtgtacaacatcaacgatcagatattaatcatacatccagagtacacatatactcctgagaagtcgattttcatgtgtttacttgccgggcacaaagttggtggcgaaggcccacgcgttgttgttgacagggtcggcgaggtggtcagcgaggttctccaagcggacacctcggccgcgaccacgctaatcga

SEQ ID NO: 18585 - DNA, 776 bp, Triticum aestivum
  Clone ID: PAT_TA_18585
agttactgtgaatacattccaacactcctggtgtgatggggcattgccactttctgaaggtcaaatccttaattggcattgtgtgtctctttactgttctgctatttctcatgtttcaatcctaagatgtaagttacagtttaatttcctgctaaatcttgagatatatggtattgatactttaggttattttaccgtacagtattagtcatatcttgtgcttacagcctcacattgtaaatgtcaggtcatggaggatgcccaaaagattcggaagagcgtgatagactactttgaaaaggcgtcacctcctaacctcagtgaagaggagagaaggaagatccttcactttgtgattatcggtggtggacctactggggttgaatttgcggtggagttgcatgattttcttgtcgaagatctggtgaagctatatcctgcaattaaagaatttgtgaagataacaattatgcaatcaggagaacatacaatgagggttgaacgttcctgcagtaataaccttagttttgggcaagatgatcaaggagtagcgaaactttagcagtcatctttggcttcaccatcttcctcccctgatcatgcatctattttagatcatataattatgctatatcatatatattgtttagttcagacttgtgcatgtgcgtccattggcattgatttatacagagatattgcatgatttgtacataaaaggagtacagatgatctaagaataaatgttcaaataaagttagtagtgagatttaaaa

SEQ ID NO: 18586 - DNA, 503 bp, Triticum aestivum
  Clone ID: PAT_TA_18586
agacatgaaacatggagtagaattcaagtgtgagtaatcagaagcataaatatgtatcagtatcacatcgtctgatgaacatgtagtgaccctttcccttcctatgattgaccaaagtgaaatacgagacccaacttacgtacatgacaagaacggttcatctgccgacgccgatgtacggcatgaacatgaacacagcacgaatgaaaattcaaaaagaaaaattattaacaccgagatggatcgacctgcttcccctaaccttacttattatcaacacggaatcaacggaattcaattaaaacgtacgccatgcatgcgcgcgcttcaaggttaccatggtgaccacgccgcctgcttccatggatcgatcggtgcagctgctagtcccatgccttcgggcgacgcgtgcgtgtaccttggcatggcgcgatcggtgcgtcggccggtggcgatcacaaggccagggcgccggcgaccgtgaaagccgcgagggtcgccgc

SEQ ID NO: 18587 - DNA, 1098 bp, Triticum aestivum
  Clone ID: PAT_TA_18587
ttttttttttttttttttttttgtagaaacatgtgacagtttttcataacgaatgcatcacaaattattcgttcacaggaccgcggcacattcttcacggctgacgcgcacgacaccagctagcgtcaacagttgatacaatgactttattatatttcctatataatccctatgctcatatggccccagtgccatatgaaatgtcctatagtatatctacgcacgcccgatcttctccaccaggcgtctctcgatccccatcctcttcttcatgagcaccgtgtacttcttcaggagctccctgccctcctcccccggcgccgggaccgccagctttgcgcccagcgaggtcttctccaggttgcccgtgtacatccgggagatgggaacaaaacctccttcctccttgcacagccacccgtgggcggctctcagagctgcacccagcgaggccgaatcaggtctctcaactgtgaagacagggcagccaaagatttgcgcgatcaacttgaggatgctctcattggaggatgccccaccagttgctatgatccgctttggtgggttgggcatgccaaaccgctcggcatgccctctcatggacaacatctgaccctcgacgatggcacggacctcagattgtggatcaaattcttgcacctcatgctccttcagattattagatgaggcgtcattgaaattctcgacaatgtatcggtggaaaccaacaggaagaggaggcaggatctcatggtctttgtagtagaatcctaacttcccaccattcagagggggtgttttctctagatagttgttgaaaacatcccacgatttttctgcgcactgattccgcacatcttcccgggtcaatgagccatttttgtaacatagcatcaccatgtaaccatccggttcaacagggttggggaaaacatggccttcaaggcttggtttagcttcggcagtaatcccaaaaactgtgtcactagtaccaaggctgattgcaagatcgccaggtgtattcagtgttaaacctgcaaggctattgggattgtcacctgacccctgaataaccaaacagttcttgcggacgcgtgg

SEQ ID NO: 18588 - DNA, 855 bp, Triticum aestivum
  Clone ID: PAT_TA_18588
gcggccgaggbgaccatcaagacaccgatggagccycgggggatagtggtggcaactttcsgggctctcctaatcatggatcaactcracracgatacagctggtgggttcaccatctcccarttcctcctattcctgagctccacggtggcggcactgacgtgtatggtgatgaagctgcctgccgaccgttttttgggcagtgctccggtgtcagagttgctccaaaaraccttgcttctgctcctactggtgacggtgcacacattggccgcggagttgttgggcgaggacgtggttctgttctgcatgccagaggtcatcccggtgctcctctggtttagccttaacctcgaccgcccgcaccacagcccgctcaccaacatctacaaaatgaagcgacacctgaagggactcactattgccctaggtgtactggtggtagttcctcttttcgcgtacttagtgagctccatggatgtatctgggctctcgtactgcacgacgatcatggtggcatgtggcatctcaggggttctgacctactacattgtattcatgctaaactactggcattggccgtggcagaagcaacaagcagcagctggcagcagcagcaaggacgatgtgccttcctcatgtatgctcaagttttgggcagatgttttactgatagtggcggcagtgctcctgctgctaaggtatatggttgatgtccggcttgatctccaacaaccactatagttggtagactatgtcgaaatttgcgatgactatgctagtatagtcctagtactccctacttgtgtatgtatgttgttattttttcaccatatatacatcccaattatgagc

SEQ ID NO: 18589 - DNA, 1142 bp, Triticum aestivum
  Clone ID: PAT_TA_18589
gatcaagttcatcaccagcatttcacaacacacttatatcatcctgcatccccaataggttaaaggttttgttaccgcacatcgacctaagccacgatccacatatggttccatataagtcataatcatacaacacgcatcatattagagagtactgtaggcgaagcaaactgcttagttgtcagaggcagactggccctgaagaagatcgtcgcggatctgcgtggcgatgtcgcgcaccgcgccagggccatgggggatgaacaccgccgaggacttggaggacgcgccgacctctttcatagtatcaaagtactgggtgatcagcaccatgtccatcacatcctttgcagtggtgccaggcacattgactgagaagcccaggacgctgtccctcaggccatccacaatggcctggcgctggcgggcgataccgaggccagacaggtacttggcctctgcttcaccctcggcacgcttgatctggacaatcttctcagcctccgccttctcgtttgcagccaccctcatccttgcagctgcattgatctcattcatcgcctgcttgacatgcgcatctggctcgatgtcgacaatgagggtctgcacgatctcaaagccatatgccgacatagccttttcaagttcatcctccacagcctgtgctatatcattcttctgcacgaaagcatcatccaggttgagctttggaacacttgccctgatcacatcaaaaacataggcctgaatctgggatctggtgttggtcagtttgtagtatgcgtcgctttctttgccagccagaggtcggtactgaattgatgcaacaacagtgacaaacacattgtcctttgtcttagtttcgcagcgcacatccagctgctgcaacctgagtgtgagatggccaactacacgcttcccaaagatccaaggcaggcagtggcatcctggctcaagcacactgtcaaacttcccaaactgctctctgatggccacagtagattggtcgacttgaacacagcagcacagattgcccatactgcagacttccgatcacttccggtagcacctccggggcttggagaagagtggggaaaggtgggcttgcgagtgagttgctaggggcaacgacggcgtctgtc

SEQ ID NO: 18590 - DNA, 727 bp, Triticum aestivum
  Clone ID: PAT_TA_18590
aagcagaagaacagagatgccttgattaatctgagaaaatagccagatattacacaaacaccatcttgtagtgtacacacaccaactcctcatctcgactcgcgctcacatgcaaacatctatcagtccggactactcaatctcacaacgggaagaagcagagatcgacgacgacacacatgcagcagcatccatcagccatgaagttgtcggcctagaggttgagctgaccgcgctcacttgccggggacgaagttggtggcgaaggcccaggcgttgttgttgacggggtcggcgaggtggtcggcgaggttctcgagcgggcccttgccggtgacgatggcctgcacgaagaagccgaacatggagaacatggcgaggcggccgttcttgatctccttcaccttgagctccgcgaacgcctcggggtcctcggcgaggcccagggggtcgaagctgccgccggggtagagcgggtccacgatctcgccgagcgggccgccggcgacgcggtagccctccacggcgcccatgagcaccacctggcaggcccagatggcgaggatgctctgcgcgtgcaccaggctggggttgccgaggtagtcgaggccgccctcgctgaagatctgggagccggccttgaccacacggcctcgccgaacttgacgccggtgcgggcgagcagctccggggaagacgcagccgagcgcgcccagcatggcccagc

SEQ ID NO: 18591 - DNA, 1002 bp, Triticum aestivum
  unsure (1)..(1002): unsure at all n locations
  Clone ID: PAT_TA_18591
ggtcgacccacgcgtccgaaactgttctaactgaaatgactggtaaatggcttggcagtagacaaataaggtgcaactgggcaacaaagaccaacgcagaagagaaacaagaaacggacaatcataacgcagttgtactaacaaatggtggttccagtaatgcagcaatggaggcaaaccaggatacaggaagcaaagaaaatccagagaacaaccctgatttcacaacggtgtacgttggcaaccttggacacgaggttaatcgggatgagcttcaccgccatttctacaacttaggggtcggggctattgaggaagttcgtgttcaacaggaaaaagggtttggatttataaggtacactacccatggtgaagcagcattagctattcagatggccaacggattggtcgttcgcggcaagccaatcaagtgctcatggggcaacaaaccaaccccccctgggacatcttctaagccgctgccgcccccggattgcttcttatcaacccgtagcaatggctggcgtgccgcaaggcttcacagcagccgaacttctagcctatcagaggcagcttgcattgagccaggccgcggcagggcagattgccggccagcacggcctcgcggggccaggtatcctgcggggctactcgcctgctgggctcccaggccctgtatgacgggctaccccgaaccagacgtcggcgcagcagctcatgtactacaactagtatatagggttaaaaggaggaaggcatttgtagcgctcagcttgttggccgcaagcctgacctgaccttcctctccggttctcgtatttttctattttcatgtactattgtcgtgagagcttttcatgtgcttgtcgcgggattgtgtttttatttttcttctcattgctgtactattgaccatttttctggtctgatttcgttgggtagccctccttaacagagtaccgggtgtattttaatgtnaatctgcggttnattaatgtaatg

SEQ ID NO: 18592 - DNA, 720 bp, Triticum aestivum
  Clone ID: PAT_TA_18592
gggaaaccttcgcctccctccccccgcccagcttttttcgcgtgattctccctgcccggtcgcagatcggcgcgggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggcggtgttttcttagtgaacattcatttccctccagattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgttccctgctgaccgatcccaacccggatgatccccttgttcctggagattgcccacatgtacaagacggaccggtcaaagtatgagacgacagcccgcagctggacgcagaagtacgccatgggttgaagacctgcatcgtggacaactgaaatgtcgcttcaagaaaaaaatttatgggccattgtttcttcgatttgttgctggttgtgtgtaatccgatcctcaaggattgtaaattgcattcggcgtgggccctatcataattgccactagtatcggagacatgatgcctatcagcctattcacctatgct

SEQ ID NO: 18593 - DNA, 2241 bp, Triticum aestivum
  Clone ID: PAT_TA_18593
ttttttttttttttttttttgacaataaaatgtacttaatacatgataaacattgtgtacaagagaatggtcaattacatcatataatttggttctatacaaaatgaaatttcctcttttgtgtacatcctaaagaccacccccttgtgatgaacgttttgttcttcgagtcaaatggcacaactcctgtcctttgtggaaaaataaaggagtctgcaatacccatcaatgtccagagcaaaaagattatgtaatgcatcgcaactaattgattgttttatctccgcaactataaatcgtgtcttcaaaaggttgccgaagctctaaacttctccggaatagcagaattttaatatgagtagcaaagaggtggagaaccataatccttcttcgggcagagacaacagcggacggcttggtgcctgcaggcagccgacagcgtttccggttgtattgtttggtgaatccggacactgggcaggctgtcgatggacatactcggcctttccaatggtgccctcgatcttgaagagtcaagtgcattcacctccctctctctttctccctcctctcgttccttctctctctgtccctcatctctctctctcctgcagggaccgggccatggcgctggatcgaatcgaacaccccagtcgttgcctcttgcctgcaggtcgctgccactgccggagatgcccgccatcacgcccgcatccgcatgcctcggtttgtacatgaaaacatatgaaacattaaaaagcagagaagcaagatctgtagtgttcccatcaaccattgaaagatttaattaggaatgaattagttgtgcacacagtaaagagtcaaagcttaaaactaatcacaacatatttagtcaaatcagcagcaatctgaaattacaactaccatgatatttttagaaaccaatattgcaagcgaagcaggataattgccacaatcttctaggaattcatggccccacctagctagtatcaacaaatgccaaaagtttgtgatcccatgaatgtattaagtgattgtcttaaagtttgtaccagacctcacacaatatccctgcaaaaattggataaactgaaactactaatgctttgaacttgcacaaaacagaaaggtaccatttttattcaagctacatttacaggctgctttttagttacagaaagttgggagacacataatcaaagcaagcccgcagatagtgatagatgaggcagaacaactactatagtgaaagtatccaagcaatcaaccaatgatagaaataccatgcaaatcttatccaaaaacacaaacaataaaagttattagcactctgccgcagaaatcaaataggggaggtattgacctgaggtttgcattatcaatttgtgtgttgatgccatggacgatcgaagatcggctacgaagctgaggcacaatcaatggtacctatgacatccaggaattaaaatcattagttttccaaaaatgaagtatggaggcggggaggataggagcacactgccacagataaccacataatcgtcctgcaaatgcttgtcgtcggcataagaatatactgccaccaaaagtcccaatgccaaccattccaggaccaacctcaacatctatgacatccaggaattaaaataattagttttccaaaaatgaagtatggaggcggggaggataggagcacactgccacagataaccacataatcgtcctgcaaatgcttgtagtcggcataagaacatactgccaccaaaagtcccaaagccaaccattccaggaccaacctcaacatatagggaggtgccaccaggggagagggagacggcggcgctatccctgcagtgacagcacgcaggtggatcggccgcttctcgctgatggatgcaacctcgtcctccctggccttggccgccgccacatctgccctctccgcgcccgtcccggccgcctccatagcctggccgagccgatccgcctcctggctctcatccgctgcttccctcctccggccgaagacgcactggttgagctcctcctccgtacctatctcgcaccgaggtcactcctcctcccgcggcttcctcgcaacctggggcagatgagaacctcgcgaggtggtggatctcatcgaaacggaaggcggagcccctaggttgtggctgtggtgaggggaggaggggggagaagggagaaagaaggagaggagctgcgggtgtgttgattggg

SEQ ID NO: 18594 - DNA, 1392 bp, Triticum aestivum
  Clone ID: PAT_TA_18594
gagcaaaatgattcgagacaacaccaatagcaccaagctcgccgcaacacaacggtaaccatgagagggtcttgagcaatcattaccaacctgagccacacgagaacaccaccaccgtagacgaagagctccaatcaaccgagaccatccatgatgcctcaatgctattggcgcagccgaaaggcaacgagcgatcgagtccacatccggacgaagagccacacgcagccgagactacatcacaacagcggcaccgccggcgaagccgaagggcatcaaggagtcgagtctacacccggatcgcttctccgagcacaccagcgcaatccggccgcgccaccaccactccaccaccacatcacacaccaccgtcgaccccagtcggccgcacaaacagaccaccagccgcacctctttcatccacacacaccaacactagccgaagttcgtgtctccaagatggcgcctccaagaagggaatgatgccagagacaccaccgccacccgatccggcaagcccgaccataggttttcacccggaaaacaacgaaacaggaggtttgcggctgaaaaacagctccacggcggcccctccgcgaggaaaacgacagccacagccgccgttgccaccggcgtcgaccaagtcgacccagaattttgcatccggagcgtgagcaaccaacaaaccatgacggcatcttcagggcgtgtgctgcccggatcttgcgagaccacatcggcgcgcaccggatctgggcagaaattagtctgccccatcgagcacaggaacagccagggtcgcgcctccccgagctggaacagtcgctcgccggagaagccgagggccgccgcaagatgcagcggcgcacagaggcaggccggatcgagacagcgctgaaggaaaggagcaggccagcccccgacgcacctgagaaggacgaggtggatctgggcgccagcgccacccccgagcgcccctccaccacctagcagaccatgggccgcgctcgagcagcagcaccttcatgtcgacgatgaggcaggccaccggagccggacgagtcgaatccgagcgcccttgccaaatccgccgccgcggtcaccgagggaggcacgaccgtgaccagggccatcccacgacgcgagcaaggcccccccccgccgccgtcggctgcaacggctttgccctgcagcttcctccagcggcggcgggagaggaggggtggatctcgcggtgggggcgctaggtttctgggttccgcccgtgtcgctcgcacgggagcaacgcgagcggcgacagtggtcgggctctcctactcaccactagagactagatcagacgaagaagcagagtaaggcagaagcagagtagggcacaagcacctacagttc

SEQ ID NO: 18595 - DNA, 1163 bp, Triticum aestivum
  Clone ID: PAT_TA_18595
ccattgaaatagcacactcgtttgttttctttttttcttcttcttttgtagtccttggctgctcttgcaaccctgaactcgcctactgtacatttgtttcagagagaatttcagtaatcttccagacagtcatcttgcaagtttttttcttttggaagtttaccatcattcttgtttgataaaccaatccaatactgttacatgtcctcatcggacgaataatcgtacaggtgaaaaaaacacccgcagtagcccttgttttgtttcacacaacccatgtctgttccatacatcccaagccccgaaggggaacaggcatcgcctcatattcacttcccgggggacgaagttggtggcgaatgcccaggcgttgttgttcacgggatcggcgaggtggtcggcaaggttctcaaggggccccttgccggtgacgatggcctgaacgaagaagccaaacatggagaacatggcgagccggccgttcttgatctccttcaccttgagctccgcaaatgcctcagggtcatcagccaaccccgagggggtcgaagctaccgccggggtagagggggtcgacgatctcaccgagcgggccaccggcaacgcggtacccctcgacagcgcccatgagcacgacctggcaggcccaaatggcaaggatgctctgcgcgtggacaaggctggggttgccaaggtagtccaggccaccttcactgaagatctgagaaccagctttgaaccacacggcctcgccgaacttgacgccgttgcgagcgaggagctctgggaagacgcagccaagagcaccgagcatggcccaccgacagtggatcacctcgagctccctgttcttcgcgaacgtctccgggtcagccgagagcccggccgtgtcccagccatagtcgccagggaactcgccggtgaggtaggacggcgcatcaccggagagtgggccgagatagaggacacggtccgggccgtaccacgggctgctggaagcggcgggcttggccttggccgccgtcttgcgcattgtgatgcggccctcaccaaacacgttggaggagatgatcttggccgcagcaagacccggggaggagagtgccatggtggacgcagccattgcagaggaagaatatttggttgcttgtcttgtgcttcta

SEQ ID NO: 18596 - DNA, 1594 bp, Triticum aestivum
  Clone ID: PAT_TA_18596
tgtacttaatacatgataaacattgtgtacaggagaatctcataaaaatagtggtcaattacatcatataaaaaatttgaactgaattacattatataatttggttctatacaaaaggaaatttcctcttttgtgtatatatcctaaagaccacccccttgtgatgaacgctttgtccgtcaagtcaaatggcacagctcctgccctttatggcaaaataaaggagtctgcaatacccatcaatgtccaaagaaaaaagattatgtaatgcatcgcaactgattgattgtttcatctccgcaactataaatcgtgtcttcaaaaggttgcagaagctctaaacttctccggaatagatgcaacagaaaagaataagctataccatactcaagttgaccactccaacaaagatcgttataaaacagaaacttcaaaggccatatcaggtaatgtgttgataggatttagaaaacaatttcttgaaaacgaatatatttctcaacactaaaataaaaatgcatcaagcacaatggttccactacactatgtcgatgcctaattgctaatttacattttacgattgatggaacaaacaacatataaagaatcacgtttgaagtatatcaaaagcttgtagcttggaaagcgaaaacaagacaagacacatgagacttgtaggacatacatttctcaaagaacacaaccgaaccttagtgtataaagatcatagtgctcgaccaccaatccttgaactggttaaagtacaaacaaaattaatcctgtcgtagaataaaaccattatgacctactaaatccaacctgacaaaatgatccacaaaacatttgatgtgtcgttaattgccagttgttattttttttggaaaaaagccatggcgcaacatatattgtattgccgtttacagaacaaaggaaattcaagcaatattttaacattaactttatcttccatcctaatgatagcctcatacaacgccacatctttaagcttgagcttttgaaaaataccatacaaatatgttagatgggtgcaaacgcttctattctcgttattaatttgttgcaatgcacatttttaagatatacatacaattccagctagaaatacactgacaaattgccattgaaatcatcataggaaattaagaacaggatgcacctttttcttgaaagaaaataaagaaagaaagaacatagcagaattttaatatgagtagcaaagaggtggagaaccataatccttcttcgggcagagacaacagcggacggcttggtgcctgctgcaggcagccgacagcgtctccggttgtactgtttggtgaatccggacactgggcaggctgtcgatggacatactcggcctttccaatggtgccctcgatcttgaagagtcaagtgcattcacctccctctctctttctccctcctctcgttccttctctctctgtccctcatctctctctctcctgcagggaccgggccatggcgctggatcgaatcgaacaccccagtcgttgcctcttgcctgcaggtcgctgccactgccggagatgcccgccatcaccctcgtgccgaa

SEQ ID NO: 18597 - DNA, 892 bp, Triticum aestivum
  Clone ID: PAT_TA_18597
gagtagctcccttggaaattaagacatgaaatctgcaatgtgcatacaagattcatcgtcgtcgtcatcatcatctacaagcaaaatataactcccaagacactctagtccaaacctgtcgaatggccgttcatttcgctaccctctgctaccactactacagctaccagaatgaaaactagacaagttccaacatgattgcgcaagaccagcaacaacgaaatgtaaaacacaagagggccatcatctgaaggagctccataacatgtagatgaagtagcacgctccccaccggcaaaactagatagtcgatcttcatgctctaaagatacttgaagaggatgcctccataggtggcgaagaagggggcaaacacgagggactcgaccgccatgagcttgataaggatgttgagtgaggggcccgaggtgtccttgagagggtccccgatggtgtcaccgatcacagcagccttgtggcagtctgagcctttcgggcccaggctctttgcatgctcagacgcgccggcctcaatgtacttctttgcgttgtcccaggcaccaccggtgttcgatgctgaaatggcaatctgaacaccagaaaccagagcaccggcaaggacaccagagagggtctcaacaccgaagaaggtcccgacaataagaggtgtcagcataacaagagcacccggggggatcatctccttgatggacgcatcagtggagatcttcacacatgtcgcatagtcgggcttggcggtgccctccatgagcccagggatggtgttgaactgcctccgcacttcctccaccatcttgagagccgcacttccaacactcttcatggtcatcgcagagaaccagtacgggagcatagcgccaacaagaaaacc

SEQ ID NO: 18598 - DNA, 853 bp, Triticum aestivum
  Clone ID: PAT_TA_18598
gtcgcgcacgacaccacaaagcgaggggcggaccccggagaaaaaaagaccaccaaaggcaggcgtcctccgtccctctgtcctcgccgtccccaacctctcgctgcaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggacccccctgacagtccctatgccggcggtgttttcttaagtgaacattcatttccctccagattaccccttcaagccaccaaaggtatctttttaagacaaaggtcttccatcctaatatcaacagcaatggaagcatatgcctttgatattccttaaaggagcagtggagccctgctctgacaatttctaaggtcctgctctccatctgctccctgcctgaccgaccccaacccggacgaccctcttgtcccggagattgcccacatgtacaagacggaccggccgaagtacgagtcgacggcccgcagctggacgcagaagtacgcgatgggctgacgaacgctttcctgctcgtccacccgactggcgtctcaagaaagccgttcctgggcgccattgttcccttggatttgttgttggtcgtgtgtatccctgatccatctaggatcatcgtattgtattgtattgtagtgtatgtcgtcggcttaacatcgttgccatccaccatagtgaggtggttggacatgcttcgcctatatgcacctgtcttgccttccttcgggtccgtgctccttggtaatgttatggaagacgttgatttaaaaaaaaaaaa

SEQ ID NO: 18599 - DNA, 646 bp, Triticum aestivum
  Clone ID: PAT_TA_18599
cggtgcaaattggtttcattactattgttattaatctgaccttcaacagaggccaacagacacgagagcctgtaatgatcacaggggatcgatctagacggacaggacagctactaggcactgctactactactcaagatggttgctccgaccatcgatctcttattcatcgtcgtcttcttcagttcctcctcttcttgcatggagccaggcagcgagcgatcactggcaggagacgcgcgggaggccgcacttggcggggaggctgttgatgatgtcgatggcgccgcaggcgcagtcgcgggacacggagcccagcgcggagcagcactccggcccgggcgtcgggagcgcctgccccggcagcggcggcacgctgtaccgcgcgcacggggccagctggctcagctgcgcgccgcaggtgccgagcggcggctgcgcctccgccgcgccgcccagcgtgatgagcagcaccaggacgaggagggccgccagggcgcgcggctgcggcagctgggccgtggtcaccgccatcgtcgtcgtagtcgccggctcggtgcgcgcgctgctagcttgagcgttctgtgtgcgtcggacgcgtgggcggacgcgtgggcggacgcgtgggcggacgcgtgggcggacg

SEQ ID NO: 18600 - DNA, 863 bp, Triticum aestivum
  Clone ID: PAT_TA_18600
gaattcggcacgaggtcctccgtccctctgtcctcgccgtccccaacctctcgctgcaaaaggtgtggaaaccttcgcctctctccccccgtccagctttcttcgcgtgattctccctgcccggtcgcagatcggcgcgggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggtggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctctaaggtcttgctctctatctgttccctgctgaccgatcccaacccggatgatccccttgttcccgagattgcccacatgtacaagacggaccggtcaaagtatgagacgacagcccgcagctggacgcagaagtacgccatgggttgaagacctgcatcgtggacaactgaaatgtcgcttcaagaaaaatatttatgggccattgtttcttcgatttgttgctggttgtgtgtaatccaatcctcaaggattgtaaattgcattcggcgtcggtcctatcatcaattgccactagtatcggcagacatgcatgcctatcagcctatcaactatgcttgttgggtaacttccacaagtgttggtgttatttggtaaatgttcaattaaaacatgtttgccttaaaaaaaaaaaa

SEQ ID NO: 18601 - DNA, 1090 bp, Triticum aestivum
  Clone ID: PAT_TA_18601
gctttgtctccttccgtaatcagcaggaagctgaaactgctataactgaaatgactggtaaatggcttggcagtagacaaataaggtgcaactgggcaacaaagaccaacgcagaagagaaacaagaaacggacaatcataatgcagttgtactaacaaatggtggttccagtaatgcagcaatggaggcaaaccaggatacaggaagcaaagaaaatccagagaacaaccctgatttcacaacggtgtacgttggcaaccttggacacgaggttaatcgggatgagcttcaccgccatttctacaacttaggggtcggagctattgaggaagttcgtgttcaacaggaaaaagggtttggatttataaggtacagtacccatggtgaagcagcattagctattcagatggccaacggattggtcgttcgcggcaagccaatcaagtgctcatggggcaacaaaccaacaccccctgggacatcttctaagccgctgccgcccccgattgcctcatatcaacccatagcaatggctggcgtgccgcaaggcttcacagcagccgaacttctagcctatcagaggcagcttgccttgagccaggcggcggcagggcagattgctggccagcacggcctcgcgggccaggtatccgcggggctactcgctgctggctcccaggccctgtacgacggctacccgagccagacgtcggcgcagcagctcatgtactacaactagtatatagggttaaaggaggaaaggcatttgtagcgctcagcttgtttgatgcaagcctgacctgaccttcctctccggttctcgtatttttctattttcatgtactattgtcgtgagagcttttcatgtgcttgtcgcgggattgtgtttttatttttcttctcattgctgtactattgaccaatttactggtctgatttcgttgggtagccctccttaacagagtaccggatgtattttaatgtgaatctgcggttgattaatgtaatgctctcctgtttgaccgatcccctgaggactgtcgtcggccctgggggagaaagctgggttttttaaaaccccaaaacccc

SEQ ID NO: 18602 - DNA, 1137 bp, Triticum aestivum
  Clone ID: PAT_TA_18602
gagagaactagtctcgagttttttttttttttttttaagcagaagaacagagatgccttgattaatctgagaaaatagccagatattacacaaacaccatcttgtagtgtacacacaccaactcctcatctcgactcgcgctcacatgcaaacatctatcagtccggactactcaatctcacaacgggaagaagcagagatcgacgacgacacacatgcagcagcatccatcagccatgaagttgtcggcctagaggttgagctgaccgcgctcacttgccggggacgaagttggtggcgaatgcccacgcgttgttgttgacagggtcagcaatgtggtcggcaaggttctccaatgggcccttgccggtgacaatggcctgcacaaagaagccaaacatggagaacatggcgaggcggccattcttgatctccttaaccttgagctccgcaaatgcctcggggtcgtcggccaggccaagcgggtcaaagctgccaccagggtagagtgggtcgactatctcgccgagcggaccaccagcaatgcggtacccctcaacggcacccatgagcacaacttgacaagcccagatggcgaggatgctctgagcgtggacgaggctggggttgccaaggtagtcgaggccaccctcgctgaagatctgagagccagccttgaaccagacggcctcgccaaacttcacaccattgcgggcaagcaactcaggaaagacacaaccaagcgcaccgagcatggcccatcggcagtggatcacctcaagctcccggttcttggcgaaggtctcagggtcagccgagagaccggcagtgtcccacccatagtcaccggggaactcaccagtcaagtagttggggggctcgccggaaagcgggccgaggtagagcacacggtcagagccgtaccacgggcttctagatgaaacttgtttggctttcgcggcggtcttgcgcatgttcacacgtgcctcaccaatgaaagccgacgagggcaagttcttgacggccttgccggcgaaggaccaagaggaaagagacatggtggtggccgccattgcgctgcacttatggtgtgttgtcccctgtgtgttctccaatagtgtggccctgagctcgtgc

SEQ ID NO: 18603 - DNA, 1011 bp, Triticum aestivum
  Clone ID: PAT_TA_18603
ttttttttttaaacacaaggaacagagtacagacagacagtatggtcggaccaatctacatccatcaagttactgaaatttactaccccccacaatcgcaccaagccactgatgaggccattattcctttattctgcttcaggaatgtccccaaaactgaaactgcacacggtcagtttaattgcgcaacagcacaggacccccagcctagaaacggtgccggcgaagctcatgacagacccatgactttcccggtcgcccgtgtcgatgtcaatttcgtagaagcaggggcctcgtaggaagaccaggcattgtgctcatggtgccgacgagcgggtagatgaaaccggctccgatgctggcccgcacgtctcttatcggcagcacaaagtcggatggtgcgcccttcatggatggaacatgagaaaaggagtactgagtcttccccatgcatatcgggaggttggagaagccttgcttggtgtacatctcgatctgcttttcggcctgttcagagtattcaacaccactagcaccatagaacttagctattgactcaatcttctcctttatgctagaatctaaaggatataaaaacttcaggggctctgcctggctttcacatgctctttgaacagcgactccaagatcaaccgctccgtcaggctttcgcccattgcggaaaattccccactgctgcctcccgtaggagtctgggccgtgtctcagtcccagtgtggctgatcatcctctcggaccagctactgatcatcgccttggtaagctattacctcaccaactagctaatcagacgcgagcccctccttgggcggatttctccttttgctcctcagcctacggggtattagcaaccgtttccagttgttgttcccctcccaagggcaggttcttacgcgttactcacccgttcgccactggaaacaccacttcccgttcgacttgcatgtgttaagcatgccgccagcgttcatcctgagccaggatcgaacc

SEQ ID NO: 18604 - DNA, 1056 bp, Triticum aestivum
  Clone ID: PAT_TA_18604
ttttttttttaattaaaaactttttgtcaccagctctagattctgtttacaaccttcgtcttctcacagttccggtacaaaacaggcggtaaaatacagctagaatgtatgtattgtaaaacaaaaccagacaagacacaaacgagccatgagataaaagcccaacactgcttacccaggagggtctacacagcagcaatcaagatacacaagtcaagtctacacagcagcagcagcagcagcagcagccacccctgctgggcggggtggggtagggtagggtaggaccaagggacaggccaagtcgcgcttatttgcagaacgggagcaagagggatgagctctaggtagcaagtaaagggctacaacaccggtgtattatggtggctggccggccggggcagtatcatcatcagcctcttccatgggaaccgcctcccccacgctgagggtacgagtcttcctgcccgccacccctcccatagcctcctctgccactgccgccgccaccatagtagttatcctgcccaccaccaccaccaccccttcccatgtttccatagcctcctctcccaccaccatagtagttctcctggccgccgccccttcccatgtttccatagtctcctctcccgccgccgccgtagtacgacccacgggaacgcccgccacccccacggtaaccaccacgtccaccgccacggtagggctggcgatgccttgggaaatcgccaaaagtctctgtgtccattttcctcagttctgaaaaccttggccttccgttttgcccacctcgtccaaatgttcccccagaaagggaatcgaaaaaatcatccttgacgtagacaggcttgacatctagctctggattgtctgtttcctcgtactccaggtcttcatcaaatacatcatccccttgctcaccatctttgtctctagactgggatttcctaccaagatggccccatacttcatctttgttaaacttctcattcatggccataaaatcaaactcttcagtaaattttgttgacgcttgcgacaacgcactgcctc

SEQ ID NO: 18605 - DNA, 878 bp, Triticum aestivum
  Clone ID: PAT_TA_18605
ctcgtgccgaattcggcaccaggtcgcgcacgacaccacgccacaaagcgaggggcggacccggagcaaaaaagaccaccaaaggcaggcgtcctccgtccctctgtcctcgccgtccccaacctctcgctgcaaaaggtctggaaaccttcgcccccctcccccccgcccagcctctttcgcgtgattctccctgcccggtcgcagatcggcgcgggttgcttgtcatggcatcaaagcgcatcctcaaggaactcaaggacctgcagaaggacccgcccacatcatgcagtgcaggtcctgctggtgaggacatgtttcattggcaagcaacaattatgggaccccctgacagtccctatgccggcggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgctccctgctgaccgatcccaacccggatgatccccttgttcctgagattgcccacatgtacaagacggaccggtcaaagtacgagacgacagcccgcagctggacgcagaagtacgccatgggttgaagaagacctgcatcgtgggacaactgaaatgtcgcttcaagaaaaatatttatgggccattgtttcttcgatttgttgctggttgtgtgtaatcccgattctcaaggattgtaaattgcattcggcgtccggccctatcatcaattgccactagtatcggcagacatgcatgcctatcagcctaatcactaagctggtgggtta

SEQ ID NO: 18606 - DNA, 1586 bp, Triticum aestivum
  Clone ID: PAT_TA_18606
ttttttttttttaatccacacaatgtcatattgcatccatccaatcacctacagaatgataagggtagctcccattgaaaattcaagacatggaatctgcaatatgcatacaagattcatcatcatcgtcgtcgtcatcatcatcatccatcttcaggcacaatagaacccccaagacactctagtccaaacctgtcgaatggccgtccatttcgctaccctctgctaccactactacatctaccggaacgaaaactagacaaagttcaacatgattgcgcaagaccaggaacaacgaaatgtaaaacgcaagagggtcatcatctgaaggagctccataacatgtagatgaagtagcacgctccccaccggcaaaactagatagtcgatcatgcatcggccttctcgctctaaagatatttgaagaggatgcctccataggtggcgaagaagggggcgaacacgagggactcgaccgccatgagcttgatgaggatgttgagtgaggggcccgaggtgtccttgagagggtccccgatggtgtcgccgatcacagcagccttgtggcagtccgagcctttcgggcccaggctctttgcgtgctcagatgcgccagcctcaatgtacttcttcgcgttgtcccaggcaccaccggtgttcgatgctgaaatggcaatctgaacaccagaaaccagagcaccggcaaggacacccagagagggtctcaacgccaaagaaggtcccgacaataagaggtggtcagcatgaccagagcacccggggggatcatctccttgatggacgcatcggtggagatcttcacacatgtcgcatagtcaggcttggcggtgccctccatgagcccagggatggtgttgaactgcctccgcacttcctccaccatcttgagagccgcgcttccaacactcttcatggtcattgcagagaaccagtacgggagcatggcaccaacaagaaggccaatgaaaacgtttggtgtcagaacatcaacagttgtgatcccggcacggctcacaaaggcaccgaagagagcaagggacaccagggcagccgagccaattgcaaaaccctttccaatggcagcagttgtgtttcctgcagcatccagagcatcagttctctcacggattctgtggctcatgccagccatttcagcgatgcctccagcgttgtcactgatagggccataggcatcaatggcaagaccggtcgcaattgtgctgagcattccaagagcagccacagccacaccatacatcgcggcaaggctgaagctgaggaaaatactgaaggcaatggcgaagatagggataataactgatttgtatcccagagcaagaccaaagatgacattggtaacaaaaacagttctgcaggaatcagcaacatcctgcacaggactgtatgcattgcttgtgtagtactctgtaatgaatccaatgactaggccagcccagagaccaaccgccacacacaaaaatagttgccagctatgcacagtcttctgggcaccaaagttgaatattgtgaaggtatacgggaggcctaaccaactgccaaatgca

SEQ ID NO: 18607 - DNA, 738 bp, Triticum aestivum
  Clone ID: PAT_TA_18607
cgtccgcggacgcgtgggcggacgcgtgggcggacgcgtggggagaaaacagagggagaaaaaagaggagagagagagagcgagcgagagagagaaaatacgaggaaaaatctcacctcctcttcctccgttcccctgctcgatccgccgcgagaaattcgccaccaaatctattgatctgttggatccaatccgccgatccgtcgatcggttcgcgcgggccctccgtcccccggtgtttcgatctggtcggagtcggaggagatgaatggcgccggcgcgagccagcagcaacagcagcagcagcagaggctccggcagcagcagcagcaacagcagcaggccctcctgatgcagcaggcgctgcagcagcagcagtatcagtccggtgtcctcgctgccgccgccgccgcggccatgactcagatggagcctgtttcaaatggcaatctcccacctgggtttgatccatccacatgtcgcagtgtgtatgtaggaaacgtacaccctaatgtcactgagagccttctgattgaagttttccagggctctggtcctgtggaaagatgcaagctcatccggaaagaaaagtcttcctttgggtttgttgactactatgatcggaggtcagcagctcttgcaataatgacccttcatggggcgtcacatatacggtcaagcaatcaaggtgaactgggcgtatgcgagtacacaaaggggaggatacatctgggcatt

SEQ ID NO: 18608 - DNA, 949 bp, Triticum aestivum
  Clone ID: PAT_TA_18608
tttttttgaattggaccagcaagcacgcggttaaagctcaacatcaaacttcaccaaaaaaaaaaatctcaacatcaaactataaggaacacgaacagagtacaggcagacactatggtttgaccaaatctacatccatcaagttacagaaatgtactacccccacaatcgcaccaagccaccgatgaggccattatttatttattctgcttcaggaatgtccccaaaattgaaactgcacacggtcgatagcgcaacagcacaggaccaccagcccaaaaacggtgccagctgagctcatgacagacccatgaccttcccggtggtcgtgtcgatgtcgatttcatagaagcagggccttgtagggagaccaggcattgtgctcatggtgccgacgagcggggtagatgaaaccagctccgatgctggcccgcacatctcttatcggcagcacaaagtcagatggcgcgcccttcatggatggaacatgagaaaaggagtactgagtcttcgccatgcatatcgggaggttggagaagccttgcttggtgtacatctcgatctgcttttcggcctgttcagagtattcaacaccactagcaccatagaacttggctattgactcaatcttctcctttatgctagaatctaaaggatataaaaacttcaggggctctgcctggctttcacatgctctttgaacagcgactccaagatcaaccgctcctttaccaccgtgtgcatggtgggagcaaacgacagcatcgaaagccccagctgtcatagccgcctttttcacaacttccatttcagcgtctgtgtctgttgcaaatttgttaattgctactacaacattcactcccataaccctttgtgtttgagatgtgcttagcaagattaacacatcccagcttcaacaagagtgacattttccactgacatatgcatg

SEQ ID NO: 18609 - DNA, 1730 bp, Triticum aestivum
  Clone ID: PAT_TA_18609
gaaataaaaaaacttgtcatcagctctagattctgtttacaacggtttcttcttctcaattccggtacaaaacagttggtaaaatacagctagaatgtatgtattgtaaaacaaaaccagacaggcacaatgggtgatgagataagagcccaacactgctcaccaggcatgagatagatcggcgtcctatacaaccacatctcagactcacggcacccgcacaacgatcaagatacacagaacagagtctacacagcagcagccacccctgctgggtggggtgggtagggtccgaccaagggacaagccaagtcgcacttatttgcagaacgggagcaagagagatgagctgtaggtgccaagtgaaggggctacaacaccggtgtattatgacggatggccagcccggggggcagtatcatcagcctcttccatatgaaccgcctcccccacgctgagggtacgagtcttcctgcccgccacccctcacatagcctcctctgccactgccgccaccatagtagttatcctgcccaccgccaccaccccttcccatgtttccatggcctcctctcccaccaccgtagtagttctcctggccgccgccccttcccatgtttccatagtctcctctgccaccatagtacgacccacgggaacgcccaccgcccccacggtaaccaccacgtccaccgccacggtagggctggcgatgcccttgcgaaatcaccaaaagtctctgtgtccattttcctcagttctgaaaaccttggccttccgttctgcccacctcgtccaaatgttccaccagaaagggaatcaaagaaatcatccttgacgtagacaggcttgacatctagctctggattgtctgtttcctcgtactcgaggtcttcatcaaatacatcatctccttgctcaccatctttgtctctagactgggatttcctaccaagatggccccatacttcatctttgttaaacttctcattcatggccataaaatcaaactcttcagtaaattttgttgacgcttgcgacaacgcactgcctctaccccttccacggcccctatagttgtggtggccctgtgaaccagctccattgtgccgttgaggtgtctgttttggcaatggcagtataggctcattattttcaggctgagcacgtgccggaggatcaggcagcagtggttctgcaacctttgttttagggtcagcaggcttggcgatgttgttgctcatctgtaaaggtgtttgcatggactgagatgatgaaatcatggatggagcattctgcaatagctggccagatgatgctaacaaaggtggtgggacctccaatccagcaagacaagatgaggcaatagtcgaagaaattgcctgggatgctgtttggtgcgacagtgttgagcctggatttacagcaggagtcttactcctaacaagagaatttaagctgtgcgatgctgttgcactagtttcagtcatggaaattggctgactggctacaggaagagaggcaccatgagatggcaccggaggagtgaacaaaggtacaatgttcggcagcagaggctttgatgtttctgggcctaataagctagcagaaggtgccgttgtagcaggtgtggcacttgaggaaggaccctgagcagtagcagatggttgcaacaaggggggcccagatggtaaagatgcattcagtcctggatatggaaagactgtgga

SEQ ID NO: 18610 - DNA, 1087 bp, Triticum aestivum
  Clone ID: PAT_TA_18610
aacgcccaagtattcatcgttctcatttctcatggagcaacacacaggctacatccaggacatgaagcaagcgggcagatcaaaccatttccccaaagatccttgtaatttacaccatgatgttacaatttgaaccacccatattatgtgtgcagttcaccgcagttgccttgatatatggctacaactcgcagctagcgagcgccaacgcctcacttgccggggacaaagtttgtggcaaacgcccatgcgttgttgttgacagggtcggagaggtggtcagcgaggttctcgagtgggcccttgccagtgacgatggcctgcacgaagaagccaaacatagagaacatggcgaggcgaccgttcttgacttccttcaccttgagctccgcgaatgcttctggatcgtcggcaaggcccagtgggtcgaagctgccgccggggtagagtgggtcgacaatctcaccaagtgggccgccggcaacgcgggtacccctcaacggcacccatgagcacgacttggcatgcccagatagcaaggatgctttgtgcatgcacgaggctggggttgcccaggtagtcgaggccgccctcgctgaaaatttgggagccggccttgaaccacacggcctcaccgaacttgacaccattgcgtgcaagaagctcggggaagacggcatcccgagcggcaccgagcattgccccaccgggcagttgaatcacctcgagcttccccggtttcttggcaaaggtctcggggtcggccgagagaccggcggtgtcccacccgtagtcgccggggaactcgccggtcaagtagctcgggggctctccggaaagcgggccgaggtagagcacacggtcggcaccgtaccatgggctgcctgatgaaacctgcttggcctttgcagcggtcttgcgcatagtgactcgggcctcaccaaggagagctgatgaagccacgttcttcactgacttgccggcgaaggccgaggagagggacatggtggtagtcgccattgcgcggctaaggcggaatgtgtattgtgtgttccaaacagtgaaaactgaagctcgtgccgaattc

SEQ ID NO: 18611 - DNA, 1363 bp, Triticum aestivum
  Clone ID: PAT_TA_18611
cgcggccgcgtcgacccggaccgcccgaccgaccccccatgctgcgctgccacatcccgccgcaatgcggcccggccccgctcggccgccgcggcctgccccgggcggccacggcgcccgcggcggtgcgctgcgccgcgcgggccccgtcgcgggggaccgtggcggctgcggcggcggcggcgcaggtcgccgcggcggtggccacggccgaggggcacgagggggtggagcggcccggcctggcggagcggctgcggatggggagcctcctcgaggacggcctctcctacaaggagagcttcatcgtgcgctgctacgaggtcggcatcaacaagaccgccaccgtcgagaccatcgcaaacctcctccaggaggtagggtgtaatcatgcacaaagcgttgggttctccaccgacggttttgccacgactacaacaatgagagaacttggactcatttgggtcacaaataggatgcacattgagatctacaaataccccgcttggggtgacgttgttgagattgaaacatggtgccaagctgatggaaagatcggtactcggcgtgattggatccttaaggatttagctaatggtgaagttattggaagagctaccagcaagtgggtcatgatgaaccaaaatacacgcagacttcaaagagtcagtgacgaagtcagggatgaggtgtttatccactgtccgaagagtccaagattagcattccctgaggaaaataatggcagtctgaagaagattcctgttctaacagatcctgcacagcactcgaggctcggtctagtgcctagaagagctgatctggacatgaaccaacatgtcaataatgtcacttacattggttgggtcctcgaaagcatacctcaagatattattgatacccatgagttgcaaacaatcactcttgactacagaagagagtgccagcatgatgacatagtcgattctctcacctatatagaggaaggggaggagataaattctaatggatctctgttttcagcgccgcacccagaagagcagcgtcagttcttgcactgcttgagatttgctggggctggggacgagatcaaccgtggtcgcaccgtgtggaggaaactagctagataaaaagtgatatgtatttgctcatatgtattgtgctgttccttttgttttactgttttgctctttgcgaccggcgccgcatcacgagagaatcaactgtacccggaattttgtgattacctttgtgacctgtgtaacaatcaatgccaatctgtggcaaatgttggacctcagctggtgttcatccgttttggactatgcaatatatgtatgtatacaagacaaaaaaaaaaaaa

SEQ ID NO: 18612 - DNA, 759 bp, Triticum aestivum
  Clone ID: PAT_TA_18612
gaaatatgtaaccttaaaccagcattttacatgcaattgacagcactaaaaggcaaaataaaagaagcttagatcaagttcatcaccagcatttcataacacacttatatcatcctgcattcccaataggttaaaggttttgttaccgcacatcgacctaagccacgatccacatatggttccagataagtcataatcatacggcatgcatcatattagacagtactgtaggcaatagctagcaaaccacaaaccaccaccagcttcaaagttcatgccggcgaagcaaagtgcttagttgtcagaggcagactggccctgaagaagaccgtcgcggatctgcgtggcgatgtcgcgcaccgcgccagggccatgggggatgaacaccgccgaggacttggaggacgcgccaacctctttcatagtgtcaaagtactgggtgatcagcaccatgtccatcacgtcctttgcagtggtgccaggcacattgactgagaagcccaggacgctgtccctcaggccatccacaatggcctggcgctggcgggcgatacccaggccagacaggtacttggcctctgcttcaccctcggcacgcttgatctggacaatcttctcagcctccgccttctcgtttgcagccaccctcatccttgcagctgcattaatctcattcatcgcctgcttgacatgcgcatctggctcgatgtcgacaatgagggtctgcacgatctcaaagccatatgccgacatagcctt

SEQ ID NO: 18613 - DNA, 1427 bp, Triticum aestivum
  Clone ID: PAT_TA_18613
atatcaagcttatcgataccgtcgacttttttttttttttttttttaaagctgaacatcaaaacataaggaacaccaacagagtacagacagacgctatggttcgaccaaatctacatccatcaggtaactgaaatgtactaccccccacaatcgcaccaagccacccgatgcggccattattcgtttattctgcttcaggaaatgtccccaaaattgaaactgcacactgtcgattcaattgcgcaacagcacaggaccaccagcctagaaacggtgcccagcgaagctcatgacagacccatgactttgccggtggccgtgtcgatgtcgatttcatagaagcagggccttgtagggagacccaggcattgtgctcatggtcccgacgagcgggtagatgaaaccggctccggatgctggcccgcacgtctcttatcggcagcacgaagcctgacggcgcgcccttcatggatggaacatgagaaaaggagtactgagtcttcgccatgcatatcgggaggttggagaagccttgcttggtgtacatctcaatttgcttttcggcctgttcagagtattcaacaccactagcaccatagaacttagctattgactcaatcttctcctttatgctagaatctaaaggatataaaaacttcaggggctctgcctggctttcacatgctctttgaacagcgactccaagatcaaccgctcctttaccaccgtgtgcatggtgggagcagacgacagcatcgaaagccccagctgccatagccgcctttttcacaacttccatttcagcgtctgtgtctgttgcaaatttgttgattgctactacaacattcactccataaccctttgtgtttgagatgtgcttagcaagattaacacatccagcttcaacaagagtgacattttcactgacatatgcgtgatctaaaggcttcccagccacaacatctgggcctcctccatgcattttaagagccctaattgtggccacaataatagcacactgtggtgtcaatccactatacctacactttatgtccatgaatttctcagtcccaatatcagcaccaaaaccagcttctgtaacaacaaagccacccttcccaaccaacttcaaagcaatcttatcagcaactatggaagagttcccatgtgcaatgttagcaaaaggtccagcatgcactaaaacaggagtgccttcaagagtttgcatgagggtgggatgaatagcatctttcattaggacagtcaaggcacctccaagaccaagatcatcagctgtaaccggctcacccgccttgctgttgcctatcaccattcttccaagtctttccctcatgtcagcaagggaagttgtaagagctaatacagccattatctcacttgccacagatatgtcaaagcctgttt

SEQ ID NO: 18614 - DNA, 1268 bp, Triticum aestivum
  Clone ID: PAT_TA_18614
accttaaaccgcattttacatgaaactgacagcactaaaaggcaggcaaaagcattagatcaagttcatcaccagcatttcataacacacttatatcgtcctgcattcccaataggttaaaggttttgttaccgcacatcgacctaagccaagatccacatatggttccatataagtcataatcatacggcacgcatcatattagacagtactgtaggcaatagctagcaaaccacaaaccaccaccagcttcaaagttcatgccggcgaagcaaactgcttagttgtcagaggcagactggccctgaagaagaccgtcgcggatctgcgtggcgatgtcacgcaccgcaccagggccatgggggatgaacaccgccgaggacttggaggacgcgccgacctctttcatagtatcaaagtactgggtgatcagcaccatgtccatcacgtcctttgcagtggtgccaggcacattgactgagaagcccaggacgctgtccctcaggccatccacaatggcctggcgctggcgggcgataccgaggccagacaggtacttggcctctgcttcaccctcggcacgcttgatctggacaatcttctcagcctccgccttctcgtttgcagccaccctcatccttgcagctgcattgatctcattcatcgcctgcttgacatgcgcatctggctcgatgtcgacaatgagggtctgcacgatctcaaagccatatgccgacatagccttttcaagttcatcctccacagcctgtgctatatcattcttctgcacgaaagcatcatccaggttgagctttggaacacttgccctgatcacatcaaaaacataggcctgaatctgggatcttgtgttggtcagtttgtagtatgcgtcactttctttgccagccagaggtcggtactgaattgatgcaacaacagtaacaaacacattgtcctttgtcttagtttcacagcgcacatccagctgctgcaacctgagtgtgagatggccaactacacgcttcccaaagatccaaggcaggaagtggcatcctggctcaagcacactgtcaaacttcccaaactgctctctgatggccacggtagactgatcaacttgaacgcagcagcacagattgcccatactgcaggcttccgatcacttcccgtagcacctccggggcttggagaagagtggggaaaggtgggcttggcagtgagttgctagcctaggggcaacgacggcgtctgctcccgacccggccggc

SEQ ID NO: 18615 - DNA, 880 bp, Triticum aestivum
  Clone ID: PAT_TA_18615
caaaaaaaagagcatcaatgcaattctagacaaaaggttctttctgaaggaccttcagaatacttattccggtcgcagagtctcacggagaatgtcaaggggaagggcttttttttttgtagcaacagacttttgcattcaaccttcgtactttacatcatggttgtacaaacgaaaccaggtgcatgcatgcatgcgcacgcttcatcgcgtacgtacgtacgtgcacggtcgatcagtttttttttttttttcggtgcaaattggttccattattattaaatctgacctttaacagatgccaacagacatgagagcctctaatggccacaggggatcgatctagacgaaccggacagctactaggcactgctactactactcaagatggttgctccgaccatcgagcttcttattcatcatcgtcttcttcagttcttcctcttcttgcatggagccaggtagcgagcgatcaccggcaggagacgcgcgggaggccgcacttggcggggaggctgttgatgatgtcgatggcgccgcaggcgcagtcgcgggacacggaccccagcgcggagcagcactccggcccgggcgccgggagcgcctgccccggcagcggcggcacgctgtaccgcgcgcacggggccagctggctcagctgcgcgccgcaggtgccgagcggcggctgtgcctcggccgcgccgcccagcgtgatgagaagcaccaggacgaggagggccgccagggcgcgcggttgcggcagctgggccgtggtcacctccatcatcgtcgcgtcgccggctcggtgcgcgcgctgctgctggcttgagaaatgaatgaaaatgcgttcgtgtgtgtgtgtgatttgcgtcgccggacg

SEQ ID NO: 18616 - DNA, 2192 bp, Triticum aestivum
  Clone ID: PAT_TA_18616
gagcggccgcccgggcaggtctagtctcgagtttttttttttttttttttttttttttttttttttgggaaaaacatgtgacagtttttcataacgaatgcatcacaaattatccgttcacaggaccacggcacattcttcacggctgacgcgcacgacaccaagcgagcattaacagttgatccaatgactttattatatgtttcctataatccctatgcctcaaatgggccccagcgccatatgatatgtcctagtatatctctacgcacgcccaatcttctccaccaggcgtctctcgatctccatcctcttcttcatgagcagcgtgtacttcttcaggagctccctgccctcctcccccggcgccggcaccgccagctttgcgcccagcgaggtcttctccaggttgcccgtgtacatccgggaaatgggaacaaagcctccttcctccttgcacagccacccgtgggcagctctcagggctgcgccccagcgaagccgaatcgggtctctcaactgtgaagacggggcagccaaagatttgcgcgatcaacttgaggatgctctcattggaggatgccccaccggttgctatgatccgctttggtgggttgggcatgccaaaccgctcggcatgccctcgcatcgacaacatctggccctcgacgatggcacggacctcagatcgtggatcgaattcttgcacctcatgctccgtcagattgtcagatgaggcgtcattaaaattcttgacaatgtatcggtggaaaccaactggaagaggaggcaggatttcatggtctttgtagtagaaatcctaacttccaatcattcagagggggtgttttctctatatagttgttgaaaacatcccacgatttttctgcgcactgattccgcacatcttcccgggtcaatgaaccatttttgtaacatagcatcaccatgtaaccatccggttcaacagggttgggaaaaacatggccttcaaggcttggtttagcttcggcagtaatcccaaaaactgtgtcactagtaccaaggctgattgcaagatcgccaggtgtattcagtgtcaaacctgcaaggctattgggattgtcacctgaccactgaataaccaaacagttcttgtcaaactgatgcctttctacaaaatatgaagaaatccgacctgcagctgcatatgccggtgccagatttcccagcttctgttcaagatcaggagcagttgcctctaaaacagcttttgaccacgtcctcttgtttatatccatcaagttcatcccagcaccatcagtttcatcaatacttgcatagcatccagcaaggatagatgccatgaatgagctcaccaaagatattctctcggtattttcataaatatggggtgctgtttggtagatcttccgtatctggggcccggtgaatctctcataggcacgagaccctgtcagcttagataactccaatgctcctccgacagcattttctacttctctgcattgcttggtggtgctactgtccatccatattggagagtccatggtagaaaaggcatccttaagctgagataccaagctcttaccaggatccagggaagacagcacagcttgactacccttcttccaataaacgctgccgtgctgttgcccactccctgaaacggccacaaccttactgaagttgatctttggttttagtttctcaagaagcagttccaaagcctcaacccacattatggttggtgaatatatacggccgtcatctgtaggatctctgtaaaccccaccctcggttttgtagtgcggtaattcagagtcaaaattaacagtttcagaagcgactattattaactcattgctgagcacagtagctttcacagactgagtggagctgtccagtccgaggaagagggccccatccgggagggagctccgcccgaccatggctgccggcgaccggtccgcctcgtcggcgcccacgcgatcccctgctccgggtacgacggcaggcgacgcgagccgggaggggaggaatcagacggatcggggagggggagcaggtagcgccgaagtggactgatcgaccaacaaacaaacaaatataacccgtaggacttggtgggataaggacggcgctatccggctaggatgagatcagggagcggccatgccgcctcgtgccga

SEQ ID NO: 18617 - DNA, 1049 bp, Triticum aestivum
  Clone ID: PAT_TA_18617
ttttttttttaacaagatggggagcagtggcacttccggagtggaccaaccaaacaatgtctttgcacccacgcaaaaaaaacaatgtctttgcacacaattctcatagtttacatgttggtgttacaattcaactgacactcacatacaatttgcatccatcaatcctgtcttacttcccgggcacgaagttggtggcgaatgcccacgcgttgttgttgacagggtcggcaatgtggtcggcaaggttctccaatgggcccttgccggtgacaatggcctgcacaaagaagccaaacatggagaacatggcgaggcggccattcttgatctccttaaccttgagctccgcaaatgcctcggggtcgtcggccaggccaagtgggtcaaagctgccaccagggtagagtgggtcgacgatctcgccgagcggaccaccagcaatgcggtacccctcaacggcccccatgagcacaacttgacaagcccatatggcgaggatgctctgggcgtggacgaggctggggttgccaaggtagtcgaggccaccctcgctgaagatctgagagccagccttgaaccagacggcctcgccgaacttcacaccattgcgggcaagcaactcgggaaagacacaaccaagcgcaccgagcatggcccatcggcagtggatcacctcgagctcccggttcttggcgaaggtctcagggtcagccgagagcccggcggtgtcccacccatagtcaccggggaactcaccagtcaagtagctggggggctcgccggaaagcgggccgaggtagagcacacggtcagagccgtaccacgggctgctcgacgaaacttgtttggccttcgccgcagtcttgcgcatgttcacacgtgcgtcaccaatgagagccgacgagggcaagttcttgacggccttgccggcgaaggacgaagaggaaagagacatggtggtggccgccattgcgctgcacttattgtgtgttgtccctgtgtgttctccaatagtgtggcttgactcgtgccgaattcggcacgag

SEQ ID NO: 18618 - DNA, 1739 bp, Triticum aestivum
  Clone ID: PAT_TA_18618
aggaattcggcacgaggccccatgtcgcggtaggaagaccgtccgaaccctaaccctagctccatccaccggcgtccccgtcctcctccggccatcctccatggacgcgaaggacatcctcgggctccagaagacctccttcccgtccgcccaggagaagaagtcgcggccgcccaaggagccgcagcgcaagcccgatggcgtctcgcgcgaggtgtacgcgctcaccggaggggtcggaatggcgccgctcatgccgaccatcgaggcctcgcacctgaagcgccggcctgctgtcgagaaggagaaggtagcatggcagtggctacctttcacgtcatctgcacgaactgacaatctgcaactttaccactgggttagagttgtaaataatgttccaccaactggtgattatgacttcgcaaaatataacacgaaggtggatgttcttaaatacaccgatgaggagtatgagaaatatttaactgaacctacatggagcagagaagaaacagaccagctatttgaattatgtcagcgctttgaccttcgtttcatagtaatagcagataggtttccaactgctcgcagcgtggaagatctaaagagccgttattattcagttactagggcccttctaattgcaagagctcgatcattcgatgaagttgccggaaaccctcttgtgaaggaaaccttcaatgctgctcatgagactgagagaaaacgtgcattgtctgcactcttctcccaaacaaaacagcaagaacgaaaggatgccgaggttttagcagaagcaaaacgcattatggaatctcgtgctgctaataaaaacgtggaagaagccggagcaccgacgagcttgcctaatgctgcggttcctgctgacggtgtatctcccttgagcaacaatcttccatcttcagctgctacacatccagctgcagcagcgaatacctccatacctgatacactgcggatgcttaaagtgtatttgagaacccatgcacttgatcaaatggttcaagcagtaactgcttcagctggcattagaatgattaaaagggtggatcaaactctacaagatcttggggtaaatttgaagcctaaggtcccaacaaaagcagtttgtgccgaacatcttgagttacggaacgagatactcacactgcttaacatacagaagcagctacaaaataaagaggctgaagttttagcaaacagagaaagttcattcacagaggcaccgaccacacctaagcgttctaatagagatattgatcgaccctttgtccctgatatggctgggtttggaggtgagagagcagtcaaacgggatcacaagaggaagaccactggaagatttgatggacccccctcgccaacccagggcaagaggcctcggaagatgaaggcgtccgattgataatctgacacagcataaaacatcgggatgtagccaaacaaccagagccggccctgggccagggcaagaaggacgatggccaaggaaattaggaccagtcttttgtacactaggttagccgtgcaccacctgttttgtaaaatggaattgatggtggttttaaccttgttgttggttgtggaaatgaactctgttttgtgcaaagcaatgtgcatgacgattcagagcagagcaagagttggaactggattcccagaaatgctttgggcacccatattatcgaattcattaagttcaaaaaaaaaaaaaaaaa

SEQ ID NO: 18619 - DNA, 1047 bp, Triticum aestivum
  Clone ID: PAT_TA_18619
atcatcattcttgtttgataaaccaaccaaataatgttacatgactacgaataatcgtagaggcgcaaaagaaaccaagccctagtagcgcttgtttcactgaacccatgctcactccacactcccgttaccttggggcaatctcaattcacatagcgaacaggcatcgcctcgtattcacttgccggggacgaagttggtggcgaatgccccaggcgttgttgttgacgggatcggtgaggtggtcggcaaggttctccaagggggccccttgccggtgacgatggcctggacgaagaagccgaacatggagaacatggcgagccgtccgttcttgatctccttcatcttgagctccgcaaatgcctcggggtcatcgggccagccccgagggggtcgaagctacccgcccggggtagaggggatcgacgatctcaccgagcgggccaccggcaacgcggtacccctccgacagcgcccatgagcacgacctggcaggcccagatggcgaggatgctctgcgcgtggacgaggctggggttgccgaggtagtccaacccaccctcgctgaagatctgagaaccagctttgaaccacacagcctcaccgaacttgacgccgttgcgagcgaggagctccgggaagacgcagcccaagagcaccgagcatggccccaccgacagtggatcacctcgagctccctgttcttcgcgaacgtctccgggtcagccgagagcccggccgtgtcccagccgtagtctccggggaattcaccggtgaggtaggacggcgcatcaccggagagcgggccgaggtagaggacgcggtcagggccgtaccacgggctgctggaagcggcgggcttggccttggccgccgtcttgcgcatagtgatgcggccctcgccgaacacgttgaaggaggcgatcttggcctgcttggcggcaagggccggagaggagagtgccatggtggacaacgccattgcagttgcagaaaaccctcaagaagatttggttgcttgtcttgtgcttccctcgtgcgaat

SEQ ID NO: 18620 - DNA, 939 bp, Triticum aestivum
  Clone ID: PAT_TA_18620
aaatcggggcttcttgtcgtagacctcggtcttgaaacttctcgaacccggtcttgaggcgctccacggcggcgtccatcaatgcgggtgcgacgggcgcggcctggacgggggtgttcctgatgagcttggggcggaaggaggaggagttggagggcgcgggggtgccgaggctggcgacgatggtggaggagcgggcacggggcgcgacggttgcgtagcaccagttctcgtgccgaattcggcacgagcgagttttttttttttttttttttttctagcaacagacttttgcattcaaccttcgtactttacatcatggttgtacaaacgaaaccaggtgcatgcatgcatgcgcacgcttcatcgcgtacgtacgtacgtgcacggtcgatcagtttctagacactcgatcgttgctacaagacctagcagcttacttgccgggcacaaagttggtggcgaaggcccaggcgttgttgttgacggggtcggcgaggtggtcggcgaggttctcgagggggcccttgccggtgacgatggcctgcacgaagaagccgaacatggagaacatggcgaggcggccgttcttgatctccttcaccttgagctccgcgaatgcctcggggtcatcggcgaggcccagggggtcgaagctgccgccggggtagagcgggtcgacgatctcgccgagcgggccgccggcgacgcggtagccctcgacggcgcccatgagcacgacctggcaggcccagatggcaaggatgctctgcgcgtggacgaggctggggttgccgaggtagtcgaggccgccctcgctgaagatctgggagccggccttgaaccacacggcctcgccgaacttgacgccgttgcgggcgagcagctcggggaagacgcagccgagagcgcccaacatggcccaccggcagtggatca

SEQ ID NO: 18621 - DNA, 1843 bp, Triticum aestivum
  Clone ID: PAT_TA_18621
accggtccggaattcccgggtcgacccacgcgtccgcgctaaagcaccagcaacagccaagaagattgaagaatccagtgaaagttctgattccgaaagctctgactctgagaagccagctactgaagtgaagaattctgcggttgccactgcacaaaagaaaaaccaggacggctctgacagtgattctgatgaatcatcagatgaggatatggtcactaaaaaaccagtagccaagaaagtggtagaatccagtgaaagttctgattctgactctgaggaggaggataccactgctaaaccagttcaatcttccaaggctgttgctgttaagaagggcaaagaatctagtgatagctcagattctgactcagattcagattctgaagaagataccaccgctaaaacagtttctgtaaagaaagaagaatctagtggcagctcagatagtgactcggattcagattctgatgaaccagcaaaatctactattcctgcgaagaggcctctgacaacagagaaaaagagtgaacattccaaggatgattctgatgatagttctgatgagagtgatgaggaagagcctccacaaaagaagcctaaggattcatcttctggtgctgccaagccagtctctaaggctgccaagaaagaaagcagtgatgatgatgacagttctgaagagagctctgacagtgatgaggaaaagagtaaatcggtgtcagtggcaaaacccaagcagaacgaaccaaaaactcctgccagcagtggtcaagctactactgggtcaaagaccctttttgttgggaatctgtcatacaatgtggagactgaacaagtgaagcaattttttggggaggctggtgaggttatggatattcgttttgctaccgctgatgatgggagcttcaagggttttgcacatgttgaatttgctacaactgaagctgctcaaaaggcatacgaattaaatggaggagatttggcggggaggcctgtcaggcttgattttgctcgtgagcgaggcgctattactcctggcagcgggagggacaatagttctttcaagaagcctggtcaaagcaataccgcttttgttagagggtttgattcatctcttggggaggaagagatccgaagctcgcttcaagatcattttagctcatgtggagatattagaagagtttcaatcccaaaggattatgatactggcgcaagcaaagggatagcgtacatagaatttgatgacatcagttctttgcccaaagcgctcgagctgaacgggtctaacattggagaaggcttaagcttgtttgttgatgaagccaagcctagggctgataacagagatggcgctgatagtggtaacaggagcgcaggaagatttaatgggggcgggggccgcagaggaagatttgacgggggcgggggccgcagaggtggaaggtttgacgggggtgcgggccgcagaggtggtggaagatttggccggggtgacagaggcggccggagtgacaggggccgtggtcggggtggtgcaccccccaggcagagtgctggcacacctagtgcagggaagaagataactttcggtgatgactgagcttggtgtctccgcttgaaatcgcgcagaaactccaacccacccctagtgaaacgccaaactagtgaaatgtcgaacatttcgtttttgcctggagactcgtacttgctgtttttaatattatcttattattattattgtggaccgtggtggttatctgccagactatgtcgtctgtttgggagatttatactcgtgatgaattttggtcagatatatatattacctcctggcttgctt

SEQ ID NO: 18622 - DNA, 2434 bp, Triticum aestivum
  Clone ID: PAT_TA_18622
attcccgcctgctcctctctgctccacttccatctgctgcgccccgcccatccatccatccatccttgaaacatcaagttgaccctctggctgggccacagcggttgcagagacaagagaacaagtctcctccacaaaaggggtgccacagcggtgagatgtcctcgctgaggccgctcaacacggagccaagttttctccactcccagaagctgcagagcccgagggatgcctgcggggcaccgctgaggtcgccgtcgccgagggtcgtcgccggcccgcccaagaagaggatggcgcgcgccggaggcctcttcgagaggtcgctcagcttcaagaactgggaggcggaggttggcgccgatgagccagaggcggcgagccggtgcatcaacggcgcgcgccccgggaccctcgtgctccagagcccaggaagcaagcagcagcagtccccgaggccgtcgccgtccaaggcgcacttcgtctctccgaggcctcaggccgagctggacgacgcggccaccaaggtccagaagctcttcaagggccaccggacccggaggaacctcgccgactgcgccattgtcgtggaggagctctggtggaaggcttacgattccgcatcactcaacatcaagtccatctccttctttgacgaggccaagcaggagacggctgcttcccggtggtcaagggctgggaagaggattgccaaggtcggcaaggggctctccaaagacgagaaggcccagaaactggcactgcagcactggctcgaagctattgacccgcgccatcgctacggccacaatttgcacctctactacgacatctggtccgcgagttccagcacagagcccttcttctactggctggatatcggagccgggaaagacgtgcatcaccaaaagtgtccgagaagcaagctgtattcccaattgattatgtacctcggaccaaacgagagggcaaggtatgaggttattgtggatcaagggaagctcatgtacaggagaagcgggcttctcgtagaaaccaccgaggattccaaatggatatttgtgctgagcacaactagatcactatacatcgggcagaagaagaagggtaaatttcagcactcaagtttcctggccggggcggcgacaaccgctgccggtaggttggttgccaaagatggcattcttaaggcaatatggccttacagcggccactacctcccaacagagggagaacttcagggagttcatcagtttcttggaggagaacaatgtggatctagctaacgtcaagaggtgttccgtggacgacgacgagtacccatcgttcaagaagacctcagacgagcctactgaaatggaagaacatgacgagaagcccaccgaggcgcaacatgatgggaccctcaacagctcgcaaattgaactgcctgagatggacatcatcaaggaaatggttgccgaggacaacgcggagaccgaggcagcagcgaccaagatggccagtctcccatccttcaaatgggcaaccgctgctggcgcgcggatcggctgtgtccgcgactacccggctgatctccagagcatggctctcgagcatgtcaacctgtcaccaagagtggtgccgtctccgagcgcgaatcggctgcccatcccgtcacctcggcccagccccaagatcaggctgtctccccggctgcactacatgggccttcctacccccaccggccgccggctcccgatcccgagcccggaaatcaggaggcagcagttcatgggctttcagacaccggaagtgtctctcactctccccaagcacaaggccaagtgatttttcatgtcgccatctcgcggcacctattacaaggctgctgctattgaagctataacagcagttttagatatagttattatagctagatcagagatactcacaattttgtttcttatggttggttctttggttctgtttcgtgtcaccgttctttagtatgttcatcttcttatttgacctgaggtgcgtcggctgtagtgtaaagtgtagactacagctgcctagcctcaaaccacaactctgcaaataagccatgtaactttccagctttgttttgataataaaagggttgttttgttcatcaaaaaaaagaaaatacgaggaaaaatctcacctcctcttcctccgttcccctgctcgatccgccgcgagaaattcgccaccaaatctattgatctgttggatccaatccgccgatccgtcgatcggttcgcgcgggccctccgtcccccggtgtttcgatctggtcggagtcggaggagatgaatggcgccggcgcgagccagcagcaacagcagcagcagcagaggctccgtcagcagcagcagcaacagcagcaggccctcctgatgcagcaggcgctgcagcagcagcagtatca

SEQ ID NO: 18623 - DNA, 1882 bp, Triticum aestivum
  Clone ID: PAT_TA_18623
accggtccggaatttccgggtcgacccacgcgtccgaaagaggagagagagagagcgagcgagcgagcgagagaaaatacgaggaaaaatctcacctcctcttcctccgttcccctgctcgatccgccgcgagaaattcgccaccaaatctattgatctgttggatccaatccgccgatccgtcgatcggttcgcgcgggccctcggtcccccggtgtttcgatctggtcggagtcagaggagatgaatggcgccggcgcgagccagcagcaacagcagcagcagcagaggctccggcagcagcagcagcaacagcagcaggctctcctgatgcagcaggcgctgcagcagcagcagtatcagtccggtgtcctcgccgccgccgccgccgcggccatgactcagatggagcctgtttcaaatggcaatctcccacctgggtttgatccatccacatgtcgcagtgtgtatgtaggaaacgtacaccctaatgtcactgagagccttctgattgaagttttccagggctctggtcctgtggaaagatgcaagctcatccggaaagaaaagtcttcctttgggtttgttgactactatgatcggaggtcagcagctcttgcaataatgacccttcatgggcgtcacatatacggtcaagcaatcaaggtgaactgggcgtatgcaagtacacaaagggaggatacatctgggcatttccatatttttgttggtgatttaagttctgaagtgaatgatgcaactctttatgcctgtttctcagcatatccttcttgctctgatgctcgagtcatgtgggataataaaactggacgctccagaggttatggctttgtctccttccgtaatcagcaggaagctgaaactgctataactgaaatgactggtaaatggcttggcagtagacaaataaggtgcaactgggcaacaaagaccaacgcagaagagaaacaagaaacggacaatcataatgcagttgtactaacaaatggtggttccagtaatgcagcaatggaggcaaatcaggatacaggaagcaaagaaaatccagagaacaaccctgatttcacaacggtttacgttggcaaccttggacatgaggttaatcgggatgagcttcaccgccatttctacaacttaggggtcggggctattgaggaggttcgtgttcaacaggaaaaagggtttggatttataaggtacagtacccatggtgaagcagcgttagctattcagatggccaatggattggttgttcgcggcaaaccaatcaagtgctcatggggcaacaaaccaaccccgcccgggacatcttctaagccgctgccgcccccgattgcttcatatcaacccgtagcaatggctggtgtgccgcaaggcttcacagcagccgaacttctagcctatcagaggcagcttgccttgagccaggcggcggcagggcagattgctggccagcacggcctcgcaggccaggtatccgcagggctacttgctgctggctcccaggccctgtacgacggctacccgaaccagacgtcggcgcagcagctcatgtactacaactagtatatagggttaaaaggaggaaggcatttgtagcgctcagcttgtttgacgcaagcctgacctgaccttccttcccggttctcgtatttttctattttcatgtactattgtcgtgagagcttttcatgtgcttgtcgcgggattgtgtttttatttttcttctcattgctgtactattgaccaattttctggtctgatttcgttgggtagccctccttaacagagtaccggatgtattttaatgtgaatctgcggttgattaatgtaatgctctcttgtttaaaaaaaggggggg

SEQ ID NO: 18624 - DNA, 1282 bp, Triticum aestivum
  Clone ID: PAT_TA_18624
aacaattgttgccatcatccgggcaaccgctggagctcatgtttatcgatgtcacttaacattgtgtcactgtacatattgtacatttcatggatgaacaaagtcttcatattgttttgcactacaatgcttgtacttcaaccatactaacatagcaaaaagatgtgcatcatttgtagataaaacttgagatacattcttcaacagcccggatttagttccgaactggcaaaggcttgctaaacggacccaagcggtcagcatagctgcggtactaagcagcttattacaatttacaatacggcaataacaatcgatcaagctaagacttctcacatcccattcttttccttctgcggtctgagtaccgaacgcagaccctacgctcacataccttcttcatcttctgctgcatgtatcgcaagccatacatgttgtagtgctaggctccacactatttgttgtactactatatttttttgccttccttccacgtgcattgtcgtgtgcatcggtgcttcctagcatccgaagtcataggaaaccaatccttgcagctccgggccgttcagcctgctgttgttctcgaagcttcgaagagggaagcttgagaatggaccatcgacggggatcgtcccacataagtcattgttagacaaatcaatgactttcaggttggagagtttggccagctcccgtggaattgatccagcaagtttgttgttgttcaaacgcatgaatctcagtgagctgagcttggaaagggacttggggattcttccggtgagcttattggcatacagatccaagctgatcaaattcttcagcttgcccaactcttttgggatctcgccgttgaggttgttcctgtacagctccaggtactgaagattcacaaggcggctgagctcggggccgatggagccggagacgttggagttgcctaaatccaggcggacgacgcggctggcgctgtcgcaggtgacgtggaaccaggtgcaggggttgacgagggtgggatcccagctctggagcacgccgttggggtccgacagccgcatccgcagcgcgtacagcgcgtccccctcctcgttggacgcccgcgccgcgccggccgccaggcccagcagcagggcggcgccgacgaggaggagggaggaggagggcacgcgaggcgccatggcggcgaggagaggccgggcgcggggtagatcgacggggctgctgctgctgctcctctgctctgctgtagcgtgggaggaggaggacgggtggttgtgga

SEQ ID NO: 18625 - DNA, 1236 bp, Triticum aestivum
  Clone ID: PAT_TA_18625
tttttttttttttttatttttttttttttttttttttttttttttaaacataacaaagagatggggatcgtttgtagataaaacttgagatacattcttcatcagctgggatttagttccgaactggcaaaggcttactcaatggacccaagcggtcagcttagctgcggtactaagcagcttattacaatttacaatacggcaataacaatcgatcaagctaagacttctcacatcccattattttccttctggggtctgagtaccgaacgcaaaccctatgctcacataccttcttcatcttctgctgcatgtatcgcaagccatacatgttgtagtgctaagcttcctactatttgttgtactactataattttttgccttccttccacgtgcattgtcgtgtgcatcagcgctttctagcatccaaagtcataggaaaccaatccttgcagctccgggccgttcagtctgctgttgttctcgaagcttctaagagggaagcttgagaatggaccatcgacagggatcgtcccacataagtcattgttagacaaatcaatgactttaaggttggagagtttggccagctcccgtggaattgatccagcaagtttgttgttgttcaaacgcatgaatctcagcgagctgagcttggaaagcgacttggggattcttccggtgagcttattggcatacagatccaagctgatcaaattcttcagcttgcccaactcttttgggatctcgccgttgaggttgttcctgtacagctccaggtaccgaagattcacaaggcggctgagctcggggccgatggagccggagacgttggagttgcctaaatccaggcgcacgacgcggctggcggtgtcgcaggtgacgtggaaccaggtgcaggggttgacgagggtgggatcccagctctggagcacgccgttggggtccgacagccgcatccgcagcgcgtacagcgcgtccccctcctcgttggacgcccgcgccgcgccggccgccaggcccaggagcagcgcggcgccgacgaggaggagggaggagggcacgcgaggcgccatggcggcaaggagcggccgggtctgggggggagaggagcgcggagtagatcgacggggctgctgctgctgctctgctgtagcgtgggagggggaggaggaggaggacggtcggttgggaaaatttttttcagaattttttttaaatccgagaccggccggc

SEQ ID NO: 18626 - DNA, 1325 bp, Triticum aestivum
  Clone ID: PAT_TA_18626
gatccaaatgatacagattaccactgattcatgtatgcaaagtagcctcgtctcctgtaacgggttgtcctcgctacaattgctgccaccatccgggcaactgctggagctcatgtttatcgatgtcacttaacattgtgccactgtacatattgtacatttcatggatgaataaagtcttcatattgttttgcactacaatgcttgtacttcaaccatactaacatagcaaagagatgtggatcgtttgtagataaaacttgagatacattcttcatcagctcggatttagttccgaactggcaaaggcttgctaagtggacccaagcggtcagcttagctgcggtactaagcagcttattacaatttacaatacggcaataacaatcgatcaagctaagacttctcacaccccattcttttccttctgcggtctgagtaccgaacgcagaccctatgctcacataccttcttcatcttctgctgcatgtatcgcaagccatacatgttgtagtgctaggctccatactatttgttgtactactatatttttttttgccttccttccacgtgcattgtcgtgtgcgtcgggcgcttcctagcatccaaagtcataggaaaccaatccttgcagctctgggccgttcagcctgctgttgttctcgaagcttcgaagagggaagcttgagaatggaccatcgacggggatcgtcccacataagtcattgttagacaaatcaatgactttcaggttggagagtttggccagctcccgtggaattgatccagcaagtttgttgttgttcaaacgcatgaatctcagtgagccgagcttggaaagcgacttggggattcttccggtaagcttattggcatacagatccaagctgatcaaattcttcagcttgcccaactcttttggaatctcgccattgaggttgttcctgtacagctccaggtactgaagattaacaaggcggctgagctcggggccgatggagccggagacgttggagttgcctaaatccaggcggacgacgcggctggcggtgtcgcaggtgacgtggaaccaggtgcaggggttgacgagggtgggatcccagctctggagcacgccgttggggtccgacagccgcatccgcagcgcgtacagcgcgtccccctcctcgttggacgcccgcgccgcgccggccgccaggcccagcagcagggcggcgccgacgaggaggagggaggaggagggcacgcgaggcgccatggcggcgaggagaggccgggcgcggggtagatcgacggggctgctctcgtgccgaattcggcacgag

SEQ ID NO: 18627 - DNA, 969 bp, Triticum aestivum
  Clone ID: PAT_TA_18627
gccggccggtccggaaacaaacccgtcgcgcacgacaccacaccacaaagcgaggggcggacccggagcaaaaaagaccaccaaaggcaggcgtcctccgtccctctgtcctcgccgtccccaacctctcgctgcaaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggtggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctctaaggtcttgctctctatctgttccctgctgaccgatcccaacccggatgatccccttgttcccgagattgcccacatgtacaagacggaccggtcaaagtatgagacgacagcccgcagctggacgcagaagtacgccatgggttgaagacctgcatcgtggacaactgaaatgtcgcttcaagaaaaatatttatgggccattgtttcttcgatttgttgctggttgtgtgtaatccaatcctcaaggattgtaaattgcattcggcgtcggtcctatcatcaattgccactagtatcggcagacatgcatgcctatcagcctattcacctatgcttgttgggttaaccttcatcagtgttggtgttatttggtaaatgttcattaaaacatgtttgcttaatgaccttgtccagatttatcttcttttggttttaggtcatgttttcgtatgtatggatgttcagtttggttgttcttcgcagctaaagcatcaaagggtagttgcaactagcaat

SEQ ID NO: 18628 - DNA, 1608 bp, Triticum aestivum
  Clone ID: PAT_TA_18628
tttttagtttaaaagttgtattaaatatgaaaatacagtcccagcaatatagtacccttttttttatcgaaacacaagattcaatgaggggccatatgaccattggcgccaacatgcataaataggatggaacttacatagattagttcttactttctgaatattagtctgaatttacagaagctacttctcagggccttggaatatatacgtctaattacatcaaaccatacggaccaatcatctccattgcatagtgaggttgaggacacttttttatttacacagtccaaagtgaccagtctattgcggggcggggggtaatcacaggtctacaaagggacgacaatatgatacaaatagagtaccgagttaagaacctttcaggcccagttcttccgcttagatctcagcctcattagtttgtccttccatgttgctgcatctttgtatctctcttcaacaactgcaatgaacatgtttcgcaccaaactgaactcttgagcttcaacgcagggctctccatcaggtctgtcaagttcagtaaacaataaaccatctgaaaggccacctgcagccaccaattttgctggctcgactgatcttatgccgtcgctgtatgcaagactcctatgtacttgtataggaaccttgcagcgaacagcaatattgatagcatccgaaggccgaagatcaaatgttatactctctgtttgatctccaatctttgttagataaagctcggccacagtatgcttcttgaattcttttgtttacccgaacaagttttacctcatagcccatcttatcgatcagttccttaacaacttgatatatggtaggtcttgcaatatgaacatggcgaatagcagccatcagaagtacacttggcatctccaaaacaatgattggaagtaaagttccacttccatcttcaattctcaaaacgatagcaggttgtggtgcactctctggaatctctctcccttgagaattattatgcacacaccgcaggtttttcccatctcgcatctttactatatatccttctgatccacttctgacctcaacagcttcaagcacagtggaattaacataatcttcatcattctcattgaagtttccagccatgtatccattaccatcagatgaggagctgaagctacgacaaataggaccaaagttctttgaagatgactgagagattggagaaactagtctagtaatgttgcggtatttagacacagcacccaagaatgcagtgccaagctgcccagatttgatcaatgagttgttgacaagggcagcaggaagccttgcttgcattatagggcgacaaagaattggtccctccattgccatcaatgtgccaccagcaacggccgttcctcggaatcgagcacgagcgcaactttttttttaggggaaacacgagcgcaactttattatagagataagtgaccaagtatatttattgtctgggggtggaaaatggaagcgaaagaggtggggcttggcttatccagaagagagcagaaaatgtagcggtgggcgagcggctcctatgcagtaccagtgggcgagtggtaaaatgttcccacgcgtccg

SEQ ID NO: 18629 - DNA, 1054 bp, Triticum aestivum
  unsure (1)..(1054): unsure at all n locations
  Clone ID: PAT_TA_18629
ctcgtgccgaattcggcacgaggtcgcgcacgacaccacgccacaaagcgaggggcggacccggagcaaaaaagaccaccaaaggcaggcgtcctccgtccctctgtcctcgccgtccccaacctctcgctgcaaaaggttgcttgtcatggcatcaaagcgcatcctcaaggaactcaaggacctgcagaaggacccgcccacatcatgcagtgcaggtcctgctggtgaggacatgtttcattggcaagcaacaattatgggaccccctgacagtccctatgccggcggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgctccctgctgaccgatcccaacccggatgatccccttgttcctgagattgcccacatgtacaagacggaccggtcaaagtacgagacgacagcccgcagctggacgcagaagtacgccatgggttgaagaagacctgcatcgtggacaactgaaatgtcgcttcaagaaaaatatttatgggccattgtttcttcgatttgttgctggttgtgtgtaatccgatcctcaaggattgtaaattgcattcggcgtcggccctatcatcaattgccactagtatcggcagacatgcatgcctatcagcctattcacctatgcttgttgggttaaccttcatcggtgttggtgttatttggtaaatgttcattaaaacatgtttgcttcatgaccttgtccagatttatcttcttttggttttaggtcatgtttcgatatgtatgtatgttcagttttgttgttgttcgcagctaaagcatcaagggtagttgcaacttgcaatataccagaagctcgctgcaaaacgtgttggctctgcatatttgctttgccccaagtcaaactttctaaacttnaccattcattcaa

SEQ ID NO: 18630 - DNA, 1565 bp, Triticum aestivum
  Clone ID: PAT_TA_18630
gaatgggaatactttagctggttggacttccagaaaaatattcggagaacttctgtatttgacattcagaagttcagagaaaccaagaagttaagcagaagaacagagatgccttgattaatctgagaaaatagccagatattacacaaacaccatcttagtgtacacacaccaactcctcatctcgactcgccctcacatgcaacatctatcagtccggactactcaatctcacaacgggaagaagcagagatcgacgacgacacacatgcagcagcatccatcagccatgaagttgtcggcctagaggttgagctgaccgcgctcacttgccggggacgaagttggtggcgaaggcccaggcgttgttgttgacggggtcggcgaggtggtcggcgaggttctccaggggccccttgccggtgacgatggcctgcacgaagaagccgaacatggagaacatggcgaggcggccgttcttgatctccttcaccttgagctccgcgaacgcctcggggtcctcggcgaggcccagggggtcgaagctgccgccggggtagagcgggtccacgatctcgccgagcgggccgccggcgacgcggtagccctccacggcgcccatgagcaccacctggcaggcccagatggcgaggatgctctgcgcgtgcaccaggctggggttgccgaggtagtcgaggccgccctcgctgaagatctgggagccggccttgaaccacacggcctcgccgaacttgacgccgttgcggggcgagcagctccgggaagacgcagccgagcgcgccccagcatggcccagcggcagtggatcacctccagctcccggttcttggcgaaggtctcggggtcggcggagaggcccgcggtgtcccagccgtagtcgccgggggaactcgccggtgaggtagctcggggggtcgccggagagcgggccgaggtagagcacgcggtcggagccgtaccacgggctgctggacgccgccaccttgggcttgcccgccgtcttgcgcatggtgatgcggccctcgccgaagggcgccgccctggaggccttcaccggggtgcccgccatcgccggggaggagagcgccatggtcgcgcccgccattgcgtgctactcgctagctttgcttcgggtgagctgaggctggcagtgggaggcgcctcgtgccgaattcggcacgagcacagggccgggtctctgcttgcatgcacgtctctgtaatctacgtagatgctctcttagccggcgagagcgctggtgttgtagacgaggaggacgccgccgccgaggaggccggcgagggtgacggcccagataagaagcccggtcgttccgccggcgtagcggtcaccagattcagaccattcctccggcgtgtagattgggctgtagccgtcgacgttggcgccgtacttgtcaacaaactggtacacgcccttcttgccgaccttcctgccgttggcgtcgatgtcgactgtcaagccgcctccgagtccgaggggcttgtcgaccttgatcttcttgccaccgcctcgtgccgaat

SEQ ID NO: 18631 - DNA, 1429 bp, Triticum aestivum
  Clone ID: PAT_TA_18631
gcacgaggccaccccacccaccgttctctctctccctcttcttctccctcggcgagcagagggtgggagaccaggctaagcggaggcatcccagcgattcggcgcggagaccgcttcctcggccgcacccccgcatcctctcctccccctcccccgcgctcccctccatttgtccccgcccccgcgccccccccaatcttaacctccacacccgcccctgggcctcgctcctctggccccaaatcttaaccagctccccccctccgcccccttcttcttcttcccctcctcccctcccctgtctcgcccgcagcttcaccggcagcgagggaaagagggaggatgagcgcgtccaggttcataaagtgcgtcaccgtgggggacggcgccgtcggcaagacttgcatgctcatctcctacacctccaacaccttccccaccgactatgtgccaacggtgtttgacaacttcagtgctaatgttgtggttgatggcaacactgtcaacctcgggctatgggatactgcaggtcaggaggactacaacagactgagaccgctgagttatcgtggagctgatgtcttccttctggccttctcgcttatcagcaaggccagctatgagaatgtttcaaagaagtggatacctgagctgaagcattatgcaccaggtgtgcctattatcctcgtgggaacaaagcttgatcttcgagatgacaagcagttctttgtggaccatcctggtgctgttcctatcactactgctcagggggaggaactaaaaaagttaataggcgcaccctactacatcgaatgcagctcgaagacccaactaaatgtcaagggtgtatttgatgcggcaataaaggtggtacttgcgccaccaaaggcgaagaagaagaaaaaggcgcagaggggggcttgctccatcttgtgatctaatcatcggtagacaaagaacaagggcgaagttgccgccatgctatattattgttacgtcttgcttcagcggagctgcactctcatggtcgtcgtccctcccccctaccccaccctaggttacccaccggcagctgcagcaaggtctctttgtcgaggcatcgggcgatccatttgtttgatttctcttcttcctgccttgtgattatctcgtgtgactgacaagtcgtggcaatttaggtaacttgcttagtagacggtatttcccgtgtttgagaccccgtaaaaaaaaagtatctcgttgttatctcggttccataagtagagacatgatgtaatcgcactcagtttattttatttttgcttgttattttcacttcaatggaaaattatgtttcctttctaaaaaaaaaaaaagaagagctaccagcaagtgggtcatgatgaaccaaaatacacgcagacttcaaagagtcagtgacgaagcagga

SEQ ID NO: 18632 - DNA, 1085 bp, Triticum aestivum
  Clone ID: PAT_TA_18632
taggggccttttttttttttttttttatgtctaacaacagccttttgcattcaaccttcgtactttacatcatgcatggttgtagtacaaacgaaacccagctgcatgcacgcatgcatgcgcacacttgatcgcgtacgtacgtacgtgcacggtcggtttccagacataacacaacacctagcagcttacttgccgggcacgaagttggtggcaaaggcccaggcgttgttgttgacggggtcggcaaggtggtcggcgaggttctcgagagggcccttgccggtgacgatggcctgcacgaagaagccgaacatggagaacatggcgaggcggccgttcttgatctccttcaccttgagctccgcgaacgcctcggggtcgtcagcgaggcccagggggtcgaagctgccgccggggtagagcgggtcgacgatctcgccgagcgggccgccggcgacgcggtagccctcgacggcgcccatgagcacgacctggcaggcccagatggcgaggatgctctgcgcatggacgaggctggggttgccgaggtagtcgaggccgccctcgctgaagatctgggagccggccttgaaccacacggcctcgccgaacttgacgccgttgcgggcgagcagctccgggaagacgcagccgagcgcgcccagcatggcccaccggcagtggatcacctccagctcccggttcttggcgaaggtctcggggtcggccgagagccccgcggtgtcccatccgtagtcgccggggaactcaccggtgaggtagctcggggggtcgccggatagcgggccgaggtagagcacgcggtcggagccgtaccacgggctgcccgacgacaccggcttggccttggccgcggtcttgcgcatggtgacgcgcgcctccccgaagagcgccgacgacggcaggtccttcaccgccttcccggcgaaggaggagggggagagcgccatcgcggtggtcgccattgctcgctggtcgaggagacttcgtgcgtgtccgatgtgcgtgctctctaggagtggggctgtggtggtgtatggcgggatcccggaacggccggc

SEQ ID NO: 18633 - DNA, 886 bp, Triticum aestivum
  Clone ID: PAT_TA_18633
ccccccccttttttcgcaattcagtgtttgacattgagaggttcagagagacaagtagttaaccagaagaacagagatgccttgattaatctgagaaaatagccagatattacacaaacaccatcttgtagtgtacacacaccaactcctcatctcgactcgccctcacatgcaacatctatcagtccggactactcaatctcagaacgggaagaagcagagatcgacgacgacacacatgcagcagcatccatcagccatgaagttgtcggcctagagcttgagctgacggcgctcacttgccggggacgaagttggtggcgaaggcccaggcgttgttgttgacggggtcggcgaggtggtcggcgaggttctcgagggggcccttgccggtgacgatggcctgcacgaagaagccgaacatggagaacatggcgaggcggccgttcttgatctccttcaccttgagctccgcgaaggcctcggggtcctcggcgaggcccagggggtcgaagctgccgccggggtagagcgggtccacgatctcgcccagcgggccgccggcgacgcggtagccctccacggcgcccatgagcaccacctggcaggcccagatggcgaggatgctctgcgcgtgcaccaggctggggttgccgaggtagtcgaggccgccctcgctgaagatctgggagccggccttgaaccagacggcctcgccgaacttgacgccgttgcgggcgagcagctcggggaagacgcagccgagcgcgccgagcatggcccagcggcagtggatgacctccagctcccggttcttggcgaaggtctcggggtcggcggacagccccgcggttcccagccgtagtcgccggggaactcgccggga

SEQ ID NO: 18634 - DNA, 1101 bp, Triticum aestivum
  Clone ID: PAT_TA_18634
gaattcactaagtgatttcgagcggccgcccgggcaggtcgcacgacaccacaaagcgaggggcggaccccgaagaaaaaaagaccaccaaaggcaggcgtcctccgtccctctgtcctcgccgtccccaacctctcgctgcaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggcggtgttttcttagtgaacattcatttccctccagattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgttccctgctgaccgatcccaacccggatgatccccttgttcctgagattgcccacatgtacaagacggaccggtcaaagtatgagacgacagcccgcagctggacgcagaagtacgccatgggttgaagacctgcatcgtggacaactgaaatgtcgcttcaagaaaaaaatttatgggccattgtttcttcgatttgttgctggttgtgtgtaatccgatcctcaaggattgtaaattgcattcggcgtcggccctatcatcaattgccactagtatcggcagacatgcatgcctatcagcctattcacctatgcttgttgggttaaccttcatcagtgttggtgttatttggtaaatgttcattaaaacatgtttgcttcatgaccttgtccagatttatcttcttttgtttttaggtcatgttttcgtatgtatgtatgttcagtttggttgttcttcgcagctaaagcatcaaagggtagttgcaactagcaatatatcagaagctcgctgcaaaacgtgttggcttggcatattagctttgccctaagtcaaaactttgtaaactttaaccattcattcaatgatgaatctattattactagtatcgattagaaaaaaa

SEQ ID NO: 18635 - DNA, 2384 bp, Triticum aestivum
  Clone ID: PAT_TA_18635
ttttttttagcaaacccgaacaattaatgtccactcgtattcatatggaaaatgaaaaccatgcatttctcatatagacatttcatgttccagacgggccctatttgtaaacatctttgatagtgtacaacatcaacgatcagatattaatcatacatccagagtacacatatactcctgagaagtcgattttcatgtgcagatcaagccaattcagaccagccatgcagattctccaatccaatctaacttgaaacaacattcagccaatttgaatttgcctgcttactaaagataaattagaacgacattcagcatattcttgttaagcataaaaataagaattccaaagaactgtaaaaaaatactacctccgtccgaaaatacttgtcattgaaatgaatgtatctagatgtacttttaattctagatacatccattttcatccatttatgcgacaagtatttctggacggagggagtattcaataaattggatcacagttcataataagtcggtcttcatagcattttaagctatgaaaaaaccgtacgctggattctctaatcttacataatgcaatttaatcaggcaatcggcaagctgaaattgcctaactaaccaggcttcctcgacacaacgcctgcaccttacagaatatatcaacatgaacaatttaattcttcaattcaggtttcagtatatcaaacactagcaacatttcttaagatcgaaaatggcattgacaatcataactggtctgcaacttcattagatatgaagatctgcctccagtaatcctcaaaacgaatccaactttccacgtgaggtagtatgatgcagcagcaatatttggacaagctccagtaactaagtatacaaataaatttcgaagactaactagttgtacacaaaggaatcaagtcttccgatggtatatacatagagaagtactcatggtaaccaacaggaaatgcaagcaactcgccttcttaggaccacaagactacggacacggcatggtaagataaaataaatatgcagagttattaaaagttctcaggatcacttagcccgtgttgcgtaagtagatggttgttggctcgtgggaatttccctattttcattcttggggtgcaagggtacaaaattacaggtatgatcaaccttgtattgaactgaagatccaccatgtacagttaactcatttagttgagatgaagtgcacaagaattttttgatcgacaactttgaggtcagttcagattgacccttcagaaaagcactaacgtttctgggtcacttaaaatttaaattgatataacgctgaaagaagtagttagatgtaccttcgtgcgtagttaaattgatcctcacaacgtagttaccgctgcgcccaggcctgttcacatattagctatgtaggatcgcggtgtacttcagatgatgcggtggaatcaacaacacaggagaaggacagagacaccatggcagggtggagaacccgggcaaaatagaacaaatagattgttcccgtgcgatctccaccccgcaaacaccaccaaatatactttttattgtcttgtggcctgccaaggcgagcgcacccgacatggcaaaggccgtcctaccctaccaatgtattggtacatcaagttgtacaatacgcacgtcctcgcatgcgcatcatcagcttaccaacacaattacctttctgtgatgtttggagacaggccagaatcatcttgtgagcagaagggaacacgtacatcatttgatcggcaaacagaaaccatatattggatggcccgtttccttctggcgccttgcggagacaagaaagcctcaagaaagcattcttcagcttaaccaccaaccgtcgtctgagaagatttcagttggcgttggccgtgggcatcataaaccagtgaagatgaaccagcaggagtggcgttccacggagataaacatccacaggggcatgcgaacaggaagcagatggcataaactgacggatctgacgcatcaaccgattcagccgtcacaaacggaaggccacaaaatcccttcgcttaagggatagacatgtatttggagaggcgaatcgtccaccacttaatcaaaaagaagagataacccatgagatctgaaaggcgttgacgaatattcagaacagaaatcctaattaggtgaacagcgtacaaaaggtcgtctaactttggctccataatatagttataagaaatttgaaacagaaataatttggaatttaagaacaacaatccaggaatccacataataatcttataacgaataaacaaacaatatatagatcgaattcgtagtactgtattagggcaagaatgaagacaaaccctcgtgca

SEQ ID NO: 18636 - DNA, 1069 bp, Triticum aestivum
  Clone ID: PAT_TA_18636
taggggcctttttttttttttttttaagtctaacaacagtcttttgcattcaaccttcgtactttacatcatgcatggttgtagtacaaacgaaacccagctgcatgcatgcatgcgcacacttgatcgcgtacgtacgcacgtgcacggtcggtttccagacacaacacctagcagcttacttgccgggcacgaagttggtggcgaaggcccaggcgttgttgttgacggggtcggagaggtggtcggcgaggttctcgagggggcccttgccggtgacgatggcctgcacgaagaagccgaacatggagaacatggcgaggcggccgttcttgatctccttcaccttgagctccgcgaacgcctcagggtcgtcggcaaggcccagggggtcgaagctgccgccggggtagagcgggtcgacgatctcgccgagcgggccgccggcgacgcggtacccctcgacggcgcccatgagcacgacctggcaggcccagatggcgaggatgctctgcgcgtggaccaggctggggttgccgaggtagtcgaggccgccctcgctgaagatctgggagccggccttgaaccacacggcctcgccgaacttgacgccgttgcgggcgagcagctcggggaagacgcagccgagcgcgcccagcatggcccaccggcagtggatcacctccagctcccggttcttggcgaaggtctcggggtcggccgacagccccgcggtgtcccacccgtagtcgccggggaactcgccggtgaggtagctcggggggtcgccggagagcgggccgaggtagagcacgcggtcggacccgtaccacgggctgccggacgacaccggcttggccttggccgcggtcttgcgcatggtgacgcgcgcctccccgaagagcgccgacgacggcaggtccttgaccgccttcccggcgaaggacgagggggagagcgccatcgcggtggtcgccattgcttcaagaagactcgtgcgtgtccggcgtccgtgctctctgagagtggggctgtggtggtgtatggcgggatcgtaagcccggccggc

SEQ ID NO: 18637 - DNA, 714 bp, Triticum aestivum
  Clone ID: PAT_TA_18637
ggtagagggtgcgtgcatacgggctccaagaatccacccttttacagtttccaaagtaggaagtaggagtatatggtaactgcgttacgtacatacataaaccatctgttcgaatcaattactttgcatcgttgatgacatacattcacaggaggtagctacgtagattacagagacgtgcatgcaagcagagacccggccctgtgttacacgtagatgctctcttagccggcgagagcgctggtgttgtagacgaggaggacgccgccgccgaggaggccggcgagggtgacggcccagataagaagcccggtcgttccgccggcgtagcggtcaccagattcagaccattcctccggcgtgtagattgggctgtagccgtcgacgttggcgccgtacttgtcaacaaactggtacacgcccttcttgccgaccttcctgccgttggcgtcgatgtcgactgtcaagccgcctccgagtccgaggggcttgtcgaccttgatcttcttgccaccgctgcagacgacggcgaaggaggagccccggcgggagagggacggcaggctcgtcggcgccacaatcggcgaggtgatcatggaggctgccatctcgcgcgcgctctctcaagctctgtctgtctgcgcttgcttgccaactctgtctgaagaaaagcgtccagcactggcgcagcgacgggccaatcggacgcgtggg

SEQ ID NO: 18638 - DNA, 1066 bp, Triticum aestivum
  Clone ID: PAT_TA_18638
tttttttttttttttttttttagcaaacccaaacaattaatgtccactcgtattcatatggaaaatgaaaaccatgcatttctcatatagacatttcatgttccagacgggccctatttgtaaacatctttgatagtgtacaacatcaacgatcagatattaatcatacatccagagcacacatatactcctgagaagtcgattttcatgtgtttacttgccgggcacaaagttggtggcgaaggcccacgcgttgttgttgacagggtcggcgaggtggtcagcgaggttctccagcggacccttaccagtgacgatggcctgcacaaagtatccaaacatggagaacattgcaaggcggccgttcttgatttccttcaccttgagctcagcaaacgcctccgggtcgtcggctaggccaagggggtcgaagctgccaccggggtagagtgggtcgacgatctccccgagcgggccaccagcaacgcggtacccctcgacagcgcccatgagcacgacctggcaagcccagatggcaaggatgctttgagcgtggaccaagctagggttgccgaggtagtcgaggccgccctcgctgaagatctgggagcccgccttgaaccagactgcctcgccgaacttgacgccgttgcgagcgagcagctcggggaagacgcagccgagcgcgccgagcatggcccagcggcagtggattacctcgagctcgcggttcttggcgaaggtctccgggtcggcggagaggcccgcggtgtcccacccgtagtcgcccgggaactcgccgctgaggtagctcgggggctcgccggagagcgggccgaggtagagcacgcggtcggggccgtaccacgggctgttggaggcggaggccttgggcgcggccttgcgcatggtgatgcggccgccgccgccgagggcgtaggaggctccggcgagcttgatcgcgggggaggagagcgccatggtggtggtggccgccattgctgccggatggaacagagcaagctgctgatgtgcggctgccgctgctactgatgggtggctgcgt

SEQ ID NO: 18639 - DNA, 711 bp, Triticum aestivum
  Clone ID: PAT_TA_18639
acctaggtagagggtgcgtgcatacgggctccaagaatccacccttttacagtttccaaagtaggaagtatatcgtaacagcgttacgtacatacacataaaccatctgttcggatcaattactttgcatcgttgattgcatacattcacaggaggtagctacgcagattacagagacgtgcatgcaagcagagacccggccctgtgttacacgtagatgctctcttagccggcgagagcgctggtgttgtagacgaggaggacgccgccgccgaggaggccggcgagggtgacggcccagataagaagcccggtcgttccgccggcgtagcggtcaccagactcagaccattcctctggcgtgtagattgggctgtagccgtcgacgttggcaccgtacttgtcaacaaactggtacacgcccttcttgccgaccttcctgccgttggcgtcgatgtcgactgtcaagccgcctccgagtccgaggggcttatcgaccttgatcttcttgccaccgctgcagacgacggcgaaggaggagccccggcgggagagggacggcacgctcgtcggcgccacaatcggcgaggtgatcatggaggctgccatctcgcgtgcgctctctcaagttctgtctgtctgcgcttgccaactctgtctgaagaaaagcgtccagcactggcgcagcgacgggccaatatactccagccc

SEQ ID NO: 18640 - DNA, 1184 bp, Triticum aestivum
  Clone ID: PAT_TA_18640
gcataagttgccatcacgaagagcgacctctgactaagtaacgcccaagtattcatcgttctcatttctcatggagcaacacacaggctacatccaggacatgaagcaagcgggcagatcaaaccatttccccaaagatccttgtaatttacaccgtgatgttacaatttgaaccacccattatgtgtgcagttcaccgcagttgccttgatatatggctacaacacgcagctagcgagcgccaacgcctcacttgccggggacaaagtttgtggcaaacgcccatgcgttgttgttgacagggtcggagaggtggtcagcgaggttctcgagtgggcccttgccggtgacgatggcctgcacgaagaagccaaacatagaaaacatggcgaggcgaccgttcttgacttccttcaccttgagctccgcgaatgcctctggatcgtcagccaagcccagtgggtcgaagctgcccccggggtagagtgggtcgactacctcaccgagtgggccgccagcaatgcggtacccctcaacagcgcccatgagcacgacttggcatgcccagatagcaaggatgctttgtgcgtgcacgaggctggggttgcccaggtagtcgaggccaccctcgctgaagatctgggaaccggccttgaaccataccgcctcgccgaacttgacgccgttgcgtgcaagaagctcggggaagacgcatccaagcgcaccgagcatggcccaccggcagtggatcacctcgagctcccggttcttggcaaaggtctcggggtcggccgagagcccggcggtgtcccacccgtagtcgccggggaactcgccggtcaagtagctcgggggctctccggaaagcgggccgaggtagagcacacggtcggcaccgtaccatgggctgcctgatgaaaccggcttggcctttgcagcggtcttgcgcatagtgacacgggcctcaccaaagagagctgatgaagccacgttcttcaccgacttgccggcgaaggtcgaggagagggacatggtggtggtcgccattgcgctgctaaggcgggaggtgtattgtgtgttctccaaacaatgaaaactgaagagtgagtgtggagatggtttgagacgagtggaggatggagctatttaaggaactggagctaatataggggattgagcgaaag

SEQ ID NO: 18641 - DNA, 1339 bp, Triticum aestivum
  Clone ID: PAT_TA_18641
ttttttttttttttttttttttttttttttaaacgaggcaaaagcattagatcaacttcatcaccaacatttcataacacacttatatcatcctgcattcccacaaggttaaaggttttgttaccgcacatcaacctaaggcatggcatgccacgatccacatatggttccatataagttcataataatacggcatgcatcatattagacagtactgtaggcaatagctagcaaaccacaaaccaccagcagcttcaaagttcatgccggcaaagccaactgctagttgtcagaggcagactggccttgaagaagaccgtcacggatctgcgtggcgatgtcgcgcaccgcaccagggccatgggggatgaacaccgccgaggacttggaggacgcgccgatctctttcatagtatcgaagtactgggtgatcagcaccatgtccatcacatcctttgcagtggtgccaggcacattgactgagaagcccaggacgctgtccctcaggccatccacaatggcctggcgctggcgggcgataccgaggccagacaggtacttggcctctgcttcaccctcggcacgcttgatctggacaatcttctcagcctccgccttctcgtttgcagccaccctcatccttgcagctgcattgatctcattcatcgcctgcttgacatgcgcatccggctcgatgtcgacaatgagggtctgcacgatctcaaagccatatgccgacatagccttttcaagttcatcctccacagcctttgctatatcgttcttctgcacgaaagcatcatccaggttgagctttggaacacttgccctgatcacatcaaagacataggcttgaatctgggatcttgtgttggtcagtttgtagtatgcgtcactttctttgccagccagaggtcggtactgaatcgatgcaacaacagtgacaaacacattgtcctttgtcttagtttcacagcgcacatccagctgctgcaacctgagtgtgagatggccaactacacgtttcccaaagatccaaggcaggcagtggcatcctggctcaagcacactgtcaaacttcccaaactgctccctgatggccacggtagactggtcgacttgaacacagcagcacagattgcccatactgcaggcttccgatcacttccgggctccggcagcacctccgtccgggggttggagaagagtggggaaagggggggagcggtgaagtggctcggtcccgagctccccgaggatcgccatggctgacgaaaccctaacggaccgaacggacggtacggacgaggcggcggggggtgagggggggacgggtctc

SEQ ID NO: 18642 - DNA, 3235 bp, Triticum aestivum
  Clone ID: PAT_TA_18642
ttttttttgatgcaacaatcgtcatgatatcatcgttcaagggttcaaacattatcgtcgtcatcatgggacgaggaaaatttgccagacacataccaataatgaccgaggacatctggtctctctcttctactacatggagctacaagccggtaggtaatggtgagactaacgtaacacacccaagaggccaaagggaaagtggggggtaaactgcggcaatcctggaataatgacacaagaaccaaaaataacagcagcgcacaacatacgaacggtggacgacgggcggggcggggaagttattcgtgatgctgtccgtagattcgaagtccgctcgactcgtcgtgagtcttctagatgtacctgaacagcacgcctccgtacgtggcgaagaagggcgcaaacacgagggactcgacggccatgagcttgatgaggatgttgagcgacgggcctgaggtgtccttgagggggtctccgatggtgtcgccgatcacggccgccttgtggcagtctgaacccttggggccaagggacctcgcgtgctcgctgttgccagcctcaatgtacttctttgcgttgtcccatgcaccgccggtgttggaagcagagatggcgatctgcactccagaaacaagggcaccagccagaacaccagacagggtttccacgccgaagagggttccgacaatgaggggggtgagcatgaccaaagcacccggagggatcatctccttgatggaagcatcagtggagatcttgacacaggtggcatagtcgggcttggcagttccctccatcagtccggggatggtgttgaactgcctgcggacctcctcaaccatcttgagagcagcacttccaacactcttcatggtcatggcagagaaccagtacggaagcatggctccaacaatcaggccaatgaacaccttgggagataggacatcgacgaccttcacgccggctctgctgacaaaagcaccgaaaagtgccagggacacaagagcagctgatccaatggcgaaaccctttccaatagcagcggttgtgttgccagcagcatcaagagcatcagtcctctcacggattctgtggctcatgccagccatctcagcaattccaccagcattgtcactaatgggaccataagcatcgatcgcaagaccagttgccattgtgctaagcatgccaagagcagccattgcaatgccgtacatcgcagcaatagagaagctgacgtagatgctgacagcaatagcgaaaattgggatgatgacggacttgtaacccagggcaagaccgaagatgacgttggtggcagcaccagttctgcaggaatcggcaacatcttgcacagggctgtaggcattgctagtgtagtactcggtcacaaacccaataatcagaccagcccacagaccaactgccacgcagaagaacaggccccagttggacacgtccttctgagcaccgaagttgaagatggtgaacttagctggaagagccaaccagctgattaccgcaacaccgatggtcattaaagcagtggagatgatgagctgcttcttcagagcaggttcaatttcgcttgcagccttgatctcgaagaaatcagttgcaaagagcgtggtgagcaagcaaacaatgatgccgacagagctcacgagcagtgggtagcacatcgcagtgaaatcatggttgattccaaaagatgagatagaagcaacaacaagagcagcgcaggaagattctgcgtatgaaccaaagagatctgatcccattccagcaatatcaccaacattgtcaccgacattgtcagcaatcacagctgggttccttgggtcatcttcaggaatgttcctttcaactttgccaacaaggtcagcacccacgtcagcagccttggtgtagatacctccaccaactcttccgaatagagccatggaagacccaccgagaccataaccagtgatggactcaaaaagaccttcccagtcatcaccgtagtacatcttgaacacgttgatggtgatgtaaagaaccacaagcccacttgatgacaacaagaagcccatgactgcaccagagcggaaagcggtgataaatgccttcccaacacccttccttgcttccagggtcgtcctggcattggcgtatgtggcgatcttcatcccaaggaaaccagacaccagagatgtgatggctccaagcaagaaagacgcagtgctgaagagagcggtgtagagagctggcttgcaggtgcccgtgctgtaggtgcagggctggccctttgtgctgaatccctcaattgacccaaggaagacgaagataaccgcagcaaagacgaccatgaacataccaacatactggtacatggtgaaaaggaatgatgttgctccttctgagatggcggtctggatctcggcgcacttgacgacgacgttgtggtcgttgaggccctcctcctcctcgatgaggtagtcgccgtagccgttcttggagccgccggcggcggcggcgccgggggtgaccttgaccttggagacgatgaaccactgcgcgatggcgaagacgatgccgacgaccccgcagacggggatgaggatctcggtgccgagctccccgaggatcgccatggccgacgaaaccctaacagcagcgcacaacatacgaacggcgggcgggcggggcagagttattcgtgatggtgatggtgtccgtagattctaagtccgctcaacgagtcttctagatgtacttgaacagcacacctccgtacgtggcgaaaaagggcgcgaacacgagggactcgacggccatgagcttgatgaggatgttgagcgacgggcctgaggtgtccttgagggggtctcccgatggtgtcgccgatcacggcgggccttgtggcagtctgaacccttggggcccaagggaccctcgcgtgctcgctgttgccggcctcaatgtacttctttgcgttgtcccatgcaccgcccggtgttggaagcagagatggcgatctgcactccagaaacaagggcaccagcaagaacaccagacagggtttccacgccgaagagggttccaacaatgaggggggtgagcatgaccaaagcacccggagggatcatctccttgatggaagcatcagtggagatctttacacaggtggcatagtcgggcttggcagttccctccatcagtgccagggatggtgttgaactgcctc

SEQ ID NO: 18643 - DNA, 857 bp, Triticum aestivum
  unsure (1)..(857): unsure at all n locations
  Clone ID: PAT_TA_18643
accagatgcgccctatgcatggtagagggtgcgtgcatacgggctccaagaatccacccttttacagtttccaaagtaggaagtatatcgttacagcgttacgtacatacacataaaccatctgttcggatcaattactttgcatcgttgattgcatacattcacaggaggtagctatgtagattacagagacgtgcatgcaagcagagacccggccctgtgttacacgtagatgctctcttagccggcgagagcgctggtgttgtagacgaggaggacgccgccgccgaggaggccggcgagggtgacggcccagataagaagcccggtcgttccgccggcgtagcggtcaccagattcagaccattcctctggcgtgtagattgggctgtagccgtcgacgttggcgccgtacttgtcaacgaactggtacacgcccttcttgcccaccttcctgccgttggcgtcgatgtcgactgtcaagccgcctccaagtccaaggggcttgtcgaccttgatcttcttgccaccgctgcagacgacggcgaaggaggaaccccggcgggagagggaggggacgctcgtcggcgccacaatcggcgaggtgatcatggaggctgccatctcgcgcgcgctctctcaagctctgtctgtccctcgtgccgaattcggcacgagggtccttcaaatgggcaaccgctgctggcgcgcggatcggctgtgtccgcgactacccggctgatctccagagcatggctcttgagcatgtcaacctgtcaccaagagtggtgccgtctccgagcgcgaatcggctgcccatcccgtcacctcggcccagccccaagatcnnnctgtct

SEQ ID NO: 18644 - DNA, 1166 bp, Triticum aestivum
  Clone ID: PAT_TA_18644
acattgagatctacaagtacccagcctggggtgatgttgttgagatcgaaacatggtgccaagaagatggaagaattggtactcgtcgtgattggatcctcaaggacctggctaatggtgaagttattggaagagctaccagcaagtgggtcatgatgaaccaaaatacacggagacttcagcgagtcagtgatgacgtaagggatgaggtgtttatacattgtccaaagactccaaggttagcattcccagaggaaaataatggcagtttgaagaagattccgaatctttcagatcctgcacaatactcaagactaggactagtgccaagaagagctgatctggacatgaaccaacatgtcaataatgttacttacattggttgggtcctggaaagtatacctcaagatataattgatacacacgagttacaaacaatcactctcgactatagaagagaatgtcaacatgatgacatagttgattcgcttacttacatagaggaaggagaggagaaaagcatgaacgggctctgcttctgcaggcaggcgccctcacaaagaagagccgggcagccagttcctgcattgctttgaggatttgccagcccaaacgggacacggagattcacccgttggcccgtaccgtgttggagggaagctaggctagattaaaaagtgttctttcgtccataaatgatatcgaccatcagaccctaccattcccatccaagcagacgctagctagtttaaggctccttgccaaaacgtcgacatagtcccaaccgtacaagggagtttcccacggctctcatgaacaaaaatataaggttacgctgacgccgagcggcagagccagaaatagtcatcaactacacctaagtaattacatcagagaagagtgcatcagaacctcttcctttttcccctcactgtggacaattgggatacaacagattgaaaagacaaagcacggagacagccatagacgaaaattccagccacgtccagcggatcccgtaacttggtatgaccaaacatcagattcctctaagcaagagtaaccagcagcgatgccaatgtatgcatgcagcgatgtagatcacatgaaaactcattcactcgatactatgtcctgacaaagctgatctgatacacttgatgtca

SEQ ID NO: 18645 - DNA, 1655 bp, Triticum aestivum
  Clone ID: PAT_TA_18645
ccgccgccggcggcgtggcggccgtgcagctcaccgttgacctcaagcccgacgtccccagcgaggcggagcggatcaagaagtgcaggggcagggtgttcgcgctgcaggacgagccggaggtgccgagggtgtggcttccatttgacgacgcgccgggcctggccatggcgcgggcgttcggggacttctgcctcaaggactacggcgtcatctcggtgccggagttcttccactggccctctcacggacaaggaccaggttcgtcatcctcgcatccgacgcggcctggatggtcccaagcaaccaagagacggccgatttagcgtcctcgtccccgagtccgggccaggcggcaagctggtggcgcgaggcagctaaccgtgaatggaaaaccaagtatccaacatccagggaccgacgactgcgccgtcgtttgcttatatttggatggcaaaatggaccacctgcgtgagcgcctacagggccatggacacggacctcctgaggcaccccgacctcctcagcttctccaagcgcagcaccaacatcaccgccctctaactcggcacggacctttacaggacagtcatcggggacgctcgcgcgaacctaggcgccagagacgccgccgccggcggcatggcggctgtgcagctcaccgttgacctcaggcctgacgtccccagcgaggcggagcggatcaagaagtgcaggggcagggtgttcgcgctaggcgatcagctgacgacgcgccgtctgtccatcctagtattcttcgcgccgggcctggccatggcgcgggcgttcggggacttctgcctcaaggactacggcgtcatctcgaaaccggagttcttccactggcctctcacggacaaggaccagttcgtcatcctcgcatccgacggggtgtgggatgtcctgagcaaccaagcggctgttgacatagtgtcctcatccccaagtcggtcaaaggcggcaaggactcttgtcgaggcagctaaccgtgaatggaaaaccaagtacccaacatccaggaccgatgactgcgcggtcgtttgcttatatttggatggcaaaatggaccatgagcgtgattcgaccgcgtccatggataacatcagcattgaggatgattcagtcgcagaccctaacgaagcgcaggagcaacaggagcccgccttaacccgcaatttcacagttaggacagtcccggggagcgctcaggagaaagccttggcgggcgcagacgccaaggtttccggtggagccgacgatcacaactggtcgggcctcgatggggtgacgcgggtgaactcgctcgttcagcttcccaggttctccgaggagaaggcggtcagttgacgacgagccgtccggccattctagtattcttctctccccccttgttgtttgttgctctgcgtttagggtagtggtcagttgtttcagggaaaattgtagaaatggaacaggcttctgatttgctgttgtgcttcactgcctggcaagccttccgttgctgtgcttggaattcgagctgttgcccctttttaccccaccaaaactgtatatcttgaatgacaaaaggctcacatttttcgggtgtcgctcgattatttatgaagattggggggcgcgcctcgaggacg

SEQ ID NO: 18646 - DNA, 1225 bp, Triticum aestivum
  Clone ID: PAT_TA_18646
cttcgcctcggcctccgcgcaggagtccccccccctcggcgccctcctcgcggctgtcggcgtggcgcgcgctctgctccgggctctggccggcggcgccggcgtcgagggcgtccccggcggcgcggtggaggcgggggccccggcgaaggtggtgggggcggggtcggaggtggaggcgggcgaggccgccgtggccgtggccaagaacatgtcgttcagggaggagagcaaccgcctgggcgacctcaaggacgccgagcggaaggcgctcgccgagctccgcgccaaggtcgaggaggccatcgtcgagggcaagctgttcgacgacgacagcgccagcgtcaaggtcaaggcgaaggcggagcccatgaagcagcaggtggagcagcgcgaccccaggcccccgagcgccgcgtcgctgctgcaggtgacggacctccgcggctcccccggccccgccaggaaggacctccgcgtcgccatgaagcaggtgctcgacctcttccaggacaactacccggagctcgtcgccaggaacatcctgatcaacgtgccgttctcctactacgccttcaccaccgtcttcttcccgttcctgacgcagcggaccaagagcaagctggtcgtcgcccggccctccaaggtcaccgagacgctgctcaagtacatcccgatcgaggccatcccggtgaagtacggcgggctgaagcgcgacggcgacgccgagttcaccggcgagcacgacgccgagatcgccgaggtggtcgtcaaggcgggcgccaccgagaccatcgagatcgaggccgccgagggcgacacgacgctgacctgggacgtgacggtgctggggtgggagcgggggtgcaccgagggggtcgtcccggccgtcgggggcgcggattcgtgcgtggcgtgtgtgagtgtgcgggattctacattcttttgtgcaagatagtagtactagtggttgtgttcggcgattgttaccgtgccgtggaattattttatccgagacatataaaaagatgcagtcctccggcacaaggccaagagcgccctcgccaagaagtgctaagaaagaaaaaatggagatgtgccagacgtgtgtgtaacgagggggaattcgaattctttgggggctgagatttgtgcatgtcgtgtgtgagtgtgcgggattctacattcttttgtgcaagatagtagtactagtggttgtgttcgg

SEQ ID NO: 18647 - DNA, 1338 bp, Triticum aestivum
  unsure (1)..(1338): unsure at all n locations
  Clone ID: PAT_TA_18647
gccacccgcccccctcctcccacccgtcatcccccatctccccccaaaccgacgcgcacatccatccatccgcttcgtccccggccacggcccaaaccctagagaccgacaaccgccgcgcgagcagcgagagggagaggaggagaccgccgggcgccatgaacgacctcatgaccaagtccttcatgagctacgtcgacctgaagaaggcggccatgaaggacctcgaggcgggcggcgacgagaccgagaccgagctcacccaggccggcggcggcggcgccaccgacgagcgcctcaagggcttcttcagggaggcggaggcggtccgcgaggagatggcggccatccgcgacgcgctcgcccgcctccacgccgccaacgaggagggcaagtcgctgcaccagcccgacgcgctgcgcgccatgcgcgtccgcgtcaacgccgacatcgtctccgtgctcggccgcgcgcgcgggatccagcgcgcgctcgcggacatggacgtcgccaacgccgcgcagcgcaggctctccgcggcatgccaggagggcaccaccctcgaccgcacccgcacctccgtcaccgcgggcctccggaagaagctcaaggacatcatgctcgacttccaggcgctgcgccagcggatgatgtccgagtacaaggacaccgtcgagcgccgctactacacgctcaccggggaggtccccgaggacgaggtcatcgagcgcatcatctccgagggccgcggcgaggagatcatgagcgccgccgtcgccgagcacggcaagggcgccgtgctcgccgcgctcaacgagatccaggaccgccacgacgccgccagggaggtggagcgcagcctcctcgagctccaccaggtgttccttgacatggccgtcgtcgtacagtcgcagggggacaagcttcagaacatcgagcaccacgtgagcaacgccagggactacgtccactccggcaacaaggagctcggcaaggcccgcgagcaccagcgcggcagccgcaagtgcctctgcatcggcatcatcctgctgctgctcctcatcctcatcgtcatcgtccccatcgccaccagcctcaggaggtcctgagcagccacaccacaccggagtttgtgacgatgatcatctggacacctgcatttgtgtctaatatgctgtttcgatttcgtattctactgcttcattcgttgatttctgctccccccgaatgtctctgtgccgtccaggatttaagctgatgatgaatagtacaccgtatatctgttcagtccaattttacaacccttnaaaatctgctgattgattccaanaaaaaaaa

SEQ ID NO: 18648 - DNA, 727 bp, Triticum aestivum
  Clone ID: PAT_TA_18648
cgtccgggagcttcccactgaagtggcatctagtaaaggatgtgccgaattccacctttcgacacatcatattagagaacaacgagaacaagcctgttaccaacagccgagatacacaagagataccttataagtcgggaataaacatgctaaagctatttaagagtagtccaatgacgacatcgattcttgatgacttccctttctatgaagggaggcagaaagcaatgctagaacagaagcgcagaagtttgggcagaagtttcggtagacttacttatgttccagcacttgttgctaaaaggagtgttgtcgtggagggtgaaccttctgaagtaggtgaaggcattagcagcaaagatccacatccagggaaaactggacaggatagtggtgcttgtgagcaacctgacaagacaagccaaacgaaagatggagtggttacacaagtactgaaaaaggatgcagtatcacctgttgagcaacctgagcatgtaaaaacagaacggcatagcttagatgatattcatcaacagaatgagggctgttccgtttctgtgtcaccagaaaatgctggaagggaacatgctggcttgagcgaactggtaaaatctaatggaaaagtttatagtgaccgtgaatcacaacctgttataagctcaactgaacccaatagttctggacgaaaagggctttctcaggagcttggtggtcacgacccatcaga

SEQ ID NO: 18649 - DNA, 685 bp, Triticum aestivum
  Clone ID: PAT_TA_18649
ccttatttttttctgctttccttacaaaataaataacagaacctaaccatcaaaactgtagtagaagaaaagaaataactattcagatagcctaacgcttccggcctcctgcccttttcgcctcgtccttgctctgctcttctaccctcttaccaaggacaggcaggggctgggtagtgtcatataattccacttcgatgctctgttgtctgttcgtcgtcctcacatgaagaagttgggcacaccaacgccgaaggtcggggtcgaactcgaaaaggcagtccatgctcggggccgacacgcctgtgagcgccgacaccacctcctggaggtcgccgtcccagcgcccactccgcgtaccgcgccggctggcaccgggtaacggcgacatggccagaccaccgttggagccagacgccacaggcgaggccccccacggcgctgagactcagctgccgttcaggccgccgtgctccgcgtccacggtcaggccggctctgaggctctgcagcaggctctccgcgtccgggttgtgttggttcgtcggcggcctcctcccgcccccgccgcccgttggcctgcaggtgtgctggccgtggtagacgacgtcgaagagcgcggggtcctggtcggccccctgcccctgcttggtggcggggcaggcctgcgagttgcggtgggtgca

SEQ ID NO: 18650 - DNA, 482 bp, Triticum aestivum
  Clone ID: PAT_TA_18650
cgtccgcgactccattatttcagcaaacaagaacaaacatatcgaggaaatggcctcgacggagcacggcgacaagctgcggatcctgattgtgcccttcttcgccaccagccacatcgccccccacaccgagctcgctgtccgcctcgccgcggccaggccgggcgccgtcgagcctacggtggcggtcaccccggccaacgtctcggtcgttcggtccgcgctcgaccggcacggccactccgcagcgagcaacgccgtcaggatagccacctacccgttcccggacgtggatggcctcacgcctggcgtggagaacctctccgccgccggggccgacgcgtggcgcatcgatgccggcccggtggacgaggagctgacgcaaggggcgcagcgcgctctcatcccgtggctgctccctgacccgcgccggaaagctggtcgtcgtacaatgatctgcacaggcttatcagtgatctgat

SEQ ID NO: 18651 - DNA, 1488 bp, Triticum aestivum
  Clone ID: PAT_TA_18651
gaattcggcacgagcatcgacgagctcgagcgcctccgcgcgccgctcgccgtcgccgtcgctgaggaggtctccgtcgcccccgcccccgccccggccccggcccccgccccggagccctccggctcggattcctccgtccaggacctcctcgcgctcgtctacttcggcaccctcttcgacgtcaagccgcagagcgacttcatcgccaccatggtcgcccgcgagcatgagcggagcagctgcatcacctacgactgcgtcggggacgacactgtggacctgctcgtggagggcgacctcgacgtcgtgtccgctgtggcggcccttgccgcggctcgccctgcttccgcggtgggcgtctcccaccgcgacgcgctccaggcctgtgcccaccatgcccgcttatggctcgcccgcgccgacgagccgatccaccctggctcctctgttacttatgctgcggtgagggctaagctggacaggatcatggcatcagactactacacagcagctgcagttggaggagggagctatggagctgaaggtgtgcaggcacaggagagtatgactgcctcaccagaggcatcagcagtggaggagaacctagctgctgaaggtcacaaggaggagaaggaagactcccatgctacggaaatttacaatgatcatcagtctgattcagcggacgtgcaaaatgtggatcgtgaagcccccgtgaaccctcccgaggaatatccctctgttcaggcagagcaggagaagtttgacatggaagagcaagatgagagggatgctgagccaaaagagcagcagttccagcaccctaggcggtctcatcagaaccagcggggaggtggtcgtggcaggaggggggcctaccccaatggccgtggcgggcgtggaggcggccgcggcatgggcggcggataccagaacgggcgtggataccagggcgggggtggcggataccagggaggcggtggcgggtaccagaatggccggggtggcggtggcgggtactacaacaacaacaacaacgaagaagggtactaccagccgaggaacttcaacaacaacaggggcaggggcggtcggtctggcggcggcaactcttactacggcaaccagggaggcggcggcgcgcagggaggcggccacgcgtacgccgagagggttgaggcaaacgcttagttgttgaattgttttgcttgggtggaggtcacgagagggagagagaagagtctgggagccattttgttattatagaactaacttagcctgttattacgtcgcaatccgtcacccatctgtgagttggttttgttggtccaatccgatgactgcatatggttggtcgataaatgtggaatcttggtcgaaagtagcttcaggtcatgtttgttggttcccttgttgcttctgtttacggatgtttttagttactcttcactcgttcgatgtgttgggcaaccaacatatcaggga

SEQ ID NO: 18652 - DNA, 521 bp, Triticum aestivum
  Clone ID: PAT_TA_18652
tcgacccacgcgtccgacgtccgatggcaatccgtcttctgtcgcgtcaaaatctgaggaagctggctgcttccttcacactccttaatccatcccagaagatactgctttcacctccccctccggctcacagatctgatgctatttcccctagcaaatgcttaagtcccttttacccgtttatgtattcacggggtgttagatgggctagctatgaatcagtgaatctggttttgtctgatgatgggaaacccaagtttgagattgaggaggtggagccttccaagaaggggaggtttttgacaaagaggcgtttgaagcttcagaggaagcgagaaaagaggaaaaggaaggaggccaataaaaacgatccacgtcgtatcagacccaaggggaaaaaaataaaacagaaatttcctacacctgaagctcgtctcaaatacaagatcgagaagtccaaattaaaaaaagctatgttggttgagaagctaaagaggtacgaggttgcgaaagctgaaggc

SEQ ID NO: 18653 - DNA, 1415 bp, Triticum aestivum
  Clone ID: PAT_TA_18653
cgtccgcccacgcgtccgcctaaccgcggccaaatcgagtcgattgtgccctcgccgccgcccccaaccgcgatgtgccctcgccgccgccctgcaaccaccgccactccgaccattgccggtgtcgcccccagcaccccaccgtagcgccgccgaccaccaactaacacggatctaattcccccgccggccggcccccgtcgccgagcccttcgcccctgtcaagtatcctcagatctcgttcgcccttcgctgcattcccagcgccgcccaaatgtggtctatccatccacgcattctcctctcgcagcaccatctactcggcctcccccccgccctgccgccatgggccaggcgccggcctacgctccggcgccccccgcccccccgggcggcggacccccgtcctcgcgcctccgccgctggtccacctcgacgtcgtgctcgcccatcatcctttgtccgtgctcccccagtttcgtgcttcctcggcccccccgtccgctgcttgcgtccggcaagaatcatcaggtcaacatgatgttggtgttcaaattacgggtaataccatttaaaattttcaatgattaatgacaccacctgagctcatatgccaaatgttcttcctctggtttgaagaaaatagcagagcactcgaatggaagaatatatctggaaccgtcagccttacaaagtgctattttcagctgcatgttttactaatagttgctgtgcctggtatcttgtctgacctggaacatatggtcattttagtaatagcaacgtcaaagtagaaattaggttgggcagggaattcttctgtttgtttatagtttctagccagtaatatagttcttgtgttgttttggccgtgtttgggttccttttgctttctcttctgttggttatccttttgcatttgctttgcctgtaatgcttgctttgtctgttgcaggagacaggagacactcgcagtttggctgtgtccatgctgctgcttttgcctaagatggattcaattaattgagatggaggtggattataatactttggtgataataacaccagccttacagccatatcatttacgaataactccataagatttctcaaaggaccttcaagttgctgaagatttggaagacctacaattaagttggtggagtgataatgtcatttgtcttgtttgttgaacctagagacttgatatgctcattttgttggttattaagctcattttggttgtgtggcacacatctagaaacatatgtacatctccttttgtggcactattttattttggttgtgtggcaaacatatatgtactccttttgtggcacaacctccttatatatggacgaatgaagttttaaggttttcaatgaagcttatatgttaaaaaaaaaaaaaaaaaa

SEQ ID NO: 18654 - DNA, 730 bp, Triticum aestivum
  Clone ID: PAT_TA_18654
taggggccttttttttttttttttttttttttttaaccatgaaaagagaagcttcggcaacaaaatctatcgagctgtaccaaattattacaggcatgcgcccctgcccatgattcagtggcatggtacaccactggaaagcgcgacacgctgagggttcccttttgaacagtatatatgaattagtcggtcactcatgctttacttagcgaaacggcgaacattccaaaacaaaaacagaggagaaacatggggacggtgtcctgctacagaaaatgcgactactgcttctcagtgcgctcacatcggggtctgctgagtcccgagcattccgccgacaatgttagtcacctgccagtactttgaaacacaccgatcaatgcaactgttctctcccatattgagttcaccttctttatgccttttctcaatgcacttctcaaaacaaacatgtgtaagccggttgaaaagctcgacccggtactccatctccttctccgccatcccgaacatcatctccttctccagctcgctccgcacgtccttggcggcagccattgtcgcgacgccttcgcggggaaggatgaccggagtaggccggagatctcgcgagctcggcggcggcggcggtggtcgagatgccgcggaggcgaagaggaacgctagagcagccgcgcctcaatctctagggttttgaaaagcgccgccctccgttcccggccggcgaatc

SEQ ID NO: 18655 - DNA, 1170 bp, Triticum aestivum
  Clone ID: PAT_TA_18655
cggcgtgatgtgggccgtgacattgctgagcttatatgttagagtccaggtcaccatattaggcagacatctctacttggactttgctcgtggtacagatggcgctcaattgcaggcggaatctgatacttttagcggcaatggacataaggactttcttggaactgctgactaccttgcaacatatggtatcactgcattgatcaggcaaatgcaacatgctgcaacagaaatcttgaaagagaagcaactgaaagaccctatgagcatggaccaagtattacaaacgatgttacagatatcggagcagttcatgagtctgtgtgaaggcaactcatggataaatttccttgtacctgaaaacgccaatcggtatgcacagttgatggctgtgtcgagcagcggctttgatgactcatctcttctaatggatgttggaaagcttgaccagctaatgactgagacacgcatagtgttggcaagcgacgatttcagaaatatcatggacatgtcattgaggaaggtagctgatttggtgatagaggacttgcgtgcacaggttggagccgcgcttcctccatcaggattgcccttggcgaagctcttggctagagtggctcaactgagctcaatgctgctcgaggaaccaagcaagaacaagcacatccagaccatccgaagcatgcccgaggtgggactcttctacacattcctctatgcaaacatgccgccgcaaacgtgagttcacgtcgatgtggacaggggcatgtttcttcctaatttttggcccgaaacctccaaaggatctagtggtttatgtgtatgaaaactcgatcgttctggattctggaaagtgataccggtggagaatgttcgttcgtgaaaaatatacgtgtggagaggaggctgagtttatgccctgtatattgctgaagatgtgctcttgttatgcttcaggaaacaagagttctttccctttttacttggttcttcgttaaatacttgttctttcttaatctagttagaattcgacaggctatttctgccatctcgtttacatattttggtagcatgcgtgatggaatttgtgtacctcatgaatgttcaactctacaaattggtttatgaatgaatgtgtgatgtgggtatacctatttggttaaaaaaaaa

SEQ ID NO: 18656 - DNA, 1392 bp, Triticum aestivum
  Clone ID: PAT_TA_18656
cgtccgcggacgcgtgggcgaacgcgtgggcggacgcgtgggcggacgcgtggggcagatggtagattaccttattggttgtccaatacttctgcactgctgtgccttctgcagaagaatctacggtcaaatggattttttggtacaccatctcgccgctctgctggagggctaggtgggaagttagcccaacttgcagggcgtggtgatactgcacaagtggatgctaggtatccagccatactattcaaacagcagctaacagcatgtgtcgaaaagatctttgggcaactaagggataatctaaaaaaggaaatatcacctcttctcagtctttgcattcaggctccaaaatcaacacgccctggaaaagctcccaaagcaccaggggttagtgctcaacagccatcgaactcccactgggataacattgtcagtttcctaaatttgcttatggatactctgcgtgaaaatcatgtgccatcgttctttatacgtaagctgatcactcagttattctccttcgtcaacatccaacctgtcgcccgtcttcgtcttccgcctggggcttgttctcccgcctggggcgaatctgggtttcccgctctgtcattgctggagaaatggattactgatgtctctgaggagtttgcaggaacttcttggcatgagcttaattatattagacaagctgtcggatttttggttatacaccaaaaaaggaagaagacacttgaggagatcagtcaagatctctgcccgtccttgagccttaggcaaatctacaggatatgctcaatgtactgggacgacaagtacaatacccagggaatatcaaatgaggtcgtttctgcaatgcgggagatggtcaacaaagatactcagaacctcgcgtcaaattcatttttgttggatgacgatttaagcataccgttttcgaccgaggatttgtcgatcgccatcccagcaatagattatgcggatgtggagctgccggaatctcttcatcactatccatctgcgcagtttctactgacggcatcatgacccactccctgtgtaatagaacaacaaggaggtttgggcttgaagatcagttaatccccagatttttatggggttgcaccccttcagcaatgttgtactgttgtttagttttctagagcaaatttgatctagggtggaagggggtggtaggtatgcagttccaaagcaacaattgttgctagacgccgaacggccctggcttcgtgggtgtccagttgtcttggctatctatgttgtacaaagaatactgtagaaatgcgaagcagttgcccgaaattattacatctgggcaaaatgtcctgtttggtgcagaacatgtttcgcactcgtaaccagatgcgttct

SEQ ID NO: 18657 - DNA, 510 bp, Triticum aestivum
  Clone ID: PAT_TA_18657
cgtccgcggacgcgtgggtcctggccactgccactagcctcaagagtgcaaggagaatatatactcctcctccattgctcctcactccccgtgcagtagaccacttgctgtgacagggttagccatggccgcaaggagggccgcttcctccttcctctcgcgccgcggcctcctcccgaggcctcccgccgactctcttctcggagcagacaatgcacggcgctcgctgcccaggaccgttgccgggtgctgctgcggttcgcgcacctgatggagcggcacaccgaccagatcgcggcgctggagtcgtgggacggcggaaagccgctggagcagtccgccggcggggaggtgccgatggcggcgcgctgcatgcggtactacgccgcggcgccgggccacctccacggcatgctgccgccccccggcgccccgccctgtgcaccgtttttctccaggaaggacgttcccgacggtggacccccgcaccggcgaggtcatcgcgcgcgt

SEQ ID NO: 18658 - DNA, 466 bp, Triticum aestivum
  Clone ID: PAT_TA_18658
cgtccgacctgaccccgcccccgcccccgccgggaaagcgaagagaagagtatatcccatgttatcccctcgcgtcgtccggccccagcctcacgacggcacggcctccgccggctcatcctcgtcgcggcgccacatggtggaccgcgtgtccgagtgggagctcggcctcccctcggccgccgagctgacgcccgtctcgcaggcgctcatcccgccggcgctcgccgcggccttcgggatcggccccgcggacgcgctctcctcccccgttgacaccggcttcctccacgactcgcccacctcccatctcacatccaggttcgacgagtacgacgaggaagacgaggaggagggggagggcgagaccgacgacgccgccgcccgggcgcggaggggcggcggcggcgggaagaaggcgaggattgtgtggacgccggagctgcaccaccggttcgtcgaggcc

SEQ ID NO: 18659 - DNA, 1264 bp, Triticum aestivum
  Clone ID: PAT_TA_18659
cagaacattttcggggaaaacctagtagaaaaagatgaatttctggaggcattctcaaaggaatgccagtgcatcagtgatgttgtgaagaatggtaattccattaaacatgatgcatcagatgaagatgatctgtcagttcagattgttcgagttgaactccaaggtgctgctgcatacctttattcacgtttggtatcacttgttctgcttctggttgaaggttccacacctatagatatcacggaacatggatggcaaatgctccttgtagtgaagaaggcagagcttgagtcatctgcttcaaaatttcagttgctaggctttgcagctgtccaccatttttatcattaccctgagagcactcgcttgcgtatcagtcagatactggtccttaccaccttatcagggtgaagggcacggccgtcgtcctcctgaggcaatcaattctattgcagaatccgagaacatgtatgacgtaactatcgaagacccttctgattacctgcagtatgtacgttcgtccatcgactgtctccgtctcctcacctttgagccaatcaagcctgcacttggtgctatggtcttgtctctagagcagaccaacctgtctaaaagaactcgcagttcgataatggttccgccgtccgacctggccgagaccgtgcggcagaagctgaagatcaacaagaagcagttcctgcggtgctgggaaattctgatctatctacaccttgacgccgaaaacctcaagtgcattgacaacttcagggcctgcatctacgaccgcaccaaaggtgagctgctcggcggcgcctctggaaccaacgggaagcggctcgtccaagtgcccactagtttcgatgaggacacgtcatttgctgtgttctggacaaaggaaggcggggacgaagataatcagacagtccagctgcagccggaagatcttgccactcaggaggagcagctaaatgaattggtggacaatcaaatggaagagattgctgaggtcgccaagaacgttgcctcacgcggcaaggataaattggctgcttgatgacgtgagatcttgtagctcgttggtagaaagttagaaaatttcttactggagattatcctcgacgtggagaactatgcaatgcggattttttgtttcgagaatgttacattgttatactgtttcaacttagtaaccgtaccaacttatgttatttgagtgaaaaacaaatgcgatagagtcaattacaccggtggtgctagaact

SEQ ID NO: 18660 - DNA, 1074 bp, Triticum aestivum
  Clone ID: PAT_TA_18660
cgtccgcccacgcgtccgcggacgcgtgggcggacacggagatgagcttagcgcttctagggggctactcctccgccgaggacgacgaccccgccgccggcgccggcgtcgagctgagcgactccggcgactcatcagccgaagaggccggatctgacggagacgagaagtccgctccatcgaagccggctgcgaagccccgcccccgcgtaaaccctagccccggagatggggactcctcgctgccctcggcgctagatgtcttcgccgagatctccgggcccccggctttcctcaaccgcagagtggcccagcccgaggaggtcggggaggcgctcggcgtgctcgatcgtcgctccaactccaagaggagaaagccgccacctccccggtgcggttgtggcggcgaagccacagttggttgccatccgtgaacgagttagcagtgacgtgaagaatggtgccaaccctccagttgcggttgtgtcggcgaaaccacagctggttgctggtcacgaacgagttagcagtgacatgaagaatggtgccagccctccaggttctgttgaaggaaagaggaaaataggcgctgcaaatcctggtccagaagatgctgccgagcttctaagaatgtgcctccagtgtggtataccaaagacctattcacatgcgcaaggaatggtatgccctgtttgcaacgacagaccggtgcaggctaaagagccagagaagaagaagggttctgctgtaaaagacaaggagaaagtgaagaggatgagagggcaatcgtcacatgcatcgtggaagagcgaaactgagatggccctgcgccaacaattcgactgattggtgtcaccaggagtgctggtgcactcagtctgtaactgtacactaggtagaatacagtatttttgcctgagtaagctcgcatcactgcgtcccggttggttcacaaggtttgtttcttgtatttgcagttctctgcgacactcggattggtctgataagctgtgttcgttaaaatgtttccagcgaagtcaggtttaagtaaattactcgggcctcttttgcttc

SEQ ID NO: 18661 - DNA, 1299 bp, Triticum aestivum
  Clone ID: PAT_TA_18661
gccccccgagcccagcgcggcgagaggcacgcacgccgcacgcacttggtcggtcgccgccaccacgccgccgcccatcgccgccgcccgtcggagaaggggcccggagacccatggcgggccgcaacggcttcgaggacgacgacgtcaaccccttcgccggagggagtgtcccccctgcctccaattctcgactctcacctctctcccacgagcctgcgggtttttataatgtggacattcctatggattcaactaaggatgtgaagaaaaaggaaaaagaactccaagcgatggaagccgagctaaacaaaagagaaaaggaactgaaaaggaaggaagaggctgcgtcgcgagctggcattgtcatagaagacaaaaactggccaccctttttccctctcattcatcacaatatttcaaatgagatacccatccatctacaaaaaatgcagtaccttgcattttcatcatttttgggaattgctctctgcctcttctttaatatcatagcgactacaactgcatggattaagggagaaggtgtcatggtttggttgcttgccattatctacttcatttctggtgtccctggggcttatgtgttatggtatcgccctctttataatgcgatgagaactgagagtgctttgaagtttgggtggtttttcctattttacatgattcacataatcttctgcgtgtggtcagctgtgtctcccccattccctttcaaaggaaattctttgactgggattttgcctgccattgatgtcataaccaagagccttattgttgggatattttactttgttggatttggattgttctgccttgaatcactgctgagcataggtgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagacaggatgtgtgccgattggaaatggtagtcttgcgcatcgctgcaccatgcggatttggatcgctgaaatcatacagctatatctttttgctcttctgttaatacaaatataaggagccttctcgtgtggatacttttaaggtggtgttgtttccattcgttgacatggttttagatgtggttgatagcgaggaccgactaatattcttggtggaatatatttgcatatgtttgtgagggagtaaatttacttgttcataaaaaaaaaaaaaaaaaaaaaaaactcgagactagt

SEQ ID NO: 18662 - DNA, 737 bp, Triticum aestivum
  Clone ID: PAT_TA_18662
gtgttggcgatgtgcgtactggtgccccttcagctcctaaaaaccgagtctgagcataatgggtccagaaattgatctccaagaacctcgctttggggttgtcaatagacccaacagaattacctgtgattttatgcataatgaaactaatataaatgcaaacatgtctggctgtgatggattatatgctgaatttgatagattcgatgatgattgcctactcaatgaagtcacaaagacaatgggtgatatttcttgccctgagatgccacacttcagtgatggattctaccatgaaggttgcagtacccccattatcttgaaaaggtgcagtacaaggaagcagttggggactgcagcaggatatgttgacggccttgaaactaatgcaattgctcagatgaacttccctgatatccatgcagcgtgggaaagtgacgccatggatatgtcctccatcaaagataatcatcttcatttatctcatccattcttgttaccagatacacctagcagtcaaagtcatgcaaggactggcttggaattgcaggggagatcaagtaaaagctttgcttcttggaactgtgaaaatatggacagtgattttagatctacttattaccgtgacaacagtaattcatcaaaagcagttggggagatctgcacgatacgttaactgccttgaagctaatgcaattgctcagaacaacttccctgatatccgtgcagcgtgggaa

SEQ ID NO: 18663 - DNA, 1322 bp, Triticum aestivum
  Clone ID: PAT_TA_18663
accaagttacaactactacacacgcacacacacaatcctagctaataagccaccatgtcgcctcagtctttcaccttggagaccaccaccaccacgcctgctgccaaggggtcagacccttcctacttccaatccgctccagcttgccatgagatgatccagcacaaggagcttcttctccacttgtacgcctaccagaacgtccagaaaaccccagatgctaaccaggcagtcatagttgagtcgaagcgccccgagtgtttcggaatcctcgctgctaatgactggaccgtgtatgatggtcctgcccacaatgcaaaccttgtcgcgcacgctcaaggtttgcacctcggggctagcatggccaaagagaactggttcatttgtttcaacatggtcttcgtcaatcagaggtttacaggttccagtttcaaggtgatgggggactttcagggcaccgcccacaacggtgaatgggcaatcgttggtgggaccggagagtttgcatatgcacaaggtgtcatcgccttcaagaagacccaacaatccgagagaaacgccaggatggagcttcatgttcgtgctatgtgcctctccttcttaagacctctgctttctctaggtgacgggagcgccgtcgccaagatcggcccttggggtaaaatgagtggagagttactcgacatcccctcgacaccgcagcgtttagagcgcatcaccatccgccatggcgttgtcattgattcacttgcattttccttcattgacaaagctggtgaaccatataacgttggcccgtggggtggccgacgtggggataacaaggacacgatcgagcttgccccttcagagatcgttacggaagtctctgggacagttggtatctttgcagaagacaatgtcgaatataatgctatagcatccctcaccattaccacaaaccaccgcccgtacggtcccttcggagaaacacagagcacccctttcagtgttccagtgcaggacaataataacatcgtgggtttctttgcgtgcgctggtaaatacgtggaggctctcggggtttacgtgcgttcacccgtttcaacctagtacgtgcctgggtgttgtgtcacaccctgtatgtcttccatgtttctatgttgtggcaataaggaagaagtgtgttactatctatttgtggtgtaatgttatatttttgtaagcttgttggtttacttatcagcacagttctcttatcaatcaatgcaaaataatgtttgtaccaaaaaaaaaaattaagctcacgcttaccatattgtactctattagaaaataaatag

SEQ ID NO: 18664 - DNA, 653 bp, Triticum aestivum
  unsure (1)..(653): unsure at all n locations
  Clone ID: PAT_TA_18664
cgcagctgctcgcaaaggtgagttttttctggaacccacagatcttacgagccatcctcctcgaagaactccagtgcttatcttctactcgcccctggcctaatccatccaatctttcggttcagaaggcgaggagggtgcggtgcctggtccagatctcgtggccgccatggcggagcagttcgcggagtcagcgaacaatgtaatcatcgaagaggtgaacaagggcctgaaccctggaatgatagtcctgcttgtggttgcgaccaccctgctgcttttctttgttgggaactatgcgctgtacctgtatgcgcagaagacgctccctccgaagaagaagaagccagtctcgaagaagaagctcaagagggaaaagctgaagcaaggggtttctgcaccaggggagtgaagagatccatcgatttctcatgtcgattgctttatgctgggctcctctttacctgataaaaaatatataccatcntggagctgcggtgttgagcgactgtttatgtagaagccttgtcttgagtggtacatcgtcggtattggacaccttatttaagtgaactgataaaccttagcctaaattaagctgctcctggtcatagtttctttaattaaaaactttgctgnggatcatctgtggt

SEQ ID NO: 18665 - DNA, 682 bp, Triticum aestivum
  unsure (1)..(682): unsure at all n locations
  Clone ID: PAT_TA_18665
gccggccgggctgccgtcaatacgggcaaacaaaatgggggagatcgtaagaaggccgcagaaaggtcccagctgctcgcaaagaaggcgaggagggtgcggtgcctggtccagatctcgtggccgccatggcggagcagttcgcggagtcagcgaacaatgtaatcatcgaagaggtgaacaagggcctgaaccctggaatgatagtcctgcttgtggttgcgaccaccctgctgcttttctttgttgggaactatgcgctgtacctgtatgcgcagaagacgctccctccgaagaagaagaagccagtctcgaagaagaagctcaagagggaaaagctgaagcaaggggtttctgcaccaggggagtgaagagatccatcgatttctcatgtcgattgctttatgctgggctcctctttacctgataaaaaatatataccatctggagctgcggtgttgagcgactgtttatgtagaagccttgtcttgagtggtacatcgtcggtattggacaccttatttaagtgaactgataaaccttagcctaaattaagctgctcctggtcatagtttctttaattaaaaactttgctggggatcatctgtggcaaacttgtgaaacttgtgtagccgtttgcagtttggtaaaaagtgttgcattnnnnnnnnnnnnnnnnnnn

SEQ ID NO: 18666 - DNA, 813 bp, Triticum aestivum
  Clone ID: PAT_TA_18666
gccggccgggccgggaaaaatcattatcgatctttgtggtggctgctgtgatgaatcacaaggacggtatctgagtaaggtggctcttgaaaaaggccctccttccttgattatacaccctaaactgatcttaatttctgagcaagcagaaagaaagtcgcgtgggccgcgtggtcccagctgctcgcaaagaaggcgaggagggtgcggtgcctggtccagatctcgtggccgccatggcggagcagttcgcggagtcagcgaacaatgtaatcatcgaagaggtgaacaagggcctgaaccctggaatgatagtcctgcttgtggttgcgaccaccctgctgcttttctttgttgggaactatgcgctgtacctgtatgcgcagaagacgctccctccgaagaagaagaagccagtctcgaagaagaagctcaagagggaaaagctgaagcaaggggtttctgcaccaggggagtgaagagatccatcgatttctcatgtcgattgctttatgctgggctcctctttacctgataaaaaatatataccatctggagctgcggtgttgagcgactgtttatgtagaagccttgtcttgagtggtacatcgtcggtattggacaccttatttaagtgaactgataaaccttagcctaaattaagctgctcctggtcatagtttctttaattaaaaactttgctggggatcatctgtggcaaacttgtgaaacttgtgtagccgtttgcagtttggtatgttgtgttgcattgtggtttggcgtccctgaaaaaaaaaaaaaaaaggcccctac

SEQ ID NO: 18667 - DNA, 903 bp, Triticum aestivum
  Clone ID: PAT_TA_18667
ccgcactgcccgcgatcgtgagtttctcccgggtccggtttttcctggaacccacagatcttacgaaccatcctcctcgaagaactccagtgcttatctcctactcgcccctggccgaatccatccaatctcgggggtgagaaggcgaggagggcgcggtgcctcgcccagatgtcgtggccgccatggcggagaagttcgcgtaatcagcgaacaatgtaatcagcgcatgaggccaacaagggcctgtaacccttgggatggtagtcctgcttgtggcttctaccaccctgctgcttttctttgttgggaactatgcgctgtacctgtatgcgcacaagacaagccgaagccaagaagaagaggccagtctccaaggaagaagctcaaagagggaaaagctgaagtacagggtttctgcaccaggggaagtaaagatgatccattccgattttccgctgtgtctgattggtttatgctgggctccttttttacccttgaataaaaaatatttacccagctgggagctgcggtgttgtagcaagctgattagtgtttggaaaaccttgtcttgagtgttacagtctatagcttttgggttggccttacttaaatgcgaaactgataaacctttgtcccgaatttagctgcttcctgggttatagtttttgtaaatttaaaaatttgctggggataattaaaagctaactggggaaacatctgttgcaatcttgcgaaacgttagttgccgtttgcagttggggaaaatgcgttacatacttttaagttgtcaaagaaataacatgccaaaaaaacaaccataagccccctgcctatgcatgccgagcgctccggggtcctgaatgcaaaacaggtaatcccttggcacttaaaaaaaaaaaa

SEQ ID NO: 18668 - DNA, 1287 bp, Triticum aestivum
  unsure (1)..(1287): unsure at all n locations
  Clone ID: PAT_TA_18668
aggttttggaaatttctcatgganccannaccccacttcatattgggggtgttaatctgnccatgttatgtgcttgtaattgaacagcattattttgaataaagtggttgccnttcaggagatgtttgaaaagacgtatggctttatccttaacagtgaaggatttatcaccaaatattggtgtgttatggtatttctttgccgaagtcttggacttcttcagaagcttctttcttanagtctttaatatgaacatcatttttatggtcttgccattggctatccgtttgaagcatcgaccgttcttccttgcctttgtttacacagcaattgtcgcaatgctgaaatcttatccctcggctggagattcagctctatatctaggacttttaggcctattcgccaatgaattagcggagatgcaattcaccttcttcttgttttttggatatattggagtctctctccttagccctgtcatgcataacctatggatctggaggggtactgggaacgcaaatttttacttcgcgactggtttagcttatacctgccttcagaccgtgttggttgtagagactgtaagttcaatgataaagcatgacaggaaactaaggctacttacaaaagcctaacatcattcctcagaaggtcagcacgtcagattcttttcttgctggttccctatgatgcgaacttgcgaccagtttgccgttctgggattctgggtagatgtagtggatgatgtttcatgtcatgttgtattgtacctcccacatttgtacaatatggaccagattgcttagccaggattagagaaagaatataggtttctccctcgaagctaactatagtcggcactgaatttctccatggatcctttgattactgccttgcctgatcttggtgaaatttatccctggtagcctgtgcaatcagcttgtcaggtagcctttggatgcctctgctttcgttgtcaagtccattttctttcatcttggtaaagccgaggtcattgtcagtcacacgttgcagtattatcccctatgtactgcaaatcaagctcgccgagcaggctgagcgttacgaggaaatggttgagttcatggagaaggtcgcanagaccgctgatgttggtgagctcactgttgaagagcgcaacctgctctctgtggcttacaagaatgtgattggtgcccggagggcttcctggaggatcatctcctccattgagcanaaggaggagagccgtgggaacgaggcctatgttgcttcaatcaaggagta

SEQ ID NO: 18669 - DNA, 150 bp, Triticum aestivum
  Clone ID: PAT_TA_18669
acgggaaacacaatcatttctgaatttccttccatgttagccagggtaaatgtattaagtatgcagtcttttctcttggatggcttggataatggttatggtgaaataactcatttgtaaccatgtctcatgttcttctgaattccatgg

SEQ ID NO: 18670 - DNA, 583 bp, Triticum aestivum
  Clone ID: PAT_TA_18670
cccacgcgtccgcccccttctcccccccctcctcttgtcacaatcaatcaagaacgtactggaaggaagaaagaggaggaagaaccgagcaagaaccgtctctcctctccccggcgctcttaacgagaacgcagagtctcttttgaacccttgttagcagcggacaggccttcctccgtcatgtgctccggcccgcgcaagccgtcgaccccgccgccggcggcggcggcgcccaaggatccggcggccgtggcctcgctgctcctggagctggcggcggcggacgacgtggttgagttcaggcgggtcgtggaggaggagaaggcgtgccttgatgccgcgggatcgtggtatgggccctcggctgtcggccagggacggctggccgcggagagccggacgccggccatggtcgccgcgctctacgggagcacggccgtgctggcgcacgcgctgtccgtcgcgccgggcgaggcctgccgcgcgtccggcacggacggcgccaccgcgctgcatatggctggcgccggtggcgcggccaacgccgtcggggccacgcaccctgttgctcgccgcgggggcc

SEQ ID NO: 18671 - DNA, 605 bp, Triticum aestivum
  unsure (1)..(605): unsure at all n locations
  Clone ID: PAT_TA_18671
ccacgcgtccgcccgcgactcggagcccccctcgcttctttcccctcctcttgtccccatcaatcaagaacgtactggaagaagaagaaccaagaaagaatcgtctctccccggccctcttaacgagaacgcagagtctcttttgaatctttgttagcagcggacaggccttcttccgtcatgtgctccggcccgcgcaagccgtcgaccccgccgccggtggcggcggcgcccaaggatccggcggccgtggcctcgctcctcctggagctggcggcggcggacgacgtggtggagttcaggcgggtcgtggaggaggagaaggcgtgccttgatgccgcgggatcgtggtatgggccgtcggctgtcggccttggccggctggccgcggagagccggacgccggccatggtcgctgcgctctacggcagcacggccgtgctggcgcacgcgctgtccgtcgcgccgggcgaggcctgccgcgcgtccggcacggacggcgccaccgcgctgcatatggctgcgcccggcggcgcggccaacgccgtcgcggctcgcgcctgccgctcgcccctccagcctccagctctgcgtgtnnnnnctcc

SEQ ID NO: 18672 - DNA, 1333 bp, Triticum aestivum
  Clone ID: PAT_TA_18672
cgtccgcacgccgtcgtgtaccgcgcgctcttcctccccaggaaccagaccgttgccgtcaagtgcctggatctcgaccagctcaacaacaacatcgatgaagtacaaagggaggctcaaataatgagcttgatcgatcaccctaatgtcatcagggcttactgctcatttgttgtggagcacagtctttgggtcataatgccattcatgacggagggttcatgtttacacttgatgaagattgcgtatcctgaaagtttcgaggaacctgtcattgcatcaattttaaaagaaacactcaaggctctggagtatcttcataggcaaggacaaatccatcgtgatatcaaggctggtaacatccttattgatagtgctggtgtagtgaagcttggggactttggcgtttctgcttgtatgtttgatagaggtgataggcaaagatctaggaacacatttgttggaactccatgctggatggctccagaaagtgctccagcctggcactggatataacttcaaagccgatatatggtcgtttggaattactgcacttgaactagcgcatggacatgctccattttcgaagtacccccctatgaaggttcttctcatgactctccagaatgcgccacctggtcttgactatgaccgagacagaagattttcgaaggcatttaaagagatggttgcgatgtgcttggtgaaagatcaaacaaagaggccgacggctgagaagttgctcaaacattcatttttcaaaactgcaaaacctccagaatcgacaatgaagggtatgttaactgatctacctcctctatgggagcgtgtaaaggcactccagcttaaagacgcagcacaattggctttgaagaaaatgccttcttctgagcaggaggcactttccctgagtgaataccagcgaggtgttagtgcgtggcactttgatattgaagacctcaaggctcaagcatcactaatttatgaggatgaaccatctgaaacaaaagaagacgatgtcgctgcaagaatcattgaatctgaaaagagtttatattcgaggaccccttcaggacagtcgtcatctgcaaatgaaaatacctgcagtgaagaaacctctacgacaaatcctgattgtagaaggatgcccaatggacatgaaaattctagatcagagaatgattcattgccctctacatcaaaggaaccagagtcgaaatattggagaactaatgttggacagaaaaacagacactgggggtccagtgaaagtggtgttaatagctcaacaactgaaaggagccataattttgaaagggatgcaactgctgac

SEQ ID NO: 18673 - DNA, 1148 bp, Triticum aestivum
  unsure (1)..(1148): unsure at all n locations
  Clone ID: PAT_TA_18673
ctcgagtttttttttgtttgttttacagctcggaggagatcgcgctctggtagcattagaggttagagatagatatagataggcccgattagcgcctctctcgtccgcttgcgagacgaaagtcgatcggtatcgtgatattatttttaattttagagtaacgcaggcgaagacgggaagagagtcaggggttgaggagattgggattgagattgcgatggcgagcgggcggttcatggaggagatgatgagggagcacgagcagagcctgctggaggcgacgtgcggcggcctgttcgaccacatcgaggacctgctcgacttccccaaggaggactcggcggaggacgtgctgctcctcgacgcgccggtgcctgacagccccctcgccgcgcgcgtcctcgccggcggcgcgcccccgccggcgccggcctcgctggagcagcagcagcagcaggcgtcgctcatggtgcccccgccgccgttgcccgccggggaccactccgcggccttcctcggcgccctcggagacacccacattggcacgtgcgacgagcttgacatggacatggcgcagctcgaatggctgtcagggctgttcgacgacacctccatcccgcacgagccggccttcgcctgcgccgcgcccatcatcagggcctccgcgctctcggccaacgccggcgtcgtgctgcccgacaagatggaggacgcgctcttccgcagctccagccccacctccgtcctcgaggacggcggcgccaacaatgccaacatgaacatgaacaacaacagcgggggctcctcggcgtcgtcgacgtcctcatcggcgtcctcctcctcggagtccttctccgggagcggtcgcccgtggtccgtgccgctgtcgccgcgcccggagccgccggtgctcgtcatcccggcgcgcgcgcgcagcaagcggtcccgcgcctccgcgttccccgctgccatccgcgccgccgtgcccgcgcccgaggccaccatcctggtgccgacgcccatgttctcctccacctcctcctactcggaggagcccgagtgcattgccgagtccaactcgcagcccaagaagannnnnaaggccaagaggccgacccctgcggtcaccnnggacgccgagggcgaca

SEQ ID NO: 18674 - DNA, 1098 bp, Triticum aestivum
  unsure (1)..(1098): unsure at all n locations
  Clone ID: PAT_TA_18674
attcggcacgaggcaacatcttgaggagcgagnagggatccaatcggcgggtgcgcttctgatggcgggcaaggaggaggtggaggcggcgaggaggtggatgatgagcccgtgcaccgccgccaagtctacggacggcgcggccgccggcgacgatggtccggtgatgcggttcccctccaagaggaaggcggcttccggttccatctacaaggtgggtgagccgctgccggccaatgggtggatccatcctgcgggagaaggggatctttccgcgttacataggagggaggcagcgatcgacaagatgctgcaggagtccaagctgccagccacagtcaagcagggcaccgatgccaacgccgccgtcaagcagagcgccgatacctccgccgtagtcaagcagggtgtgtattcctcggcggcagcggcatgtggaagcaaagggaagaagtatcggctgaagaaaagcgagctgaggaccataattgccctcaggccggagccttaccccccggcagacgactatctcgagctggccccgttcttcccgccagggtggctcgagcagaagaagcgggaggaggaggaggatgcggtccaatttgccaggatggaggcggagtttgaggccttccggcagcaggtgattgagggggtcaagaagaacggctacttcgaggtcgacgaggacccctcggatggcagggaaagggaggaggctaatgaatacgctaggcaagaaatggcagagattgacttcagtgaactccgtctccttgatgctagaccaaatctgccacaggcgaaattttttccttacgttcctaacgaggacgacgctcttctagatgacattcccagcgatgatgatgattttgaagaggaggatgctctgcccatccaaggagaggacttcgaaggggaagccgccgccgccgctcacaagcttgttcctcctattcagtccagctgagaagatgattcagttggtctacctctatctattctatccaattatgtttagcagatgtctctgtcgtggatccgtacatgtgggttggtcgggtctatctatctgtattaatttctcctgtt

SEQ ID NO: 18675 - DNA, 1998 bp, Triticum aestivum
  unsure (1)..(1998): unsure at all n locations
  Clone ID: PAT_TA_18675
gcccactctccgctagtagtattaacccctaatccgctagtaataatccctggcgccctccctcacgccgcgcagcccgtaccagaagaaggagaacctggggaacgtgcggcgcgggatggggtacagcgcgccgccgcgccgcaacgtgctctcggccatcaacaacggcggcggcgccaacgccgagccggcgccctccgaggccggctccgaggcgcccgccttcgagttcagcgggagggaggatgtggaccgcctgctcaacgagaagatgaaggtcaaatccaagaacgactacaaggggaggacggagcagatgggcgagtacatcaagaggctcagggcctgcatccggtggctggtggagctggaagacggatacttggccgagcaggagaagctccgggggcagatagattcagacaatgctcgtcacgcagagtttgaggctcagctcagtggtgcgctggaagagttgaaagcggcaaacttggaaatgactacacggtgtgactcactggaggagagcttgaacaaggagaaggccgccaggctgcttgctgtggagtcctatgagaaggaaagagaagaaagggaatcagccgaggcttcacgggatgtactgacggtcgatcttgaaagggtcactcatgaggctaaacggtttagtgagcagctaaaaatggtccaagacaccaacaaaagacttcaggaatacaactccagcttgcagcaatacaacagtaatcttcaagctgatacatcaaagaatggagaaatcatctcgaagctgcaaagggagaagagtgcaatgatggaagccatgactaatctgaaagatcttaacaactcaatgaagaaccagttggattcttccatgtcctcccagaaagaagcaattagagtgaaagaagaacttagaaaagaagtagagtgcctcagagctgatttacagcaagttagagaagaccgtgatcagtctgttgctcaactgaataccttgaccgctgaactggccacttacagcgaacaggctagaaagtcttcgaaagactctgaacttttgagaataaaggcggcagcctttgaggaaacgtgcaagttcacagcaagagcaaattgaaacattgcagaagcagctttgcagttgcaactgagaagctgaagcatgctgatgtgactgcaattgagggcgatgacaggatatgaatcacagaaagagacaatcaaagatctggaagagcgtttggcatatgcagagtttcaaatcattgaagctgataagctacgaaagaagctgcataacaccatcttggaactaaaaggcaatatcagagtattttgtagggttcggccctttctgtcggactctgattctaatggtcaggaagaagccattatttcttatccatcatccgtggaaaatgctgggcgtggtattgatttgttgaatcaaggtcagaaatgttctttttcatatgacaaggttttcgatcacagcgcttcgcaagatgacgtgtttgtggaaatgtcacagctagtccaaagtgcgcttgacggatacaaggtatgcatatttgcatatggtcaaacagggtcaggtaaaacttatacaatgatgggtaagccaggccgtgatcagaaaggtatcatacctcgatctttggagcaaattttcaagaccagtcagtctctagaatctcaaggatggaagtattgtatgcaggcatcaatgctggaaatatacaatgagacaattcgtgacttgttagcaccaggccgctccagtagtgatatgcctggcggtaaacaatacacaataaagcatgattcccagggaaacacaacagtctccgatcttacaactactaatgtgttcagcactgctggatgtgacgtctcttcctagagaaacatccatacaagtctgtaggtaagacccaaatgaatgagcatcttccaagancattttgcctccacactaannaattgggt

SEQ ID NO: 18676 - DNA, 520 bp, Triticum aestivum
  Clone ID: PAT_TA_18676
cgtctgccagccgccgccgcgcccacatccggggtctgtcacgcgcgacggcgtccgcggacgcgtgggtcgatttcgcaggcgggtggtgggattatgcgccacctgctcctgccccgccgccttctcgccatggctcccctctccgcttccgccgcgaccaaagctctcctgctaaacccagcccgaggccgcctcccctcctcgctcgcgtgcctctccgcccatggcgcccgctcgttccgcgccgcctcgctccgctgctatgccgccgccgcggtggccgagcagcaccgaatcaaggtcaacaaccccatcgtcgagatggacggtgacgagatgacgcgggtaatgtggaagatgataaaggataagcttatcttcccgtacctggacctggatgttaagtacttcgaccttggggtgctcaaccgggatgccaccgatgataagtcactgtcgagagtgccgaggtacttgaagtataatgttctgttaagtgtgctacaattactctgat

SEQ ID NO: 18677 - DNA, 1618 bp, Triticum aestivum
  Clone ID: PAT_TA_18677
cgtccggttctctcaagcaagactctagcagatgtcgttgaagcacttattggggtctattatgtagcgggagggaaaattgctgcaaaccacttgatgaagtggattgggattcatgccgagttggatcctcaagagatccctcccccgaagccatataatatacctgagagcatattgaaaggcatcgagtttgagacattggaaagcatcttgggtatgaaattccagaataaaggttttcttattgaggctataacgcatgcatccaggccatcttctggtgtttcctgttaccagcggttggaatttgttggtgatgctgtgttggatcatctcatcacaaagcatctattttttacatatactgatctacctcctggtcgcttgactgacctgagagctgcagctgttaataatgaaaactttgcaagggttgcagttagacgtaagctgcacggacatcttcgccatggatcatctgcactggagaaacagattcgggagttcgtgaaggatgtccgagaagagatttcaaaatcaggtttcaattcttttggactaggggactgcaaggctcctaaagttcttggagacattattgagtctattgctggggcagtattcctggatagtgggtatgacacctcggcagtctggaaggtgttccaaccgctccttgaacctctggtaacgccagagacccttccgatgcatccaattagggagctccaagaacggtgccagcaacaagcagaaggcttagaatacaaagcatcccgggcaggcaatgtagctactgttgaagtctttgttgatggtgttcagattggtgtagctcagaatccccagaagaaaatggcacagaagttggcggcgaggaacgcacttgtggtcctgaaggagaaggaaaccgcagcaaagaaagagaccgaaaaggacggtgataagaacaatgccgggttcaccaggcagaccctgaacgacacttgcttgagaaggcagtggccgatgccacagtacaggtgcataaacgagggcggccctgctcatgctaaaagatttgtctacgcggtcagggtcaatacatccgatcgcggatggaccgacgagtgcgtcgggagagccgatgccgagcgtgaagaaggccaaggactctgccgcgatgcttctcctcgagcttctgaaccgaagtttccctgaaaagcctgacggtaagaagtgataggtattagtgttgttggtgatcgttgtggtggtgttgagacattcggcatttttacacagcatagattcattacccattcagtgctcttcagctctggcaaataagaagatagatagacaggcagaggtgacgagtgagagcagaggatacttttaccaacctagttgaggccgctggatgtcattagagatttatttactggtgaggcgggataaataggagtctgcaacagcagaaagggtagtctgatataggatagacaagtggaggcctcttattctattgtactgtataatgtaacttgcaaacatgcaattagatgattgatccaatagtagaattctgaatttacccttacccaaaatattcgctcgccattccccggctttc

SEQ ID NO: 18678 - DNA, 1106 bp, Triticum aestivum
  Clone ID: PAT_TA_18678
gggcagcagtttgatattcgtggaacagttgatgagttcaggcatgagatcaacatgtatatgttctggaaacctgggatggagttggctgtttctcatgttcggaggaaagagattccagcttatgtgtttccagaaggatacaagagacctcgtccccaaaggcatgtgaaccatcaacaccagtctgataaaaataacactgcaaatggcacattgactggatctccagacagccagctgaagagaaagcatgatactactgggattgatgataccgaaccttgccgatctgttaagagggcttcaatcagcccagttcacccaaaaactttatcacctcggtcgggcaacattagtgatgagcccagaagtgacagccaacagaaagttacttctaatgcaagcggtgggagtcaggattcacctggcagtggcaatcgagataaaacaaagtgttcaagttcatcacatgcatctgagaaaagcttggattcagtcgcatcaggctccaagtgtgtgaaaatggaagcggtttgttctgatgacgtaactagcaagcatgtcgattgtatttcacctgtcaaggacagcactgctccaaccgtagcagtgagtacaactttaaagcgtgttgccgagaaggtcgttttggagcttgttggaagtgaaagcattggcggcaataatgcagagttactgcagattgcagaaaaggacatgggaaatgtccttgttgaaaatctacactttggtgggaatggagttcctcagagcggcctccctgaagaattagaggtgtgaagtcagatggatcccagaagtcgtcattgagatctgcaaacactggggacttggaaggaagatggtggtaaaatcatgtctggcaatggcatggcaaaaacaacaaacaagtgaagtttctttcatggaaggtcgcaagatctttgccaactctagtctagatctgtggcaagttcgtttatggaaccagctcgctccgcagcttaatttgtcgattctgtctggagttgcggtgtagcttgccctatgtatggatcgagctccagcagtctccttgggtggacttgtttacgtcccaggga

SEQ ID NO: 18679 - DNA, 2981 bp, Triticum aestivum
  Clone ID: PAT_TA_18679
tcgaccccgcgtccgatgcctcctgtctgcgacatctgtgctcctacaatacccctgtcgcccgtctccctgcgtcgtgtcggaatggttccccggccgccggtgtggaccaatttagtggcggcgctcgtcggctctgggttcgtcagttacagggcgtgccctgtccaggtgcgtgcgaaaagcgtcgatttcggggcggttcggttcgaattttgccgagcctttttcgtgctctgaggcgccgatctgtgcggtttaacgttcttgagattttcgttctgaaggcgggcttgtcgctggagggaggattacttggttgctttatcgtagattagaggcgccacccttcttatgtgagaagtggcgatctctaacaagccaatatcgctggccgggccgttagacgctgtcgtccagaggatggtggaattgaacaagttcctgcttgaggtcgtcctttatgtaagtgtcgaggtgtcggttaggcgagaggaggtgttgggatcgatcgacatcattgtcctagcttgggtgtttcagttaactagccagagaggatttactgatcaaatggttgaagaggcaaatcgccgtgcttttcacctttgggtcataccgtctaggggtccatggacctggggctgacatcgatactctatgtgttggaccttcatatgtgaatcgcgaggaggacttcttcattgtactgcatgacatattagcacaaaatgaggaagtgtctcaattgcaacctgtacctgatgcacatgtacctgtgatgaaatttaagttccatgggatatccatcgatcttctttatgccagcgtttctctcttagtagtaccatctgatttggatatctctcaggaagcagtgctttatgacattgatgaggcaactgttcgtagtcttactggctgcagagtggctgaccaaattcttaggcttgttccgaatattgagagctttcgaacaacactaaggtgtttaaagcactgggcaagaagaagaggtgtttactctaatgtcactggttttcttggaggtgtgaattgggctttactggttgcacgagtctgccagctctatcctaatgctgtgccaagtatgctggtctcgagattcttcagggtttttacccagtggcgctggccaactccagtgatgctttgtgccattgaggaggaggaacttggctttcctgtgtgggatccacgcaaaaatcctcgtgacagaactcatcatatgccaattatcactccagcatatccatgcatgaactccagctataatgtttcgacgagcacgctgagggttatgatagaacaattccagtttggcaataaaatatgccaggaaattgagatgaataaggctagttggtctgccctttttgagcctttcaatttttttgaggcgtataaaaattatctgcaagttgacatcatcgctgaggatgatgaagatctcagactttggaagggatgggtggagtctcgattgaggcaactgactttaaagattgaacgggacacttatgggaaattgcaatgccatccatacccatatgagtatgcagatccttctagacagtgtgctcattgtgctttcttcatgggcttatcaaggaaagaaggtgtgaaaatacaagaaggtcagcagtttgatattcgtggaacagttgatgagttcaggcatgagatcaacatgtatatgttctggaagcctgggaatggagttggcggtttcgcatgtccggaggaaagagattccagcttatgtgtttccagaaggatacaagagacctcgtcctcaaaggcatttgaaccatcagcaccactctgataagaatgaccctggaaatggatctccagacagccagctgaagagaaagcatgattctactgggattgatgatactgaaccttgccggtctgttaagagggcttcaatcagtccagttcacccaaaaacttcatcacctcggtcaggcaatgttagtgatgagcccataagcaataatcaacaaaaggtcacttctaatgcaagtggtgggagtcaggattcacctggcagtggcaatcaagatcaaacaaagtgctcaagttcatcacatgcatctgagaaaagcttggattcagtcgcatcaggctccaagtgtgtgaaaattgaagcggtttgttctggtgacgtgactagcaagcatgttgattgtatttcacctgtcaaggacagcactgctccaaccgtagcagtgagtacaactttaaagcgtgttgcccgagaaggttgttttggagcttgttggaagtgaaagcatcggcggcaataatgcagagttactgcagattgcagaaacagacatgggaaatgtccttgttgaaaatctgcacttcggtgggaatggagttcctcagagcggcctccctgaagagttagaggtttgaagtcggatggatcccagaagtcatcattgagagttagtttgacatcaacagcatgaggttccagagccgggtggaatggagggtctggtgtccctttggtaagttgttcaactcacaaactttccttttcgacacagatctgcaaacactggggacttgaaggaagatggtggtaaaatcatgtctggcaatggcatggcaaaaacaacaaacaagcgaagtttctttcatggaaggtcataagatctttgccaactctagtctagatctgtggcaagttcatttatggaactagctcgctccgcggcttaatttgtcgattctgtctggagttgcggtgtagctcaccctaatgtatggattgaactccagcaggctccttgggttgacttgtttacttcccagggattccgctgtaggtctagattagagagatgtgctactatccttctgtgtttctcaagacccctttgtaccctcccaacctttgtaatataagatctgcaagacggttccttgtactttagcaa

SEQ ID NO: 18680 - DNA, 785 bp, Triticum aestivum
  unsure (1)..(785): unsure at all n locations
  Clone ID: PAT_TA_18680
cggcgactgaattttacatctcaggaggttggtaccgtgctagctatctcaggttttggtgttttggtatatcaacttctgatctacccgttccttgccaagtatgctgggctagtcaagccattccgttctgcagcggtattatctatacttctccttgcaacatatccattcatggctaacctatatggtgtggagctcaaagtactcatcaacatagcctcgcttcttaagaatatgtttgcggctacgattactattgcctgcaacattctgcagaacacagcggtggcacaagaacaaaggggtgtcgcaaatggtatatctgtgactctgatgtcaatcttcaaagcagtagccccagcagcagcaggaattatgttttcatgggctcagaaaaacataactggattgttcataccaggtgatcagatcctgttctggatgctgaacatggtgtcagtaatcgggctctcattgacgttcaagccatttttctctatgccgagtgcgctgaaatgatgagcacacaattatgttcatctagctagttaagtaaagttagggacacaccacagtttgcagccctggataaaaaaaactggtcgtgtattgtgtcacatatatttttcatattttttttgttgtgtgatcagatgtggcaagtatcttcttttttttgtcaaaactcctacgcacaaggtgctttggtttatgactcgttcctggtaagaggaccggtggattgttaatataagacgtaattgttcgaggggnctcgcacg

SEQ ID NO: 18681 - DNA, 1207 bp, Triticum aestivum
  Clone ID: PAT_TA_18681
gctcgggggaaagaaggatcactttagaagagagagagagagggagggggggagaaccgaagcagagtgcagcccaaccacatcttccgtactacacacgctcgtggtaactggtagtagtaacttcctcgcccatggcgatctccggcgacgacaggtacgcccccgccgccgactccggcggcgggaagctctggaacctctgccgcatgcccttcaggcaggccagcggcgcgccggcgccagcgtcgtcctcctcctcgtccgggatccaccactcggccggccgctacggtcatgaggcgcccgtcgccggagacggcggcgcccctgtcgcgccggccgggatctcgacggtcgccaaatccctgctgccggcgcggcgccgcctccggctcgatccgtccaacaagctctacttcccatatgaaccaggcaagcaggtcaagagtgcaattaggataaagaatacaagcaagtcacatgtagcattcaagtttcaaacaactgcacccaagagttgctttatgcgtcctcctggagccatacttgcccctggcgagactatcatagcgactgttttcaagtttgtcgagcacccagagaataatgagaatattctgcagaagtgcaaggtcaagttcaagattttgagcttgaaggtcaaaggacccatggaatatgcaccaagaattgttcgacgagcagaaagatcaggcagtggttgagaaagatactgagggttgttttctttggatgttcaaaacccaggccctcaactggaaaagctgaacactcagttagccgaggcagaggctgcacttgaggcgcggaagaaacctccagaagagaatggtcctaaaattgttggtgaagggcttgtcattgatgaatggaaagagaggagggaaagatacctggcacaacaacaggttgaagcggtcgactcggtgtaaattgtaccttcttgtgctagagcagcatatggcttgagcaatgtgttgtgataattcttataaactgctaggttctgctagtttagtgtgcggtagtttagagttgtgcttgaaggatcggtctccagtgaacaagctaaccttttggttgtttcagtactcgctgtgtaacagataaattaattggcttgtcagaacaataaagtgcatatgcgtagcttgcgtttaaaacttgcgagagctgaccttgc

SEQ ID NO: 18682 - DNA, 766 bp, Triticum aestivum
  Clone ID: PAT_TA_18682
cgtccgcccacgcgtccgcagacacttcgttctgtgttgggacgcctggagcaggcctactgtggcacgagtggttacgagtacatgcacatacctgaccgcgaaaagtgcaactggctgagggagaggatcgagacagttaacccaagggagtacacctatgatcgtcgccaggtcatgctcgacaggctcatctggagtacgcagtttgagaatttcctggcacagaagtggaccactgcaaagcgtttcggcctggaaggtgcagagacactgattcctggtatgaaggagatgtttgacagggcagctgatcttggtgtagagagtattgtcattgggatgccacacagaggcaggctcaatgtcttgggaaacgtggtacgtaagcccttgcgacagatcttcagcgagtttagtggtggtaccaagcctgtcaatgagggggagggtttgtatacagggacaggcgatgtcaagtaccatctaggaacttcatatgataggcctaccagaggtgggaaacatatccatctatcgttggttgcaaatccaagtcacttggaagcagtcgatcctgttgttgctgggaagaccagagcaaagcagtactattcttatgatcttgacaggaccaagaatctaggggtgctattgcatggtgatggaagcttctcagggcaaggtgttgtgtatgagaccctgcatctgagtgcacttccaaactacaccaccggtggaacaattcatcttgtggtcaataatc

SEQ ID NO: 18683 - DNA, 495 bp, Triticum aestivum
  Clone ID: PAT_TA_18683
ttttggtaaaaacttaaacttacgctatagctttgctgcttctgtataacaatcccggcctacaatatttcatgtgagtttgtaccaagggttttgagattattacaacatacccattcctgtgctgactatcggatgtaattctacaaatattgcctattagtgatgtcctagctcaccatttgaggggcagtggaaacaaagttaacgaatataatggaaacaaaatttgttttctctgtgctccagaagaataagtctgcgctcttagtggccttatgtgcattcacaagctgcatctgtacatcctgcgagacagtattatgctccatatactccaactccaactcgccttttccctgtgtcattgagcgaagcgctgtcgaatttccaaacatattgtttagtggaacatggggtactacaactgtgtcatcgcctttctggtcatttgcaacagtagtaccttttctctttgttatgggacccagttct

SEQ ID NO: 18684 - DNA, 801 bp, Triticum aestivum
  Clone ID: PAT_TA_18684
cgtccggtcacgcacgctccccattccccctcacaaaccctagcgccggagagcagcagcacccggcgccgccagccggggaggagccgatgccgccaggaggaggaggaggtggaggcgagcatggctctaccgtccgccgcgacgacgacgctccgtctgattctacgccgccgctccccgccattgtcccggtggcttccgaggatgcgaagaagaagcagcgggtggaggagcagcagaccgcgccgagcctccccgagggcgccatcgttgagatcctttcacgagtgccctacaggtccctctgccgcttcaagtgcgtgtccaagccctggctcgctctctgctcagccccggacatccgcaagaggtcgccacagaccctctccggcttcttctaccatgatgaaggcgatgctctcagattctgcaacttgaatgggagaggtccgcctctggtcgacccatctctccctttcttgcgcagaacgtaccgccacatttctggccaacaggtctgcgccggccttctcctctgcagctggtccaattcttcgggagaccaaagctttttggaactggaattcttcgctagaagaaaagctggtatgttgtctgcaatcctggcacaaaagaggggactgggcttgcttccgtgggaattccaaaagggcgaccaaaccccttttctaaggtttgagggctggtgggcccttccccctttgggggggttgggcccccggcccaatacgtttaagtgggcaccgtttcttccccaaggggaaatctaattcgtca

SEQ ID NO: 18685 - DNA, 339 bp, Triticum aestivum
  Clone ID: PAT_TA_18685
attcccgggcggacgggtatggctgctaaattagcatcagagctcatgccctctgatgttgcaaaggcgttatggggcaccaccaagagttcctccaagataaataaagaagtccaggagcttttaaagcttacactgagcaaggcccgagtcaagctgactgagaataccattttcaatcggatcgttacggactctaatggctcagatccattcaatggtctctatgtaggagcgtttagtccatatggccccgaagttgtacagctccgtcgaaagtttggccattggaatagtactgatgacgtggagtttttcgagtatgtcgaagcggttaag

SEQ ID NO: 18686 - DNA, 1287 bp, Triticum aestivum
  Clone ID: PAT_TA_18686
ggaaaatccccaacccagaccgccgcgtcagtgctccgatcctctccatctttcttcccgtcgccggaggccagaagcaccgggcaccgtctcccgtcggccgaggccagaagcgccgggcaccctctcccgtcggccgtcgcgatctctacacccgccgctgctggccgatcagagcgagacccctcgatccgttccccaccgtttctccctaggagggttcagttgaaggtttgtggaagatgggctggggggatatcccggctgattggaactgaaggcggctgtcttgctcaccgcagcgtatttcgttcatggactgggcatgaaactgctctcattgcccctcatatacacctgcctgattgccgtgcttatctccattgcttcccatccgtcggtcgacctcccgttgcttctcggcaaggcatccaatggaagctttcccctatggtcatgggtcatgttctcgccctttctctttttcatccatctgtttgtgctgttgcggagatttgtgaaaaatgagcccttgtacaccgagatagcagacggagtgtatgttggaggctggccttcttcagttgaacgcctgccacctggtgaacccgcagtcatcgattgcacgtgcgagctgccaagaagctcaactatatccgagaattcatatttgtgtgtcgctacatgggatacaagggcgcctcagccaccacagattgagtcagcggtgcggtgggccgtgagaaagcggtcacagaacaaacctgtgtatgtccactgtgcctatggccatggcagaagtgtctgcgtgatgtgtgcacttctagtcgcactgggattagctgacgattggaaagctgctgagcaaatgatccgcgagaagcgaccttctatcagcatgaacactcttcatcgcaaaagcttagaggaatggtcaaaacacttgctttctccctcaaaaggaagtggggaatccgatgtgagttctgtgattctttcggactacacccggaaaaagcattgaactcgcaagacacggacttgttcagtaactgtgataattgagaagacttcatgctttggtgttatctactgttgtcctagtaaatgtccaaggcatttcgttgtctaagttactgtcctcgattatgttgtatggatacgtggatattctattactgtggcttacaatgttgctctttttatgcatactgtgcagtgatccttggggtcattgaatgctttcaagacaaatcgttttgtgggattttctttcttaaaaaaaac

SEQ ID NO: 18687 - DNA, 1111 bp, Triticum aestivum
  Clone ID: PAT_TA_18687
gaaccccaagggtgaagtggccatcaatagttcagttgatgtgaagtcctatacctccttgcatacccttgtcaatgacatgttccctccaacaactttggttgagcaggaagactacaactcctggaattattggaaggtgccgctgccagacattgatttgtagagtagtcttgacaagtacagcagttagacgcaagtagagtctgcgggcagcatgataggcaagtttgtgcacgctagttctcaatcgccacagcagaattctgtccaacctgtaaagcatctggtgagttttccagatggactgttttgatcgccgttgttgcagaagctcgattttccttgccccgacgcagctctatcacgatcattcatcttttaggtagtgatctgatcgtcatagccgtcgttgaaacttaacgctgctgtgccggcatctcaattcgcaacgaggtagcccgccgagcctgttagtaatctgttgtcagcagctgctagcctgcgttgctttccttgttcccgtagctgtaggctgtagcttatctgtgagttagattacttgtggtacactggaaagcaaccgggaacagaaaactgtcaatcacgctgtatgttgttgtatatgggatataaatacgactgcatttttgtgggctccagtgatgttaatgatctgaaggtgagcgggactcctaggaaacggagcttggatggtggatttgacacagaagcaatcgtggcagcaaggaataaagatgttgtagcttctagtccgataattcgaaatggcgcaattttgtcaaatcaatgctttccagctccagtcattaaacccagtgttaccaatgttgctaattcaagggcaataggcacaccagcgtctccattgccaggttttacggctccaattcataccggaatatcaactgaattatcatctaaggatgagagggaagtgaagcgtgaaaagagaaagcaatcaaatagggaatctgctagacggtcgaggctgagaaagcaggctgagacagacgagttggccacacacgtgagatcgcttacagctgagaacacgtgtgtaatatgtgaaatcggcaagctaacgaaa

SEQ ID NO: 18688 - DNA, 1917 bp, Triticum aestivum
  unsure (1)..(1917): unsure at all n locations
  Clone ID: PAT_TA_18688
gggttctgatgacaggagcaaagataccaccccttctaatattgctgctagtaaatctgatcgcttgcgaatgtccccaagcagtgacagagacaaattaggaagcattccggagaacccaactgctgaagaggaaataaataaagaagagcacccccatttacagaagggtttgggctttgagatttctctgagtgggcacttgctacggccaggaatgggccaaacatctgctgatgaggtgttccacaaaatcttgtccctgaggaggatttcaaattgtctggaccatcaataataaaaaatgcaaaccttattgtcagaattggctgtaactatttcacatggagtaaagtttctcatgttgttcttgggaaggctgtatttggtccagacttctgtgtagaacctatcgatgctattccagttgaacgccaagaaacacccaattcgagagatgattctcttgggttgtccccaagccggagatggaggctgtggcctattccatttaggatatcaagatctcttcaacgcagtaatagtgattcttctgaggatatttttcttgacacagagacagtcttaagtcctatggatgagcaagccccagccaacaataaagaccagtcaccaagaaagcaatttgtgcggactttaattcccactagcgaacaggtggcatctctaaatcttaaggagggacaaaacattgtcacctttagcttctgcaccagagtttttgggaagcagcaggttgatgcacatatctacgtgtggaaatggaatgcaaaaattgttatatccgacgtggatggaaccatcacaaggtctgagcgttcgggccccaaccaggtctgatgtcttgggccaggtcatgcctttagtcggacgagattggagtcagtctggtgttgctcgactcttttctgcaataaaggaaaatggttatcaactgatattccttagcgctagagccattgtgcatgcatatctgacaaaaaccatcctcttcactctaaaacaggatgggaaagtaatgcctaatggacctgttgtaatgccacccaagggagaatccctttcagcttacagcgcggttatacgaactgaaaccggcaagctaacgaaaagctccgaggagctcattatagcactttctccttccgtctacaatccattttatgctggatttggcaacagagacactgacgagcttacatacaaaaagatgggaatttcgaaaggcaagatttttatcatcaaccccaagggtgaagtggccatcaatagttcagtcgaggtgaggtcctatacccccttgcagccccgcgtccccgacctgcgcccgccccccgcctccggcgcgccggcggatgtcgtcgccgcgaactgttggatggtgccgccgcccgccggcgctgtctagtgcagcttgcacgaggcctggggtttcagccagctcatgctgctcacataacagatcggcgtgacagtgtaggtatttttatttggtgagtatattcaggaactccggcggtcatatctactggtgattttggttcctgacctgttttgtacgccgttgttgcatgctctcgattttccttgccccgacgcagctctgtaacgttaattagccttttaggtagtgatctgatcgtcatagccgtcgttgaaacttatcgctgctgtgccggcatctcaattcgcaacgaggtagcccgccgagcctgttagtaatctgttatcagcagctgctagcctgtgttgctttccgtgttctcgtagctctaggctgtgatgtagctcatctgtcagttagattactcgtggtacattactggaaagcaacagggaacagaaaactgtctatcacgctgtatgttgntgtatatgggatataaatacgactgc

SEQ ID NO: 18689 - DNA, 786 bp, Triticum aestivum
  unsure (1)..(786): unsure at all n locations
  Clone ID: PAT_TA_18689
cgtgcgcccacgcgtccgcccacgcgtccgcccacgcgtccgaagcaaacaaatattgatatacttgtcttgagccgtggagcgtgagggtccgtcatctcgctatgtccatactcgatatcctgtgtgctacttgcgtgtgggctgttggagtgttggtgctgttcggcagagaataagatattgggttgctgagctgcggtcacntccatcgatgctctctccgccgcttccacaagccgtcagactgtacagttctgcaaggaaaaagaatggaaaaggaatagaagaagacaatgctgaagcacaagcgcgtgagaggcgagctttacttaaagcaaggaatagtgatgattttgaacgatttgggtccttcacattctcaaatctaaaagaagattttggaggacgagccagtcagcgacaaagtaaaagaaagaaggtttctcaaagattgacaagttgatggaggtttgggagatctacaggttgacgaagattatgaacgcctacaattaagtcagtgtagtgacaatggaatatgccttgtttgttgaacctggagacttgctctgctcattttggtggttgttaagtcaatgtatgctcatgttggttgtgtggtgcatcgcgaaacaaatgtgtttctccttttttggcacaacttcggcttggttgcgtggcacatctaaaaacaaatggaagcacttcttttgtggcacaacgtctttgtatatgattgctatgattattgagtgaagttcaatacttatgaaaaaaaaaaaa

SEQ ID NO: 18690 - DNA, 150 bp, Triticum aestivum
  Clone ID: PAT_TA_18690
gtcagcgtgtcggtttaatttgatgcatgtgtgcgtgcgcttgtgaggtcaactccgagtctgttccaagttgtgtttaatttttcatgtcaatttcatttgataattgtcaatgcacattttttttcagaaagaaggttgtaccctcgg

SEQ ID NO: 18691 - DNA, 965 bp, Triticum aestivum
  Clone ID: PAT_TA_18691
agcgcagtagcaagccatggccaacgcaatgttgctccccgtgctcatctccttcctcgtcttgcccttctccgccctggccctgacccaggacttctgcgtcgccgacctgtcctgcagcgacacgccggcggggtacccgtgcaaggccggcgtcggcgcgggggacttctactaccacggcctcgccgccgcgggcaacaccagcaacctcatcaaggcggccgtgaccccggccttcgtcggccagttccccggcgtcaacgggctcggcatctccgcggcgaggctcgacatcgccatgggcggcgtcgtgccgctgcacacccacccggccgcctctgagctcctcttcgtcaccgagggcaccatcctggcgggcttcatcagctcctcctccaacaccgtgtacaccaagacgctctacaagggcgacatcatggtgttcccccagggcctgctccactaccagtacaacggcggcagctccccgtccgtcgcgctggtcgcgttcagcggccccaaccccggcatgcagatcactgagtacgccctcttcgccaacaacttgccgtccgcggtcttcgagactgtcaccttccttgacgacgcgcaggtcaagaagctcaagtccgtgctcgccggcaccggctaagcattaatcaagcaagcaggtctctatgcaaggtcgtcatttatcctggtgtccccgtgtcggattacgtacctggacgataacaccgccacagaaatggtttctacctataccgtgcatgcatattatatagtagtgtgcatgcatccatcatctatatatcgccaattgggtcgtgcaatattttctagttttgtcaaaattttcttgtcctaaattgttgtatagtgtttctatgagattgttttcttccttcaaaacgtatcataatgtttcaccgtgtactcagtaagagagctttgtatccttt

SEQ ID NO: 18692 - DNA, 1918 bp, Triticum aestivum
  unsure (1)..(1918): unsure at all n locations
  Clone ID: PAT_TA_18692
aagcacggccgcagtagcaagccatggccaacgcaatgctgctccccgtgctcatctccttcctcgtcctgcccctctccgccctggccctgacccaggacttctgcgtcgccgacctgtcctgcagcgacacgccggccgggtaaccgtgcaagaccggcgtcggcgcgggggacttctactaccacggcctccgccgccgcgggtcaacaccctggaaacctcatccgggaggaccgtgtcccccgccctggtcccccaggtccccggcgtagatcgtccccgcgatctccgcggcgaaggtcgtcatcggcgtgtggcagcggcgagccgatgcagacccacccggccgcctcttaccctctcaacgtaaccgagacaaccatcctgtatatcgtaatctattcaacatctcatacaaagacttccaatacaggctcgaagggagtattattgtgtgcatgcctgcgccatctatattacgacaactggagagtccgcgccacagccgcgtagctccttgcgctcatctcctgccccaacgtactgtatagtgctcaattccctctatttcgtccttccgcgccgtccatcttcgttggtcacctcctccgccgacgtaccggtgcaggacgtgagttcgcgccagtgcgtgctaggagcatcgccttgaccactactctaacaagaagatctttatgtaagcgcgtgtctgtacgtcgttacgtgggcgtgttcgcctgcgtgaacagactcgggaccctcgcagccaggctctttttcgtcattcagcggccatgtgcttttgaataatgtcccagcctccttttttctaatcatcgtcaatgaggccaccctcctcgccagattcatgaactcctcttccaaactctgtctactccaagacgctatacaagggagacattagggtcgtcctccaggctctgcaacattacaagtagaaccacggcagaaccccggccgaagccctggtcgccttcagcggccccaaccccggcctgcagatcccagccatggccaacgcaatgctgctccccgtgctcatctccttccttatcatgcccttctccgccatggccctgacccaggacttctgcgtcgccgacctgtcctgcagcgacacaccggcggggtacccgtgcaaggccggcgtcagcgcaggggacttctactaccacggcctcgccgccgcgggcaacaccagcaacctcatcaaggcggccgtgaccccggccttcgtcgggcagttccccggcgtgaacgggctcggcatctccgcagcgaggctcgacatcgccatgggcggcgtcgtgccgctgcacacccacccggccgcctctgagctcctgtttgtcaccgagggcaccatcctggcgggcttcatcagctcctcctccaacaccgtgtacaccaagacactctacaagggcgacatcatggtgttcccccagggcctgctccactaccagtacaacggcggcagctcggcggcggtggcgctcgttgcgttcagcggccccaaccccggcctgcagatcactgactacgcgctcttcgccaacaacctgccgtccgccgtcgttgagaaggtcaccttcttggacgacgcgcaggtgaagaagctcaagtccgtgctcggcggcagcggttaattaagcagttctcagcaaagttcgtcgtggtgtcagcgtgtcggtttaatttgatgcatgtgtgcgtgcgcttgtgaggtcaactccgagtctgttccaagttgtgtttaatttttcatgtcaatctcatttgataattgtcaatggcacatttttttcaggaagaagtaattgaagttaattcacataaaaaaaaaaaaactcgagggggggcccggtacccanttcgccctntagtgggtcgt

SEQ ID NO: 18693 - DNA, 955 bp, Triticum aestivum
  unsure (1)..(955): unsure at all n locations
  Clone ID: PAT_TA_18693
ggttccctttgnncnntaccctactaaagggaacaaaagctggagctccaccgcggtggcggccgctctagaactaggcgggccccccggctccaggcatccggctcccgccctcagatctcggtccgccgccgcccccaacccaccccaccgccaccgtagacgaggtcgaggctgacccaagatcgagcccatgcctatgacgaggtcgaggacgagtgaagccccgcggagctgcccacaaactgctcctcttccccaacccccgattcctctccaatctctgccgccaccgtcgatccccacccccatcggcgacctcgtctccccgtcctccccatccccatccccgccaccgaccgacctccctcctcatctcgtccatccacccatggaaaccccctcttccacggatccacccacccacccacgcccacccatggatggatggatggatggggctcaccagttctggcgatggcggcgccggatccgcacccacctgtgcgatggaggtcggccacatcaggatccacctgcacgatggaggccggccggatcggtgtggcgcggcacaccacaccacaccggagcttgctgttgcggtggttgtcgacaacgacgcatctccggcgggacctagacgggtttcgcccgagcacaccgagcgccaggaccagccgccagaggacctttctcctcttcgtttccatcgcgagccagttctcgtaccccttctccggcagacgtcgcggtgaccctgacgacgagtgcggcgacaagtccgacccgggcgcgctggcggcggcggaggcctaggagctcgccgctcttgatggcgagggcgcgcccaacttggatggtggccgccaaggccaactactacaaaaaaagaaacatccgtgacattttgggccgaacgaaatttttttctatcatacttatnacacttcta

SEQ ID NO: 18694 - DNA, 2342 bp, Triticum aestivum
  Clone ID: PAT_TA_18694
tgtccaaaaaaaccaattcgtagacatggtgaaagttggagatccaggattcgcagagaggaggcctgttgagaaatttagagacgtgcagcagcagcagcccattgaccaagtcccgacacatgtagctcccaaatatgcggaaggtctttgctgggtcatgagatactactatcaggctgtttggccatggcagtggttctatccataccattatgcgcattttacaacagacctaaaacacttgactctgtgagaaataaacttgttcagggggcaggctgtcaagctggttgaccgtctaatgggccaaccgcccgatggtagcccggatggaagataaccatgcagaatccgtaagccgactgatttgccgtaatgctgcaagatgttcaattgttgtgttccatgcgcacgcatgaacggaaagcgttttgcatatccagctatagcgaaattgccttttattgatgaaaggcggccgcttgtggatactcagaaacttgcagctgctgtaacagcagaagagagatgtagaaatactgctgattttgacgtaatgtgtgggcgggctgctcatccatgggctattcagaatgcatacctggatcagatgtactctcaacaaatgatagcagatccttcctattgtatcccgattgcacctgctgctagtggcggaatgaatggatttctttgtttatctcaaagaaattggtacagcatctctgtaggatctccagttaagggcttcaatggcatcaccaataaccgagttctgaatgctacctatgttaaccctcagtatcacaaacacatcccggagcctccagagggtgccattatacctccaaagatattgaaaccttacgatttcaaacctttccctgtgttgtggcatgaagataatagtcggcgacagacacgagacaggcctcaggtgcatggagctctgacaggttctgtcttaggagaggctgcacaccgtctactgaaaaattccctgcagatcaaatctggcagctctgctgggctgcttcatgttccatacggagcagcaccctatggccctggaaacagagcaaggccctctggacctttgggatatgagaggggttttgtggacaacccataccatgcacacatgtccagaagcgctccaaatcctcggcctcagttctttggtgaagctcaagccaacagacagaatgtgcggatactagagcggccaaacaatcgaaacaatgatggtggcatccattcagggatgtcaaaactgacgattcaagatgggccaagaatgcatcaaaatcccaggatgcagagtcctggatattttccaaaccagccatatccgaatcagtatggtgggttcccaccccagcggcccatgcagaacgccaattttgcaccgcagcgacctttccaaaatgcaccattcccacagcagcggcctgttcagcagcggcctgttcaaaatgctgtattcccacagcagaggcctgttcaaaatgcaggattcatgcagcagcagcagcagcagcaaccagtgaacggggttcccccaccactacctcccagcacttggatcggcaagcaaccaagcggaggccaggctggtacacctgccaagcagcaggacccaagggcaaatagacagcctaagcaggataatagacagccaaagcaggataacctgagatcacagcatgagagcagacagcaggctgccaaggtggtataccgtgtcaaaggccaagctcccaatggcttgccagagtgaagataaccatgaagaatccgcaagccgagtgattcaccgaactgctacaagatgatctgttgtgttccatgtgcacgggcatgctgctacaaggaggttcattcaactcaacatactcctggaagcagccatagggatttcttgctatgtcggccgccctttaatttatcgccccattgctgcacctgttgtatccccgtctgaatggagttgaactgttgatgatcaggtcgaatggagttgacctgctgtatcgcgctgaatgatctaggacaatgatttaggaaaaaaaacgttatcaagtcgttaggacagaatgtgagcagagggcaaccactgctgttgtatgcctgtaaccctgaaactgtgtttgtgcgtaacaattacgcttgccggtagcaaagggctgactgaaccctatcattccttagtgcctttgctgttgctgccgctggggtgtcgtgtctcgcgtcaagtctggctactgttgccgtggtaactttgtgtttgaactctgatgtactactactactactactataaaaaaaaaaaaaaaaaa

SEQ ID NO: 18695 - DNA, 1104 bp, Triticum aestivum
  Clone ID: PAT_TA_18695
cgtccgcggacgcgtgggcgaagatcttctctcgcctggagtgtaagtgatgggagatatccagctgcttccttaggctcaaggcaggaggaaatcggcgacaaggaagaatagattacctacgagcaggtcgcctcctcctgatgtgtcacccggtgtcacaagaaagcacagcccctcatccatcagaaacaagaggctgtcaccgccttcagaccgcaaggtaggccaagcgaagaactgcgactacaaggttgacactgcaattgcacctgatgctaccccgatcaaagaggtgactgaagagaagcttcttaaaggaggcaatctgagatctaggctggaaacaaggaggacgcttttccagggcaatgaagagagggcaaccaagttggctggagcgaaagctggctcgcgagttgttccgtatgaatgtggtggtaacatggaagaattatcctcatgtacggcgccggcgtcactttcacaacgaggattctctctcgcaggcagtgtaagtgatgggagatatccagctgcttccttaggctcaaactccgttcagtcggcgacgaggaagaatagattacctacgagcaggtcgcctcctcctgatgtgtcacccggtgtaacaaaaaagcacagtccctcatccatcagaaacaagaggctgtcaccgccttcaaaccgcaaggtaggccaagcgaagaactgcgactacaaggttgacactgcaattgcacctgatgctaccccgatcaaagaggtgacggaggagaagcttcttaaaggaggcaatctgagatctaggctggaaacaaggaggacgcttttccagggcaatgaagagaaggcatgatggtggtagaaactcttccagactacgacttgctactacagatggctaatttcgtgtaagaatgcagtcgcgatgtatcaccgtaaggaacttatgatggatgtatatagtttggataataaaacagcttggcttggcggcgatccaccgttgtttcaggtgtgtttgcagcttcacgagatggcagtgtgcccagtgtttttgttttgaggcgcccagtgattttggttgtgttacttgttatc

SEQ ID NO: 18696 - DNA, 605 bp, Triticum aestivum
  Clone ID: PAT_TA_18696
caccaacccgttagctgagccgaattttcttctgttgggagaactgcggttactcaaaagggcaggaggaaggatttggctctacaaaagtcaagggttggttaggtgagatgaagacatttcgtttgatgtacgaaccactcgagctagagcatataagcatcgaggcaggtaaaatttccatcttgtgctgcgacttttggagggtttttctcctctgtcggagctccgagcatgtggcgtacatgaatcacggagatccaagtcgcctcatgcaatgccaaagtccctgagttgggcattaagtctgaagtagaactcagcctctttagctgcaccctcactcggggttgaagaaacagtggctgaggctcctctattatccaaaacgtgtttgaggcgctggggcatgagatgaggacggcccttgtcttttttccttctactccagactacgacttgctactacagatggctaatttcgtgtaagaatgcagtcgcgatgtatcaccgtaaggaacttatgatggatgtatatagtttggataatcaaaaataaaaacaactcccctaaattaactaaagcaaaaaaggggggcggccgc

SEQ ID NO: 18697 - DNA, 845 bp, Triticum aestivum
  unsure (1)..(845): unsure at all n locations
  Clone ID: PAT_TA_18697
gagagaccaccatgatttgattctctctcccccgactacgatatcagctgtgcgctccacacagcgaagcccggaggcgaaaaggggaccgagcaaggcggctcccggaccgcccgtcgatcctcccctctcattcggcagcccccctcgcatcctccgaaatcccccattccccggttcgttcctaggttctcatgagcatggaggtgctacatgatacaacagggaagaaggaagcggttgtgtactatatggatgcccccttgccatatgcaattgaagagaatttcgggggatgcttctttgaagatgatgttgatcttgcacaagttcttcaagatcaggaaatagtgtatcaattaatccaaggaaatgatggaagtggtttatctaggactcattcagatcctagttctagttgtggccatccacgaaaatcgagtgggcgaagattaacaagaggcgcaaattatgagtcacagctagctgtcgatgaagctttagctagagacttgcaggcgatggaggaccaaattgccaaggcaacgatagatgacaagaagagaaaagaagtaagaaagcccgtaagttcttcaacatccaacaatggcaatacttctgttagcagatcttctcaggtattaacggagagtgaagttgatcctgataatatgacttataaggaactagaacaatagagggaacttattgggtggcaccttatcgggttgccattggatggcctaggggtctttaagttttttcctggttaaatcgggacgttgtttcctgaacccaatcatggtgcaggaaaaaaggcccctnaagtttggcaaancttcccc

SEQ ID NO: 18698 - DNA, 1514 bp, Triticum aestivum
  unsure (1)..(1514): unsure at all n locations
  Clone ID: PAT_TA_18698
gagacaccgagagttcacatggtgttgatgcctctagcaaggagttaagcaagccggagtgcagtggtggcgctggtcaggatgaagggcctagtgtctcttgtcccaagaagaggaaaagaccaagccaggatcgtggggtgaagcatgtacaagaagggagccagcaattggcaactctggctgcaaagcaggagaaagatgacgacnacnaagatnaaccaaagaggcctgttgggacatccagaaagtccaacgggaagcaaactgaggataaatctgatgcgccaaaggaagattacattcatataagagctcgaagtggccaggctacaaacagccatagtcttgcagaaagggttcggagggaaaagattagtgaaaggatgaaatttcttcaggaccttgttcctggttgtagcaaagtcattggtaaagccgttatgctggatgagataatcaattatgttcaatcattacagcggcaagttgagtttttgtcgatgaaactttcagctgtcaacccagcactagacttcaacatagagcgcattctatctaaggatttatttcagtctcaaggaactgcatcgtctacctttggcttcttaccagacattggccatcaatttttgcatccaccaaaacattctcaagctgcgttgcacagcattgtaaatcccgccgatgcatttggaagggtaacaaatgctccggtaggatgtacattcaaagaggccacacatcaggtgcccaatagttttgatggagagttccacaacgtgatcgggatgccttttaccctgtttaacgaccaaggaatccacatggtaaaccttgagcaatagattccgcaaccgaagcaacgagatcataacgggccatgagatttcaacagaacaacatgtgagcttgttgacacggttctaccagctcgcatttgagcactgaagtatagccgtccaaattgcttaattgttgatttcccaatattggaatcagcacttgagatatcctatagaggccctttcctcagatgtaccatttgctattggaggaagctggagatccgaccctcgggacgtccacatggagatttcaagcattacattctcctctgaaaatttacgtgtataactattggtgattcaacaatctttgcatcatgatggtgagttccattttgccagaaggtggctgtatctgggtaccatctagttcagacccagtaatattgtaaaatgctctctttctgcaagattcacactccgcggtataatataacagcctttggtttgttagttgctagtatcgtgagagtgaaagaagaatctttgttgtacttctatggctgcgcatgcaaccatatagaactgtgtactggttttcgatttcttgagaatattatgagtgtattttcagcgcgtgattatgtgtggaagaaacagtgaaggcatctgctcttccagaattccaaaaaaactgtaggcatctgtgctattttaaaaaaaaaa

SEQ ID NO: 18699 - DNA, 1886 bp, Triticum aestivum
  Clone ID: PAT_TA_18699
cccgggcgcctggaggcccgtcctaccctggcgctggtagctgctggagcatttgaaaatcgcgtgtgcatgcctggatgacaggccgtccaggcggccaacgatgctcaaggtgatgacgatgttcaaggagatccaggctgggtcaacggtggactcgaaaacctcgtcggtggccaccgggctgagcgacgatccaggttttgcggtcatggacatgaccctcaaggaagccaaggaggagaaagattaggaagatgaccaccgccggcaacacgcagccggcggtgaccgggcagcaacacgtccgtccgaccagtctggggcctgggcgaagtgcccgtagaaatcacagtctctcagatgctgataccatcctagaagttcccacgacaacgcaatgcttaagaattttctttttgatggtacacgtataagaaggaattttccctcccttgaagctctccgtaagtacctaagctgtcatgtcatgtacctataggagtagctcaccactttttccttctctttctttcccagctttcttcagctcctcgtttattttgtcttagcgctccagtaagagctgtgtatgtacatatataaatgggagggttgttgcaatccaggtcccctcccctgcgggtgcccagggtgaccgggagttcacgagcggaaatggagaccattggcaagatcaaacaccgcaaccttgttccgctcctcggctactgcaagattggtgaggagcggctgctgatgtatgacttcatgaagtttggcagcttggaggatgtgctgcatgaccgcaaaaagattgggataaagctgaactgggcggcaaggcgaaagattgcaatcggggcagcaagaggactggcattcctccaccacaactgcattccacacatcatccaccgagacatgaagtcaagcaatgtgcttgttgatgagaatctggaggcgagggtctcagatttcggcatggcgaggatgatgagtgtggtggacacacacctgagcgtgtccaccctcgccggcacgccggggtatgtgccaccggagtacgaccggggcttccggtgcaccaccaagggcgatgtgtatagctacggcgttgtattgctggagctgctcaccgggaagccgccgacggattcaacagattttggcgaggaccataatcttgtacgatgggtgaagatgcacacaaagttgaagatcgccgatgtgtttgacccggagctgctgaaggacgatcccaccctggagctggagctgctggagcatctgaaaatcgcgtgtgcatgcctggatgacaggccgtcccggcggccaacgatgctcaaggtgatgacgatgttcaaggagatccaggctgggtcaacggtggactcgaaaacctcgtcggtggccaccgggctgagcgacgatccaggttttgcggtcatggacatgaccctcaaggaagccaaggaggagaaagattaggaagatgaccaccgccggcgacacacgcaaccggcggcgaccggcagcaacacgtccgtccgtccatccagtttggggccggggcgaagtgcccgtagaaatcagtctctcagatgctgataccatcctgaaggttcccacgcaacgcaagcttagaattttcttctgatggtacacgataggaagaaattttccctcccttgtagctcccgtaagtcccaagccgtcatgtcatgtacctataggagtagctcaccacttttttcttgtctttctttcccagctttcttcagctcctcgtttattttgtcgtagcgctccagtaaagagctgtgtatgtacatatataaatggtggattttctccggtgcaaattccctccactgcttctaacc

SEQ ID NO: 18700 - DNA, 497 bp, Triticum aestivum
  unsure (1)..(497): unsure at all n locations
  Clone ID: PAT_TA_18700
cgtccgcccacgcgtccgcctcacccagtctcccccaagctcgcgtcgtccgtccatggcgttcaccgcgccggtaggggtggcgggagcccttctccccctcgccctccccgcgccctccagctccggctcggcctccttcctcccccgcgccggcggtgagtcccgacggcgccgcttagccgtcccacgcagaggaggcgccatgggagatagccgggggagatggaattgccacatgactcgctctgccggcaagggcgaatgtgggtgaccgaggacgatgcggtgaatgttgctgctgatgccgccaacgggaccaaagctgcccgatgatgccgcccgatgtgctcgagtcctttgaaccctttgactgctgattgattccaagtgatccatggaataaaagcaacttatctttccccttctctggtgcaatacactcctgggaggcaaatacaataaatcnaaaggngnacggntggggagcaaanaan

SEQ ID NO: 18701 - DNA, 1014 bp, Triticum aestivum
  Clone ID: PAT_TA_18701
ttcggcacgaggtacctcgggggttcctccttcccttccccgccgccgccggccatcgccggccggcgaatcggagaagacgccgcgactatcccgttcccggagccgcctccactcgccaccgccctctccccgtcaccaggcctcatccatccaacgcctcgacgccaagctacagccagccggagcccttgcagctgcagcacggacaaccacaccctaacccagcgaccaagaagcccaggccagcgacgatccatcatcgatggccgcggttcgacacgcaatgaggaggctcggcggctccctgctctggccaacggccacctcaccggcagcggcggcgccaaggcggctcacgcacagcgaaagcttggcctcggagcaagctcgtcacgaggaggtgctgcgcaaggtccagcagaagacggacgagctgtacgatgtgttgtgcgaggcggagcgggacttctgcacgagcagctggcgcaacacgcgcatgctccagcacctctccatgagggtcacgccgaggccgtgggactggaggtggcgcatccggcgcttcaacagaaggtttcacaatgtggcagagcttgccgggtttatctcgctctacttcggcttggaggtgctgaaacaagaagtcgaggaaaaggaaaagcatgcggccgaggcaacgacggtgtcctgcccgatcgactgagaaccaaccaaagatccatcaaggacgagtaggagaggcgataacattatcttgcattgcgttacgacggacaaccaaagacgagatggtgatcttgtctagtgttatctaatttggtagctatcttttgtgaccggtattgtcttgtgtgacatggtactaagttgttatatccatgaaaccatgacttgttttggttatatgcgaatgcaccaaaccctagttaaatgttaaatgtgtatggattctccatcgagctggattttataggagagtggttctttaaccaagcatattctccaccaacg

SEQ ID NO: 18702 - DNA, 1619 bp, Triticum aestivum
  unsure (1)..(1619): unsure at all n locations
  Clone ID: PAT_TA_18702
cgtccgcgtttaccgaaactgagtacacatgctatcattttgaggtcaatcgggagtatctaaagggagccttagacagattttctcaggtctgggtatcacctcttgttaaggctgaagctatggaccgcgagatattagcagtagactcagagttcaatcaagttctgcaaagcgatagctgccgcctttaccaactgcagtcccatacttgctctcaagggcacccattgaatagatttacctggggaaacaagaaaagcttgtcgaatgcaatgggcagtggaatcaatctaagggaagagattttgcaaatgtacatgagtaactatcatggagggatgatgaagctagttataattgggggagaaccccttgacactctagaagcctggaccatagagctattcagtgaagttaaagctggtcctctgttagaaataagtccaaagtctgatatgcctttctggaaatctggtaaactttataagctagaggctgtcagagatgttcacagtcttttcctgtcatggacacttccttgcctgcacaaggaatacatgaagaaaccagaagattacttggcacatctccttggtcatgaggacaagggaagcttgctatattttttgaaagctaaaggttgggctagcacattgagtgctggcgttggcactggaggaacacaacgatcctcatatgcctatatctttgagatgtctatccgcctttctgattctggacttaaaaatctcttcgaggtcattacagctgcgtcccaatatataattttacttaagcagtctgagccgcaagaatggatatttaaggaacttcaggacattgggtacatggaattcagatttgcagaagagcaacccccagatgattatgtagtagatcttgcagaaaatatgctattttattctgaaaaacacataatttctggagaatatatttatgagggatgggaaccagagttagtcaagcatgttctgagcttctttcatccagacaacatgagagttgacatactgagcagatcatttgataaacagtcccaagccattagatgtgaaccatggtttggttcacagtacattgaagaggatattccgccagctttgattgaaagctggagaaatcctgtggagatagatggtaattttcatttacctcggaagaatgaatacatcccaggggacttcagtctgcggaatgctagcattcctaaatcctcaaacgatgataatcctcgatgtattgtggatgaaccattcataaagctctggcacaagatggatattacatttaatgttcctcgtgccaatgcatactttttgatttctgtcaaggatggctgtagcagcctcagaaactctgttctgacagatctgtttgcaaaccttcttaaagatgagctaaatgaggtcctctatcaggcttatgtggctaaaactccagacaatcaatatctgtccgttggtaagcaacccttgagctaaaactttaatgggttacaatggacaaagctngggcaatncctggctgtnccaanaaccntgggtggncttcccaantncccttttccccaaaaagaatgggtaagggnttgaagg

SEQ ID NO: 18703 - DNA, 1212 bp, Triticum aestivum
  unsure (1)..(1212): unsure at all n locations
  Clone ID: PAT_TA_18703
cgtgcccccatgcggaccttccccacccctctcccctccccccccctctgctccctctcctccgtcaggatttcgttccagaaatcgaaagatgaagatcattccggtggcttgcttggaggataactatgcctacctgatcgttgacgagagcaccaaggcggcggcggccgtcgacccggtggagccggagaaggtgctggcggcggccagcgaggtcggcgcctacatcgactgcgtcctcaccacccaccaccactgggatcatgctggtggcaatgagaagatgaggctgctggtgccagggattaaggtctatgggggatccatggacaatgttaaaggctgcactgatcaggtggaaaacggaactaagttatccattgggaaggaaattgagatactgtgcctacatacgccatgtcatacaaaaggtcatattagctactacgttactagcaaagaggaggaagacccagcagtatttactggagacaccttgttcattgctggttgtgggagatttttcgagggtacggcagagcaaatgtaccagtccctttgtgttacactgggctcgctgcctaagtcaactcgtgtttactgtggccatgagtacactgtaaagagcctacaattcatgctgacagtcgagccagagaatgaaaaaatgaagcagaaactggaatgggctcaaaagcagcgtgaggcaaatcaaccgacggttccctcaactataggagatgagtttgagataaacaccttcatgcgtgttgatctgcctgaaatacaggcaaaatttggtgccaagtcggcagttgaagcgctgaggacggtcaggaacatcaaggatacctggaaaggttgataaacgcagctgccactcatactgtggcgtttacagccgtgcgatgctttgagagtggcaacgagctacatacgtgttaagaaggtaatatgccagtgtttcctttaagaaaaacataagagaaaggagtccagtctgctaatatgcttgggtagcaatcagaaaacaactgttgtggcatgttaattacttccggtatgttatttcttggcaaaaaaaaataaatatgttggcctgtggcagaaagtcttgtgtatatctgaagtctgtgatggttttggaacttgcatacatttgatgatgagcaaccaaaggtcgacactaaggttagatanaaaagagat

SEQ ID NO: 18704 - DNA, 517 bp, Triticum aestivum
  Clone ID: PAT_TA_18704
acgcgtccggacacccaaatccaaagtctccacagatttcgaccacctgcaaatccattgcgtcgttcttggacgggtgtcctctgaacttgtacgaatagtctgcacctatggactccatcaagatcaagctcgccgtggacaggtcgcgcaaccgcgtgctgttcgctgacgccggctccgacttcgtcgacgtcctcctctccttcctcacgctcccgctctccgcaatccagttctgtgcggcgacatcaccgggatgcctcttcaacctctgcgacagcgtcaaccgcctcacgggaggtaggctgcttaaggttgaggcctgccatgacatgcttctcacgccttcgaccgcccatgagtttggagggagcagtttctggaattctcatgatgcgtttgtcaagaaccagccgaacctacaggtagatggcgattactgcaggtgttggcaagtcatggctagacttgtgcatgtctacaacaaagtgagctctgggtctgtgatgttcgt

SEQ ID NO: 18705 - DNA, 757 bp, Triticum aestivum
  Clone ID: PAT_TA_18705
gaggcttgattctcccaaatccaagtatactctatgtgggcattcagacagcgtgcactgccaggattcggattgggtgcacagtctggattatttgattagtggctctgttgacaagactgccaagatatgggacttgcagaagaaggagtgcgttcatacgctccaaaataagtctacagtttattccgtctttgcccatcccagtcttccagttctaattacaggtacaaggaatggcgctgttcgtgtgtggagctccactgatttcaggctgaagacaaagcttggggacatcagtccggtttgtggtttcgcatgtttaatggggtcagaaagggttgcaattgcacactgtgatggagtgtcggtgatggaaattggtgatgaaaaagaacaaggtggtagtgaagccagcaacgagtactccatatcagctatagattattaggaaacccaacaccgatcaaaaggactgttagtacgtctacgcaggctatgctaacacgggcataatgaatttccagatccggaaacttgaacgactgattggagatgaacagtacttgtctgctagtacctcaactctagcaggtggcaacaggttgtgtgcagaagatgatgatttcaccaagattacttgttttccgtgaggaaattgcacttccttctatgcgtgcgtcatgaccagtgacttaagtgaatataaacgtgtaaattgacaatctcattgccggagattcatttgtacagtaat

SEQ ID NO: 18706 - DNA, 706 bp, Triticum aestivum
  Clone ID: PAT_TA_18706
gaggaattcggcacgagggtcggcccggtctccacgtaaactcgcagacgccccgcaccgagcccaacaaaccctcgcgcacccccacacctctccttcgccgacgcggccatggcggcggtggcgactgtgagctcggccggcgggatcctcgccatgctccacgagccggcggaggagctcaagctgcacgcgctcgccagcctcaactccgtcgtccacctcttctaccccgagatctccaccagcatccccaccattgagagcttgtatgaagatgaggagtttgaccagagacagctagctgcactagttgtttctaaggtattttattacttgggcgagttaaatgatgcactattgtatgcacttggtgctgggcctctgtttgacgtttctgaggattcagattatgctcatgctcttctagccaaagcattagatgaatatgcgagtttcaagacaagagcttctaaagctaccgaggaagaagaaaatgtggatcctagattagaggccatagtggagaggatgttggagaagtgtgttcttgatgggaaataccaacaggccatgggtatggctgttgaatgcaggagactggataaactggaggaagcaattgttcggtgtgataatattcacggggctctttcatattgcatcaacctttctcatcaatatgttagtcaccgtgaatatcgct

SEQ ID NO: 18707 - DNA, 1031 bp, Triticum aestivum
  unsure (1)..(1031): unsure at all n locations
  Clone ID: PAT_TA_18707
cgtgcggtggtcccaaatggcgcctcccctcctcctcctcctcctccctctcgccgccgccaccgcaccgtgcgcgcatccggcctacccgagccagccggcgtcgtgcccggcggagcccgtgctggcgccggagcgccgggagacgcacggcgggggccgcatcctggacatcacccactactaccgggaggacatgccctcgtgggagtccggcgccggggtgggccagttcctgtggctgcccgcctccatgcgcaacggctccctcgccaacaactccgagatgcggatgcccacccacaccggcacccacgtcgacgcccccggccacgtcttccagcactacttcgacgctggcttcgacgtcgacaccctcgacctcgacgtcctcaacggtcctgcactgctggttgatgttccaagggatgaaaatattactgctaaaacgatggaatctttgcatattcctaaaggagttcaacgggtacttttttagaacgttaaacactgacaggaacctaatgtggaagaaagagtttgacacaagctatgtgggttttatgaaagatggtgcccaatggttggtacacaacacggatattaagcttgtcggaataaactatttgtccgttgcagctttcgatgacttgatcccttcccatttagtttttctcgaaaaccgggatatcattcttgtggagggcctcaaactggagaatgtcatacctgggatatactcgttgcattgcctgccacttcagttgcgtggagcggaaggttcgccgatcaaatgcatccttataaagagaagacatctgtatcctgctgcgatttagtttgataccgcacgaaagcttataaaatnnngatgtgtatagtagcagcaaagccccatctttgatggcagaggagtgttgtcatgtcttggcgcttcttaaggagcgacagacgaccggggatgcaaatgtgtaacctctnnncctctanngtgccctccgaacctttagttcaacnnnntaaattaaaac

SEQ ID NO: 18708 - DNA, 1052 bp, Triticum aestivum
  Clone ID: PAT_TA_18708
cttcgcgtcggacgaaaaaacgacgtctcgaaaaaaaaaaaatcctctgaagcttcgcagccgcttcccgcacgccaccgccgccgcctcggccgctcgatggccgccccggcgccggaggagcgcctcgacgtgctcaccgccgccggcgacaagacgggcgtctccaagcccaggtcggaggtgcaccgggacggggactaccaccgggccgtgcacgtgtggatctactgcgagagcaccggggagctgctgctgcagcgccgcgccgactgcaaggactcgtggcccggccagtgggacatctccagcgccggccacatctccgccggggactcctccctctcctccgcgcggagggagctccaggaagaactaggcatcaagcttccagtcgatgcttttgagctcatcttcgtttttcttcaggaatgcgttatcaacaatgggacttacaccaacaacgagtacaatgatgtttaccttgtgacaactttaactccaattccactcgaggccttcactctccaagaaagtgaagtatctgcagttagatatatgcaccgtgacgagtacaagagctgccttgcagcagaaagcggagaatatgtaccttatgatgtgaatgggcaatacggccaactgttcagtattattgaggaaaggtacaaagataacacggagtctcgcagcttaaccttacaaaagcaaattagtcgttatgctcccatccatttggaaccagagttgactactctatctgaaggagacaaagaagccttgggatatattcttaaagcatcaatggttattgatgaaatattttatgagcaggtatggaatagcaacacaatgctaagagactggctaaaagcacatgctgactcctcctcccttgatagtctgaagtgggcatattactctattaataaaagtccatggtcctgccttgatgaaaataaggcttttctatccactgccgattcggctgtgaaattgctcacagatgccaccaagccaatttcaggatggaaggggcttgagtatcgtgc

SEQ ID NO: 18709 - DNA, 1255 bp, Triticum aestivum
  Clone ID: PAT_TA_18709
ggtatcaatgaatgtgcttgcttttgggattcagagctctgatatcacaccggcattcccatatgtcgcgccgttttcatgcactgtgccagatatttgtcgtattgtgcggtcattcattgaggactccgtgaacttccttggcccatgggggcggtggtgacacatatgcagcgggtgaagaagtaccttggtcggatactctcagaggttgtgaatgcttcgatacgcacgcgtgtggattctggcagtggtctcagtgtctctcaggcaatgcaggttgctgcaaacatgtcaataatggagcgtgcgtgtgagttttttacgcgccatgcagcgcaattgtgtggtgtgcctctacgcgcagtagagcgtgggcggcgtgactttccacttcgcaagtctcgtgatgctgcagaggcgcttctgctgcggctattgtgttccaaggttgatgaattcatgcggcaatctgatggtgtcaactggatagctgatgacccacctgctgggggcaatgagtatgccaacgaggtcactatctatctggagactcttacttcaactgctcaacagatccttcctcttccagtgctccgtcgtgttcttgttgcagttcttaagcatatctctgagaggattattgccctattcttgaatgactcagtgaagcggtttagtggtagcgcggtcatcggtatagatactgatcttaaaatgtttgagtcattcacagagaacatgtcgagcctgttcctggactctcatcaggattctgcagcaagtgaaatgaagtctgcactgatggagccgaggcagctggtgaatcttcttatgaacaacagcccagagaacttccttaacccagtgatccgtgagaagagctacaataagcttgattacaaaaaggtggcaattatctcggagaagttcagggatacctcagagagctatttctcgacatttggaactaggggtgctaggcagaatccaaagaagaaatctctggatacccttatcaagaggcttcgagaagctagctagtctctaccctgcagtaagataatacgtgcatgtaatttagcttgtatgtggtgtgcattatgtgtgttaaaatcattgttcttctacatactacaattttcttgaaggtagagtgcttgttccatatgtctggatatcttaattttgattcttttatttactcatcaacagtatgatcaagaattcaagatatagtacatcatttgtttta

SEQ ID NO: 18710 - DNA, 677 bp, Triticum aestivum
  Clone ID: PAT_TA_18710
cggcgcgtactccaccacgggctgcatacgccgcccgcgtcagccacccgtccggtcgcgcgaaccttagcggtcgagcacctgttagcaatggcgtccggtcaggagaaggggaggtcggagctggacagcttggcccgcgaggggcagaccgtcgtccccggcggcaccggcgggaagagctacgaggcgcaggagaaactcgctgaagggcgcagccgtggtgggcagactcggaaggagcagatgggggaggaggggtacagcgagatggggcgcaagggcgggctgagcgccgaccacgcggccggcggcgagcgcgccgccagggagggcatcgacatcgccgagtccaagttcaagaccaagtcctagatgttcagttcgctgccgaccgctccctcgcgtctggctgctcgcccttgtgtgtgtcccggccgctcagcgtgtccgggcgtctggttctcggagctcgtcgtgagcacgcatgtaataggtgatcatgtgtaccgtgatcgtgtgtgctttagtgtccctgcgtgcttctgcgtcccggctggcgtcggcgtgctaggtggaggcctcgctgtaagttgtgaccaagctaggctgttgctctctgtaatgtagtgcgtctgtctgtttgttatgaatctgaatctccgtcaaaaaaaaaa

SEQ ID NO: 18711 - DNA, 811 bp, Triticum aestivum
  Clone ID: PAT_TA_18711
aatcgactaccgggactactgggactttctggactggcgatatgccgtatctcagcttccttcctctgttcttccctaattcctcccctaatccttgatctcctctgccccatatcctttctctttcccaatccatcagccatgtagttggccctctggatctgccttgtccggtgtcgatcccctgctcctctcccgctgccctgttcttcctcttccttgcccgttccctgtttcatctcaacctgattggatccatcccatctcctttcttaagtcgattcctcgcttctccaagctggatctgggcagctgccttgcagatccaactactgggagccatcctcatgtttctgcgccgccgctgtttccatttggctgatgcccaagcctcaatccaacgagcctcttgctctgctgcagtagcaccgccaccgtcgtctctccggtccagggcgcttagtcccagattagctgagccgttgattaagatcagtacctcaactattgctgcaccatagttttcaacctgccacggccgcatcatactgctatttgtttgagagattgggtgccatgaaagccattgcttggaattgccgaggtatgggtcggaaccttggcaatgatcgtatggtctttctggccaacttgattcgttccactaaagcgcagccaaaacctcttctttggcaggctctttaaagatgtggtgcaggaaaaaaaaagcctatccagcacgatctttcggaacttgaagcgaacattaatcaacttcagcaacacccactgcaacagcaggatcattgct

SEQ ID NO: 18712 - DNA, 676 bp, Triticum aestivum
  Clone ID: PAT_TA_18712
gccggccgggtcgggtcgtgacgctcaaggtgttcgaggaaacgtgctggtgcgcgagttcctggaggagaagggccagggcagggtgctggtggtggacggcggcggcagcctgcggtgcgccatcctgggcggcaaccccgtccagcaggcgcagaacaacgggtgggcgggcatcgtggtgaacgggtgcatccgggacgtggacgagatcaacgggtgcgacatcggcgtgcgcgccctcgcctcgcaccccatgaaggccaacaagaaggggatgggcgagaagcacgtcccggtcaccatcgcgggcaccaggatctgcgacggcgagtggctctacgccgacaccgacggcatcctcgtctccaggaccgagctgatcgtgtaggagaggccgcccgcctcgttgtccgcgccgttccactctgtggttgtatttgcttgtctgtaacatgatggatgaactgggctctggggcactgcataaaagagaggaggagggctgctgtggttgctgctgctgctgccctccctgattgaatggtgttgtatctggacttcacattcagaagctccgaacttgtaataattgtaagcttatcttgcctgatcaaatggaatgaggaatcggaataaaattgtcaaaaaagtcggatgcctgcagtgcactgtc

SEQ ID NO: 18713 - DNA, 1016 bp, Triticum aestivum
  Clone ID: PAT_TA_18713
ccaacgcctccccacggaaaagaaacaggaaaaaaggaccctcctttcttctcccccgcttctcggattggatcccttccctccctccgattgattccatcccgttggagcccggcgaggtgacggcggagtgaagatctcgacaggactgcctcgctccccacggcggtgaggcgagaccgaccggcgacgcgcggtcagccctgaattgaatcagctactatggcggccctgccgttggccacagcggaagtctgcgacgccaactcgcacctcatcaccggcggcgagctgcgcgcgctgcagcccgtcttccagatctacgggaggcggcaggtgttcgcgggccccatcgtgacgctcaaggtgttcgaggacaacgtgctggtgcgcgagttcctggaaggagaagggccagggcaggggtgctggtgggtggacggcggcggcagcctgcggtgcgccatcctgggcggcaaccccgtccaggcaggcgcagaccaaggggtgggcggggaccgtggtggaggggtgcatccgggacccggacgagagcaacgggtgaacgaccggcgtgcgcgccctcgcctcgcaccccatgaaggcacaacaagaaggggatgggcgagaagcacgtcccggtcaccatcgcgggcaccaggcatctgcgacggcgagtggctctacgccgacaccgacggcatcctcgtctccaggaccgagctgatcgtgtaggagaggggttgcagctgttggttgtgttgttctgactatgtggttgtatttgtttgtctgtagcatgcatggatgaactgggcttctgtccctaatcataacatgtcggaatcggggtgctgtattcactgctgcttctgccctccctgattttgaataataattgtatctggacttcagattcagaagctctgaacttgtaataattgtaagcttatcttgcctgatcaaatggaatgaggaatcggaataaaattgtcaatcggaaaaaagcaaaaaaa

SEQ ID NO: 18714 - DNA, 1019 bp, Triticum aestivum
  Clone ID: PAT_TA_18714
atccaatcctcccacgcccggttgcctgccgacgagccgccaccggcagggccgccgccggccccgccgtgctcgctcctcctcaatacctctccaccaccgtcgttgcctgcgcccctgccgcgtcgtccgcggacgcgtgggtacacattacgtgtccttcacagccgctgccgcatgcgcccgcccggcgagctccgccgccagccgtcacctcgcttccctacgtctcccagcctccgcgccagcccgtccccgacctcccttgcgcccgctgccatgtcgagcagataccgcagcccaaatcttgagccagggaaaccctaatcgccccaggaactataaggcgccgccagcaccgcatttcccaaacccttgcgccacaaccagacgacgggtaagggaggagaagaacaacagcgaaagatggtgtcgctaaagctgcagaagcgccaggcctcgagcgtcctcaagtgcggcaaggacaagatctgggagtttgaacaattcaccaagattccagtttgtgtataacagaatgggtggaatttatcatgagatcctacccaaatctgagtacttctccaaggcactgtacaccttccattttgcccaaaacgatctcaccttgggctacttcaccaataagactaccaaacagattgaggcctatgaccccgatccgaaggagcggttcactgtggcaatgcagctgagttcatactgtacctcaggacatgaactgcaagtggtgctagggtttgattgctggatggaacaacaccaagaacgtgcgttattactccagccacatggaagcaagcaggcatggcgccgcccacgtggcctgattagtgatcaaccacacgtatgatatacccgtatatacttgtcgatcatacatacatgtgtacccacatattcttgattagttggttaatatataaatagattcttaattggtctattagttcgtgtgatgttacgaatcaaaagaaaattactggggagttattgca

SEQ ID NO: 18715 - DNA, 2100 bp, Triticum aestivum
  unsure (1)..(2100): unsure at all n locations
  Clone ID: PAT_TA_18715
gcaccaggccaccccctcccagaaggtaaggacgcaccacctgcggcgactgggccatctccggagatggcggccggcattagaagcggcggtgggacacaagggagcggtggccgggtaggtaggagtggcggtccgcggcgatgtataagaacctgcttcaggagctggcgcagcggcgctgcttcaacctgccggcgtacacctgcctgcgggaggggccggaccacgcgccgcggttcaaagctgcggtcatcttcaacggcgagcaattcgagagccccgggttcttcacgacgctccggcaggccgagcatgctgccgccgaggtcgccctcgccgcgctcgcccggcgcggcccctcctactccctagccgcccgcatcctggttgaaacaggggtttacaaaaatcttctgcaggaagtggccaagagagttgggggtccgttgccttcatctattggtgagcggtctggccttgggcttctgcctgttagcaccagctcagcagagttatcgtgcaatggctatgtcagttgctcgtttgcccggagtgggagatgcttatacttcactgtgtatggcagttcggggtcgctctagctggctttacctttgcccccccgtgttcggccggtcaccccgtgccccttgggaaggattatgaggtggcaattattacatcctacgtccgctaacgcgtacgggaaaagatagcgatggccaataatcccaatgcttcaccatttcccaagaaatttcccatgcaaccagagaggaagccttgttttggtcaatcctctcagtccagttactcgaagattcttcctctattccggccaaagtctagttcaagatccagaccagagtcaccagccgcggctgatggagcatcacagtcaccgttctggcccattgaaagctctaattcaaggtcgaggttcccggccgcagaagcagccccttatgtcccagttgggcactaccgtatgccttgtcatagtatggctcctccggtcacagtcaggagctctatccctgtgttctctgctccacctctcccacctccaagtggacgcacacagcagcttcctcctctcctgagcaacccaccgtcagtccggatggcatccccagttcacatcaggccagcttctccacactttgctccctcgggtcctgcgcagcgtccaagacctgtgatgtctgttcagatgaaggatgtgcagcacaagccaataagggaatcgatgtcgtctgcgatccctattcaggtgaaggatgcgcagcagaggccaaccaaggggtcgccgtcgtctgcgccgccggttcagccatgggttgcgccacaccggctggcgccgggcccgatgtcctggtttgacccgcgcgtccagatgaaggatgtgcagccccagccagcaagggaaccattgtcagaaggtaaggacgcaccaccggcggcgactgagcctccggttaagatcgaggctccagctcaagtcaaggaagcttcagaggtggtcaccagtgaagtagtcccatgtcctgctgctggttctgttgctgctgctgctagttctacttctacttctaccagtgaatgcagcactgctgcgccagcaagccagtctggggctgatgatgatgcagccaagggtgaagaggcgcgtgaggacgtcctggaaactgaagcagcactggaggagggcatcatcaagcttttagagataaaatgactttgagtgaagcgcaaaccatcttgtccttgttgtcagattttgtaattagctgcctcctgtgcacatcacatcccttagtttttggcatgcgtcggttggttaggggctcctgggcaagctgcattctggtagggacaccttagctttttgttcatgcagtggttaggtggcttgcccggttgcccggagtcggagatggttatacttccctggatatggcagttggtggtcgatctagctggctttacctttaccccccaatgatgaggtggacactgcgtgcctctagggaaggattatgaggtggcaattattacatcctanacttggtaaaaaaaaaaaaaaaaaagccccta

SEQ ID NO: 18716 - DNA, 2054 bp, Triticum aestivum
  Clone ID: PAT_TA_18716
tcgacccacgcgtccgctgattcttaccgatcagccccatgttcacctacagtattaggcatggatgacatgtatggcccctgcggaaatagccgagcattcagtagacagctttcgagcattcaatcatttaattcgaggtttgggtctttcaattcgaggcttggatcattcaattgtaggcctagtggtccaaggtccgaaaacatgtcgatccctcctgaggaactcagatgtcccatttccttgcagctgatgtatgacccggttattgtttcgtctggtcagacttatgagcgtgtttgcattgagaaatggtttaatgatggtcacagcacatgtcccaagactcagcaacaactggcccacttgtctttgactccaaactactgtgttaaggccatgatttccagctggtgtgagcagaatgagtttccagttccagatggtccaccgggatcctttgatgtaaattggaggcttgctttatcggactcccaggcaacgggctgtgtgtctgttgatagttttgacactagcaacatcaagggtgtcaaggtggttcccctggagaacgagagaaaggaagaaccggcgaacagcgagtcaggcacattggatgatagctcttgttttgagtttgatatgaatgaggggtatcggaacttgctgctggtgcttaatgaaagaaacaacatactgagccagtgcagattggttgagcagataagatatctgctgaaagatgatgaggaagcaaggatccagatgggctcaaatgggttcgctgaggccctagttcagttcttaaggtattctgtggaagaaggaaatgagaaggcacaagaagttggtgccatggctctttttaaccttgccgtcaataataacagaaacaagggacttctgtgtggggctggaatagtcgaactacttgagcagatgacctcgaatccacgcctagctgctgcagccacggcgctctaccttaacctttcctgcctcaccgacgcgaagagcgtgattgcttccacgcaggctgtgccattcctagtggaccgtctgtacaaccacgatgcctgcgacccgaaagccagctcctgcaagcatgatgccctctacacgctgtacaacctctccacccaccaggccagcatcccgtcgctcctgtcggccggcatcgtggatgcgctccacacgctcctgacggactcctcggtgtccgagggcatcgggtggacggagaaggccctggcggtgtccatcagcctggcggcgacccaggccggcaggaaggagatcatgtccaccccggggctggtgagcacgctggcgatgctgctggacacgggggagccgacggagcaggagcaggcggtgtcgtgcctcctggcgatgtgcgcggcggacgacaagtgcattgcgccggtgctgcaggagggcgtggtgccgtcgctggtctccatctcggcgaccggcacggggcgggggcgggagaaggcccagaagctgctgaagctgttccgggagcagcggcagcgtgacggtgggcaaccgcccgcgtctcagcagcagcagcagcaggccccgtcgtcggaggccgggaacgggaacgggaacgggaacgggaacggcggtggggtgatggtgtgccaccgggagtcgaagccgctgtgcaagtccaagtcgaggaagctggggcggacgctgagctcgctgtggaagaaccgcggcttctccctctaccagtgctagcctagcaggcaggtttttggggcctggttcatcatcgtcagtaggatctgtacatctcctctttcttgtttcttttttccttgggtcttcttccgctttggcgcctttgggttaagtaagttgaaagagactactgcttcttccccccctgctcggtggggtgatgtagggcattttccccctctttgccgccttctcatgacattgtacaatgtatatatagcctgccttgttacgagatgatgcttgtctcccttttcagtcaagcaaccgtttgttctcccttgtcaaaaaaaaaa

SEQ ID NO: 18717 - DNA, 1053 bp, Triticum aestivum
  Clone ID: PAT_TA_18717
gattgcagtgacaccagtaaaaactgcaataggtgcagaagctgctgcagcttgacctggatttggtgcgctgtatacgaacctgcgtatgcacttgtaaacaagaaatgagactgcagcacccatcagtggagaaataagccatgacgaagatactctagccaaggagctccagaaacgtccgcccacgcgtccggtggaaccccgggacctcgtcatttgattgacatggtataacaaagttcaaaagaattatctgtgatggaatgtaacctgtaaccatgtaccagcagcagcgagggaggacagcaatccagcaaagagcagagaatcatttccttggaagacagatgtgacgaggatgcccttctgcatggtgctggtgacatgggtgcccataaggaatgcaccagagaactctagcacagctgcagtcagcaccgcctgccggagagtcaaagcaccagatcctaccgacgtccccatggcatttgccacatcattcgctccaatgttccatgccatgtagaatcctgacagaagggtcagatatgccagcaccttcatcttggtcgtcccatggaagagcagtgagcgcatcgccagtggaacagtgagagctgcaaatgcaatcaccacagagattgacatggccatccgtggtgaaatatggaacgcctttgccatctctgacagctcggatcctccgctccgctcccccgaggcatccgggtttgcaccggagccatcgtcagcgtctgcaaaggaggagagtgtggcgcgcggaagcaccaggtgcgagctcagtgtcttggcaggcgacactttagccagacggaagtaccttgggcagtgaatggtgggtggcagctgagcggcagggcaacggagcaggagagcggcagccgcagctcgccctcctgctccagcatgtgctcgggcaatggaaaagaaaggagaagattgagacatggagtggcagaagctaaacccgccgcgggccgccttcctcaaagagatgagatatcagtggagagcaggagaggaaggggc

SEQ ID NO: 18718 - DNA, 1486 bp, Triticum aestivum
  Clone ID: PAT_TA_18718
ccgtccgcccacgcgtccctttgcctcccacaattggcttctcgccgcgccctctttccccctcccctcccccgcctcgcccactgccccctcgatccagcgcgggagcaccagatggatcggccggcgccggaccagcggcccacgctcttctcgccgtaccagatgcgccgcttcagcctcgcccaccgggtggtgctggcgccgatgacgaggtgcagggccatcggcgggctgccggggccggcgctggcggagtactacgcgcagcgggccacccagggaggcctgctcatctccgagggcaccgtcgtctcgccggccgggccggggtttcctcacgtccctggaatatacaatcaggagcagatagatggatggaaaaaggtggtggatgctgttcatgccaagggaggcatctttttctgtcaattatggcacgtaggcagagcttctcaccaagtatatcagccagacggtgctgctccaatatcctcaactgataagccgatatcagcaaggtggaagatattgttgcctgatggttcatacggaacgtatcccacgccaaggcgccttgcgacatcggaaataccggacatagttgagcaatatcgccaagctgccataaacgccatcaaagcaggtttcgatggcatcgagatccacggcgctcatggctacatcattgatcagttcctcaaggatggcatcaacgaccgcaccgacgagtatggcggatcgctcaccaaccgttgcaagtttctactcgaggtgacccgagccgtgttatccgccatcggagcagagcgaactgcggtgagggtgtcaccggccatcgaccacctcgacgcctatgactcgaacccgatgcagctcggcatggccgtggttgagcggctcaacgccctccagcaggaagccgggcagctcgcctacctccacgtgacacagccgaggtacgcggcctacgggcagacagaatcgggcccgcacggcagcgccgaggaggagagccggctgatgcgcaccttgcggggtgcgtaccggggcacgttcatgtgcagcggcggctacacgcgggagctcgggctggaggcggtggagagcggcgacgccgacctggtgtcgttcgggcggctgttcatttcgaacccggacctggtcgagcggctcaggctcaacgccggcctcaacaagtacgtgaggaagacgttctacacccctgaccccgtcgtgggctacaccgactacccgttcctcggcaagcctaaatcgcgcatgtagtgtgtacaaggttagtgatcggagttgggatttactgtgaagtgtatttggagaaataaggtcatatacgcgcatgtagtgtacacgagttagcgatctgagatgggtttgtgaaatgtatttggaggaaataaagtaatatacgtgactgtaatttatttcaaaaaaaaaaaaacaattcgcccgatagtgagtgtat

SEQ ID NO: 18719 - DNA, 1103 bp, Triticum aestivum
  unsure (1)..(1103): unsure at all n locations
  Clone ID: PAT_TA_18719
cagtgtacagcagatagtatacataatctaaactcacaatcatcacatatggctagattttaagtctggcttattcttttattccatctctagccgccccgtggctgttgctgcagcggctccaaacattgttcacaagcttacaacaaactgccatatcatctaccaggatcttgcttgcaacttttagattgtgtggcgattgtcggggtggtccagctgtctaagcagcagcttccgcctgctcttcgatctcgctgcgtccagcatcacttgcggcactcccattaaccggcacttcagcggcggcgacggaaggcgagctcgcggcaccgttcacctgcacctcaccagcagcctcggacgtgtcgctagacggttgcttcgtaagagacttctgttgacgaatagcagccgccgcttctggcatggcgacacctggaggctgaggggggacccattgacgctgaggcggcggcctttccacaacaccgctgctgtacgccagcggcctcggctcctctgcatggaaatcaggggccttcccgttctggtggtacgagggggcatggttgtcctgagcttgggagtatgatccatcctcgctcaagtaggcgttggatctataagcaagcttttgttctgcgtgttgcagcatctccaatgcctgctgtgtcttggtcccagaagatctattatcccctcgctgcaccgtctcgacataagatcttgaatatgacccggaggtaggttcagtaggtgctggcgcaaacgaaggcctccctgagccgaagtcactgtttggggcaccatacatattaggttgctgaggaggtctccatggagtgttaacaggcccattccttgtggcggagggggcatgctcttccagtgggcggtagtgcgaaaacctatcctcccttgtaatatttacggagtccctgctatggctcaacgactcactcaatgatttcaacactttgctggaatccagggctgcgtcaaagtcacaagatcttcttttcttcgtcattggaagcgagcaactcccggttggtctgagcgatggcggaaacggcctcngcggaggccttgacggcctc

SEQ ID NO: 18720 - DNA, 2118 bp, Triticum aestivum
  unsure (1)..(2118): unsure at all n locations
  Clone ID: PAT_TA_18720
caccgccgccccggccgtcgtcccctcgcgtgcttttttttttttttagctcacaaccataacagtcttttcttgttatttttcagtatacagcagatagtatacataatctaaaattcacaatcacatatagctagattttaagtctggcttattcttttattccatcactagccacaatccaaacactcgtcacaaacttatgacaaactgccatatgtagtacccaggctctggacctaggacttttagattgtgttgcggttgtcaggatggtcgcacctgttgcttagacggcttccgcctgctgctcttcgatctcgctgcgtccagcatcgattgcggcactcccattaaccggcacctcagcggcagcgacggaaggcgagctcgcggcgccgttcacctgcacctcaccagcagcctcggacgtgtcgctagacggttgcttcgtaagggacttctgttagacggatggcggccgccgcttccggcatggcgacacctggaggctgaggggggacccactggcgctgaggcggcggcctttccacaacaccgccgccgtacgccagcggcctcggctcctctgcgtggaaatcaggggccttcccgttctggtggtacgagggggcatagttgtcctgagcttgagagtacgatccatcctcgctcaagtaggcgttggatctataagcaagcttttgctctgcgtgttgcagcatctccaatgcctcgtctgccattttggcggagattgcgattttctcacaccaaaaggctagtcagagtgggtctgataatgtccttgaccgtacaaaatcagcagacctgagaaattcctggaatatgctatctaatcagtacatggaagagcatgagcaatgcatacaaaagttacttcctccagaagaagcaaagtcagtagactacgatcaactatacaaaggtcttgaagtgctatcagaatttgagagacaggcaaattctagggttattgattccggtgtcttgaggggaatgaacttagatgatatcagaaaagctggggagcggcttattctgcaagatggttgtcgaaatttctttaagaagattggagagacaagggagaaggtcaatttagatatccatattctttcgtactgctggtgtgcagagcttattaggtcagccttttcatcagttggttgtcttgacggagtaaacatacattccaacgagtttacctttgagggatctgtttcaactggtcacatcaacagaaagatagagtctccactagacaaagttgagaagttcaaaatcatcaaaagtgacctggatagtataacaccatcgttgtctgtttatatcggggactcagttggagatttgctttgcttgttggaagcagatgttggcattgttgttggatcaagcacaaccttgcggagagtgggcaaacagtttggtgtttcttttgttccgttgcttcctggtttggtagagaagcaaaggcggctctggaagcaagaagcatccatcttcaaggcgcgatctggagttcttcatacggtttctagctggtcagaggtacaggccttcattctgggaaatgattccaagctgattgttgctggctgcccttatcactctcttttcctttggcatcaagactggtaccagctcatgcaaatcagacgtgaaatccccgttgtggccattttatgaaagccacattgctattcacctcctatatgagtaccctgtgtcctgaaatggtttagtttgtatgatcaatgtgtcattgattacacttgagttgtctttccatttgggatcatttcttataatcgcgggagtggttcctgtactggcatcgctacagaacagagtggtatactgtcgccaggtgtttcccaggtgcaagcgtagagctgtttttggcaatgaaatttgagattgctatatgtttgtttgtttgactacatatccttatcctgggactgatcatagctgagatgattggaggcagaacattcaagatgtaaaatcacataggatgnataaacaaaatactcctctgtttcanagtanatatattgatgttttggaaccggtcggttttccaaagta

SEQ ID NO: 18721 - DNA, 537 bp, Triticum aestivum
  Clone ID: PAT_TA_18721
ccgcaccaggcctccccgggtctgcctgccctgaggacagggcgcccacctcgagcccgccgcggctcacaaggttcagacttcagatccggaatggcgtcgatctcgagcccgctgccggtggcctggtaccccgctctggccgtcctcacggtcgccgtcggcctcatgctcaccgcctccttcttcatttatgaagcgaccatatccacgcgcagccgaagcttagccaaggagctcaccaccgcagctgttgcttccgtttttctgggttttggatctcttttcgttctcctcgcaagtggtgtttatgtctgacaagggacttgcagcctatacctacatggacatccaagaatttctctaggggaaaggacatcaaagattgaaaattcgtgtttacatgtagtcttgtgtttagaagtttatttcaagttaaccctcacttctcatgttacatgacatattactattataatacaaatacagaacagaaagattgaagtgccaaaaaaaaatgcctgcaaaaaaaaaaaa

SEQ ID NO: 18722 - DNA, 346 bp, Triticum aestivum
  Clone ID: PAT_TA_18722
agtgaggggatatctctgcccctccccctctatagattgcgcctaaatacctctcgtcttagttttgccgatcgatcgatctgggtctgagcgctcagccgcagccgcctcgcttattttatcttcctccccccttccgttctcggaatccgtcctaggggaaactcgtccgcaagtcagtaagtcagtcagtcagtccgtgtgatggttaattttgctatgaattggtctctggtacccgtaccgtactctcagttgatgtttaaggtcgtgatgatgatggattattggtgatttttgtgtggtgatgatgaggagattgcaacagatctctgttttttggttt

SEQ ID NO: 18723 - DNA, 467 bp, Triticum aestivum
  Clone ID: PAT_TA_18723
cgatcgcgcaggcgccagggaaagagagagaaaaaaaacaaccagttcgtcggtagggtttcgggggctgcgatggcgatggaggctcggatgaaggggacggtcaagtggttcaacgacaccaaggggttcggcttcatcacccccgccgacggcagcgaggacctcttcgtgcaccagtcctccatcaaggccgacggcttccgctcgctggccgagggcgaggtggtcgagttcgccgtctcggagggcgacgacggccgcaccaaggccgtcgacgtcaccggccccgacggatccttcgtgcagggcggcgcgggcggcggcggtggcgggggcggcttcggatcccgcggcggcggcggatctcgcggcggcgggggcttcggcgcccgcggcggggacggatctggcgggtatggtggtgggtacggcggtggttgtggttgaggcttgtgccgtcttag

SEQ ID NO: 18724 - DNA, 1751 bp, Triticum aestivum
  Clone ID: PAT_TA_18724
cccacgcgtacgagaaccaccgctccaagctcccgctagccgctagctagctaatcaaccccaccggcgagacacgcgccagttgccatcgcttccctgatggagaagaagcaggcgagctacgggaagggcgcggccaggatggcgccgatggaggtgtcggtggaggccgggaacggcgccgagtccgactggcttgacgacgacgggcgcccgcgtcggacgggcacggtgtggacggcgagcgcccacatcatcaccgccgtcatcggctcgggcgtcctctcgctggcgtgggccatcgcccagctcggctgggcggcgggccccgccatcatgctcctgttcgcgctcgtcatctactacacctccacgctcctcgccgagtgctaccgctccggcgacccggagaccggcaagcgcaactacacctacatggacgccgtccgctcctacctcccgggcaccaaggtgaagctctgcggcgtcatccagtacgccaacctcgtgggcgtcgccatcggctacaccatcgccgcctccatcagcatgcgggcgatcgggagggcggactgcttccactaccacgacgtcaggggccgcagcgggaaggacgagtgcaagacccacgggtccgcccacgcgttcgcccacgcgtccgtgcagatcctcttctcgcagataccggacttcgaccagatatggtggctctccatcgttgccgccgtcatgtccttcacctactccaccatcgggctcggcctcggcatcgcgcagaccgtcgccaacggcatccagggcagcctcaccggtctcagcgtcggcccgggcgtgacctccatgcagaaggtgtggcgcagcctccaggccttcggcaacatcgccttcgcatactcctactccatcatcctcatcgaaatccaggacacggtgaaggcgccgccgccgtcggaggcgaaggtgatgcagaaggcgacggggataagcgtggcgacgacgacggtgttctacatgctgtgcgggtgcatggggtacgcggcgttcggcgacgcggcgcccgacaacctgctcacggggttcggcttctacgagcccttctggctgctggacgtcgccaacgccgccatcgtgctgcacctcgtcggcgcctaccaggtcttctgccagcccctcttcgccttcgtcgagaagtgggcggcggcgaggtggcccgacagcgccttcatcgcccgggagctccgcgtggggccattcgccatcagcgtcttccggctcacctggcgcacggccttcgtctgcctcaccaccgtcgtctccatgctgctccccttcttcggcgacgtcgtggggctcctcggcgccgtcgccttctggccgctcaccgtctacttccccgtcgagatgtacatcgtgcagcgcggcgtgcggcgggggagcacgcggtgggtttgcctcaagatgctcagcgccgcctgcctcgtcgtgtccgtcgccgccgccgccgggtccattgccgacgtcatcggcgagctcaaggagtaccggccgttcagcggctgagcgatatttgtgtaggatggtgggtagcacagcggcacatgggagcacatgtgtacgtacggattgtgtgctgcatggagacggaaacaaattaccgttaccaacctgtgtgaacttttatcaagtagcacctcgtagatacttgtatttccgttgcaaaggacttctttcatgcatatcgttgcaccctt

SEQ ID NO: 18725 - DNA, 650 bp, Triticum aestivum
  unsure (1)..(650): unsure at all n locations
  Clone ID: PAT_TA_18725
tggggcctgcttcaagtgcggggagcctggccacatggccagggactgctcggtcaacggccccgccggtggcggcggcggcggcggctgctacaagtgcggggagcaaggccacatcgccagggactgcttcaacgncggcgcgggcggaggagacggcggctacggcgggggcggcggcggcaactgctacaactgcggcgagccgggacacatcgcgagggactgccccaccagcaccggcttcggcgggggcggcggcggcgggaggttcggcggaggaggcggcggcggcaacgaccgctcctgctacaactgcggcgagcccggccacatctcccgcgactgcaccaagtgaggggatatctctgcccctcccccctctatagattgcgcctaaatacctctcgtcttagttttgccgatcgatcgatctgggcccaagcgcccagcttcagccgcctcgcttattttatcttcctccccccttccgttctcggagtccgtcctagggaaaagtcagtcagtcagtcagtccgtgtgatggttaattttgctatgaattggtctctggtacccgtaccgtactctcagttgatgtttaaggtcgtgatgatgatggattattggtgatttttgtggtgatgatg

SEQ ID NO: 18726 - DNA, 944 bp, Triticum aestivum
  Clone ID: PAT_TA_18726
aaaaggacatcaaccggtcagccaatcaaggaattaatccccaagaaggcaaccaattttcaagggcggggaaacaatcctaggggaatacccatcacaccaacaatttgaatttttgcaaaaaggaaatcgacatcaaaccggcccaccgggggatctccaaacaagatgggtccagccagactggcagagaactgcccaagaagcttcatcagtacttaacgctacaacgctcgccggaggccagagcgccgccgacgccgacgccacccttcggcttgaccggaaccgtgagccagcaccaaatcctcggcttctggcggatcttgatgctggcgaacctgtagcgcacccgcgcatccacgtccacctcaaagctcacggcccccgcgcccgcccccctcgctagctccccggcgacgtcgccggggacgccgacgccgccgctcccgtcgaactccagcctgaccgtgtcggcgctcttcctgcgctgcaggaactccgccggggaggaggcgacgcgggcagcggggccgccgaggggggcgccgccgccgccggcgcggagctcggcgtcgagcgcgtcgtagtagatgggcacgcggaggctggggttgtagagctcgagcccgacggtgaggcggtaggagacggtggcgttgtcgcgggccacggtgaggttggcgagcgtggcggagctgaccgtcgcgcggatgtggtgcggctggaagatggcccagtagatgaggatgacgaagccggcggcgacgaggaaggtgaacaggctgccgcagcaggatctctcgcggtgggtgctgtcggacatggcgggcgggcgggcggcggaggaggaggtcgttggtgggtcaacggggaggggaggagcagaggcgcgcgggtgggtgcgtgtgcgaggctgtggcgagcctcgaggcctctttgtc

SEQ ID NO: 18727 - DNA, 976 bp, Triticum aestivum
  Clone ID: PAT_TA_18727
tctctgccaccacaccgatctagggtttcctgctagggttttagtccttcgtttccggcggcggcgcaagatgggtgagagactgaagggtaccgtgaagtggttcaacgtgaccaaggggttcggcttcatctccccggaggacggcagcgaggacctcttcgtccaccagtccgccatcaaggccgacggctaccgcagcctcaacgagaacgacgtcgtcgagttcgaggtcatcaccggcgacgacgggcgcaccaaggccaccgacgtcaccgcaccaggaggaggtgcgctcgccggcggctcccgccctagcgaaggcggtggtgaccgcgggggtcgcggcggcggtggctacggtggaggcggctatggcggtggcggcggcggctacggaggtggcggcggtggctacggcggcggtggcggcagctacggcggcggtggcggctacggaggtggtggtggcggcggccgctacggaggaggcagcggtggcggccgtgagtgctacaagtgcggcgaggagggccacatctccagggactgcccccagggcggcggtggcggtggtggtggctacggaggcggtggcggccgtggcggtggtggtggcggtggcggctgcttctcctgcggcgagtccggccacttctcgcgcgagtgccccaacaagaccaactaggcggcgctgcccgtcagatctgagttccccgttccccttcgctccttttcctaccgcctgactctgcagcaagtcatacctatacctatcagtattagtatatgtcgccgtagtgttcccgtgcttctcgtaggaagaagaatcgacgatgcgagcttggttccagaagtattgttggtggattattgttcgttcgaagttatcttgtcgtgtcgtctgatgtggacagactgatctatctctatgtattggatggaccgaagttatgcaagtctaagttatgctgtc

SEQ ID NO: 18728 - DNA, 1185 bp, Triticum aestivum
  Clone ID: PAT_TA_18728
gccggccgggatccggactgaaaaggagaaaaaaaaacctcttcccacgcgtccccgcggacgtggggtttcctgctagggttttggtccttcgttttcggcggcgcaagatgggggagagggtcaagggaaccgtgaagtggttcaacgtcaccaaggggttcggcttcatctccccggacgacggcggcgaggaccttttcgtccaccagtccgccatcaagtccgacggctaccgcagcctcaacgagaacgacgccgtcgagttcgagatcatcaccggcgacgacggacgcaccaaggcctccgacgtcaccgcaccaggaggaggggcgctctccggcggctcccgccctggcgaaggcggtggtgaccgcgggggccgcggcggctatggaggcggcggcggtggctacggcggtggcggtggtggctacggaggcggtggtggcggctacggcggcggtggtggcggctacggtggcggtggctatggaggcggcggtggcggcggccgtgggtgctacaagtgcggcgaagatggccacatctccagggactgcccccagggcggcggtggcggcggcggctacggcggtggtggctacggaggtggcggcggcggcggccgtgagtgctacaagtgcggcgaggagggccacatctccagggactgcccccagggcggcggcggcggcggtctacggaggcggtggcggccgtggcggtggcggcggcggtggcggctgcttctcctgcggcgagtctggccacttctcccgcgagtgccccaacaaggcccactaggcggcgcagctcgtcagatctgagtgccccgtttcccttcgctcctttacctacctcctgattctgcagcaagtcataccctatacctatcagtactagtattagtcgccgtagcgtttccccctgctgctcgatgcgagcttggttccagaagaattgctggtggtgtgttcgttaagatccaagttattttgctgtctctctgtgatgaggacacagatctatctatgtgttggatggactaagttatcgaagtcaagtttggtgtcttgagattgatctatgatcttgcatgtctattgtttatcttgcatatctgccaggcttgaaagtgttgattctgatattctattctagcttagtggtggattattttgg

SEQ ID NO: 18729 - DNA, 1950 bp, Triticum aestivum
  unsure (1)..(1950): unsure at all n locations
  Clone ID: PAT_TA_18729
gcatcacgccacgcgaccgagccggggtttgctgcgccggccgccgagcgatagggttcctgctagtcgttttagcccgtcggttgagggggcgacgcgagcggtgggatggctctacgtgggtaaccgtgacggggtccaccgcgtccaggggggcggggaggagcctcccggccgcccttccgccagaagctccgcgcccccgccaggcgcacaccgaggccggagggcgaccagccgccgccgaggcagcggcgaaccccggcgccgacgggcgcaccgccgccccccacccggccggggccgggcccggcgcaccggtccccgccagccgacggcggggaccacggcggggggcgcggcgggccccggcgcgccgccccgggccacgggtgtcggcgcagggggttggtccggcggtggcggcggcgcagggggggggagaggggcaggcggaaccggtgaagtggttcgacgtcgccaaggggttcgggctgcatctcccgggaggacggcagcgaggacctcttcgtccagcagtccgccatcaagtccgacggctaccgcaggccccaacgcgaacgacgccgtcgagttcgaggtcatcaccggcgacgacggtcgcaccaaggccgtccgatgtcaccgcaccatggaggaggggcggtccccggcgtgctcccggccctggcgatgggcggtgggggccccggtggggggggccgctggcgggcttgcggtggcgggtgggctagggcgcggcgggcgcttgggcgctaggcggccccccgtctgccgggcaggtgcccgctccaggcccatggaggccgtcggactcttgccgatcggcgtggccctgcgtggatgcactcctgtccctgcctcgcattgccacaacactacaggagctgcccctagctcggcgacggttgcggcggctacgcctgtgcttccgatggtagaggcgtggttggctgccgcgagggttagatgggggtgtatgagggccgtgtcttcattggttggccccagggcggttgtggtggcggcggatgttgcggctacggaggtggtgttggctgtggaggtgacggcggcggtggcggcatgcttctcctagcggcgaagtccggccacttctcccgcgagtgccccaacaaggcccactaggcggcacagctcttcagatctgagtgccccgtttaccctcgctcctttacctacctcctgattctgcagcaagtcataccctatacctatcagtactagtattagtcgccgtagcgtttccccctgctgctcgatccgagcttggttccagaagaattgctggtggtgtgttcgtcgttaagatccaagttattttgttgtctctctgtgatgaggacacagatctatctatgtgttggatggactaagttatcgaagtcaactttggtttctttacattgtgcacagcggagtgcgccgggggagcacgcggtgggtttgcctcaagatgctcagcgccgcctgcctcgtcgtgtccgtcgccgccgcggccgggtccatagccgacgtcatcggcgagctcaaggagtaccggccgttcagcggctgagcgatatttgtgtaggatggtgggtagcacagcggcacatgggagcacatgtgtacgtacggattgtgtgctgcatggagatggaaacaaattaccattaccaacctttgtgaacttctatcaagtagcacctcgtagatacttgtatcctcgtagcatacggttcggttcactcacgagcttgtatacgtgtttgaagtgtttgttcttgttcattgcgtaccccgtgttgtaatgatgatgacatatatgggaaaaacatcggagctgtccattttaaaaaaaaggagccccgtaaaaaaaaaaaaaanaaaaaaaanaaaanaaaaaanaaaaaaaaaaaaaaaann

SEQ ID NO: 18730 - DNA, 1237 bp, Triticum aestivum
  Clone ID: PAT_TA_18730
attcggcaccgtcgcgttgcaacgtacaaacaaacgctgctttcagaagaagggttcttccttctccactccttcaatcccgtcacacgagtccgacggcgacgacgacttgagggagaaggcgaagaggaaggaaggcggactcgagaggttcgacggggattttgttgctcgtccggcggattcccagcgatcgaccgatccccgccggcggatggggcaggcgttccgcaaactgttcgatgccttcttcggcaacagcgagatgagggtcgtgatgcttgggctggatgcagcgggcaagaccaccatcctgtacaagctgcacatcggggaggtcctctcgactgtccctacgattgggttcaatgttgagaaagttcagtacaagaacgtgctgtttacagtgtgggatgttggtggccaggagaagttgaggcccttgtggagacattactttaataacacagatggcttgatctacgtggttgattcattggatagggagagaattggaaaagccaaagcagagtttcagacaataatcaacgatcctttcatgcttaacagtgtcatattggtatttgccaataaacaagatatgaaaggggcgatgacaccaatggaggtgtgcgaaagccttggcctctatgatttgaagaaccgcgtctggcacatccaaggttcctgtgccctcaaaggtgatggtctttatgagggcttggactggctgtcaagtactctgaaggatctgcaagcgtccggtcgcctaccctcaggagggacctaacagttctaagtagcacttctgcttataagatcctaatgctcatactaacaacctttggatgagagatgacaccagaaagaaagaagaagatactggtgaggaacaccttatagccacatatccagttttcgtgataagcttcggtgttgattctgctgaagaaaagaccttgcttgggtctgaccgcatcaaatttacctgtacaatcttgtcatggatagtgtggattctctaattcgtgacatatttcatgtaaattttcctgtgagtttagagaagctaaccatcttatgcttttgttcacatatgaggagtggaacataatgttattgatgtaaattttctgtaagataattttggcatgatacaatttatgccacacccctctaacaacaaaccagactttgtcgtagtttcagactataaaaaaaaaaaaaaaaaaattag

SEQ ID NO: 18731 - DNA, 721 bp, Triticum aestivum
  unsure (1)..(721): unsure at all n locations
  Clone ID: PAT_TA_18731
cgtccgcggacgcgtggggtctgaaagtgtagattcaaaagtatttgattcatgggagtggattgaacgagaatatgtactagttcaggcgaacactacttccatggagttgctgtcttcacttgagaaaccaatgaaggatgtcacaggtgcaagaccccgctgtgatgatatatccactatcagtgggcctgtgcagagtcaaaacagagactcactctatagagtgaaatcccatggatgtactccactgtccgcttcccgtgagtcaactactatggaaaatctgcgagggaggccacttgattgttatacaaggcttcacctactgaatcagtatattgtcattctcacagaacttgctcaggagaagctttttaaagggctggacctggaggcactatcacttgaacttgtgatacttgctatctggaaagaggcgcttaatgcatgtagcttattgccggatgctttagatgatggaagtttttcgacatttgcacacgagaattactttcctaagagtgatcagcgtctatcccagaatgtagcgcatggattggatttcactaggctggcttctgttcgttactgggttgaaagtgggttcatcaaggcatatgaccgtgctgagaagatatcacataggttgcgggagaacaatgataacactgagatgccagacgcaatggagatcatattccaaactgctntagtatat

SEQ ID NO: 18732 - DNA, 549 bp, Triticum aestivum
  Clone ID: PAT_TA_18732
ccgtccggctcagcccagccaacccgccctccctccttgcctttccttcccacacacgcggtcggacgccccctttccctcctcactctcgcctcgccatccctccccaccggcgacggacgagcccctcccgctacgccgactccctcgctgccgccgccggatcaccgctcttcctcctcccgggcgtgcgtcggcggatctacgcgcgcggcgcggggaccccgcctcttcgtcggcggccccaccggcaccccctccccgggcacgggcccttgctgtatagtggagccattgctgctatttcatcacattcagagtgagccctggtaaagttgcgtccaaatgtcgaccgcgaaagtggtggatcctgctttccaaggggctggccaaaaagttgggatagaaatatggcggattgaagattttaagccagttgcattgccaaaatctgattatggtaaattctattctggagattcatatatagttttgcagacaacttttcctaagggtggtgcatatctgttcgacggccacttctggatt

SEQ ID NO: 18733 - DNA, 584 bp, Triticum aestivum
  unsure (1)..(584): unsure at all n locations
  Clone ID: PAT_TA_18733
ggtttttcggaattcacgagattaatgtctcacggaagcattttcttccaatagggtagtacaaagagatcactaacaaattccaccatcatatatacaccaatactctagtgcaagcttagtgaggagtaccaaatatcaccaacagactcataattaatggcccaagaaacttcatggccattgacgattaggatctactgcagaaagaagcacgtctacaaaagttttcatggctaatggcgattagggtctactaatggtacaaagaagcaagtctgcagaaaatttctttttcctctgaaaacttgcatctgttgggatcactcacaaccatcagcagaatcggtactgtacctccttgcagaattctccgggcaccttctcttcttagcttcgtctcaacagaactgtgatggtgctttcctgtccgcctggtacgccctccagagactgagaacgagagctgggatcacaacgcaagctgtcgcgtctcgcgtgtataccaaatgtccccacatcctcgattacagaaccgaccatttccccctgagatatcgatccctccacatgtgncgacatca

SEQ ID NO: 18734 - DNA, 416 bp, Triticum aestivum
  unsure (1)..(416): unsure at all n locations
  Clone ID: PAT_TA_18734
cggcgcaagttttcgggtcatggctgactatccacgtccgagtccaccttcagatcgtggagctgttgtgctgtttaactgaactttccttgtcaacaaacaacaggtctcttgggactttcccttgtcgtggagtactagtcgaaacttcttactcttccctttcccttttttttccaatccaatcctcaatactcacggataaccaacctggccgtagctttaggtgagatgtagcaaaagtactacttggtttaacacagtatatcagacaaaatagcagatcgcttcttctcgtaacttgccgcaatgcctgatcatctaaaaacttgaggagactattaatcttgccttggtttctaatgacagaaattgacccggattcgacggatcatatggtcgtancaacgctcaac

SEQ ID NO: 18735 - DNA, 1011 bp, Triticum aestivum
  unsure (1)..(1011): unsure at all n locations
  Clone ID: PAT_TA_18735
gagatactgcaaagcttgaccacccgtttcttcccaccctgtattcttatttcacgacagataatctgtcttgcctagtcatggaatattgtccaggcggtgatctgcatgtcctaaggcagaagcaaccggccaggtgtttttcagaagccgctgctaggttcgtccgcgctgaagttctcctagcattggagtatctgcatatgttgggggttatatatcgtgatctgaagcctgagaacatacttgttcgtgaagatgggcacatcatgctctccgactttgatctgtccctgaggtgttcagttaatcccatgcttgtgaggtgctcatcggtaggaagagatgaacctcctaggccttccggaccttgtgcagaaagctgcatcgatccactgtgtatccagccatcctgggccaactcttcttgcttcacacctcggctggtatcttccacaccttccaggacacggagagctgagcctgtgaagaaaccatcacttccgcagcttgtcgtcgaaccaaccgatgcaaggtcaaattcatttgtggggacccatgaataccttgccccgggagatcatcaagaggagatggccatggcagctcggtcgattggtggactcctggcatctttcctggtatgaattgctcctacggcaagacaccattcaaggggacctgggcaatgatgaaacacttacaaaatgtggtctcacaggggctgaagttccctgatagcccanctgtcagctaccaagctcnccgatctgatnaagaaggttgctccgtgaangagcaagagctccgggtaggctcnaagaaaggactgccgagatnaagcggnncccttcctccaanggctgaaatgggccttgatcgttggacnnaccgccganacccgaagaacgtcaacnctcaacctcacgcacgtggacgaagaaaaggaggaattccccanttcgganaatggngacaaatganttgccctcaggggngganacattaang

SEQ ID NO: 18736 - DNA, 1052 bp, Triticum aestivum
  Clone ID: PAT_TA_18736
gcacttacggcctcgccgtcgactggcgcgtcgtcgtcttgaccctccgcgggttctccttggagaggggaggaaggggggaggcgatgggcggcgcgatctccgtcggcgcagcggcgacggggcacttcccggtgggcctccgactggcgcgcgtccccggtacccctttgcgggatctgatcggccaggggaggaagggggtagggtttgggcaaagcgatgtccggcggcgcagcggcgacgggggagtacccggtggttctcaacgtgtacgacctcacgccgctaaacaactacgtccactggtgcgggctcggcatcttccactccgccgtcgaagtccatggatcggagtacagttttggagctcatgaccttccaacaagtgggctttttgaggttgaaccaaagagctgcccaggcttcttgtacagatcttcaattttcataggccgtacaagtctacatcccttggaaatttcgagatttcattcagagaatggccccggagtatcaatggggatacataccacctcatttccaagaattgtgaccacttcactgatgacctccacacccgttcggcaggttcgcccagtgctggttcaattgtccggcttgcccaccggggtgcgttgcccaactgccttctaccagaaagtatgcggttggactcaactgagacaaagaacctcacggactaccattttctctgatgattccaacttcaaccatcaatgacaactttgacgatgatgacattgaagacaaacacttgctttccgaatcttctgtcagtgaaaatgcaattgtaaaggaagtccacaggtgaaagttgcttaagccatgcagaatagttcagtgtgcagtttatcattcattttgtacattgtaatttctgtattccgaaatgtaacatgcccattctattgtatttaagtattgtacatacattcaatggcgggtttggtgtcctggtttcttctcattccttgtacaatacagtaataccatactgccctccctaactaaaaaaaaaaaaaaaaaaa

SEQ ID NO: 18737 - DNA, 461 bp, Triticum aestivum
  Clone ID: PAT_TA_18737
tgcgtccgtccgccaccatcttcctcctgctgcctgaccacccatcgttgctcctcctcttcctctcctcttctccatccacctcaccacccaagtgttgctctcctgttcttggcaacggtggctggccagagccacatcccagctgccagcatcggtgtgctttctggctacggctggggcggcggtggcctgctcgtcggcgcactggggccaaggcggagcctcctcccgtgcagtggtggtggtggagcccctcctcccggagggtggctggggcaaccggggttgcggggcaggtgtgcaattggctcggttgcgccagatctggcggccggccagcacacacgggggcggtctggtggtgctgctcttctgccggtggccacggatgtgggagtgccgaagctacctccggtgaaagcccccgggccctggttttctcttccatgagctggtct

SEQ ID NO: 18738 - DNA, 1263 bp, Triticum aestivum
  unsure (1)..(1263): unsure at all n locations
  Clone ID: PAT_TA_18738
cgtccgcccacgcgtccgcccacgcgtccgcggacgcgtgggcccttaagagagctgatatgctgaaactcacaagcttactatcctttgatcacatctctcttgcaaaatttgatttgaagcatgtccaaagaccgttggtgtcctttggccctaatggttctacaaagcttagaacatgtcctgcagatgtctgcaagaatttaagattaagttcccatgtgctgtccgactttggcgcagatggcttatcaatttcgagtgataatggtagtttcagcacctcatggcttaagaatctgtctgatgcttccagttcttggtgtagtagctcaacaaagcctagaaaatttattacaaatgactttgacaatttccactttcatgcacaaccaagttcaatacctacatcagtattgcaattagctggctcagcatatttgatgagggccactgcctgggagcactatggaagtgctccgatggttcgaatgaatacgctggtctatgcaacctgctttgctgatgctgcaagttcatcagagctgtcactggcatatgtcaagctaattgaacagttagcagtcttcaaaggatattcagcggcattctgtgcgctcaagcttgccgaagagaagttcccatcctcgacgaattcgcagatccaccttctcaaaatgcaattgctacatgagcgtgccctgcatcgaggacacctgagaatcgcgcaacaaatcggtgatgaatttggggtgctctcatcttctgtcagtggagtagacattgagctaaagactgaagctagtctacggcgtgcccgcacgttactcgctgcaaaacagtttagccaggcagcagctgtggcgaattcccttttcactacatgctacaagtacaacatgcaagtagagaatgcaagtgtccttttgttacttgccgaaatacatagaaagtccgacaacgcggtccttggcctcccttacgcattagccagccaatcgttttgcaaatcgtttaatttggatctgcttgaagcttcagccacacttactctcgctgaactgtggctagctcttggatcaacacgcgaagagggcttaagtctgtttatcaaagccttccaagatcctggcatggcggtctgaactgctgctcgtccagtatctagcaaaatgtcattaactgatcagaattcagtttcgaaatcctgtgcgtccggacctcnaacaagcggngaaatngcaggtttaatacaananangg

SEQ ID NO: 18739 - DNA, 1217 bp, Triticum aestivum
  Clone ID: PAT_TA_18739
ggagaaaggcggcaaaccggcgctatatatcgttcagtacactaccgagcacgttcaattggagatctgtaggctttactgtcactcagcaagtgaagcccctcagctcatctgatcagaatcttcaggtttcgctctccatatcggcgaagacgaacggtcagtacgcgacggtgaatgtgagaattccgtcgtgggcatctgcgaatggtgcgcaagcaactttgaatgacaaagatttgcaaatggcatctccaggaaccttcctctcagtcaccaagcagtgggggagtggtgatcacctcacactccagctgcctattagcctgaggacagaagctataaaagatgatcggccggagtatgcgactctccaagcagtcctcttcgggccattcctcctcgccggcctcacgaccggagactgggacgcgaaggccggcggcgccgccgtctcggaatggatcacccctgtcccggcatcgtacaactcccagctggtgacgctgacgcaggaatccggcaacggcaccttggtcctctccctcctctcgaccgccaaagccacctccctgacgatgcagccgcaccccgagggtggcgggaccgacgccgccgtgcacgccacgttccgtctggtcccccagggcaggtcgccccgccgacgggcgagcggcgccacgccaccaacggcaccgccgccacggcgacgcttgcatccgcgctgatcgagccgtttgacatgccgggaatggcagtctccaacaacctgacgctggcggcagagaagggcccgagctctctgttcaacgtcgtccctgggctcgacagggcgcccggatcagtctccctcgagctcgcggccaggccggggtgctttctgatccccgccggcgcgaaggcgaatgttcaggtcggctgtggcccggggttttccctgcaggcggcgagcttcgcacgggccgagccgctgcggcggtaccatccgatcagtttcgccgccaggggggcgaggaggagcttcctcctggagccgttgttcacgctgagggacgagttttaccccgtctacttcaacgtcggcgcctgacaaatgaactagtctagtctggttttactgaataactcgtcagtaggaaactgaaaaattcagttgtttttcatttgtatgaacggataagaatcttctgattctgcgaatgaagtttggcacacgg

SEQ ID NO: 18740 - DNA, 538 bp, Triticum aestivum
  Clone ID: PAT_TA_18740
cgtccggcgcggccgaaaccgaaacattaaataaaacagaaaggggagcgcgtctggcagcagagtcggcgggaggcggcggcggggaaaggggagcgatgccggtggcaaggccggagccgcaggagccgcgggtgatcgcccacctcgacctcgactgcttctacgtccaagtggagcagaggaggaacccggcgctcagggggcagccgacggccgtggtgcagtacaacgactggaaaggcggcggtctgatcgcggtgagctacgaggcccgcaagttcggcgtcaagaggtctatgcgtggggatgaggccaagaatgtctgcccaggtataaacttagtccaggttcccgtgtcccgtgacaaggccgacctcaatgtgtaccgaaatgccggctccgaggtcgtagcgattctttcgaccaaggggaagtgtgagcgagcatccattgacgaagtctatctcgaccttactgatgcagccaaagaaatgcttttggaatccccttcggagtcgtccgagtttacttttga

SEQ ID NO: 18741 - DNA, 1184 bp, Triticum aestivum
  Clone ID: PAT_TA_18741
ccaagcgtacagcccccccccccgctggccggagccaaatggcgctgctatcgccaccctccgccccgcccctgctcacgccagctcgccaccgcctcgcctctccccatctcctcgccatcccggcgtcaccgagctctctcctctccctcccccaccaccaccacagcctcctcctcccctgcgctgccaacgcctggccgccccgtcggcaccgtcgccgcggcggcatagccgcgtcgctcgggcaggaagagcctggagtctccgacgccccccatcacctccgaaggagagttcggagagggcgactccgagctgccgatcaacttcgatgcagaggcaggcgcggtcgcggtttccgccgagccgccggcggacgccagcctcgaggacttggagaacatacgcgagatcaaaagggtgctggagcttcttcagaagaacagggacatgaccttcggcgaggttaagttgactatcatgattgaggaccctagagatgtagaaaggaagagattgctaggcatagaggatcctgacgaacttaccagggatgatttagctgatgctttggttgaggttaatgaaggacgtcttccagagaatcgtgatactcttaggttgcttgccaaggagatggcagaatggcccgatgttgatgtaaagatagaaagtcaaaagggcaagggcttctttggcagatctgtctatgcaaaggccacagatactggcattgatcctgtggcagctgctaaaagacttaacatcgactgggattctgctgctgatatagatgaaggagaggatgaggatgaagaagatgaagttccttcagcagtgggatatggtgctctgtatctgttgacagcttttcctgtcattattggaatatcagttgtgctgatccttttctacaactctctacagtagcatctgctcacctttgtttctggagaagatgccgcctttttcttgtaaagccgagttacaacgctgctgaatgagcacccctttcttcgtctcatagtaaaatagtttctgcaatggtatgacaacattgtaaagccctgaggttgtacactacacgaaaaaggaaaaggtcttgaagtattggctttttctaggaaactgaaagttgattaagaaaaacaagggaacccagtcaacggaaaaagcggcgc

SEQ ID NO: 18742 - DNA, 1068 bp, Triticum aestivum
  unsure (1)..(1068): unsure at all n locations
  Clone ID: PAT_TA_18742
ttcctcctcctccccctccttcccctcgacctgctggtgaccgccgtctgccttctccgacgaatctccccgcgagttcggcctagctccacagggagtctcgaatctcccctttgccgctgagtcgaggaagaagatcggctcgggttcgcttgctcgttcgctcgaggacgagattcagcggcgggactgattgattgattgggcgcgagcgagagcggatgaaggggaagggcggggcgctcgacaggaggtcgtctgcgaggtggaggctgctgctgctctgcgccttcagcttcgggctcggcatgctcttcaccaaccgcttctggacagcaccaaataccaataaccacatcatgtcccaacacaggagacaagaccaggagttgcaacttgtgtcagaggattgcaatacaaagaggaagcatggggagcacaaggatataatgggagaggtaaccaggacccatgaagccatacaattgttggataagtcaatctcaacgctgcagatggagcttgcagcaaagcgaagcacgttggaactggtccgttctggtgtgccagtaacttcagaaactagtcaatcaaggaaaaaagcattcgttgtcgttggagttaacaccgctttcagtagccgcaagcgtcgtgattcagtcagggagacatggatgcctcaaggtgagaagctgctgcagcttgaagaacagaagggaatagttatacgccttcactataggccatagtgctacatccaatagtatattggacaaagcaatagatgcagaagatgcacaacatcatgactttcttaagactggaccatgtccaggggtatcatgaactctcccgcaaagacaaaaatctccttctccaacggccgtgggcatttgggatgctgacttcttcgtcaaggtccatgatgatgtgcatgtgaacttaggagcgcctgccacctcccttgcgtggcgcaaaccgggaccatgggctgatattgcgcgccatgctgccaggccctcttcttcctgacctaggctgaanttggagcganaatttttccagcac

SEQ ID NO: 18743 - DNA, 1179 bp, Triticum aestivum
  Clone ID: PAT_TA_18743
cgtccgcgccgcaaggttctatgccgcggaggtgctccttgcgctggagtacctgcacatgctcggggtggtgtaccgcgacctgaagccggagaacgtgctggtcagggacgacggccacgtcatgctctccgacttcgacctctccctccgctgcgccgcctcgacgacgctggtccggccgtcgctgccctgcagcgcctccggccccaacggcggcgcctgcatccagcccacgtgcttcatgcccaagctcttcggcggccggagcagcaagaagagcgcctccgcggcctccagatcgaagagcggcgagcagcagcagggcgccatgccggagctcgtcgtggagccgaccggcgcgcggtccatgtcgttcgtgggcacgcacgagtacctggcgccggagatcatcaagggggagggccacggcagcgcggtggactggtggaccttcggcgtgttcctgcacgagctcatgtacggcaagacgccgttcaaggggcagacgaaccgggccacgctgttcaacgtcgtcggccagcagctccggttcccggagggcggcccgccgacgagctgcgccagcaaggacctcatcaggggcctgctggccaaggagccccagggccggctcggcgtgaagaggggggcggccgagatcaagcagcaccccttcttcgaggggtgtcaactgggcgctcatccggtgcagcacgccgcccggcgtgcccaggcccgtggagcccatcgccttcgcagcaatgccggcgaagtcggcgtccatggacagggtggagacgaattacaacagcagcaagagggtgccagcagggccaggggcagaccatgtggagtctggagggaaattcctccgactttgagttcttttagttagggaatttggagtttgtagcctgaaaaattgccgtggtctgagcctgtatcactgaaaatgtgtctcttgtccttttaaccttagacagtacttgctgtgggtctgagctgcagctgtagctccgtagtgtcagtattttggcaatgacatacatgaccagttttattgaatcttgtagctttcctgagcttgtataacatgttaatcaggcctcgtgccaaacatggggattttcaagtgaaattcatgcattccaaagaatgccagatattatttcatgc

SEQ ID NO: 18744 - DNA, 264 bp, Triticum aestivum
  Clone ID: PAT_TA_18744
gaggaggatgaagacgacgacgaggatgaagatgacgaggaagaggatgaagatgagtagtaagaaagagcttcatgtcctgctcctgccacaccaagggagcaggaagagcgtctattagcttgtcgatttgccagccttgtcttggtgttgttgttctcccgagtgcactcttttgatttctgtgtatcaatgtatgtttggtgtatctcctcctcgggttgcaagtgtattgctcgcatctggctattaatgtttgtattg

SEQ ID NO: 18745 - DNA, 668 bp, Triticum aestivum
  unsure (1)..(668): unsure at all n locations
  Clone ID: PAT_TA_18745
ggaatcgagcctcccaggaaggcaggaaacgcaggctagggttggccgccgcccgccgcccgcgccggcgaacctccaccctccgcccaggcttttgagggattctagctgcagaagaaacctggtgggtgatatgagcggcgaggcaggcaataggaaggaggaagccaggaagacaggtttggagggcaccggactgccccttccaggtggctcccatggcagcgtgcgatgcgctggcagcgacccgcagttgagacacatgcttgattccctcaaatcctccaaggcttctgctgtgatcaactatggggcctcatggtgcggtgtttgcaatcagattcttccacccttctgcaaattcagcaacgaattcaagaatcttactttcgtctatgcccatgttgatgagtgccctgaaacaactcagaacatacgatacactccgaccttccatttctaccgggatggagaaagggtagatgagatgtttggtgcaggggaagagaggctacgggatcggttgtggttgcattcgtgatttctaggctttggcttgcagtgatgctgttttcatgtacttagttatgcactgtacctcggatttatccttttctgaaagtcttgtttgacgngaaaggaagggcaatgttaaacnancagcgtgt

SEQ ID NO: 18746 - DNA, 1002 bp, Triticum aestivum
  unsure (1)..(1002): unsure at all n locations
  Clone ID: PAT_TA_18746
cgtccggcggcgtcgccgacgcgctcgtgcagggcggggtcatcggcttcgccggggagctccccgagcgctacatgcaggctgtcgtcgccggaaccgccgcttcaggtgtacttgtctcagcacttcgagtgatcacaaaagcgagcttccctcgggaccccaatgggctaaggcaaagcgcaatcctgtacttcatggttggcatggtggtcatgatcatctgcatagtgtgctacaacgtggcgcgcaggcttcccgtcgtggtgtactacaagaacatcaagcagagggctcagaaggcggaggtgggtggtggcatgacggggcctgcctggaggtcgaccctgtggagcatcgtcgggacagtgaagtggtacgggataggagtagttctcatctatgcagtcaccctgtccatatttccggggttcatcacggaggacgtgcactcggaggcgctcaaggactggtacccaatcatgctcatcagcgcatacaacgtgtttgatctcatcggcaagtgcctgccggccatctacctcctgcagaactccaatgttgcggttgccggttcgttcgcgaggctcctgttctatcctctcttctatggctgcctgcacggacccagctacttccgcaccgagatcccggtcaccgtgctgacgtgccttctcgggctcaccaatgggtacctgacctccgtgctcatgatcctcgcgcccaaggccgtgcccatacaccactccgagaccgcggggatcgtcatagtgctgttccttgtggttgggctggtcgtcggttcgtttgtcgcttggttttgggtcatctgaatgcatggccatctgccgatgtatttcatatctgtgtaccatagcacgatgtttcttgctgatgcttcattttgccctccccgccgtaggtaagttgtctcttctgcgcgctgtgcggttgttcctttctttaaagagacacgtcaatanaatcctcaaaaaaaaaaaa

SEQ ID NO: 18747 - DNA, 875 bp, Triticum aestivum
  unsure (1)..(875): unsure at all n locations
  Clone ID: PAT_TA_18747
cggggaccctgcgtcccccatcctgcgccgcaattcgcccgagcgacttcgcgcgactcctttcgctccctcctcctcctccggattgcggcgcgacggtggccgtgagcccgcggtgctcctactcctcctccccggcctcgcgcccacacccgggcgcccacctcgggcgacccagcccgccgcgccgcggctgcgtagtcgacttagatgaggcgggccagaatcttgtctgagatgcgttttctggcagggccggtcatgtagttgacctacacataccacgtgacaaaggagctgggcgtccctttggtttccgctgagtacgagccggcggcaattggccagaatccacttatccgtttgtcagtagtggttttccacaatgtggtatctctcaaggttaccctctttacactggtcaccctctagcataaccgccttgatccagtcatgcccacccagaactcggtaacgttacctatgcagcctcaggtcatgcatttgagtctgtcccttgtgctgcctatgccggctttgttgtgaatgctgttggtcatggagctatgaggcaaccaattatttacccatcctactaggcagtaggcaccaaagagcgggagcgggtataaaaagtatgcaggttaaatgtagcttcttagttccttgaattctcagtagcatcttgtttgtacccttgcacttcatttccatgcatgtatatagggctggtatatccgttttatcaacagtaagttggcaacggaaggctctgcccagtacattgtacaccctttgtacttgtctagaagatagcctgctagatctgttctcttcctngaaaataaagaaatgcaatagcgggggctgttgca

SEQ ID NO: 18748 - DNA, 518 bp, Triticum aestivum
  Clone ID: PAT_TA_18748
cgggatccatcgcctacaactggtccaggcccggcatgaagaccagcgtcaagctcatccacgccaggcttcatgctcaggccctcaccctggctgccttgggttgttctgcactggtggagtactatgatcaccagtcaggatcagggtcaaaagttcacgactatgcaaagcagttccttccgtcggacagaaacgccaaaaaggactctgtgtagaagaggcagcaaattatgatataggcttccattagctgatatggaattcgttgatgttattttctgagcaaacaatctggcatttcacatgccgttatccaagttctgcaggcttcctgttctccgtataagctactgaaccagcatctagatgcagccgtatgcaaatccgtggtgatggaaatatgtactttcctgaaccgcgcatgaatgaaatgtaatgaatgaaatgtttctctcttactactgatggagtaaaccaacccgacgagttggtgtgcagaagcttctgctcaaggc

SEQ ID NO: 18749 - DNA, 695 bp, Triticum aestivum
  Clone ID: PAT_TA_18749
cgtccgcggacgcgtgggcgcggaccgcggtatcgtgccggcaacagactcatttcccccgccccgccccccacccacagagccccaaacccttttcccctcttcttctactactactccccccaccccacccagcccaccgtcgcagaagcacacgcgcagacagattggaaccggagagctcgatctgatagcagaagctttcgaatcccttttggcggaaggaatggcggaggagaaggggacgctgcaggcgatgaggggctgggtcgtggaccacaagctgcgggccgtagggacgctgtggctcacggggatcgcgggatccatcgcctacaactggtccaggcccggcatgaagaccagcgtcaagctcatccacgccaggcttcatgctcaggccctcaccctggctgccttgggttgttctgcgctggtggagtactatgatcaccagtcaggctcagggtcaaaagttcacgactatgcgaagcagttccttccgtcggacagaaacgccaaagaggactctgtgtagaagaggcagcaaattatgatataggcttccattagctgatatggaattcgttgatgttactttctgagcaaaaacaatctggcatttcaaatgccgttatccaagttccgcaggcttcctgttctctgtaaaaaaaaaaaaaaaaacatctcctagc

SEQ ID NO: 18750 - DNA, 1015 bp, Triticum aestivum
  Clone ID: PAT_TA_18750
caaagcccttttcccctctacttctactcccccccgcgccattccccacccagcccaccgtcgcacaagcacacgcgcacacagaattggaaccggagaactccgtctgatagcagaagctttcgtttcctttcggcggaagtaatggcggaggagaaggggacgctgcaggcgatgagggggtgggtcgtggaccacaagctgcgggcccgtagggacgctgtggctcacggggatcgcgggatccatcgcctacaactggtccaggcccgggatgaagaccagcgtcaagctcatccacgccaggcttcacgctcaggccctcaccctggctgccttgggtcctggctgaagggctccgagtactttgtccaccagtcacgtccagggtcaacccgtcccatgactggataagggtgttcgtcgcggatcggaaactacgggccgcaaggacgctgtgggtcaaagggatcgcgagttccaacacctgctactggtccaggcccggcatgaacgaccaggcgtcaatctcatacaagccaggcttcattattcaagacgccaccatggtgctttgggtttgttctgcgcttgtggagtactatgatcaccacttcaggctccagggtcaaaagttcacgactatgcagaagcagttccttccgtcggacagaaacgccaaaaaggactctgtgtagaagaggcagcaagttatgatataggcttccattagctgatatggaattcgttgatgttactttctgagcaaaaacaatctggcatttcaaatgccgttatccaagttctgcaggcttcctgttctctgtataagctactgaaccagcatctagatgcagccgtatgcaaatccgtggtgatggaaatatgtacttatgtactttcctgaaccgtgcatgaatgtaatgaatgaaatgtttctctcttaagtatgaagtaaaccaatcagacgagtatgcagaagcttgctgaaaaaaaaaaaaagagcgcagcccta

SEQ ID NO: 18751 - DNA, 711 bp, Triticum aestivum
  Clone ID: PAT_TA_18751
gtcctgccaggggaggggcgcggcgtaccagttcgttatggctggcaggacggccgagaggttcagggaggttcagagcaagattgactcctacctaatcctcttcccggtgatcagccacatcggcataacacgccgccttgatcgaatctacaatgtacttgttcaagatggctccaccagagatgaaccgtctcgacttccacagtcgtcccagttgcaggagtctgcggaggttgttcaggaggtactatcgcaaggaatcaaggagttcacgttggcggagatcatagctgccaccaaaaacttcgcccatgacacaatgatgggttacggcagccatggaagggtgtacagggggaggcttcacgatggacgagaggtggccatcaaacgcatgtcagaaaacatacagctggaggacttccgcacggagcttgacgtcgtagcacagctacaacacaagcatatcatccacctccttggatggtgtgtgagcagtaagggcaagcgcctgctaacccggcgaacaaaggagttggagaggctggtcgtgtccgggtacgtggagaatggcacgctcttcgaccacctgcaccgaaatcaggccggctcctctatgccgtcaccggtgacgatgtcttggaagatgcgcatcgatgtgctcctccgtgtttcacaagcaatagagtacatgcactgtcattccaa

SEQ ID NO: 18752 - DNA, 1444 bp, Triticum aestivum
  Clone ID: PAT_TA_18752
ccctcgcgtccggccctaatttatttgtccccttcctcgtctacccgctagcttccacggctcgatttcctcctttgtttccaccactacgtacggcaataaaattccggcacgagctccgtcggattcgcctcccggtcgccgcgcggcgctcacccggacccactagttcgtccagtccggcgatcgctcggtgcggagtttctgggtggatcgccggcggattcgattcgattcgggcctccgggcatggagcgccgcgggttgctcaagacggctctactggcgtgcttgctcgtcgtctgctccgggagagtacctatggttatacaacagccatccactaccatatacaactcaacccttgccaagacactagtggaatatgctgctgccatctatactgctgatttgacacagttgtttacctggacatgtgatagatgcggtgacctgattgaggggtttgagatgatggacatcatcgtagatgtggagaactgcttagaggcatatgttggttttgctagtgatattaatgctgtcatcgttgtgtttagaggaactcaagaaaacagcatccagaactggatagaggacctgttatggaaacaacttgatcttgattaccctggcatgcctgaagcaatggtacaccgaggattttactctgcttatcataacacaaccatacgcgatggaatcgtcagcggtattcaaaagactcggaaattgcatggagatgttccaatcatggtcacagggcattcaatgggggcagctatggcttcattttgtgcacttgatcttgttgtgaactacgggttggatgatgtgaagctgatgacatttgggcaacctcgcgtcggcaatgctgcttttgcttcttacttcaagagatacttgcctcacgcgatccgagttactaatgcaaacgatatcgtccctcatctgccaccatacttctcgttcttccctcagaagacctaccatcactttccaagagaggtatgggtccatgatgtcgggctcgggagcctggtatacacggttgagcagatctgcgacgactccggcgaagacccggcatgcagcaggtctgtgagcggtaacagcattcaagatcacataacctacctgggcgtgagcatgcacgcggaggcctggagcagctgcaggatcgtcatggactacgccgagctgcggtacaagatggacctccatggaaacgtcgtcttgtcgaagcagcagcagcagcagcccggtctgtcggaccagcgaagaagacacagcgcccagtgaaaccaatgtaaagaagttgtgtgttatcatagtagcaccacgcacgcaacatgtccttccccactctgcttcattgtttctgcatccagagaggggataacaccaccacgctcgacaggaaaaagcttgctataaatgtttg

SEQ ID NO: 18753 - DNA, 566 bp, Triticum aestivum
  Clone ID: PAT_TA_18753
cgtccgcggacgcgtgggaagtttttgacattttttccacgtacgcatgcaggagggacagcttcatcacccaccgcgccttctgcgacgcgctggcccaggagagcgcgcggctgccgccgataggcgccggcatgtacggcggccctggcaacatggccctcggcaatctctccggcatggcgccccagatgcccagcggcttcccagaccaatccggccaccactcatcagcttcggccatcgacgtcctcaaccttggtggcggaagcggcaacgccggtcagttcgagcacctcatgccatcctcctcggggtcctccatgttccgctcccaggccgccaactcctccccgttctatatgggcggcggcgcagcgcaggactttgccgaggatgacgtccaccgttcccatggcaaccagggctctgtcctccagggaaagtctcccgcggccttccatggcctcatgcaacttccggaccagcaccagggaagcggcggcggcaacggcaataacaacctcctgaaccttggcttcttctcaggcaatggcaacgggagc

SEQ ID NO: 18754 - DNA, 443 bp, Triticum aestivum
  Clone ID: PAT_TA_18754
ggtcgacggggaaaccgaactggaggaaaaacactttttggataaccatcctaatgtatatttcaaacccttggtttattcaacgtctgggcagttcggttacatcaactcgaacatgatgtccttcgagcattggccctctatcaagcgggcaccctctaggacgtcctcaaaatagcgctctggcttgcggtggtccttgcctccgggtggaccctcaactgccacgatggcggccttcattttcgcccagtgcatcttgacacgggcaaaggccagccgcgcaccttctatacatgacgaccgcttgaccatgacaatttgggacagcgcgtcaacgagtcgctgcaccaggccaaaatagctgcttgcgacgggttcggctggccacagccggactatgacgtccctcatggccaatccggacaccctatgcagctcgg

SEQ ID NO: 18755 - DNA, 1693 bp, Triticum aestivum
  Clone ID: PAT_TA_18755
attcggcacgaggctactgatatgctctcagtgtcacagttcattcccgatctggatgttcctactcttatgttgggtgatatagtaatatccgtggaaacagctgcaaggcaagctgaggcgagaggccatacccttcttgatgaactgcggacactagtggttcgtggcctgttacgtcttctgggttttgaccgcgtccgcggacgcgtgggctgcaatggaattgagcctcatcactatgacattttaaaaagtctaaggtggaaagggaaaggtcttgctaagaacgctcctgatttgagcaagcctaacacataaacattggatggacaagtaacaaacagtctaaagagagctggcagcctgagattttatagaccaaaattcaaatatatcttctgtgatatggatggtacattgctcaacagtaaaagtcaagtaacagcaaggaatgcagaagctctaaaggaagctaggtcaagaggagtaaacatagttattgccacaggaaagacgcgcccagctgccattgatgctcttaatatggttgatttatctggaagaaatggcattgtttcagaatcttcgtctggtatatttcttcaggggctgttggtttatggtttggaaggagagaaatttatagaaatacattgaaccaagaagtatgccgagaggcattcttatattctttggagcacaaggtaccattagtagcatttagccaggatcggtgtttttctatgtttgagcatccattggttgattctctccatgatgtgtaccatgaacctaaggctgaaatagtggcatctattgatcagcttttaggaacagctgagatacagaaactagtgttcattggaacttctgagggagtttcttccacattgaggccatactggacaaaggcgataaaagaaagggctggtgttctccaggcacagcctgatatgcttgagcttgtaccacctgcaacttctaagggcaccgcggtgaagattttgctggaccatctttgcattagcccggacgaggtaatggcaattggagatggagaaaatgacatagaaatgctacagctagcatcactgggtgtcgctctggcaaacggcgccgagaagaccaaagcagtggcaaatgtaatcggtgccaccaacgacgaagatggagttgcacaggccatctatgactacgctttctaacagccactgacactactaaggcgcactgggacaggattgtcttcccacagtgttgttgccaaataacaagttttgttcaaacatctatcaccaagatgattcagggttgtgttcacagcacccgccaagagttttaacacttgaagcatcaggcagagctatttttttggttggcaatcagtgaagacacaccattcttttttccactgggaaatatttgtagttgtattccctatgatccatattacttgttgctcacttagtacaactttagtactggatcggcgggagtaaaacattcttccatctctgatacccaaaggaccgctctctgttttggccatgctactttgtactccttgttatgttgagaaataaccaggatggtcaaaggccatgtaccgtggctcagaattcagacccttatataatctttgttaatcgaaagaaaatgtttggtataaaaaaaaaaaaaaaaaaaaaaa

SEQ ID NO: 18756 - DNA, 1168 bp, Triticum aestivum
  unsure (1)..(1168): unsure at all n locations
  Clone ID: PAT_TA_18756
ccaactcctttccgtcgtctcaggaggcgccgccgccgccgggaacgccgtcgcggactccgcgccgccgcccgtcgagccggccatggccttctacccgccgccgccgctcgccttccggtacgccaacgccctcggcggggtcgccactggtgggaccgtctccttccagcagccggcccctggggtcggggccatcacctcccccacagccgcaccacaggccgtcggtgacaacaaggagagtgcctctaagagaaagagaggcgggcctggtggcttaaacaaagtttgtgcaatttcacctgaacttcatactgttgttggcgagactgccatgttgagaactcagattgtgaagcagttatgggcatatatcaggcagaataatcttcaggatcctgatgacaaagggaagattatatgcaatgatgaacttcgtatcgtttttggaaccgactccactgacatgtttaagatgaacaaattgttggccaagcacataactcctcttgacccagaagatcaaccttcggaagcaaaaaaggttaaggctgccactccagctcctcaacaaatgcctactataaatcaaaatcagccctacgtggttgtttctgatgcgctagccaaattccttggtgtagaaggaacggtgcctcatgatgatgccctcaagtacctttgggattacataaaagcaaatcagcttgaggatcctgcgagtgcatcaatactatgtgattccagtctgcaagagctgttcggctgcgagagcattccagcttcaggattatcagacttgcttgctcaccatttcatccaaaggacatagcatatcctcattaactgatgtaggatcgcagcggtgccagataggcctaactttacagaaatggtgttcttacaaaatggacagcgtagctttgtgtatctccccggcgttccggattatggactgcgtcagacaaaagtcagattatttgtggtagcctgtaacttgccatgtgtgtgtattggctgccgcccagtatttggttggtgtaactcgtactgagttgttgttagctttagtttctgagtgtcaaagtgtctttactgactatgtaaagttatgctttatatctgagtgccagattgaattgaaaattagtttcctnataaaggt

SEQ ID NO: 18757 - DNA, 575 bp, Triticum aestivum
  Clone ID: PAT_TA_18757
cgtgcgctctcctccataatcatcgagttaatctcctcccctgggtggccgagttccactgatgggtcccaggaagtttctcttggccaccattagtaccgtatcagttcttctttacatgtttccgcacgccaattcggagtccgtagccctccctcccgaatcggcctatggcccagccgcagagagtccagacgcgggcgcgccggagctcagcccggggccgccgccgatggtatttgacgtcgacgactacggcgcgtcggccggcggcgacgccaccgaggcgtttctcgcggcatggaaggacgcctgcaactcctcctccgacccatccctgttcctcgtgcccgaggggaagacctacctcctcatgcccctcagcttcggcggcccctgcaggtctaccacgatcacagcaatgatcaggggaacactggaggcgccgtcgaaccggtcggtgtggctcgacggcgatcgccgggagcggtggatcacgttcgaggacgtcgacggcctgcacgtcatgggcggcgggacgctcaacgggcacgggcaggagtggtggatcaact

SEQ ID NO: 18758 - DNA, 1913 bp, Triticum aestivum
  unsure (1)..(1913): unsure at all n locations
  Clone ID: PAT_TA_18758
ggctgacactcccagctggcacccgctcgcagctaacataacagccacgtcaaagaaacagcaatggccgcggacagcccggacgccgccgccatggccgtcgcggtcaccggcacccgcacggtggcgccggccaagaccacggtcaccctcgccaccttcgacctgccctacatcaccttctactacaaccaggaagctgctcctctaccgcctcccgcagggcgccgccgacttccaggacgtcaccgcgcgcatggccgacgcgctcggggccgcgctcgcctacttctacccgctcgccggccggatccgccaggagaagggcgacggcggtgcgctgtacgtcgacggggaggacggcgcggagggcgtcgagggccgccgccgagggcgatctccgtggaccacgctcgcccggtcgagggactgccggcgaggaggcggagaagctcatgcagcagctaataccctacacccgcgtcatgaacctcggccggctccaccgcccgccgctcgcgggccagttcactaagctccaggatggcctgccccgtgggctgccccttcaaccacgccgtgctggacggcaccgccacgtggcacttcatgagctcctgggccgagctcggccgcggcgccgcggacctgtcgctcgaccggaacccacaaacgcgccatggcacgacgagtgctccccggcggtcgcggctgcctgatcgcgtgggcgcacgtgcatgcggtatttagtgagctcaaaaaaacaaagtcgtggcccttagcttctccttttcggagcccgtcgtggcccgcatcaaggccggcgccaacgcggcgctgcccccgggcgcgaagcccttctccgccttccagtccctgggcgcccacatctggcggtccgtctcgcgcgcgcgcgagctgggccccgccgacatcaccgtcttcgccgtgttcgccgactgccggacccgcctcgacccgccggtgccggcgacgtacttcggcaacctcatccaggcggtgttcacgggcgtgccggcggggatgctactgggcggccccccggagctggcggcggggatgctgcagaaggccatcggcgagcacgacccccccccccggacgcccgggctggacgcgtacgaggcggcgcccaagctgttccactacagcgacgccgggcccaactgcgtggccgtgggcagctcgccgcgcttccgcgtgtacgacgtggacttcgggttcggcaggccggagcgcgtccgcagcggcggcaacaacaagttcgacgggatggtgtacctgtacccgggccgcggcggcgacagcggcggcatcgacgtggagctggcgctgcagccggagcccatgcagaggctcgagaaggacgaggagttcctgcagatcgcggctgcatgatcgcctgcgcgtcgctgcctgcgttatttagtgagcttaattaagcaaaggtttgtgatttagccagcttcgttaattcgatcttcttcactagtgcatgtgtgtttgcttgttactgctgcggatctgttccggttaaataaggatcgatcgattagtttgtgtaagatcaccatcctatttctcgtgtcatgtcacacaaatagtcatgtaatgtactagtagtatgtgatccgcctacaggatttgcatatttgtttgcacgtactcggctcatcccttctgaattaaaactactgtgttccttttttaaaaaaaaaaaaaaaaaatacgcgcgcgcgcgccccgcgcccactccgctgactggaaaacctgggtancaactaatcgcctgaagaaaccccttcgcaactgggtaatacaaaagccgacgatgccttcaanattccancctgatgnnatggacccccttcgggataaccgnggnttggtac

SEQ ID NO: 18759 - DNA, 778 bp, Triticum aestivum
  Clone ID: PAT_TA_18759
attcggacgaggcctccctccgtctggatccacgatgggacagcccggtgatgcagttcggcatgcgcacgcgtgcagcacggttggggcagcgaggcagctcgtgtagttcccttcagttccgttcgagtgccagatcctcccgaagcaaccgaggcgcacttcctcctctccgcagcggaggcgcacccctaccttcgcgcgaccatcaacggcgacccttcccgcgcgggttccggcatcgatccgtggcttacggccgcggacgccgtcccaaccccttcttcttcgagtagcacacaatgcaccgggaccccgcctccgtcgccgcgttcttgctgacggaggattggttcaccaggaccagcccggctaggtggagttccagctcagccttgtctcattcccgagctcgtgcgccagatccaaccttgacagagctccaaccagcaccgtcgctgtccaagccggcgactgcgactctgcacacaggcgtgtagttctgcccatggggaagtgcagctcggccaacgggggcgtgcagttcggcccacatcgtcgaccgcttccacgactacgattctgcacacgacgcatgcagctcaaccaacgggagcgtgcagttcggcccatggcatcggtggcttttcggcgaactagcgtctgcacggctagttcccttgtactctgcacacgtcgataattttttatgaggggttcattgtgtatgttgcagaggtcaggcgtccacatatgcgcgtacagttgagcacggcgc

SEQ ID NO: 18760 - DNA, 967 bp, Triticum aestivum
  Clone ID: PAT_TA_18760
gcgccccctcctcccccagcgcccaccgcctcgccggtggccgcccccgtccaccgcccccccgcccgccagttcgttcagggagatgtcgtccaggcgcgagaacgggtcggacggcgaggggctcggagccgagggaggcgtgcctccgtcgcctctctacgccgcccccgtcgtctgcctcctccggcccgccggggacttaggcgccggcgccttcgttggaggcgtcgttggatacgggcaaggtttgatcactaagaagggcttcaagggctcactcaccaatgcaggctctgctgccaagacttttgcagttatctccggcgtccagagttttattgtgtgcttattgaaaaagctacgcggaaaagatgatcttgtcaattctggcattgctggatgttgcactggccttgccttcagctttccaggaacacccccagccatgcttcagagcggcgccaccttcgcagcgttcttttgcatgctggaggggctggacaagcagcaggctgcaatggcccacacgctcggcggaaacgctctgacctttgggcacgggaaaggcggcgtcctcccccctttcacgctaccaccaatcctcgacgcatcagatgctctagcttcatgctgccagaccttagtgaagcccaagcactaggcaacatcatggggagagaaagagagagagagagagatgatcagtaaaaaccttagcaccagacttccttagcgtatggaaattcgtttctggacttgtcaagagtgtgtagttttgcttccttgccagtctttttcttgatgcgttctgcagcatgtgctcctttgacatggcagataaaaatcctgaaaaaccttcgcattttgttctcctgttaacatctgagacatggttttgtgacaagtacctcggccgcgaccacgctacagtcttccccctctgaaaaaaaaaaaaaaaaaaaaa

SEQ ID NO: 18761 - DNA, 792 bp, Triticum aestivum
  Clone ID: PAT_TA_18761
gggatcttccaatagagcgcctggttccgcctatttgcacaggtgatgtgctgtcagcggaatatgtcagctctgcacctacatctcgaccaactgaatgttacaggaaacggaaatgctttcagaaccatgcttcgaccaaagactgcaaggctgaagaacctttaagaggcaaatgttcattgaccagaagctgagtcacacttatctgcagatctcaatgccctgttcatgttatctaaataaccctggagtatgcaaactgcagcaaatttatctgtcattgttttggtctcaactggatcatttagtttcagaggatttaaaagggcttctacgcactttgaggtaaaattttcatcccaatatgtgtagctcaaatcatcaagtttcccagttttacaaagttctcctacaagaaggcttacttgtgatgcatctggagaagattgaccctgtaggttgaatggataacccacaacaagcccagcaagggaatagttttcaaccagtgttttgaaatcatctgccatcaaattaatgtttgtctttgtcctacccaagacacttagaggcaaggcaatcctgtttttctgatcagaaactgccagcccaacgtacttactaccaacatcgagcccgagaagccgaggctgcttcttggacccaccctcaagcaatttccggaacaactcctccgctttcctcggccccattgtcctcctcccctactgaagggacgaggcgagtgtgtggtgagccgggagggagcggcgccctgggatgccggag

SEQ ID NO: 18762 - DNA, 810 bp, Triticum aestivum
  Clone ID: PAT_TA_18762
gtgcttgctgtctttcttcgcttcattttccattgcttcctttatttttgccgaccccctcccaacccaccgcttaagcaccccagcacggccgcaagactggccctttctataaaccactttccctaacaaatgttttcggcccagttataaccaatcttcaagtttcgtgcgcccgtgatgtcctacaaaacgtgttcgtagaaatcttgcaatcaccacacttcgagatcccacggctcataattggtacgcagcaacacccgccacgatgatgacgaacaccgagagcatgaaggactccttcactgcatcgctgtacagatcgggcttgtcttcgtcgctttgagggtggaagagcatgctgacaatcttcgctatattatcgaagaattccgttatttttgcctgggtgttggccaggatccacttaagcactacagcagggccacaagagtttccctttctattaacttctttgccatcctggaaagatctcctgaattcttgcactgcctcgttattcattacagcatcccatacagtcctgtcacaggaccgggacataaccattttctgaacattagggtctctttgcaatagacggaaggcatccaaaacattcctatgctccctggtcagaagagcagtagagttgagaacatatgcagcaggttcgacccaatcgtctgatcctgatgaattggttgatgaggaatgctctgagttggacagcagtgctagttgtttctcagtttcatctgaattcacatcataataagaaccctcaaacacctccggggcgcgagc

SEQ ID NO: 18763 - DNA, 1137 bp, Triticum aestivum
  Clone ID: PAT_TA_18763
cgtccgcggacgcgtgggtttttttactataccggcagcttaatttacttgatttgtgcacgtctaaaacagccggtacaaggaactaaagcactagtatatcatcatactagtagtatgtacaaccctatttacatcggtctatttgtctacttgcacgtaagcggaacatacgtacatacatgacccaccagcaacttcctcgtgtctgctatgtacacgtaaccgctagacctagaaaagaaaagaagacctacttaatttacaaactagcccctgtaccgtcccgtattcacacaagcattccgtccgacacgcgtcctcctcctccggtccttcaggagcaggagcaggatctgatcagcccaaggttgtagagattcttcttcaccaggctgccgagcgagaacaggccggcgcctgcgccgccgccgccgccggcgtccccctccgtcgagcacaggcggggccaccgctcctcgtccacccggaggctctcggtgccgaccccgtggatgacctcgtcgatggtcttggggtcggcggggcggccggccacgtcggtgacgtggaagacgttcaccgccatgtcgccccgggtggtgatctcggcgtgcgtgaccgagaggctgttctcccggaacacgcgcgtcacgtaggccagcagcccgcgccggtcggagatgcgcagctccagcctcacgccctcggacgcgcgcctctcgatcgccgcttgcaggcgttggatcacccgctgcctctcgccctccgagctgatcgcccgcccgtccagccgccggatgtagaactcctgctgcgcgtgatcgccgtcggtgtcgaaggtgccgtggtacaccacgtagtccaggtccgtcaaggtgcagacgacgtcgaacagcagcttcggccggtcgcggcagctcacggtcaccaccgagtacccccgttccccccactcctgcaccgccaccgccgtcgccgtcgtcgccggcccctccgcgggggcccggcggtcggcatccctgtcctcgctcagcagctggtggagcctccggtccaggttgccgaccgccgccgcgtcgagcaggaccgtcctcgcgccgcgcgcgccgccccggaggacgtgcctgagccggg

SEQ ID NO: 18764 - DNA, 1181 bp, Triticum aestivum
  Clone ID: PAT_TA_18764
cgtccgccacgcgtccgcggacgcgccggcgacgatcgacctgctccgatcggatcggctcggcgagcggcggcgagcgatcgaggccgggattgggaatggaggtggcgccggatctgagcgccgtgtcggcgctggcgctgcaggtggacctcctacagctgccgccggagatccccgcgccgggggcgcccgcgctgcgcggcgtcctcgaccacctcttcgcgcactctctgtccctccccgacacggtcgcggtggtcagctgcctggcccagaaggccaaggccaacggcgcgggcttcgccgggggcgccatgttgccgtccatgatgatgcaggggggcgccaacgtgccgccgctctcgccgaggtcgccccgccgctctaggaagcccagcggggtcggcggacactccaaccgttgcgcgtccccgctccggccggccaccgcgcgcgccgtcaaggaggtcattccacagttctatttccgagatggacgcccgctgccatacgagcagaagaggcaatgcatatctatagtcgagcagctcttcgccgggcactccaatggtcttcggattcaagaatttcggatggttaccagggagctctgcaaactaccgtcgttctttaccactgttctttttggaaagatcgataaggataacactgaatttgtctcaagggatgcctttatggatttctgggtgaatagcaatatgatgactatggacagtgcaacccaagtatttacgattttgaagcaaccagatcatgattacctcacaaaggaagatttcaaaccagttcttcgagaccttttggacaaccatcctggcctggaattcttaaagagcacgccggaatttcaggaaagatatgctgagactgtcgtatataggatattttattgcttgaatcgaattggaaatggccttctcagtctgagggagctgaaacgtggaaatctgcttgattcgctgcggcatgctgatgatgaagaggatatcaataaagttttaaggtatttctcatatgagcatttctatgtgatatactgcaagttctgggaactcgatacggaccacgatttctttattgacaaagaaaatcttattaagtatggaaaccatgcgttgacatataggattgtagatagattcttcttggggtttcca

SEQ ID NO: 18765 - DNA, 837 bp, Triticum aestivum
  unsure (1)..(837): unsure at all n locations
  Clone ID: PAT_TA_18765
gccattacaggacaacttcaaaagacccgtcggatgctcttcaacttggacggtgcaacattgccaggtgacgttagcatgtcacaagtgcgatcatttgcaaattggagaggctccctgaatatacctcctctggtagaattcaagtatcttcgagtttttattgctgactttacttctagttctgaagatgacaaccggaaaatcgacctgacaggactgtgtaagttatatcagctgcgacatatatggattcgtggctgtagtaagtaccagctaccaacccaaattagtgggttacagatgttggaaacattcgatatagatgggtcctgtatcccaatggatatttttctcctgccacagttgttgaatctgcatgttccatttgttcaaaggctgcccgagggcattggtaaaatgagatccctacaacgtccgcggacgcgtgggcttcacaattcacttgacagtatgaagggcctaggagagctcaccaatctgatcactctatctctcgtaaccggtttctctgaagatgtggacatggatgttctaagctcttctttgggaaaactctgtaacctcgagtttctgctcatattatcaccttggatacctgaggcactaaccctggtcgccttcccnccccccccccaaccttgtgacactcgacatgaatagaagctgccacgtccctaacttggattggggaactccataacctccagaccttggatctcgttgttgagaagctggacagggatggtgttggtattcttgcggggttaccagccctcatcgacctgaatttaacgtttgatagtgccctggaag

SEQ ID NO: 18766 - DNA, 770 bp, Triticum aestivum
  Clone ID: PAT_TA_18766
cgcccgctctggtccggcaccgcctcgccatttcgtcgaacacgtggtagtgcgtcgcaccggcccttccgcaatggcctccttcctcgccgcccgccgcctcctctcccctgccgccgcccggcgcctcctcccatgcacttccccgccgcctcctgcccccgctgctctctgctggctgtccaccgacgcctcgcccccaccgcctcttcccgtcccccctctggagcccacagtcgaccctcccaagaaggatggagcctccttctccgccggttccggcgctggaggggcctaccggactggacagggagctgcatcggggggtcgccgatctggtggcgcggggtacgaggaggagcagcagaaggtcctccgcgcgtcgcttctccacgtgccgaggatgggatggagcgagtcggccatgatcgcgggtgcgagggacgtggccgtgtcgccggccatcgttggtgccttcccaaggaaggaggctgcgctagttgagtttttcatggatgactgccttcaacaactcatggatcgcgttgatgctggtgagggagagcttttgaaaaaacttgatgctcactgagagactatctaggcttgttcggatgaggcttgagatgcagacaccttacatatcaaagtggcctcaagcgctgagcattcagtcccaaccagcaaatgtctcaacatgcttaaagcaaagagcagtccttgttgatgagattaggcaatgctgttgagatgctggatcagatatttga

SEQ ID NO: 18767 - DNA, 1003 bp, Triticum aestivum
  unsure (1)..(1003): unsure at all n locations
  Clone ID: PAT_TA_18767
gcaggcgccggttctgaggcatcctctttcttcttccggtcttctccttcttcctgcggtcttctccccctgactgcatccaactgcacgagatctgaagcatcgactcatgaacggaggaggtagcgcgacgcccttctcccgcaccaccaccaccctcagcaccacttcttcttcgaccttgcaagcaggtgagtcgggacaaggggacagggaagctgctattcaagccgagatggccagggttaacaacctgccagccaatagttcctacgcgattcaccgcatcaaggtgctgaacaaacttcgccatcttttatctataaagaggaccacatctcaggatgaggagcttgaactccttttctcaagcctttcaatttaaagtttatcctcagtatctacatgtactaggtgatgtcactgtttcggtgtatctaatcatcgattgcccccgcctgtccagtgtagcatatattcccaatggttatcaagtttgaaggaatcactttttattcaaagtgctagggaacttgatgagttgataaatgatgtgttctcttgaacggaattcctagcgggggtgaaatttatcatgtgcatgtaatgtttttgacccaaattgggggctgccataactctagccatatggtgatgcatagaacaccagctcaatagttatgttatcaagcatcactggttttgctattgtgacagtaaaggatgcatacctggacccctacagaatatgataatttggtctctattgtggaagcatcaaggactctgggaagcaggggaaagttcagctgccttgtttgatattttgagtggatacattttggtaaacctggaatgcagtatgtttctgactagtctggcaccaaaaagcacttctattattgtgctcctacatgtttaagcccgtagttgtaaactagtgggcttccgaaacggatcctgtttgaattacnnatgatgttaggtaggcatgtgtgttttt

SEQ ID NO: 18768 - DNA, 437 bp, Triticum aestivum
  Clone ID: PAT_TA_18768
gacccacgcgtccggtacatggtatctttccaaatccgtcaagcccatttctggacatttccctgtggggaaaatgccatttctgtcactagccattttaggcagtttgcatatttgtgtaattgtggggatttttctacagagaccccaacatattatatatgtttttgggctagaaaatccaattaatccattggttatatccatttcatcatctgagcaagtttgcacacatgtcattttacatcatgttgttgttttgtcattaatgtggataattatgcaaaggtgctatgtgttagttttgcacatgaacatgctcttcataatgccacttgctgatagaattaattgtctgccatgatatgacttgtgtagagttaaacaaagcttgtaacatgctaccatgaatctgtttctgccatgccatgaaattt

SEQ ID NO: 18769 - DNA, 1394 bp, Triticum aestivum
  unsure (1)..(1394): unsure at all n locations
  Clone ID: PAT_TA_18769
gcgggggacctacccaagctccgctccaccccaagctccagtccaccgccgctgtgccctagaactgccgccgcgcccgccctcgtcgctggcgccctccctgtctcgtagcgtccctgctctcttccccccacgcgcaatcttgaacttcggttttgagatccgcccctgctgtcggttgcaggtttgcagagggctcgtcgacatgtcttgggcgccaatcgagaatgaccctggtgtttttacggagctgttgcaacagttgcaattgaagggtctccaagttgatgaactctactcacttgatcttgatgccctcaatgatcttcagccaatttatgggcttatagttctgtacaaatggcgacctccagaaaaagatgagcgccctgttatcaaggatgcagtcccaaatctgttctttgctaatcagataattaacagtgcatgtgcaacccaagctattgtttctgttctgttgaactcttctggcatcacccttagcgaggacctaaaaaagctcaaggagtttgcaaaggacatgccgccagagctcaaaggattggctatagtgaattgtgaaagcattcgtatgaccagtaactcatttgcaaagtcagatgactactctgaggaacagaaatccaaggatgatgatgtctaccatttcattagctatgttcctgttgacggcgtcctgtatgagcttgatggactaaaggaaggaccgattagcctgggaaaatgcccaggtggtattggggagatggggtggctgaagatggtacagcctgtcatccaggaacgcgttgataagttcgctcagaatgagataaggttcagtgtcatggctatcacaaagaaccggaaggaaattttcatcatggagctcaaggaacttcagaggaagagggagaacctcttatcacaaatgggcgatccttctgccaatcggcaaaggccatccattgagcggtcactcgcagaggttgctgctcagattgaggctgtgaccgagaagatcataatggaggaagagaaggcaaagaagtggaagacagagaacatcaggaggaagcacaactacgtgcctttcttgttcaatttcctcaagatcctcgaggagaagcagcaactgaagcccctgatagagaaggcgaaacagaattctcacagccgtaaccctaagtgaaacctgcgttgtaaaattttatcgtacttggttgttttggttttgtgtagagatggctgactggctttgtttcctagctgaatgggccttgtagttctagtcctagacaggccatatatccgataccgtcctggtttactcatgcagatacttaaaactttcatgtagggggaacaccctnactccttaccagaattatatg

SEQ ID NO: 18770 - DNA, 1487 bp, Triticum aestivum
  unsure (1)..(1487): unsure at all n locations
  Clone ID: PAT_TA_18770
atgacccaaggaggctcttttactcagatctgaaggacgacaatgctctagactgtattgtctccaaagtgtcaattgtgcaagtttctccttgtgttgataaccagtcaaagtcaattccttcatcccaatattactatgacatgaagtactctcaggactacagcacattctctacctttgaaatggaagatacacatgctaaattgcaatcaagtcaagtaagtagtatcagtatgaaaaaggaagacttcaataagacgcaaaagtctcatgtgccaaataagaaggagctctctttgttagatctgtaccgtggtcgcggccgcgtcgcccccggccgcggcctcggggctcgtggtggcggtgtgaatcttgtgacgagatgggctgttgatgatgatgaagttgcatgtgaaagcttcagaatgaatcatccagaaactcgggtccgcaacgaaactaccgatgatttccttgaattgctgaaagaatggcaaaagttatgcaaacaatatgtgaaggaaagtgaagtacaggacaatgctgacgctataacagaatttggtaatgggactccagatgattctgcagtccctcctgaagagcttgaagtatggaagttagttgatatttgtttcggtgatcccagtaatgtcagaaagcgctgcttatattttaaggtccgttggaagggttatggccctaatgatgacacgtgggagccaattgaaggattagggaactgcaatgacgcaattaaggattttgttattgaaggtcataagcgaaagatactaccacttcctggtgctgttgatgtcgtatgtgggtggtccaccatgccaaggcattagtggctacaaccgcaatagagaatttgatgaaccatttaacgttggcccacgcgtccgcggacgcgtgggtatggatatcatgcaatttttgaggcccaaatacgtctacatggaaaacgtccttgatatattgaaatttgctgatgcaacacttgcaaaatatgctctaagtcgcctaattggtatgcattaccaagccaaactagggatcatggctgctggatgttacggccttccacaatttaggatgcgtgtatttttattgggctgtcatcctgaagagaaattgcccccatttcctctgcctacacatggagcgattgtgaagaataatggcccattggcttttgagcgtaatttggttgggtggtctgacagcacatcagtacaactagagaagccaattgtccttgaagacattctttcagatcttccaaaagtgggaaatgcagaagatcgtgatgaaatgccatatgtaaagggccctcaaacggaattccaaagatacattcggacatttagttctgaagtgcagggtcccaaatctcatgccgcanaagctaagtcaaaaaaatctaagccaaaattgtatgaccaatcggccgttggccactggtcatgataactact

SEQ ID NO: 18771 - DNA, 966 bp, Triticum aestivum
  Clone ID: PAT_TA_18771
ccccccctagcccacccccgcgcccctgggcttctcccggcccctgggcgtccgccgcggcgcctcacccctcaacctctcgcgcgcgtcgccgccatagtcgttcccgttctacctcagcgcgtcgctgcccgtccgcgattaaccactgtcttccgaggcgatcaggccaaagatctagggtccggaaacttcaatacattgctgatcttgaaagaactgttgactctcttcagaacatgggagctgatttggctgtaagagtagcatctcatttccagcttcgcaatgctctatcaatggaaaacaagcaactgaggagacagattgctagtcttcagcaggcaaaactaatgaaggatggtcaaacacatttcttgaagaaggaaactgagaggttgaagcagatctctgcgcgtcaccgcaggagcaggagtgtcacttcttgctttgagccgggctcaattggagcagacccatcagcaatcaattggcagacagttgacatgtcaaagctgagcttaaacggcagtcctgctcctgtgcccccgagaggtggctatggcctgtaaaagcaacctgctttggtcccactgagatgagatcgcggcagtaatcctcagatgtggttaacgattcactaacctgaccaaccatatagattcgagggtttaatcctttattaggaagaaaaagtagtcagtccagttaccaccaaaaatatacagaggtcgtcagttaagcttatcttttgtaggatttctgcattggcttccgaattttaacacaaatcagatgaagcaagcttgagctttgcttgtcactagtgtttgaggtcttagaaatcgatgtttctctatgttactgcaacttaagcgtcctgatcttcccattagcgtggtgactcgtccgggtcctgatcttccggttagtggtgatttggtcgccaaaaaagaaaaaaaaaaa

SEQ ID NO: 18772 - DNA, 746 bp, Triticum aestivum
  Clone ID: PAT_TA_18772
ctcctggatgtccttatcacatatagaatacagaaagttgtaattctttagatcaaaaaccttgtaggtactatcatgtgcagaaaaagtcaatactttgccattaacatcatcaaactcaaacaaaaggccgggttatttcagcggattcggtttcaaataaaggaaatccattcttgtagctgccctctccgggatgtattctattggagttgttctgcactttcagtgaactgtaacgatctgattcttaaactgaaacagtgataagtgagtcgttgttcttattatagaacagactccttaatcacctcatccgggcttatattcaaatggcatatgcgcttgttcgttgtgcgattgaatgcaccacaaagaccacattcggcgagtgcaaatatcaaatctcttgcagctacaatctcaataatcctccttctgttccacgccaatggcagctggacaaacggatcgtcatatgtgtcgtattcttcctgcagctcgaagttgcgggacttactcccggcacgcggtggcccctcctcccggtttcccggcatgtgaaacaattctgcataaaataaactattttatgtttacttggtatagactatagacagactataaaatatgctggatcaagctttgtgaggccatggaacccttctccatatgtatccatttacgttgtaactcatccagttcatgattggcacgtttaactggtatctatattacctactaat

SEQ ID NO: 18773 - DNA, 1025 bp, Triticum aestivum
  Clone ID: PAT_TA_18773
cccacgcgtccggatccgctcgcccctctcccgatccatcctcctcccccggccgcccaatccggccgccgccgcccggattcgcgcggattcggccgcggactcgcgctccccggggtcggaaaccctatatccaccgccgccgccaccatgttctggcgcatgaccggtctctccgcggcctcacccgtggatacaatcctagacaaggaaaattttacacttgaagaacttcttgatgaggatgaaattattcaagagtgcaaagcactgaacacccgactcataaatttcctccgtgacaaggcccaggtggaacaattgcttcgttatgttgttgaagaagttccagatgacgctgaaaaaaagcgctctttcaagttccctttcattgcttgtgagatatttacttgtgaaatagatgtcattttgaggaccctagtagaggatgaagagttaatggatttgcttttctcatttgtgaaacctgatcatccacacagcacattattatctggttacttcagtaaggtggtaatttgtttgatgctgcggaagactgccccactaatgaattatgttcaggagcatccagagatcgttgtccaacttgtcgacctgattggcatcacatctgtaatggaggtgctgatacgcctgattggtgctgatgagaccatatattcaaactatgctgatacaatgcagtggttagaaaatacagatgttcttggaatgatcgcagataagtttagttcatcggactctcctgaagtgcatgccaatgctgctgaaattctttgtgctgtgactcgatgtgcacctccatctctcgctgcaaagatatgcagtccaagttttgttgggaggttgttctgccatgctcttgaaggatcaagacccaagtctgtgctggttcattcattgtcagtgtgcatatctttactggacccaaaaagattggcatcagcttcctatcaagcattcagaagcaacgtaagtcatggggcattggtcactgccag

SEQ ID NO: 18774 - DNA, 3043 bp, Triticum aestivum
  Clone ID: PAT_TA_18774
ccacccctcccagcccggggatagccccagtagaatcccgtcccgtttgctccgccccacccacgcgtccgaccccccgccagatcttctcgtcccgcgcgccccgctcccgatcctccctcctcccccggccgcccgccccgccccccgccgcccccgtgcgcgcggttgcggccgcggtctcgcccgccccggggtcggtgaccctgcagcccccgccgccgcctccagcctcgcgcgccgctccgggctctccgccgccgctcccgtggatgcggccctaggctcgcttgatcgtgctcttgaggatctccttgttgaggacgaatctgctcaggtgggcatagctcccctcccccggcgcgttgatcccctccgtgccctcgccccggtggcgcattggctcccgtttgttggtgagggaggtcccgatgaccctgtagctgcccccgctccctcgtcctcacccaactctgaggaggcttcccctgacgccatggaagccgatgttggtgccgcagttggcactgaggatctaatggaaactttgggtcttggaaatggtcctgctcaagaggccgaagatgctgcagaatgtacctcccagacgaagttgagcactgagaatgagcaactagaaagtgcagaaggtactgagcggcatctggatgtttcatttcatggtactgaagctagcacagacgaagctgcctctgaagcagctgaatcttcagtctcagctactgagacacaggcagagagaacagttgataaaccagctggctcatctgatttggacaatcctatctctgaagcttcacccgatcctgatgtcaatgggagtgatttggctggctcggcattatcttctgagcaagctgtccgtaacgaagatgtggaggtaccgaccaagactgatgcagtcgtggatactgaaatgaaaactgatacagtcgtggaaactgatgcagtcggggatgttggagtgaaagctgatgcagtcgtggaggtaccaagcaaggaagtatctgccgtggatgttgaagctaaaactggcgcagcagaagcaaaagagtgaagtggcagcgtatctcatggactgaaatggcatagctgacgagcaattattagtcagacccctcagaagacaggcaatcatctttgcttcaagtgctcatcagccacaagcaacttcgaagcaaactgctgtacaataagcaagtgtactattttgccttccattgtggccaatcactgtacaaatgagcaccattgtctaactgcacgcgcacacttcatcagaaattggtcaatttgcttcaaaatttaccctccgtttcatggggaacaattggttgatgcttgatgcgaaatgtcatttggcggtagtctcgtgtcttgcgatatgtgaaaagcacaattctttttggatggcaactgttttgtctactttagtcttttgtctccgtctgaggtttgtggtggtcctctctgttttcctgtcggtttgttgttaatctgcttaacgtgagcctttcagccaatcggcaataaagcgctccattgacttattctttgagtacccgtataacaactttttgcaccatcatgtcgagaatataattgtttcttgcctggagggtaaaagaacagaacttgtcgaacatgttcttaatgaatgtgacattgttggtaaaattcttgctgccgacaagctttcttctttggcaacagagtctaatgggcctactgtgccgtctgaagggaaaaccccttcaaaaattgggaatgttggtcacatgacaagaatagccaataaactcattcagttgggaaatagtaacagcacaatccagactcacctgcagggtaacagtgagtgggttgaatggcagacagatgttctggtcaggcgaaatgaggtggagaatgtttatcattgggcttgtggacgcccaacctcgcttcatgaccgtggtagggatagtgatgatgatgacttccgagacagggattatgatgttgcagctctggccaataacttgagccaggcattccgctatgggatatacagcaatgatgacattgaagaggcacaagggtcacttgaacgtgatgatgaggatgtctattttgatgacgaatcagctgaggtggtaatatcttccctgcgcctgggagatgatccggacggttccctctttacaaattcgaattggttcacgtttgatggagagagaggtatcaatgaccgtttagctgcttctgttccttcgtcctctcccaactccgaggaggcttccccagacatcgaggaagctgatgatggtgaagcaattggcactgaggatcaaatggaaactttgggtcatggaaatggccctgctaaggaggcagaagatgctgcagaatgtaccaaacagacaaattttagcactgagaatgagcaactagaaagtgcagaaggtaccgagcggcatccagatgtttcaattggtcgtactgaagctagcacagacgaagctgcctctgaagcagctgaatcttcagccccagctactgagacacaggcagagagaacagttgataaaccagctgtctcatctgatttggacaatcctatctctgaagcttcacccgatcccgatgtcaatgtgagtgatttggctggctcggcattatcttctgagcaagctgtccgtcacgattatgtggaggtaccgatcaagactgatgcagttgtggatactgaaaacaaaactgatacagtcgtggaatctgaggcagtcggggatgttgggagtgaaggctgatgcaggcgtggacgtaccgggcaaggaagtatctgccgtggatgttgaagctaaaactggcgcagcagaagcaaaagagtgaattggcagcgtatctcatggactgaaatggcatagctgacgagcaattattagtcagacccctcagaagacaggcaatcatctttgcttcaagtgctcatcagccacaagcaacttcgaagcaaactgctgtacaataagcaagtgta

SEQ ID NO: 18775 - DNA, 687 bp, Triticum aestivum
  unsure (1)..(687): unsure at all n locations
  Clone ID: PAT_TA_18775
gcccgtcgcctcccaccgcctccagccccctatcgttccacccccgtcagcccctccagagctaacaaaattcgcttccaatccccttcctccgcgatcgcctccggtgcttccgacctcctcccgtcgcctccgtcgagctcgtttacgtcccctcctccgcccgtcctagactagctccaatgggtttcatccagagcaacttctcgctccttgtcgtcgcggcggacggcatctacctggcccagaactacgacgagcccgaccacgatcaaaaactacatgcagggcctaatgggcaacgccacggagttggaccgtgcctacacgaagcccgagcatggcaacaagaaccaggcttactcagcacgctccccgttctcactatctgataggagggttgactatatatgattcgagttatgactctgtcctctccgtcttaagaatctgtccttgggggatgaaaatagttgatgatggcggcacgtttgtgaattgtaccaatgaatggtatgaaagaatggtgacacgtcggggtatgaacgaattaatggatgaaatgacctgttacactgcgtgattcatgacgtccgantctaaatgtaacaaactcacctctaaatgcaaatgcnnnnnnntagttctgctgctcgncnnnaannnnnnnnnnnggggggcccnnnn

SEQ ID NO: 18776 - DNA, 1404 bp, Triticum aestivum
  Clone ID: PAT_TA_18776
gaaacatgttgttcgactaacaaaatttgattataggctagcaaacaggttggattctgatctgcaaaagctgaggtgcagagttaactaccatgcattgagatttactgacccaatacaagaaatgggtgaaaagataatacagagaatgcgggagaggagcacatattttattgctcttcatttaagatttgaaccggatatgcttgccttttctgggtgctactacgggtggtggagaaaaggagaagagagaacttggtgtgatacggaagagatggaaaaccttgcatgctagcaatccagagaaagaaagaaggcacggtaggtgcccactaactcctgaagaggtggggttgatgttgagggcactgggctacagaaagaatgttcatatttatgttgcctctggagatatatatggtggggcaaagacattagcacccctgaaagcgctcttccccaatcttcataccaaagaaacagtaacaagcaaagatgagctggctccgttctcaaagtactcatctcgcatggccgcacttgatttcattgtctgtgatggaagtgatgcttttgtgaccaacaacaatggtaatatggccaaaattttggctgggcgaaggagatatcttgggcataagagaacgatccgaccaaatgcgagaaggctctactcgttattcttgagcagaggaaacatgtcctgggatgcattctcctccaaagtgcacatggcccagaaaggatttatgggggagcccaaagagctgaggccaggaaggggggagttccacgagaacccctcgacatgtatatgtgaaaacaccgatcccaaaacaccgaccaaacctaaccttcaaagcgagcaaggattgagtaatggcaccgagggaaggaaagccattaccgagcccacagttgctaatcataccaacgaggagttggtaggatccagtgcggaagaagacgacgctagcgtggagaaagaagacgacactagtgcggagaaagaagatggcgctagtgaagagaaagaggagatagctgacccggaagcggaggatgatgcgttggtgagaccagatgatcctgagctggaggaggttctttcagattagacatgagttacccaggccgtaggtagatgttaaccagccgtcagagttttggtgagcagctgatggttttttgcccctttaaatgtacatattttgcgtgctgtgtaaaataacccaccccccctcccactcctggtagcttcctcgcttccctccccgttcgttcggcccccgtctctccggctgtgcgctgatctcgctgactgtgggttgtgtgtggtatgctgtagcatgcgcttgtttgtgttttattcacttttctgaaaaaaaaaaaaaaaaaaaa

SEQ ID NO: 18777 - DNA, 632 bp, Triticum aestivum
  Clone ID: PAT_TA_18777
gacaactcagcgatgtggcttcatggagctgctggttcaagagctgtttcagctgggccccctggcttcttccaggccctccagggcctgcgcccgcagcgccccctccgtgaggtgcaacagccctctcagtacggtggtcttgggtacccgagcttctaccagtcgcagaatggtatgcaccaggagcacccgcagaactctgcggagggaagcctgaacagctcccagactcccccctctcagaccagctgagctgccttcttgagcgccaagaaagggaggtcgatgcgcttctatagtttcgaagtatgttggttttccttttttccctcactcttcttgctcacttgttgtgtgacccctgatcgggactcgtgacagatcgtaatgagttctaatcgatagtgagatgttttcgtgtaacagttagaccttactcatctaactcgagctgcttcttttaccactctctatagatgcctcactcatcctcgtgatgtcgacccatactagtcttgagctcatctcctgagagttggcgtcatcgggatgattattggtgatatttttgcatttaagggatgtctggaaggcagcttcggctttgaagatcaactttttttcaaaaa

SEQ ID NO: 18778 - DNA, 1330 bp, Triticum aestivum
  Clone ID: PAT_TA_18778
tcggcacgaggcttgatgcctagtggaaccctgtttgcagggcagagtaatctcaaggggtggtgatggtatctcaagaggtggtgacggtgatacatttgacagcgatgaccgtgtaccaaaaagtaaagatcttgatggggtattggggatggaatctgcagtagtgatcatcgatgactctgtgagagtctggccccacaacaaaaacaatatgattgttgtagagagatacacctatttcccttgcagcagacggcaatttggccttcctggaccatcacttcttgaaattgatcgtgatgaaaggcctgaggatggcactcttgcttcttcgttggcggttattgggcgcattcatcaaaacttcttttctcatcccaacctcaatgatgctgatgtgcgcagcatactatcatctgagcagcggaggatccttgccggctgccgtattgtctttagccggattttccctgttggagaggctaacccccacttgcatcctctctggcagactgcagagcagttcggtgcagtgtgcacgaaccagattgacgatcgggttactcatgttgtcgccaactcactaggaaccgacaaggtgaattgggcactacaaacaggcagattcgtcgttcatccaggatgggtagaagcttcagcacttctataccggcgtgccaatgaacacgattttgcagtaaaataaccattcctgagtccaaattcctcatccaagaggaatcctcttggggcacagtctgggtcatgaaaaccgaacaacacaagtaaaaactggaccagactaagaaaaccatgggcgtccgagaaaaccacatgccaagacaggtaatgaaaaatgatttatgcaaagcctgaattggtagaggtcgggccaaaataatctttgggttggtgagtattgcttgtgaaggggttcagatggatcatggaaaaaagaatgctaaagtgaaaaatagatcatccaagactaccaccctcccttgtaaacatgtaaaaatgtatgtttctggtgccctggcctcgtgcaaagactgcctgccgcagaaatgggttaatgacagctattggtcataaagtagccagcgcagcaaccattgggatgaagaggcattaagtccgcggacccccttgtggctgttgccgtgtggtgtggctccaggtgtcggtggctggattccttggcgtgccaaagggaaatgcagggtttgatatcatgacgtgcctgtagcatttgcgtggttagttgggcaacattatgtgtgaacacgtgatagcagagaacaatgcaagagaggtgatcagtggt

SEQ ID NO: 18779 - DNA, 1360 bp, Triticum aestivum
  Clone ID: PAT_TA_18779
cgtccgcccacgcgtccgcccacgcgtccgcccacgcgtccgggccggcgtcggcttctcctactccaacacctcctccgatctcaagacctgcggcgacgagaggaccgcgcaagactcgctgcagttcttgatcagctggatgtcgcggttcccgcagtaccggcaccgggatttctacatcgccggagaaagctacgccggccactacgtgccccagttggcgaggaagatcgtcgagtacaacaaggcttcgccgagccccttcatcaacctaaagggaatccttgtggggaacgcggtgaccgacaactactacgacaacatcggcacggtgacctactggtggacgcacgccatgatctccgacagcacctaccgggccatcctcaagctctgcaacttcaccagcgccaacgtctcgaacgcctgcaaccgcgccatgagctacgccatgaaccacgagttcggggacatcgaccagtacagcatctacacgccctcctgccacgccacctccgactcgtctgcggcatccggcaactccactgcaccccgcaggcaccgccgtgccgtgctcaagttcaaggacaccctcatccgccggaggtccaacagctacgacccctgcaccgagacctacgccgagaagtactacaaccggctcgacgtgcagagggccatgcacgccaacaccaccaggatccactacagatggacagcctgcagtgatgtgctcatcaagacatggaacgactccgagttgtcgatgctgccgacctacaggatgctgatcaaggctgggatcaggatatgggtgttcagcggcgacacggattcggttgtcccggtgacagcgacgaggttttcgctcagccaccttggtctcaagactaagatccgctggtacccatggtactcagccggtcaggtaggagggtggtctgaggtgtatgaaggactgacatttgcgtcggtgagaggcgcagggcatgaggtaccattgttccagccaaggagggccttcaggatgttcgtatcattcctggctgggaagccattgcccaaatcctgaaggttcgtgcctgccatggactgctgatgtgcagcgtgatgcctagctaaaggtctgaaactgtgtaagatggatggagagagtgatgtagagtgcttgcaagtagtagaaaataactagtactagttcataggtgacgagtgattgatttggtctggggaaaaggatgagaggagaataagggtgattatgccatggaaaccatgggcatttgcagcaacgagcaaataaacttgaaggctctattcttgatgttgtcttactatcagttttcactataaattt

SEQ ID NO: 18780 - DNA, 1483 bp, Triticum aestivum
  Clone ID: PAT_TA_18780
gtcgggctaatcgaagttgggcaccaccgtttattcactgaatggactcgaccaccaaccaattcgtccgcgccgacgccgccgctggcgcgtcatcggcgaacacggcaccgctgccggccatgctcgctgacgcccttatcggcgccggagctggaggaggagatggggaccccagcgccgctctccaacggcttgcagccctcggcgatcgcatggctgctgtccggcgcctcctcgtcgcctccatttctggggaatcgcagcccctctcctcctcggatattcagtccgtgtctccgagatctcatctgccgctcacctcgtcgtctcaacggcgcctcctccttctttggtccctcccttttcccgcccctctgcaatcccgccctccgcccgctcctatccaagagcttcccgccgcggcctccaccgccgatgtgcttccccaagaatccaccaagggctacgatgtcgtggagctcgatgccgacgaactgctcgcggagcatgtccacttctgcaatatctgcggcaagggcttccgccgcgacgccaacctcaggcggcacgggcgcgcgcacggcgaccgattcaagtaccctggcacgcgctctcccggcccggtcaggcaaagccagttgatggccgcgatgtgcgcttttcctgtcctttcacggggtgcaaccggaaccgtgcgcaccaccgcttccggccgctcaagtcagcggtgtgcgcgcgcaaccacttccgccgcagccactgccccaaactctacgcgtgtgagcgctgcggtggcaagaagcgttttgctgttcttgccgatctccgcggccacctccgccactgcggtgaggaggcacagtggcgctgctcctgcggcaccaccttctcccgcaaggacaagctgttcggccatctcgccctctttgaaggccatatgccagccatgtcccctccgaacaaggatgcagtgacaacgactacagaggcaccccttgatataatggatgaaggaggaatcgaagagcaggaagatggcggtgaaggtggttttgatccggagttcttcaaggagtggatggaggagctcaaagatgatggcgtgcctgctggtggcacagtctggcctggacgggcagcagctgggcaatagcctgtgttgcaagttctgtttggggtgtatggtaacagccgcaaggggcattggctgccaaagtgtctgaaagagcggtggggagatgcttctgaagaacagcacagaggtttctaacaagagcagtgggggcatgcccttgtttgtatggcacagtagtagtctggaatcactttgccagtctccttgtcgctccctcgttattctgtacctattgtcctgttggcaggaagtacattccaggatgttggttattcgcttgcgaggttgcagtgctctctttctatctcaaaaaaaaaaaaaaaaaactcgagggggggcccggta

SEQ ID NO: 18781 - DNA, 685 bp, Triticum aestivum
  Clone ID: PAT_TA_18781
cacgctgaacagaacgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgcgccctcgtgccg

SEQ ID NO: 18782 - DNA, 939 bp, Triticum aestivum
  Clone ID: PAT_TA_18782
gattcttcccaatttcgcgtccggggagcacaaaaatttgaatggcaagcaagcttcaataagtgagctcctagaatctgaaggtaatgctgaaaatggtgctggaacatactctggcactgacttggctggaaggaataacttgcacgtggtgtctgcatcaagcttctcgagcattgcacaaagattccttgccaatacacttcagagaagaacttctcccaaatataatgatcttcctatctcatctgggagagtgaacactgatgcaaatgggtttgatgaagctactgtaaattctactcttgcaccaaagcaagcagtatttgatgcatctcagtttgagaagaaagcagataatggcatggatggactgccaaagtcgtcaatcttctctagtcgccattactctgagaaatcatctccgccactagagcatatgaaaatatcctttcaccccatgagtgcatttgaaacgtcgaaattgaacctagatttctctgatggcaaccttcatgataatgttgatgatatgatgttaccaacatttcagttacttccagggtcttctgtcccacagcctggtagtggttctgaatcagaagatgacacctttggtagatcttacagttattcttcatatgatgatctaagcccgcgtttatattcaaactctgagttgtgggatcaagaagatggaattggattggaggatcatgagctgcataatgattcaaatcagataggatcctccacaacacctgtctctagctatatgggattcgagcagatgaacttatctggtgagaagtccactatttcactttcagatattggagatcataatggactcggctcgttaaaatcccatcctgctggagaacttccgaactttgacacctttgtgtcaacaagtaatcatcaaaatggagatgcgct

SEQ ID NO: 18783 - DNA, 1872 bp, Triticum aestivum
  Clone ID: PAT_TA_18783
cccccctcgtcggtcgtgatccgtcgggtcccccagggggcgttcggcctgcccctgcacgccagggctcccccgtgcctggtcgatctgccattcctccgcctgatgccgttcccagtccggcagaccggctggccgtggcttccacatcgcccgggtcgagccatgccacaaggttcactgccaacacagctccaacaagtgcccttccccaatctaatgatctccctatctcagctgggagagtgaacactggtgctgatggggttggtgacgctactgtaaactctactcctgcaccaaaggacgcagtctttgaggcatctcagtttgagaagaaagcagagaatggcatggatccactgcccaagtcatctatcttctcttctcgccattactccgagaaatcatctccgccactagagcatatgataatatcctttcaccccatgagtgcagttgtatcgtcaagattcaagctagagtactcggaggataacctcctcgactgagttctaaatgggatgctgtcatccactcggtggcagcctgagtcttctgtcccacagcccggtagtggttctgaatcagaagatgacacctttggtagatcttatagttattcttcatatgatgatctaagtccacctttatattcaaactctgagttgtgggatcaagaagatggaattgggttggggggtcctgggccggtttatggttccaatccggttgggtccccccccgtcgccgcgcccgcgctatatgggattcgagcagatgaacttatctggtgagaagtccactgtttcactttcagatattggagatcataatggactcggcttgttagaatcccatcctgctggagaacttccgaactttgacactttgatgtcagcctgcaggctccaaaatggagatgcgctcattccacataatccggtcaatttatcaccagatgaagatcagatgccgccgccgcctcctcttccccccatgcagtggaggacaatgagacaaacaacttccctggatgaagaaagagactctacagctaaagacatgcttaagaatgcctcaagtctaccacctgtacacactcctgtgcaggaacaatatcttccgccgtgtgcaccaccatttccacaaggaaatgttaaggaagtgaaccatcagaaagttgatgtgatcaaagaaacgagtaatcttcctaatatatttgagatcaaatcaagcttgcttcagcaaatcagggataagccagatctgcacaagctgaatggacatgaaaagcccaaagcagtatttaatgatgttaacagtttggacgaaaggggggagttgcttcagcaaatcaggagcaagacattcaacttaagacgaacaaatggatctaagacaaacacctcatcgcagtcaaccgagtccactgccaattccagcgttgtagcaattttggagaaggcgaatgcaatccggcaggctgtggccagtgatgagggaggtgatgatgataactggagtgatatcaactgagaatgcatatgacaaaccttttctgtatatgcaactagtacaagatgaagagtgaaaatgtgaataacacctttttcttcattgtaattagatattgtagctctgtttttttaaccttattttagttcatggtagtgtatcttagatccctgtggttgtagagatgttaaatcatttccacatcctgtaaatttatcttattatttattaatggtagtgatatggactaaaaaaaaaaaaaaaaaaggcccctatttgtagcattgcactaaaaatttctctttgcattgttaataagatgggggcatactgttaaaaaaaaaaaaaaaaaaa

SEQ ID NO: 18784 - DNA, 1257 bp, Triticum aestivum
  Clone ID: PAT_TA_18784
ccgcgcgtccccccccccggccgtggcccgcccccggccgcgccgccccctgatcccttggccccctcccctcccgccgccgccgccgcggcgaccagccgcccagcgccgccatggcgccggcccccgcgccgattcgcgacctcctcacctccttcagcccctcctccgacttcctcgccctctcgtccggcgacggccgcatcaaggtatgggacgccgtgcgcgggcacttgcagacggagttcgccgacatccccccggtggaggtcggggcgctccccgagacgaagcgcggccacctcgccctcgactacacctgcatgaagtgggtacaactctccaccaagaagaagcggaaggctgggagttcgctgctcgtgcttgggacgggcagtggcgatgtccttgcgctcgacgttgctgcgggccattggaagtggaggatcagcgattgtcatcctggcggtgtgacagcagtggcatactcgaggcatgggcgtagtgtgtacacagcgggcgctgatggcatggtctgtaagattgatgcctcagttggatctgttgcagggaaatttaaatcttcctccatcgcaatatctgcgttggcagtttcatcagatggaacagttttggcaacagcagcccgtctcctcccgtccttggacgcttctgacaacaaaaaaattcaaaaatcgtctgggcatccggtgtctgtgagaaacatgatttttagtaacaatggcaaatatgttctgtcatctggagttggggaacgctatgttgccatttggaagttgggcagtggtaaaagtcagagttcaagctgtatactctctatggaacacccagcaatctttgtggactgcatgtgttcaggtactaatgctactgaaggagaaatagatgtgttggctatctctgaggttggtatctgctatttctggtctgggaataacatggatgacttgcgcaataagaagcctactaagattgccttgtccgagtcctccctttcaagaacgaatcaggatttcacgatatttgccgcaaaacttcaaggaatagatggacctaattcggctcatgtccttctggcatatggatccgtggtgaaaccatctttcgataagctgctggtttgttacggtaaggatgttaattctgggtgtatctgaagatggagttctcttacctacagtctaacccaccatgcaccagaaaggtcaatctgctaaaacaaaagtaactatcact

SEQ ID NO: 18785 - DNA, 708 bp, Triticum aestivum
  unsure (1)..(708): unsure at all n locations
  Clone ID: PAT_TA_18785
cgtccgcggacgcgtgggcggacgcgtgggaggaaattagtgaagctggaaatgaagatgatcaagacagaggaacaaaagataaccattcacaagtttttgattgcgaacatcagactgatgaaagccatttaactctcaactatgaaaagaaaagagtcacatcccagcataaagattatcaagctccagggcaatcatcacaaaatagtgtctcacgaacagaaggaaggcgcagtcgctctggaaagaaagggaaaaaaagacccgctcaccgcagatctcagaaaacagatgacctgtctgctgtagagagtgacagtaattattccttccgcagagatgatgataatgcaacgagtggtagggaccaggtggtaagttcaagttcacggtttgcttcccctgaggactcaaagtacccccggcccgcccccgcgctatccccaatgggaaataactcggagaagaattacctgtcatgctggtagaaaagncctgatacactaaaagaggtatttgtactttgagagcaaaagatatcagggtccatttcaagacaaagactgctggtggggtggtggttcctgatttgtgtcaaatgctacgaacaggacctgctgctcattcctgtcacttcaaaaacaagtctgatgggatgcgatcttgttgnggnggaaatgtgcaataatagaaatgattgttttc

SEQ ID NO: 18786 - DNA, 842 bp, Triticum aestivum
  Clone ID: PAT_TA_18786
gcgcgtccgcggacgcgtgggttcgccatggccaacaccaccgccgcgtgcgaccaggcgctggaagagtacttcgccgtctaccgcctcatctacatgtacagcctctacacgcccgtctgcaccgacggctcctcctcctcgccgctcgccaagagggtcggcgtccacggcgccgcccccaagatcttctccaaatatcatgggtggtacatgaggcctgccggctacgatccctgcacgacccaatactccgaggtctacttcaaccggccggatgtccaggcggcgctgcacgcgaacgtgaccaagatcggctacaactggacgcattgcagcgacgtgatcggcaagtggaacgacgccgtcccctccaccctccccatcatccgcaagctcgtcgccggcggcatcagggtctgggttttcagcggcgacactgatgggaggatccccgtgacggcgacgaggctgactctgaacaagctcgggctcaagaccgtccaggagtggacgccgtggtacgaccgcctgcaggtgggtgggtggacgatcacctacgagggcctcacgttcgtgacgatccgcggagccgggcacgaggtccctatgcacacgccgaggcaggcgctcagtctcttcagccactttttgggtgatacgaagatgcctccggctgccttctcctagagacgaaacattccacgtgacaagggtcttcctcttctttgttctcgggcaatgtcatagatgtaattcgattggaacaatcgtcaataaacatgtcatagcgctgattggtttcggggatcgcagcataccggccaatcttggatcccaac

SEQ ID NO: 18787 - DNA, 1464 bp, Triticum aestivum
  Clone ID: PAT_TA_18787
gaattcactagtgattagcgtggtcgcggccgaggtgccgcgtccgcccaaggggccggaacagcacttcgccgtcgactgcttcctcgacatgtacaggcctctacacgccttcctgctccgacggcgccgcctcctcgtggcgcgccgcgagggtcggcgtccacggcgccgcccccaagatcttctccaaatatgtactcttcgatcgtcaccgtccacacccctcaagtcaaaacgcatcagcatctgcctgcggttcgatcattgattgtttgtctcctgtgtgcattgcacatgggtgtaaatgaggccggccggcctacgctccctgcacgacccagactccgaggtctacttcaaacggccggatgtccaaggcggcgctgcacgcgaacgtcaccaagatcggctacaactggacgcatggcagcgacgtgatcggcaagtgaaagctcccgtcccctccaccctccccatcatccgcaagctcgacgcgggcggcagcagggtctggggcttcagcggcgaccccgatgggaggatcccggggacggcgacgagctgatctgaacaagctcgggctcaagaccgtccaggagtggacgccgtggtacgaccgcctgcaggtgggtgggtggacgatcacctacgagggcctcacgttcgtgacgatccgcggagccgggcacgaggtccctatgcacacgccgaggcaggcgctcagtctcttcagccactttttgggtgataagaagatgcctccggctgccttctcctagagacgaaacattccacgtgacaagggtcttcctcttctttgttctcgggcaatgtcatagatgtaattcgattggaacaatcgtcaataaacatgtcatagcgctgataaaatacacgcgcccgccaacagccggccgtgaagttcgcgcagtacgccgggtacgtgaccgtgaacgaggcgcacggccgcgcgctcttctactggttcttcgaggccaccgccggcgccgccaagaagccgctcgtgctctggctcaacggcgggccgggctgctcgtccatcgggtatggagaggcagaggagctcgggcccttcttggtccacaagggcaagccggagctgaaatggaacccttactcgtggaacaaagaggctaacctaatgttcttggagtccccggtgggcgtcggcttctcctacaccaacaccagctccgacctgggcaagcttggggacaagatcaccggcgccgacgcctacgtcttcctgctcaactggttaaaggggttcccgcaatacaaacaccacgagttctacatcgcccgggagagctacgctgggcattacgttccaccagctggcgaaaaagaacttcgatggcaacaagcacgggcccaaggagaaccgcattaacttcaaaggccctatgataaggaatgctctgatgggcaacgagacgg

SEQ ID NO: 18788 - DNA, 1611 bp, Triticum aestivum
  unsure (1)..(1611): unsure at all n locations
  Clone ID: PAT_TA_18788
gatttgagataggcgtggaacatgcagtggggatcacttgcacataatcatagatcctatgaatatgaagtcgtggaagtcctgtcaaatttctcagttagtgctggcgttactgttgtcccattggtcaggattgaaggctttgtcagtttatttatgacagttaaggataaatctgaaattgtggtagcaccaagtgagctacttcgtttttctcacagtgttccgttttataggacaaatggtaatgagaaagttggtgtccctggaggttttctggaacttgacactgcatgtctccccattgacctggatgcagcgtttccttgtgtttctcttcactcctgcatgtcccctggcaagaaagagggcagcacatccattgatttgagcactgacagtgcaagcagtagaggagaaaatgaatatatttcttctgagccaaagacatccttgcagagaaatcccgatggtcctaattctttaggtgacttctctgagcaaaatagtccctccttagtttatacatatcctgattctgaattctataacttcgaggaatgccgctcatgtgagaagtttgaacgtggacaaatatgggctttatacagtgatgttgacaacttccctaagttctatggctgggtaagcaaagtcgagctagagcctttcaaagtttatttgacctggcttgaagcttgtccccaagcggagcaggagaaacagtggttggagcaggatatacctgtcagctgtggtaaatttaaaattcgaaactggacaaccatgtacgaaacaaacgatactttctctcatttagtatgcaccggacatgacccaaagcagcagattgaaatttttccgcaagtaggtgagatttgggtcatctacatggactggacacctgactggactccctcgagccctcatgcttgtggatttgggatcggtgagatcatcgagcgcactgaagctagcacaaaagtttctcttcttactcaagtcaatggttacacagcggtgttcaagcctggcaagcgaaagagagttgtggagatacctacaaggcacaatctgaagttctctcaccgggtgccctcgttctgtctgacggaagaaaatggcggcaagctcagcggcttctatgagctggattcagcctctgttccagatgtcttcctttacaagcatgcctgatgacatgccgatggaaaagctcaaaccctgccaatatattctgactagaatcgtgtcttattccgccgtcagttttttctacagtactccctccgcaaagaaatataagagcgtttagatcactgcntgtagtgacctaaacactctaatatttctttacagagggagtacatatatatgccggtcagctttagtctatttgaaaccatgttagcattctattgcagacttgcagtgccctctcttactggtggtggtgaagtatcaggtaaactatgcctactagcgggcggaggcgtgtgccgtcgcgcccgtcagtaaagcctgagacagtctttgtcggtttcatctaggaagaaaatttaaatagtttgctcgggatagagttgacggtgnaaagttctnatcaaaact

SEQ ID NO: 18789 - DNA, 1473 bp, Triticum aestivum
  Clone ID: PAT_TA_18789
ccaggggcgcaaagatctgacaaaaagggatattcacgtcgctctgcgtactgggtgcctcccccctccccgcctccctcgcgccccgcggctgccacctcgtccccgcctcggcccccctgccgcgcccctgcgccctgcccatccaggccctgggtcgttcggcgggccgggcctcggtgccgaggctgagtgatgtgcgccagggtcctcgtgctagatcggctgcggggtctctgtgctgtgctggccagcggccggggggcgtgcgtctccgggagatatcttcctccatggtcgcgttggacgtcggcgccgcgcttgccccgctggtcaggcctctccgacgcctcccgggcctgactgttctgcttcaccttccacccctgcattcttctctgacacgccaggtatgtccccagtgaacttgattattgatgtatgatttcgtccgattcacacctttttatcccctgaaaattaaatggctgttcaccctgtttgggcagtttccaagttgatggggtagcaagattttgtttcccaatgaattaattgcgtgcctttgtttcgaattactgatgggccagtttcacgggttcattcttgatacctccgcgggcttccgaagctttttagatactatggcgcttctgcttcgggtgcgagcgcccagaggccgtcaggtatctgtgtgatgggatagtcaggtcgctctgcgtagtgggggcctcatcatttacaggaaagttatattctaggaagcgattgcgtgctcttgtaggacttgctgaaggagagttaaggttcatttgaagtcgcggatggatgcatgatttatgcagaaatgtataagtgccatgtagtggttaattagaggtgttcttcgactaaaatcaggctgctcctgccatgtctaccagtgaaatgcctccttccatgataaagcagcctactcttaggtacagatcttggtgttgattctgcctcacctttccagccggcagtggttcggtttgctgcaggtttcctcggtgttcaggtacttcatggcagcgccgtggacagcatcaccataaccacattgatggtccaagcccaactcacgacatcatttttagttgggttgtgagcacctcaacaactcaacaacaaatatacttgatgtgtagccgcatatactacatcatcaccgacatcatttctatgacatgctcaaagtgatgtaattaaccaaaccattactgttattagtgcttagttcctcctatatctttgagaaattctaatgatggaatcaatggactatatttccttcaatcagtggaatatatattgtgtaaccagtagtggactgggtggtgctaccatcgtgctttgctattcatgtaacaacctgaatcgaatatgaatcgcgttctaccaagttggatccaatgtcaaaaaaaaaagaaataagtaggcgccccggtg

SEQ ID NO: 18790 - DNA, 644 bp, Triticum aestivum
  Clone ID: PAT_TA_18790
ttttctacgcgtccggaacgccctcgcctacaaccggaacctgctggtgcggcaggtgggcaacgagggcacgccgctgcgcccccgccagcgcctcgaggtctacctcttcgcgctcttcaacgaggacatgaagcccggccccacctccgagcgcaactacggcctctaccagcccgacggccggatggtctacaacgtcggcctcgcccagcagcagaccacgtcggcggcctccctctccctcgccgcctcctccgcgccccccgccatggatgttggaaaggacttgacgagcctgtgcctcatctcagctctggccatcctgctcacctcccaggctttcttactgggatagcaaaagcacccaagagtgcggccatatgcatgcaagcaaaatggccttgacttttgtggaccaaaagccttgcagaccaaagggcagagatggtgcaccatttgaagggggcaaaaggaaagcatatgcggtgtatgccagagaaaaagcttctctttgcgatgtggaaggcactacctctgccgtcgtggggtgtggtgggcttgtggaccgcacagcgtgtaaatattgcgaggcaaaggtccccttttgtgacgcgcgcacacatgggatcccgggagatatg

SEQ ID NO: 18791 - DNA, 1340 bp, Triticum aestivum
  unsure (1)..(1340): unsure at all n locations
  Clone ID: PAT_TA_18791
aaaaaaaatactagacactgaaagcccaaccctctcctcctctcatctcttcctcctccagtctcccgatctccgcagcagtcgcgagggtttagagctcgtagggttcacgccttgttgttgtgcactgtgctgcggtggcaggtggttgtggacttgcgggcctggtcgcgtgcagtgcgccatcccactcccatggcggcgccgtggtgggcggcggcgctggtgacgctaggcgtcgtggggttggcggcgggaccccgaggctgcgccgcgcagccggtggtgctggccagctacgcccagcccaagctctcgctcaggccctacgactggacctacctgcgcgttgacttgccggcatcattttcttctacccacatgtactcccacgccgacggagatattcccagggagcacttaagagatcttccgaaaagtgatcttgctatcatctgtttgatgattgccaaccctcctattcctgatacatctgattattatttggacaatttattatcaaactttcttgctgttggatcttttggcaatacgaataaccaatcaaatctggttcagtgcataccatttcagaagaacacaactatagtgttaacaaatggccagatatcgccagggatttggtacattggttactttaatggccttggacctgctcgcacacaatcaaagatgattagccgagggagagcactatcagtgagcactagcattacggtagaaggatgtcctacttcagcactatggggaccctactgcagccaaactattgaaactattgcttgttctcagttttcaagatataacaactcaagagatcttctaggtctgactatcaatacccgcaaaatattgaaaactaaagaaaatactagacgtaccagcttcttatcaaggtcgaaccatccaataggacatcaactcgagtccaatggtactagcgtaatgggagtggagaatttgatcacttgtgccatttcaaatgactcactatgcctcaggcaaggcgatataaagttttacttcttggatatagtcaaccaagcactgcaatttgaaattacagctacaaattttagattatcccaaagtgcatccttaatctgttatctgcgctgcaacgccttacctcagagagattggcacgattattcaggtgatattagcagtgctcccgtggttataaagctgccaaatattggacgatggtatatcgcaattgagattctgaacannacacagatgagaaatacaaccgcacctatgctggatacaatttgtttctcatttgattggcaagtaactggatgtctgaacgg

SEQ ID NO: 18792 - DNA, 934 bp, Triticum aestivum
  Clone ID: PAT_TA_18792
atcgctgcctatctgcttgcttacctctgtggcagccggccgcgccgcccttactcgcagaaaccctagcagatcgctcgagccctccgccgccgccgcgccttcagctctctccttccttcaccgattcaagatgaagttcatcgctgcctatctgcttgcttacctctctggcaacgccgcgctgagccctccctcgacgccccgccctcaggtcgctacttccttttcgatccaagatgtagttcattgctgccaatttgattgctacctctctggcgacgccaagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcatcttgtgtctgaagtatctatccttggccaggaaactagagtcaatgatgttttagcctttatttagctgagttgtgaaacactggcaagacaatgttttgatatgtaattcagcccctggttgctggttgatttactggtgaaccatacctttgctatccaattttggtgctttaacaatggtgctttaacaatgttttgatatgttctgcctgttccaatcgctgtcccatttttcctgctagtgctttggtcaacctaatacccacttctttgtaaattggcacatcgttgagtggtaagtgccatggttgttacagcgcaaaaatctcattccgactg

SEQ ID NO: 18793 - DNA, 315 bp, Triticum aestivum
  Clone ID: PAT_TA_18793
gtccgcggacgcgtgggctctaaccgggtctctgcctccgtcgctaggtgggctcaaggggctgctcaagatggacctcagcaacaaccgcctcgacggccgcatcccgccggagctcgcggggctcgagagcctcacgctgctcgacctccggaacaacagcctcaccggcgggctccccgatttcgtgctggggatgccggcgctgcaggacctgctgctctccagcaacccgctgctgggaggcaccctgatgcagcgcggctgggagaagatggcgagcctggccacgctggacctgtccaacgtcggcct

SEQ ID NO: 18794 - DNA, 926 bp, Triticum aestivum
  Clone ID: PAT_TA_18794
ctagcatcacaacactggggtggagacctgaagcgaagcagaggggcggaccaaggaaatcagagtcacgctatttctatatatcctcattctgcgctcttatattttttacacatttacaatcttgtgttcgaataattcttgtggcttgacaagacagagtggaggatcaaggaatgaagtcagaatagttttctaattaaatatatccaaaggatgataataggttgtgtcaagatgagtgcacgagaaggatagtgaaaaagaaagggattgcatgcttctaactgcgatttttgacagaggttgatcatctgggtcttaaagaagaaactaaagctaaaggttcctggttacagcacaccagtgcaattcgttgtcctgataccctttgagtatcctcttgaaggaggattgggtgagattgttgttgcaacaagaattggaactatgctgggtgatacaacaatatttgttcatccagggaataaaagatataagcatctgcatggaagatatgcaattcaccccttcaatggcagaaaactaaaaataatctgcgatgctgtgttggtggatcccagtttcggcactaggtctgtcaaaggtgtgatataatgccaactggcttaatattcatgcgttcctcttgttatgacatcgagctaatgtgccatctgttacactatttgtgctcccagactaagcataaccttgcgtactttggataaactactttctatgattcacttgtgctatgtgtatttgcttccctatgttagaactgaaattcatttgttgtagcgaatatggttgtatcaacattacccattcaactttagacttggttcatcacatatagactattcttttctctgctacttgtatgtcaaaaaactatcatgtttttgaagcaagttattagt

SEQ ID NO: 18795 - DNA, 3113 bp, Triticum aestivum
  Clone ID: PAT_TA_18795
actaattctatctgtctgtagtgatggatccaattaccattgctgccgtaggatggagcgtggccatggttggttgggtcgcctcggccaccatctctaagctcctcgccaaaggcttcgattacctcgaatatgacacagcaaagaagctggcgcaacttgagccaaaaatcttggtgctggaacgggtcatggaagttgtcgagacgagcccatacaggcctcgtctagagcagctgttcaagcggcttaaatatgctttctatgaagccgaagaaatcttggatgctgtcgagtatcactgtctagagaagcagatcaaaacagggaaactacagccgggcggtggctcgtctctacctaaaaaggatcgtctgaaaaagaaggagagtcgtatgtcaaataagaagttggtaaagagcctaaagaagatagaaaacattataaatgaagcacaccagattttggagaagcttaacttgtcaagcataagtgatggcaatatacgacacacaatggttgtcaatcctacgactaccgcagtttccccgcaaaaagtttttggtcgagataatgatcgcgacaagatcatagcaatgcttcatgaaaaggaaggtggtcttgatccaagcactagcaaaggtctatgtttttctgtaattggcatacatggagtcagcgggtctgggaaatctacccttgcacagtttgtttatgcccacgagaaaaatgacaagcaagacaacaaggaagaccatttcgaccttgttatgtgggttcatgtctctcaggattttagtgtgtggggcatcttcaaggagttgtatgaggcagcttcagatcctaaggttccatgccctcaatttaataacttgaatgccttggaagaagaactggagaggaaactagatggaaagcgattccttctggtactggatgatgtctggtgcaatgcggatgttggtaaccaggagctaccaaagttactttctccactgaagaaaggaaagaaaggaagcaagatcctagtgacaactcgaagtaaatatgcactaccggatctatgtcctggtgtgagatatactgccatgccgataactgaggttgatgataccgccttctttgagttgttcatgcattatgccctcgaagatggccaagatcaaagcatgttccagaacattggggttgagattgcaaaaaagctgaaggggtcacctttagcagctagaacagtgggtggaaatttacgtcgacagcaagatgttgaccattggagaagagtcggagatcaagaccttttcaaggtatggacgggacctctgtggtggagctactatcagcttggtgagcaggctaggcgttgctttgcttactgcagtatttttcctaggagacatcgcttgtaccgtgatgaattagttagactctggatggcagaagggttcataagaaacacagatgaaggggcggatgctgaagacgttggtctgggaatatttaatgaactattgtcgatatcatttcttcaaccaggaggccaggactggtacaatcatggcaaggaatactatttagttcatgatttgctgtatgatttagcaggggcagtagctggaactgactgcttcagaattgacaataacatgatccagaaaggagaaagctgggcaaaagatgttcccagagacgttcgccatctttttgttcagagttatgatgcagcattgattacagggaagattcttgtattggaaaatttacacacactcgtcatttatagtgttggaggggatacaacagttgaggaaatagtcatcaagaacatactcaagagtctgcctaaactgcgggtactagcaatagctttatgtctggaaaaggatggatttatttgtagaccaaatatattgtctgttccagaatctattagtcaattaaaacatctacgatatcttgctttccggacagatattgaatgcagagtaattttaccaagcagtctaaaccagctttaccagatgcaactgctagattttggtgtctgcatgaatttggtattttcctgtggtgatcttatcaacttgcggcatgtatgcagcggtcctggattgcaattttcaaacatcggtaggcttgtctcactccaaacaatcccagcattcaaagtaagtcatgaacaaggacatgaggcaaagcagttgaggtacctaaacaggctcagcggcgaactgagtatatatggtctccaaagtgttgaaagcagagaggaagctcttgcattcgatctagctgccaagaaacggctcgcagaactaacactatcattcggtggaagttcagaagttgcagcagaggtacttgagggcctttgtcctcccgtggggcttgtaacactcgacatccgtgactacgatggtttggtatacccaaagtggatggtgggcaggcaaaatggcgcaccagagaagctgcaacaacttggtctctcaggatggagccagccaggacctgctcctgcactgaaggctttcaatcatcttcgttgcctcaatctgatgcactgcagctggaacgccttgccatgcaatatggagcacctcagctcgctcgaaacagtaatcattattaaatgtttgaatatccggtcgcttccaacgctgccacagtctcttacgtatttttggctcctgaagtgcgacgatgggttcatggagtcttgtcaaacagttggacatccaaactggaaaaagattcaacacatctgcaggaaatattttagtgaatgacgcgggcttggaatcggagtcagagtacttacttatggcccctaacttgagacctgcatgccgctgcagctattttattccaattggagtcaagacaagagtatttactcgagattcataatctattcctgggtggatcttctcttgtgagtctgaaaacctaccagtgccagtctgcaatattgtaaggaaaggagtacatctatagtgtcagtgcatatacagtgtctgaatcatgcacttccgtttctgtatttcaccgtattattgattaaacagtgcatgtgcacgtgcacaatatatatttcccgaatcttctattta

SEQ ID NO: 18796 - DNA, 799 bp, Triticum aestivum
  Clone ID: PAT_TA_18796
ggatgccccaaagccaagggaggagctcgacctgctcttctaccagctgcaagagacggcacgaagggtcccgaacctccagcttgaatgcaagatccagatcgatgttgagagttttgtgaactccttccgccccgacgtgatggaggccgtgtactcgtgggccagagggtccaagttccaccagatcatggagatgacacaggtgttcgaaggcagcctgatcagggccatcaggcggctggaggaggtcctgcagcagctgatcctggcgtcccagtcgatcggcgagacccagctcgaagccaagctcgaggaggcggtcagcaagattaagagggatatcgtgttcgccgcgtccctgtacttgtgacacctcctgcgtggtttggtcccatcacaggaactcatgtgcggggatagagaggttatcattgtctgctgttcttgtccagcgccatcgacatggacacggtcgagctgccttgactggtttgctgtaacacggagcggcgtgttgtcgccatggcggggatacaattttgtaggttgtagaagcagtaagtcgtgattgaattgattagggttttggtccaaggactcaaacctgtaccatttttcttcttccctatacagagagagaattgaagtagagatgtacctgaattgatatgccgagaatgatgaatgcctgatagtatttttcttggatgtaactgaattttcatcccaaatcaaatgaatttgttgtgttgtgttgcttgtcctgaaaaaaaaaaaaaaaaaaaaaaaaaaaaaa

SEQ ID NO: 18797 - DNA, 749 bp, Triticum aestivum
  Clone ID: PAT_TA_18797
cgtccgatcctttatgagaagtacttgctacttcttttgtcttcagaggttagtttgcaatctgatgactatgaaaacggcattgctcaagttacagatgctctaagagttgctcctccgagtgtggatactttctttgcacacttgcaactgtgtcgggcttatgtggtgcaaggcgatctttcgaactccaggaaggaatacatgaaatgcttgcagaaccgcacgaatactgaggttggctgggtaatgctcaagcaacttgaatctttatgttcagtgaaccgtggctctgatgaaatagagataaatctgaaagaatgcattgaaaggaatggtagctacccatcaaaatgggctgctctttttaatctagcatgtgctcagtgttttatgcgggatgaggactttgcaagtgctgaaaaagctcttgcacaagcatgtgctgaaaaggatgctgatagctgcatcttattcctcaatggagctatgcatatggagattgcccgtaggtatgcagctcctcagtatataacccgcgcagcttcgagcctcagaaaggcacagcagaagtctcaagctgccgtacccatcatatcactcctactggcccaagcagaaggcagcctcggctccaaagccaagtgggagaagaaccttcgcctcgagtggttctcttggcccccagaactgcggcctgctgagctctacttccaaatgcacctgctggcgagccagtcgactgcggt

SEQ ID NO: 18798 - DNA, 447 bp, Triticum aestivum
  Clone ID: PAT_TA_18798
aacgtccgtttttttttgaaataagtctcatgcttataaaactgatgtgagaggatccacaacaggcatcatactgatgaggatcaaagtcaaacacatcaacagccataggccatgagaccgttggaatccattacataatttcttgccgcctatcaaagactagcgttggcacttgccattctgctcctactacctaaagcacactagatagaacttccttgtctttcgtcgcttaaatggttaccaagcaaagaaggatacccaaaatgaaacaagccccaacgagaagagggccaaagcagatagaccttaacctaattcggcttctgggctgtcctgtgggcatctgatcaactccaatatgttcaccacctcactcatgtctggcctattggagggaacctgagaagtacagactaagccaagcccacgcgtccgcggacg

SEQ ID NO: 18799 - DNA, 690 bp, Triticum aestivum
  Clone ID: PAT_TA_18799
tgagaggatccacaacaggcatcatactgatgaggatcaaagtcaaacacatcaacagccataggccatgagaccgttggaatgcattacagtacataatttcttgcctatcgaagactaggttggcacttggcactctgctcctactacctaaagcacactagatagaatgcttaaatgactaccaagcaaagaaggatacccaaaatgaaacaaggcctgacgagaagggggccaaaggagatagagcttaacctaactcggcctctgggctgtcctgtgggcatctgatcaactccaatatgttcaccacctcactcatgtctggcctattggagggaacctgagaagtacaaactaagccaagtttcatgataggaaccgcctcttccagtgggaattttccgcagagcttctcatcgacacactcttccactttgccttcatccaaagcagccctcaccacatcacacagtacaataacatcatcttccatgtactccactggtgtcctccctgtcatgacctccagcacaagaactccaaatccatacacatcacatttctcggttatcttcacagtcctgcatgtaaattctggtgccatgtaaccaagtgcactctgtaccttgctgcttagaacataccgatccaacaacggcagtagctttgccaatcccctcgtgccga

SEQ ID NO: 18800 - DNA, 1208 bp, Triticum aestivum
  unsure (1)..(1208): unsure at all n locations
  Clone ID: PAT_TA_18800
agagattcgtggtgttctgaaagcacaaaatcagaaatataaacaacttgctgcttgcaaaaggaggccaaaatcattctaagtttgtgataaggtgatgctctacctctgaaaagagagctgcctttaggtgttaagaggaagcttaggcagcgaagggggcccttctctatcatgaagaagataaatgataatgcttatgtgatagatcttccaagcgacatgggcatctccaacactttcaatgttgcggacttgactctctaccatccagaagaagcgctctatgaagataactcgagggcgagttccaaacaaccaggggagaatgatgaggaacactagatgagaaaaaaaatcgtatgtcagatttgtttggctacttctagatgcttccactctagtgtagtatttcttttcttttcttttctatcctacctactgttccctagagtcttctagttgtgagtagctatgagtagaatggtgaaacttacataatgttttctagagtattccagctataagtagaagtatgtgaaggcttcccaaagccctataaatagaggtcctcgcctctactttggaggcagactatgtacccctacctataatagaacttgttgttcttatctaagatcttggagtagatcttgtgccctaggagttctggattgaactcttgctgccctatcaacctacattcgcctctagagcgatatctagcgcggcacgttgaagctgttccttcaacacttgtgctgtacacattgtagcggcaaggtggagttgctcctccacaaactttgtgctgcttcagtggaagtgttagagtgtagcatttttgtaagcataatctatatccattcctattgggaacatacccatgtaggtttttgtaagaatcttgtaggagcatgctactaggacttatttagattgactattctagacattggcatgagaatggtctgcatcctatatatggtcttagtgcgtctaaaaaaagcgtgtgttaaataactgtcagcgcaacggtttctaaccaatagaaagttactcccgttggtatatatgaggcaatgtctaatatttttttagaataatggttttattaattggatgattatcactttcatggtgcgcctactttcnnntatgtaaaatccaggactcttatgtaatgtgccttcaatatctattcannn

SEQ ID NO: 18801 - DNA, 1843 bp, Triticum aestivum
  Clone ID: PAT_TA_18801
ggtcccggcgcgacgtcgcgtccgcgttgcgccgttccgctccccgcgcccccgccgccccttccccgcgtccgtaacctacctctcctacagcgtggggtcgtcgcgtcggcgttgcccaatcctctcccatctcccccacctctcctactccgcgccgcttgccgatctggcctccagtcaactccggcgagattggatttgattggattgaagtttactggactggagccgatccgatccgatctgatcggactctgctggcatctagcgaagcttgaggaggggtcgctcgctgtcgcgggccacagatctgccgcgtccgccatggacggcaacaaggacgacgctgtcaaggccctgcgcatcggcaagaacgccctcgacgccggcgataccgcccgcgccctcaagtttctgtctaaggccaagcggctggaccccttgctccccatcgatcacctcctcaaccccctcctcaacaaggatgacccgtcctcctcaccggcctcgtcatcatcgtcatctgccccacatcccccaccgcctccgccatcgcgagctgcatcatcagcagccggtgctgacggcttgagggaaaggaagcagaagggcaagaagaaggatggggaggagggcggcggtgatactgctggggtgaggacgtacacggaggagcagctggaggtgatccaccggatcaagaagcactctagggattactacaagatcctgggcctcgaaaaggactgcactgtggaggacgtgcgcaaagcctaccgcaagctctctctcaaggtgcaccctgacaagaacaaggccccctggtgccgaggatgcctttaagcctgtctccatgcccttccagtgcctcagcgatgcagagagccgcaagcacttcgatgcttgttggttctgatgacccgccggcatacaacaggagggcggcatccactgcccgttcatacaatgggttctatgaagatgacattgaccccggatgagatattctaggaacttttccttttcggtgggatcgcgcctgccaccaccaagcattttcggcagttttggacgttccatttcaggactggccgggatgcatcatgctcatggtgcgcagcagggttctggtggctccactgtccgtatgcttgttcagctcttgcctgtcctgctgcttctgttgctcaacttcctgccatcctctgagccagtctactccctatcccgttcctacccttatgagtacaaatttcaaacccaacgtggagtaacatactatgtcaagctgcctaattttgaggatcagtatccacaccagagcactgagcgtacaacactggagcggcatgttgagagggattactactcgataataacacaaaattgtagggttgagctgcagcgtcgccaatgggggctagcctaccagacaccacactgtgatatgcttcagaagtttgaggcaacagcacagtaattcctccgatgtcgcaagggtcgcggcgaaacaggaactttggtcatggtgtaaaagttttccaatacttgctccgttgattatctgtttcaaattggaggcggaacaagttagtttggactagtagtaaattttgtggaataagtgcattcgatgactatacacaccgccttgatgtatcttaacagtgttaaggcgtatgcagccgtaactacttgaaatgatatgcaatttgttagtacgtttcttaggggctgaacacagtgcagacatgtgtatgtatatgaatcatctatatttcttcttctgatgttattgaagaatatatacctgacctagcagactgttactgcttttttc

SEQ ID NO: 18802 - DNA, 873 bp, Triticum aestivum
  Clone ID: PAT_TA_18802
cgtccggtcgtgttgttatgtacatgcctgaggtatcaaaaacacacatgggaaacacgatgaggttgggttgccgtcgaacgttcttccgtaaaccagattgtctgacatcgaaactgtatggaaatcctccacatgtagatgagcgccatcgtcacagatatgaggtcaatcctagctttgttccaatgcttgagaatgctggacttcagtttgttggttgtgatgaaagtggaaataggatggagattgtagagctacaagatcacccattttacataggtgttcagttccatccagaattcaagtcgaggcctcgaaaaccctcgcctccatttacaggtctgatactggcagcgactgaacacatgcgaacacttacaaatgtctccaatggtgacgctggagcttctgagtagtgtcatttgcacactgtcagatggatatcgcccaatgtgtgtgcagttcaagtatctgcttgtcgtcgaagcagtttgcatcatgtagtcatgtaccagaaatgtacctaagctgagagatacgttctgttttccgtggggagtggcttaaccgatcatcatacaatggggtcgtaatttcgttggcacttgtcgatggccatgccaaggcacttgttgacatcatttgaggtacaaccgccgcaacaacccgagatgatcatgtaaagagttctttgacctgccccctctttattaccatggtaaatatggcatgctgcaatgcgaaaccctggtgaaataagtacccttttagaagaaaaaaaattgctatatgtttttctttctttttcagaacagtaccagtcttcattcatcgcagtttacacttgtcgccattctaaacatttaaaca

SEQ ID NO: 18803 - DNA, 555 bp, Triticum aestivum
  unsure (1)..(555): unsure at all n locations
  Clone ID: PAT_TA_18803
cgtccgcggacgcgtgggtccgttgccttccagttcgatttcgagttccccaaaccgcagcgcgcgcaagtcgaagccaagttcgaattcgcggagaaggagagggatcgatggcgcgtacgaagcagacggcccggaagtcgaccggcggcaaggcgccccgcaagcagctggccaccaaggcggcgaggaagtcggcgccgaccaccggcggcgtgaagaagccccaccgctacaggcccggcacggtggcgctgcgggagatccgcaagtaccagaagagcacggagctgctgatccgcaagctgccattccagcgcctggtgcgggagatcgcacaggacttcaagacggacctccggttccagagccacgccgtgctggcgctccaggaggccgccgaggcgtacctcgtcgggctcttcgaggacaccaacctctgcgccatccacgccnagcgcgtcaccatcatgcccaaggacatccagctcgcccgccgcatccgaggggagcgcgcctagatcaggcttagcaacttccgtcgcgggattgctg

SEQ ID NO: 18804 - DNA, 936 bp, Triticum aestivum
  Clone ID: PAT_TA_18804
cgtccgtgtgtttctagttttagggagcaagcaagtcatgtaacaaaagtaccttgtgttaaggtacaatataagctttgccaaacatttcgtgatggaatgatcccaactgatccaattgaggttatgtatcactgtcctgaggaggagattgcatttggacctagttgctggctgtgggattatcttcgcagaagtcgagcatctggatttttgcttccactttctggtggtgcggatagttcgtccgttgcagcaattgttggctgcatgtgccagcttgtcataaaagatatagataaaggagatgagcaagttaaggcagatgctatgcggattggtcagtacagagatggggagttccccacagacagcagagagcttgcaaaacgtttattttatactgtttacatgggaacagaaaatagttctgaagataccagatcacgcgccaaaaggctggcggaagagattggttcattccactttgatgtacctattgacagtgtagtgtctgcatttctttctttgtttgaaagattaactggcaagcgaccacgctacaaggttgacgggggatcacatactgagaatctgggattgcaaaatattcaagctcgaatcaggatggtgctggcctttatgatggcttctctaatgccatgggttcataacaagtctgggttctatcttgttcttggaagctcaaatgtggatgaaggattgcgtggttacttgacgaaatatgactgcagttcagctgatataaaccccattggaagtgtaagtaagcaagaccttagggctttcctacgatgggcagcagttcatcttcagtattcttcattggctgaggttgaagctgcacctcctactgcagagcttgagccaatccgcacagattatagccagttggatgaagtggacatggggatg

SEQ ID NO: 18805 - DNA, 1935 bp, Triticum aestivum
  unsure (1)..(1935): unsure at all n locations
  Clone ID: PAT_TA_18805
gcccgcgggcgcccgtcctaggttttgtgctttccagctcgcaaagaccctgacagacactggcttcacctgggacgacgtaacgatgctgaggttctactatttggcgaagcacgcggcggcagcggacgcgatgtcccgtgcattctctgaggccttcaccgagctcggaggagccgatggttcattgagaaccgccggggcgcccgtcttcaacctcatcccggtctcggggtccggccgctccgcgtcgatggatgatgttattacgtgcgagctactagcttccaaggcttaagccaagaagaaccttggcctgcacttgttagcttccaaagcttaaggttcaaacctggcctgtagtgcactgtctgcacatgcagcttggtgccaggtgggtgcatcttccgttagaaacattggaggcaagcagtagtaggatgggatgctctgccgaaggaccccgtgctccagctggctgggcccctgcttatctggtgcctcgcggtgcgcgggatctggcccaccggggtatgcatgtacggggcttcttatgcggggctcctagttgcattggaccttatagcccggcaccactttatggagagattttctatgtggccgggcagctcgggcttgacccccacacaatgtagctctgtccgggaggcgcaacagcgctactcgagctagcactgcgagatagtgaagctgtggctaatgccttcaagagctctatcgtctcttctgcagtacacttcctggtgtactgctctgcccacctgacatccactgagaaggaagcagttgaacaaaagctgcagaattcatatattgctcatttggattccgcaagaagtggatcatatcctactattctatatgtactagcaccggatcttccaaaaggagcatgtgtggagataaaaccaacgttgtatgtccccactgatgactacaacgacaatgacgatgatggagatattaccagagagccggaggccggagggtcaaagccatcatcgagcaaagtcccaagtgagtggagcgcgcaatactctggcttgcacgactcatgctgcctggccaacacggttgctgggaagatttgctctgctgtggtttcagtcacgaatgatatcgcgtcaaagatctgtcccagcaccgaacatctacacccctcaaaggagcatttgaaagccataaccaggttttgtgctttccagctcgcaaagaccctgacagacaacagcttcacctgggacgacgtgacgatgctgaggttctactactcggtagagcgcgcagtggcagcggatgtggtgtcccgtgcgttctccgaggccttcgccgagctcggagccgccgatggttccttgagaatcgacggggcgcctgtgttcaacctcatcccggtctccggatccggtcgctccgcttccatggatgatgtcgtgacgtgcgagctgctagcttccaaggcttaagccaagaagcaccttggcctgcacttagtggcctccaaagctaaagtcaaaacctggcctgcacatgcacatgcgccatggtcgatcatgctcgctggaatgcatcttccgttggaagattggaggcaagcagtgggacgattgattatccgccggcgctgcgtcaagctgggcagcagatagccgaccaggtgccttgttgttagcggcagtttcctctctgtgacggtgatttttggtttattgttattattatatgatgatcaatatcaaatatgatattcctactataccacanagcacattggatctggttggcctgtggctgtggcttgtaacgactttggttggttggttggctcaattagtggcatgggtgttcgtcgtgttaaccaagcacgcacggcttattgtattcacaagatttttaaaaattttgttatacaaa

SEQ ID NO: 18806 - DNA, 872 bp, Triticum aestivum
  unsure (1)..(872): unsure at all n locations
  Clone ID: PAT_TA_18806
catgccctctcatcaaaacctcanatatactgaccatgttcgtccggcattcaaccctattcagaatgataattatctgacatcccgacttctgccacagaaccatggttctctatccccttatgcacagatgtcactccaacaacctagaaactcacagcttgcaaatggtcactgggatggctggagtgatttgagacaggggaataatgttcccatgtcggacatgtcgaggatgttatatccaactgaagctaacaactttcacatgctgggttcaaatgatatgtataacagaacctttggactttaattgtctttgaaggtgaatattgacctctccgcgtctattttgggcgtgtctcttgttctgaaagtaactggttgcacagtgcttgtctaatggttgtgcttatgagctggtacgtgaaagttctactggaaggcagttgatgcaaatgggccgacacgatcctgagtttgaactagatcttccaagcacaaggttcctttctaggcgaagtcatacatgaaacaggtggtccttgaagtatatggatacatatggtttgggtgcgatggaagctggcttgagaagagagacaccgtttagcgtgtatgttctatttcgccatcgtagctgtgtaaatgttttcttgccttggggattcgagagactcctctgtacatgatttgtaacttgccgctggtaggtcttttgtggtgcatagaaagctcatgttttggtgtggggtttgttgaatcaaaaactgaaagcaaatgtgacaatcatctatagctcaactgacaattgtttggcatcaaactgaaggaaggtttttgactacaaaaaaaaagtcgacgcggccgcg

SEQ ID NO: 18807 - DNA, 944 bp, Triticum aestivum
  Clone ID: PAT_TA_18807
ttgtctacagagaagctttccctttctccttcgtgcctggatccccttttcctccgtcgttcgaccgcttttatcacctgcttcttcctccgggatcctactccggcaagagaacgccgatctcgtcgccggtgtctccagcggcggcgtctgcgtcgtctagggttccgacaaggtcggcgtcgtctagggttctgacaaagtcggcgtagtctaggcccccgtcaagcttcgtcaagctcggcgtcgacaaggtgcgatgggcggaggcagcgacggggagtggagctcgtttggattgtaagccagaagttgtcctcggcatcccgagcttgatttccgccttggaagcccatcctgcacagggggtaggggcgtggacgtgaggctccagggtgctactaccacgtatggccggccccgtagtcccgtggataagcagcggtatgactcaagagttttccttcttcatatcttagcaactacagaggtcttggaatggagggtttctctaatgatgatctacaaggtctacatgagaaattgcttttcgagattgtcacttgcaaggacaatgaaattcagctgccatttgtaacttctttcctgcagagacatggtttccgcatgttcaaataaagatttcaaggcaatcatttttgaacccacatatgaacacatcttatgtaccaactaacatatttccctttttattatcaagggtccaaatgcaacagaattttccaactcaaaggaatagtaccgtgagggaactcttctatttctttattagctgtaaagaaggctccccaatgaagctgttccattggtttcccagtgatactttgtgtcattactttcagttgtaaagaaggtttaaatctgcagaataagtttgtaaagaagctcaaacatgcttctaactcaactttctggattttcaa

SEQ ID NO: 18808 - DNA, 1007 bp, Triticum aestivum
  Clone ID: PAT_TA_18808
gcacgaggcgcgacgacagcgccggcggcgagagcgcgtgcacggcgctggtggccgtgctggcggcggcgctccacgccaaccacccgctgatgccgacccgggcggagctggacgcgctcatccgcgacggctcgtccgagtggaggcggctctgcgacgacgaggcgcacatggcgcagttccccaaccggcacttcgacctggagacggtgctggcggcgcgaacgcggcccatcgccgtggagcacgacagggccttcgtcggcttcttccagccggagagcttcgcgtcgctgtcgggcgccatgtcgttcgacgacatccgtccggacatctggcgcgagatcagcgccggcgagcgcgccccgggcgaggccgacgtgtacatcgtcagctggaacgaccacttcttcgtgctcaaggccgagagcgactgctaccacgtcgtcgacacgctcggcgagaggctcttcgagggctgcgacaaggcctacatgctcaggttcgacgccacgtcggagatgcgcgccctgccgtcgccggactcgtcaccgtcgtcggggccggaggaggaggtgtggtcgccaccggcaaggagtgctgcggggagttcatcaagaggttcctggccgccatcccgctgagggaggagctgcacatcgagcagagcgggtgcgccgacgccggcgcgccgcaccggcggctgcagattgagttccacttcaccgtgctgcagcagcagcagcaagatggagggagatgacaggcgggtgtgcttgctgctgactgcgctgctgcactaacatgatcaatgtacattcatatacatacagcacagatgaatagaaacatgaatgacagcattattattaccagttgcaagattttggatagtagtaagtgtaataggcacagggaatacagaatatgtttacatacagtgaattaggcagacagagattgtaaaatatacaccgagtttcttgaaaaaaaaaaaaaaaaaa

SEQ ID NO: 18809 - DNA, 1107 bp, Triticum aestivum
  unsure (1)..(1107): unsure at all n locations
  Clone ID: PAT_TA_18809
ccctcgcctacccccaccgccgccgggagccgggggcgatggccggcgcggggtcctcgtcgggcgggtcgggcggcggcggcggggggagggagggcgactgggactgcggcggctgtggcaaccgcaactacgccttccgctccctctgcaaccgctgcaagcagccgcgcctcctcgtcgaccccaacaccccgcgcgactccaagtggctcccccgcgccggcgactggatctgcaacggttgcagtaacaataattatgcatccagaaagaactgcaagaagtgcaacctgcccaaggaggaagcagcgatgccgcagttgtcaatgggaggaatgatgccagcctatgcagattatatggccagggtacaggagattgccaatgctgggtataagatgaactttggcaatccagctatgcagcagcagctgcttgcaaacgcaaactggccctatgggatggctggtagatatggtatgcaatcttctgcttggccattcgccggcaacagcacaaatcagtttcaaggtgttccaaaggactggcgtagtggtgactggctctgcagctgtggattccataactactcatctcgtgctcagtgcaaagagtgtaatgcacctgtcccatcaggcatggcctctacaaccatgaaatccacaggagcagatagttcttcaacattaggtaataagcgtttggcatcagaggagcttggtaatgactgggataataaaaggctaaatcctggaaatgctaattatccactttcagcagcaggctcagataatttatttatgggtcaaggtgctggaaacaataatggccagacaacttattctgcatatgacaatggaaactcaatggcgtctggacaaattccagggatgtctggtgtagttggtaaaggagcaaaatggcgtgaaggagactggttgtgcaccaactgcagcaatcataattacgcatctcgtgcattttgtaacagatgcaaaactgcgaaagagtcttcggttcatccgggtgcgctataagaatagctttgcttgtacttttgcgactaaattattaaagcggcgtngagtctcctggttctgctgc

SEQ ID NO: 18810 - DNA, 1545 bp, Triticum aestivum
  unsure (1)..(1545): unsure at all n locations
  Clone ID: PAT_TA_18810
tggacgcccacgcgtccgcccaaatctcctccccactcccgaatcaaatcccccgtcacctccgccaccaccccaccccacctatccccaccgccggcgcgagcacgggagcgcgagcgcgagcggagcgatggccggcgcgggatcctcgtcgggcggctcgggcggcggcggggggagggagggcgactgggactgcggcggctgcggcaaccgcaactacgccttccgctccctctgcaaccgctgcaagcagccgcgcctcctcgtcgaccccaacaccccgcgcgactccaagtggctcccccgcgccggcgactggatctgcaacggttgcagtaacaataattatgcatccagaaagaactgcaagaagtgcaacctgcccaaggaggaagcagcgatgccgcagttatcaatgggaggaatgatgccagcctatgcagattatatggccagggtacaggagattgccaatgctgggtataagatgaactttggcaatccagctatgcagcagcagctacttgcaaacgcaaactggccctatgggatggctggtagatatggtatgcaatcgtctgcttggccgttcgccggcaacagcacaaatcagtttcaaggtgttccaaaggactggcgtagtggtgactggctctgcagctgtggattccataactactcatctcgtgctcagtgcaaagagtgtaatgcacctgtcccatcaggcatggcctctacaaccatgaaatccacaggagcagatagttcttcaacattaggtaataagcgcttggcaccagaggcgcccgccgacggcggggttaagataaccctggctcctggacctccttactctcctctttcagcagcaggcccagagctggtacttatggctccaggtgcgggtacctgtaacggccagtccacttctgctgccggggacgatggcaacgctttggcctctggccatgttccagggtccccccgggtagttggcaaaggagctaaatggcgtgaaggagactggttgtgcaccaactgcagcaatcataattacgcatctcgtgcattttgtaacagatgcaaaactgcgaaagagtcttcagttcatccgggggcgctataataatagctttgcttgtacttttgcgactaaattgttgaagcaggcgtggagtctcctggtcctgctgcggctgatcggtcgctgccaccgccaggattgttgttatgcgtctggtttggccgtgcagtgcttatgctgctgttaaaattgttctgtctgaatctaatattgtttgtgggagtttgcatttgtttacgccgagcactagaataaaatgtttcctgtatgtcgaagtgtaccatctgttctttttttggtttttgtgtgtgcgtgtgcaacaatttgattggttcttcagtacctcgacagctatgatgtaatgtaatgctggatctatttcaagtggcaatgctggattttattgtttttagaaaaaaaaaaaaaannnnnnnnnnnnnnnnnnnnnnnnnnnnnnn

SEQ ID NO: 18811 - DNA, 1190 bp, Triticum aestivum
  Clone ID: PAT_TA_18811
tcgacccacgcgtccggctcctgcctcctggtctcctggtctcccaactccccaagaagagagagcgagatccactgccggagaaaggcagagaggatggtgggcccgcagtacgacctcgtcggcaaccccctgggcgcggtgcgcgccaccttcgagagggcggccgcggcggagtccgggggccgcgaccccgtggcggcgttccggtccaaggactggggcgccagcgaggtgttccgctccttcctcttcgagcagggcggcctcgacaaggttccattgttggatgcatcaaatctcggattgatcaaacccaacaccctcgtccggttccgggggatggttcaggacatgctcgggaacgagttctatgccggggctttcaaggatgggtctacctggaggacgaacaagtttacagatttctcgccattcgctatgccacacccgtgtgactcgcatctctgggagcgccatctcttccattgcgtgccggtgcctggacagaattcttggacactcgagtcttcccctgggcctgacttgcgccagatggcaaactgcttgacacctgaacaaagggagaaaaggaagagggatggagatgatgttgccatggatgtctcagaaaatggaaatggcgagagttcttcatgcagcaagaaaccaaaggaagatgacgtccagatcccatctagttcagccgagatgccagcaagtgaaaatgtgccacagatgaatgggaatgatcatcatattcctggaagctctttttcatgtctagtgaagatctatgatatgcctgaaagtcaagtcaaactaaatgatgttgctgagttcataggggtatacacatttgacccagaacttgctgctcccaatgataattcggatgatataatgtttgatctcattgaagatgtaacagctcagttgcctcccagcaaggtgccccgtcttcactgtttggtgtggcgaaaattatcatctgttgattttctagcaaagcatcctgctgttgagcctttgccaagtctactaaaaggcatccggcaatctttgctctcacatctcactctggtattagggaaagatgacctggcagctaactgtttactgctgcatcttctatccagactacgaactagggtggatgtggtcaccgttggcaggctctccttgaattt

SEQ ID NO: 18812 - DNA, 1200 bp, Triticum aestivum
  Clone ID: PAT_TA_18812
ttcgggcgcccgcccagggagggtcagccatttacagaatcagatttagaggaactacaggcccgaattgttgttgcagaaaatcttccagatgatcattgttaccagacccttatgaagattttctcatctgttggcagtgtaaagtcaatcagaacatgctatcctcagtccccaaatggcagtggtccagttactaatagatctgctaaactagatatgcttttcgccaacaagctacgcgctttagggtggtatgagaactgagagacatggtgaggaggatgtttcgttttctgatctgagaggaaataaacatgcagaagaaacatctcaaccgtcaagatgcgcaagggagagcatgtttccgaggagaggcactggcagatacaggccgtgggcgtggcagaaggccgagggcgtggaggtagaggcagagggcgtggctaccataacaacaatcaataccaccataacaaccatccgcagcagcagcagcactaccaaaacagcaacaatcaaggtaacaacaaccggagtggcgcccatcctgtcggaaccccgccttccagccacccagtgaaggccgagcagcagcagacacagtcatcgcctcccgcgggagcgaacaaacagcttccagggccgcgtatgccagacggcacccgtgggttctcaatgggcagaggaatgccgcaaacatcgacgcccagcatatcgactagtgaaccttgaacttgattcgtggcacaggagagacgagacacagcttgtgctgctgattgccatgttgatagagagatggcgagagactgtcttctagaagtcttgtcttttgagtgtgctttctgatttacagaccataatatggttttgcgcgtgctgtgtgtactttaaaaccattgccatgttgatagagagatgacgagagacttgtcttttaggagtcttgtcttttgaatgtgctttctcgatttacagaccataacatggttttgcgcgtgctgtgtgtactttaaaaccggtagcgcagtggtttcggagtgattatggccaccatattgtaactcctatttttttgctcctttttgcctctttgactgtaagattgtagcagtaaaagctcttttgggcacagaaaggtaaagaaaataaaaggaacatgataaaaaaaaaaaaacaaaaaaaaaaaaaaaaaaa

SEQ ID NO: 18813 - DNA, 742 bp, Triticum aestivum
  Clone ID: PAT_TA_18813
ccgcaaccaccgatctgcgccagcgtcgcggcgccccagagccccaggcagcggacacgtcgggggaaggctagaccacgggcgaggggatcgccgctgcgggggcggtcgctgaagaaggtggcggcggggccgacagacccgggcgaggcggcggcgacggagagcggcaggggcgccgcggcagccgcagcagcaaacgggtgcagcagccggacacgagagaagcccctcttctttgtcctcctcctctacaccaagtatctgcagcagtcacggcgacggcgagctgacggcgctctgccgggtccttgcgtttgctgtaaccggggcggagattctgaagaactacggcctcgctgttgagaagaagattagaacatccacggtggaaataaacgacgaatcgagaggccgcccattccaaaaggccaagattgagatagagttgggaaagagcgagaaattcgacgagttgatggcctctgctgcggcagatgccgaagaaggcgaggaggaggcctgaagaaccaaacaaagccgtagcgactgcatcctgttgctctactttgttttcgctgttgtttaaaactttcaaaaccaatgcacgagacatggcgtgtgtccctgtttaacttgtattttcgtagtgtcagtgtttgtgaactctttgtctgatgataatctgttccgcgtgcatttcttgctccaaaaaaaaaaaaaaaaagtcgacgcggccgcg

SEQ ID NO: 18814 - DNA, 784 bp, Triticum aestivum
  unsure (1)..(784): unsure at all n locations
  Clone ID: PAT_TA_18814
gtggatcccccgggctgcaggcgcgaacgtcgccgaggcccccgccgccgcctacctctccctcaacatcacgctcctcttcaccgccgtgaaccccaacaaggtgggcatccgctacgccgccacggcgttcgacgtcatgtaccacggggtgccgctcggggtggcggccgtacccgggttcgagcagcccgcccacagcacccgcctgctccagacccgcgtcatcgtcgaccgcttcaacgtgctccagtccgacgcccaggacctcatccgcgacgccgcccccagcgaccgcgtcgagttccgcatcaccggcgacgtcgccgccaagatcctcgtgctcggcttctcctcccccaaagtccaggtgtcggtggactgcgcgatcgacatcagccccaagaggcagtcggtgacatacaagcaatgcggcgtggacgggctaagcgtgtaggcagcaagcgaaccaggccaacctcgccgccgccgccgcgaacaccgcagaagcggaagctactggtattaatctagtggggatagatatatgtggatgggaatctgtacgtcgattctagtctctaatctcgggttttgattcctttactgcgcgtgggggccgggtaattttctcagctctcacctctcctcgccttaggaggtggaggttaccgctgattcttgtgaattattgctggatgccattagcagtgagtatataaatcactcgccgtcagtcctcgtcncgtgcccgcgcctgagggccgccaaaaaaaaaaaaaaa

SEQ ID NO: 18815 - DNA, 904 bp, Triticum aestivum
  Clone ID: PAT_TA_18815
cgtccgctcacacacacagccgccattagcaacaatcgcaagcaactccattacctagctagattcatcttgagttcttgaccgagtttcgtctgccgtcatccatttggggatcgatcttcaagatgaagaaggcgtccaggttcctgaagcagctgttctcggccatcgtggcggcggtgagggagaggtctgcggcgacgcgcgccaggacgagcgccgcgcggacgcggttcgtcttcttcggcatcctccgcaacaagcagctcctgaggaacgccatcaacagcaagatccacgcgatcgtggggggcggcagcggcagcggccagcaccttgttgcggcgagcggcggcggcaggacggtcgccgtgctggagaagctgccgagcttcgtcgcggatcaggggaggagggccgccgtgctgctcaacagcctgccgagcttcgccatgggccgggacggcggcagcgactcgccgctcgtcggcggcggcggggaggagaaagaggagggcgacgagggcgtgccgaagcagctgcagctggcgaacgcggcgccggggtccgtgatcgagctggcccgtggcgcggcggagcggggcggcgtggagttcaagctggaggacgagatagaccacgtcgccgacgtgttcatcaggaggttccacgaccagatgaagctgcagaagctcgagtcgttcaagaggttctgcgagatgctcgagagaaactaattcacgcagcagcaggctgaataatcagcgcgacattgatcggtgcgaagtgcattccatggttgtggttgaatcgatataattagtccctatgattaaggcagaggtttattaatcaagtaacctctcaagcacttgaaaaataactggcgcgtactgccgcttcc

SEQ ID NO: 18816 - DNA, 1583 bp, Triticum aestivum
  unsure (1)..(1583): unsure at all n locations
  Clone ID: PAT_TA_18816
agacttgcggcatgtgagagtctttagtgtggatccacctggttgtagggatattgatgatgcactacattgcacaccgtttccaaatggaaattttgaagttggagtccatattgctgatgtcactaattttgtccatcctggtacccctcttgatgaggaggcctctcaaagggcaacttctgtttatcttgttggacaacgaattgacatgctaccgaagcctctaactgaagatgtttgttctcttcgtgctgatgttgagaggctggcattctccgtcatttgggaaatgacacctgatgctgatatcatatcttcaagatacacaaagagtgttatcaagtcttgtgctgcaatgtcttatgtagaagcccaagcaagaatggatgacagccgtttggccgatccactgactgtagacttgcggaacttaaattcattagcaaagataatgagaaatcgacgttgcgaaagaggggccctgactcttgcttcagcagaagttaaattcgaaattgacagtgaaactcatgatccccttgacataggaatatatcaaattcgtcaggcaaaccaaatgattgaagagtttatgttggcagcaaatgtttctgttgctgagaagattttgcagcactaccccttgtgttcattgctacggcgtcatcctagtccaacaaaggagatgcttgagccattactccgtactgcctcctctgttggcctaagtctagacgtatcatcctcaaaagcattagctgaatcacttgataatgcgaagagagatgacccgtacttcaacaagcttatccggattttggcaactagatgcatgacacaagcagtttacttttgcagtggagatttgagcttgtctgagtattatcattatgggcttgcatctgctctgtatactcatttcacttctcctattcgcagatacgcagatgttgtggtgcataggttgctagctgctgctctagatattgcgaaacttccaccagtcttccaggatggtccacaactcacaggcatcgccgacaacttgaattataggcaccgaaatgccccaaatggcaagcagagcatcggttgagctccacactctcatatatttcagggcaaggcccgtggatactgaagctagaatagtaaagatcagggcaaatggtttcatagtcttcgtcccaaagtttggcatagaagggcccatctatcttacggcgaagggagacaaaggggctgactgggtagtagacgaggttcaccagaaagtaaccaagcctggaacaaacataagctatgctgtgttgcagagtgttatgatccatatggaagtggtggagcctcagccccaccgccccaagctgcagctcaccctcatatgaacaacaaatgtatgattgaattgtaacattagtgcattcaccctttttccgctacaacagtgtactaggtccattctttaattcaacaaacattggtgatcttatgatattgtcaaatcagcctggaattgctcttcacagagttgtaaaaatctctctttatcgatgctaaaaatnctagcanacctgctg

SEQ ID NO: 18817 - DNA, 766 bp, Triticum aestivum
  Clone ID: PAT_TA_18817
cgtccgcccacgcgtccgaagatacttatcttgaatctaacagtaatgcagttgatcttggaatactgagcctaacttctacaaggtgcatggctccaaactccaaacagattgctgaacataggcacgaatgtggaggtgcccattgggcagctgatttgccagctgatatagttttagctgggcgactaatggcacaatacatagacagcagaatgctgactggaaagagctctgccatctccggtccaaatttggatctcattcagcactatgacatagattctcctactagcaagttggaatcacatatatgtgcgattgtcttgttattatgcctccaaaagcattatatatcagatctttcgtggaaagaggaaactttatcccagctggttcttttgatatgtcaagttaaagtcaattcaattgctattggttgtatgaaatccatggatggaggccagggactgacagagagtaaaggttattctgcagctgatgatgcagttatgtgtagtgtggagcaggtcaaggttgctcaagctatctacatgtctggtagcctctttaatcactcgtgccggccaaatgtacatgcatattttcattcacgcactctcttcctaagatctaccacatatataaattcagggagcccagtcgagctatcatatggtccacaggttggtgagatgaatcttgtgaaaagacaaaagtcacttcaggagaattacaaatttacttgccagtgttcaagttgttc

SEQ ID NO: 18818 - DNA, 825 bp, Triticum aestivum
  unsure (1)..(825): unsure at all n locations
  Clone ID: PAT_TA_18818
attcggcacgaggcgaacgccctgtcctccggctctgcaccatggccacccgttcctccattggttgagcttccttggatttcgcgttggctccttcgtaggagcgtggcttgttctgtccttgctgtccaggttgttccatcttgctaatttggtgcagaatctccgtttagctcatcgccgcgtcttcattctgctcgttgggtcgcgtcaagactgcagactgcatagtaacttcatgttcttagtggcgatccattagcagcagaccttgcccatgagctaatggcagtccatccaggttcagatcggtgatatccgtgccaatggatgagttacatactcaatgaagttgatcttgggctcaaccctttaactccagcctgcaactgctggaagtttcctggctaagaagcactgagaaaaggattactgaagcggtgactgggtgggtacacctgaggcgattgatgtcaagatcctgagcatgtggaattggaatttcgtttgtcgagtcctggcaccagtattgttggctgttttgttaactttccccccctgtttatgggagatcctttaggagctgtaggcgctaaacaacacctaagtttcattcatgcaaccatgaaggttttgggggatgacactcttgctctcagaaaaggttctatacacaatttcattccataggttctgggagatcctttgtgtaaataatagcttgcaaaaacgtcgtacattgcatgtcggaggagtattacttatccatgttaacattgnaatgataagttacataagggagaaactttatcaccaaataaaggc

SEQ ID NO: 18819 - DNA, 1005 bp, Triticum aestivum
  unsure (1)..(1005): unsure at all n locations
  Clone ID: PAT_TA_18819
cnacccaccncnctctggagnccgntttataggtgntttgtattcggcccgtccgcaccccacggtccgccttggctggtcccggcgctaccccctcaaacgccgcattcccggcggtaatctcccgcacaccgttgtcaaccccggaggcggaggctccacccccggccggcggcccgagcctggcaaaacatctgccccgggcccctcctacctggcccctagacgcgcccgcccggaccccttacccgcgaccccccgagcctgacaccgactcacaccaacagagattgttgggtattcaagcaggcaggcaagttaatccccgcaaaacaatgacaaggggctccacagcgatgacggaggaagagacccggccgccgaacaacagaggacagaaggaattccccccgcaagtgcggacggtgaacatgatatacgcaacccacatacccaaaagggagcggaagcatgcactcaaggacgtatatgtgatggagccagtcgccccaaagttcaacccatggtcctcctgcccgatcacttttgatcgaagggaccaccccaccagcatccgtcatgatggattcgccgcattggttttagacccaattatcgacggatttcacctcaccagagtcctaatggacggcggcagcagcctgaacctgctttatcaggatacagtgcgaaaaatgggtatcgatcctcaaggattaaacccacaaagacaacctttaaaggcgtcataccaggtgtagaggccaattgtacaggctcggtcacactggaagtggtcttcggatccccggataacttctgaagcgaggagttaatcttcgacatagtcccgttccgcagcggctatcatgctctgcttagacggaccgcgtttgcaaagttaacacggtgccacaaaccgtactcaagctcaagatgcaggcctccangggggccngtaccaantcgcccaaggagtctatagcnnctaanggcgtcntttaa

SEQ ID NO: 18820 - DNA, 989 bp, Triticum aestivum
  Clone ID: PAT_TA_18820
ccacgcgtccgaactcattgagaatggttatgctccgcctgactgggttgcccttttgcaagttgttgtgaaaaggataagcgttgaagatgaaaatgagtcggccctcgcgtcccagcttctgggaacaatagtcgatgctggccaagagaaagttgcggcgcacattcctggcactgtgtctaacattgccaatactatcacaaatctactgccccctgtaccagatccatggcctcaggttgtcgaacagggttttgctgcactggtagctatggttcaagcttgggatagccctgcaccagatgaaaacaaggaacatgagaagagtgcgtggcaattaggccagactgctatcgctcaaacttcttcaacagtattacaaaaagcttggctgttgccagttgaacagatggagccgactttagattctgcactgccaccaccttcatgtgtaaatgatgcttccgtgttgcttgaattcatcctgaggtctattacttctatggaagaaatcacacacatgaaggcctttgagctagtagttatatgggcagacatcattgcatactgggactcttgggaggaggaggaggatcaaggagttttcaacgcaatcaaagaagctgtcagtttccatcaaagatttgactcctctggtttctttctgaagatgcttccttcccaatctgcaaatggatcacaaagttcagtcattagtcgggtttctagttttgtgaccagggccattgcagcctacccctctgcaacatggagggcatgctcatgcatccatacaccgtccgatgctccagatttttccttgggagcagaagatactagaatgactcttgctgtaacctttggggaagcaacattttcctatttcaagggtgtatctgacagccctgctgggatatggaagccactactcttggccatttcttcatgctacatttgctattcagatgctattcaacaaggtttat

SEQ ID NO: 18821 - DNA, 813 bp, Triticum aestivum
  Clone ID: PAT_TA_18821
acgagccaccgcccacccctccattttttcgccagattcaatctgttctcctatcccacaactgcagcgatcagggcctgaagaagattgggggtcgccggctggccgccccgtcggttcaagctccgatccacaacatcaaccaaccccgcgagcactccgctctattctccccctaatttgcagcgaccggcgactgcggattgaaggaggccgccccaccagcggagctcagatccaccgcatcaacccgcgcgtgagcctttccccaccgactacagcaaccgggtcaccaggatacaatgaagggatttgggggagaaaagcaccgaggtgaggtagacgaaagagagaaggcatcgagcggagttggccgcgaggcttgatgcacaagtgacaacatttgaagacctgtaggggaaggaacatggagaattgcaagctgtgaagaagagacagcaagagaagaatgaagcctggcaaaagaagcaacatgagatggataacctgattggttttctcttaaaggctcaaggaactcagcaagcaacttagcagtcccattccaaacctgacggtgcatgaaggccatccttttgtgatggaaagatagttgctgaatcatatgttgtaatcatcaggacaacacatgtggtctttagttatttaaatattgcctttttaacttgtctattgtcgtgtcaaactccagagtgagtgttccattttattgtcacttctagttagaggatgatttggctgagacggttgattatatgatatgatttgtcgtttcatacaaaaaaaaaaaaa

SEQ ID NO: 18822 - DNA, 2053 bp, Triticum aestivum
  Clone ID: PAT_TA_18822
gctccctgggcggattttgtaatggagatcatgtcacgccttgttagcaggcagatatggaaatatccgaagttatgggtaggattcctgaagtgtgctatcctgacaaagcctcagtcctatggtgtgttactgcatgttaccggcccctcggctcgttgctgcgcgggatgccatccctgcccggagggcgcccctggtcgcgcgtgcctgcctgccctccgggcgatcgtctctcccggggcctggctcggcggtgcggggcctcgctgacgctcggtctaagtgccgtctggaaccttagcaggttaagcacctccaaaccggggacagctgtctggcacattgctttgcagagttcaatcaatcgtatagatgaggtccgcatgaaggcaatacgtttggtagcaaataaactatttcctatgtcaagcatttccaaaaggattgaagattttgcaaatgaaaaacttaattcagtcctagaagtgattccagcggctgaatctgcctcagctgctgagatgggcacacccgaggttcaccaggtatacaacatttatattacactaaacatttgatggtggttttagaaaatatatcctcggtagcagatgctctaactttgatgtcgctgtattttgctctgtgtaccaagaagcactcccttctccggcgtgtatttgaaatatatggcagtcttccacaggctgccaaacaggcagttcacagacaagtacccattctgattcgcacgatacgttcctctcctgaccttcttggtatcatctcagatccaccagctcactgtcgggacctactcatgcaggttttacagactctcactgatggagcagtgccatctcaagatctgatttcttccataaagaacttatattcaaaaactaaggatactgagttccttttcccagtcatggctcatctgccaaaagatgagattctgtctgtgtttcccaatattgttaatcttccggtgggataagtttcaagttgccctttctcgaatcctgcagggatcaccacaacatggccctattcctgacccatcagaaattttgattgcgattcatgtaatagatcctgaaaaagaaggaataccactgaaaaaggtatggatgcatgtgctgcctgcttcgagcaaaggacaacattcactcagcaagttttggcaaaagcactaaacaacgggttgaacagattcccctacctttgctgtccatgcgaacggttatgcaaccgataagggcttctccggccttggtggattttgtgatggagatcatgtcacgccttgttagcaagcagatatggaaatatccgaagttatgggtaggattcctgaagtgtgctatcctgacaaagcctcagtcctatggtgtgttactgcagttaccagctccacaactcgaaaacgccctgaataagaaccctgtactgaaggcgcccttggtcgagcatgccagccagccaaacgtgcgatcgactctcccaacgtctcgcgtcgcggccctgggcctcgccgaagatcaacagcagcagcccgcacccgaggcgcagagcagccagaaccaggccgcggagaccagcagctccgccgcagaggccacgacagaagtaacccaggagtcctccgccgccagttgacatttcccgccgcagcccctggccttttctgtatttgctggaacggaatggaggcatttgccaggcgatgaagcactgcccgtattaatgtagtaccgggaaagatggcatggaaagaccatgtggcgaagcaatgtttagctgctgcgcaatttgtataaaacatttattacactaagaatttgaaaatagtggtaggagaaagttgtcgttgagccctgttgtccatttgtttgggtagcctgtattccagtccactaaagtggtatgtagaacattcaacaaggtttgttgtaaaaaaagttctgaatttgtctactatcaatgttctatttaactgttcgtagcggtgcatttgagcttggattagaagaacacacttcaaatc

SEQ ID NO: 18823 - DNA, 548 bp, Triticum aestivum
  Clone ID: PAT_TA_18823
cggtgatttggtcatggttaatggacttctattccagctttcactgccgctgaacttccttgggagtgtctaccgagaatctagacagagcctcattgacatgaagtctatgtttcagttacttgaggaaaaacctggaataaagggcgagccgcgtccgcgaccgcgtgggcggacgcgtgggtgcattgaattcgagaatgtccattttgggtatgtaccagaaaggcagattcttaatggggcctctttcactgtaccggcaggaaaaagtgtggcaattgttggaactagtggcagcggaaagtcaaccatacttagacttctcttcagattttttgattctacttcaggatctatacgaatagattgacaagacatccgaggagtcacactggagagtcttcggaagtctcttggtgttgtaccacaggacacggtacttttcaatgatgctattaagcataatataccatatgggcggttatcagcaaatgatgaagaggtttatgatgctgctcgacgtgcttctatccatgatacaatta

SEQ ID NO: 18824 - DNA, 654 bp, Triticum aestivum
  unsure (1)..(654): unsure at all n locations
  Clone ID: PAT_TA_18824
atggacaagcatccatcgaatcttcccatttttattttcccacatgactctacgcaacacaagaacacaataagagacttgggaagcataacgagtggacaacgtacaacacactaatgaccccggatgtggatcctctgactttgcaatccctgccataccctgcctttgagtcactgacaggtgggccccatgctttgtgggacccgtgtgtcagtgactcaaaggtaggcttggccacggcaggggatcctcgtcctaatgaccccttgcgtagaggtggcccgggagcttgggtttcatcactacctgtagcgggaacttgcgcggggtcgacaggccgaagatctcctccatgctgagctgatccgtcgccacgccatcggggagctcgcacacaaagccgtgcagcaggttggcgaggctcacatggatcaccttcagtcccagactatagccggggcacatccgccgtccggacccaaatggcagcagctcgaagtcatgccccttgatgtcgatcttgctgctttcgaaccgttctggtacgaactcctccggcgaatcccacactgccgggtcgcggccgatggaccacacgttgatgagtacacgcgtaccaacggngatgttgtagccacctacggaggcatc

SEQ ID NO: 18825 - DNA, 699 bp, Triticum aestivum
  unsure (1)..(699): unsure at all n locations
  Clone ID: PAT_TA_18825
ccacaactgcgcccctccccaaggattccctcggatacctccccttccctccctccccagctccagctccgtccccacgccgtccggtcgcggccgggccacggccattggcctcgctcctcccctcccctccccgtcgcccttcggccggcctccgtctcccccgcggaatatgaaactaaggacaaaacgacctggatggaagtccctcgtgcctctgcagttgagcaggaaatccaccatgcgcttctttctgtttcccaaggttcaggcatccggtcaatctccaaatgatactccggtttatcttaatgtgtatgatttgacacccatgaatggctacatatattgggcaggccttggtatatttcactctggcattgaagttcatggcgtcgaatatgcatttggagcacatgattatcccacaagcggagtatttgaggtagaacctcgtcaatgtcctggtttcagattcaggagatcaatattccttggtacgacgtgcttagatcccatccaagttaggcattcatggagctacaatccagtaaactacaatgggagattccttaccatccttatcantgaaagaattgcaaccactttgcaaggtatgtgttacaaattngaccggnagcaaattccaaaaggggtgaaccgtcgccaaaatagtgcatctgcaacgcccccccgggg

SEQ ID NO: 18826 - DNA, 776 bp, Triticum aestivum
  unsure (1)..(776): unsure at all n locations
  Clone ID: PAT_TA_18826
cgtccgctgatcccctctcccacgccccctctcgtccccatcctctcctcccgcgcatcgccgccgcaccatggcctcccccggcccgaaccaccgccgccagccaaggccaccgtcccctgtccacaccaattcccctcccctccatcccagacctcttcgcaccgtctctctgttctccctgttcacaggcggttcggccgtcgccagatctgcgcccaggccggacgaacgacggccggccgacgccccccggcgcaggatcttcgtaaagaaccgggaagtggatttcgtgatggagactggtgccaggaatagatgcatacatgaaatctatatataaatacacggagagtagtgccagggatcatgaggaaccaagatgtttttcagctgataatgtattaagtgattttcttcgggaggtcgtggggtcggggtgggtgcttctttaccagcactggggggtttatccacgtctcttaaggctgcccttctggttggcgcgggcccagcggaactcccttccaaatgtagctaggggccgccgcacaaattagatgctgttgcagttggcctccttggcttctatgctggggggcagaatgtgcggggcccataccaacgtttcggttatcggtcgggtggcggcccggtctgcttctctagacccctanttttttgggaacnggacnnaggcnttnnantttnaattctaangcgnncggcanaattttttgaaaaaaacccttaattttggcgtttccccccnaaag

SEQ ID NO: 18827 - DNA, 762 bp, Triticum aestivum
  Clone ID: PAT_TA_18827
ggagaactagagtctcgactggcagaagttcgcactgaaaactcaaagctaaaggataaactagatgtggtgaagttgtcccacaatgaattgacaaaggaacttagatcagttgagaatcagctagctgctgagggttcaagatgccagaaactggagtcccaaattgctgctgcgcataaaaggttggagtctgctagttctctggaaaatgaactggaagccttgcagcaacaaatatctcaggcggaacaaaccatgacgacttctcagagacggaaatcagggggcgtgtggaagtgggtgggaggaagtgcagaggtctccgacaatgaatagtccttcaagacaggcagccacccagcagcgaaacggaggcgaagctgctacagttttgagacggcttgtttgtcgcaggccaccgggctcctcctcaagaacttgcccgcgactgattttgcgaaggcgtcactgagaacagtcttttggatcttctgaagcggcgacacctggtagaaattttccgtaggcggcccgtttagacattgcacagcaaaagcatggtggtaccatatatatgacaagtatacctaagattgtaccggactggaaatataattggctggggatgttagctcttgttttttgttttaacctttctggagttggtatacaaatatgctcattggttcaggcgactgggtggaaaatacattgtttatagcgtaaatttaccgacttactgtcaagcgtttctggttc

SEQ ID NO: 18828 - DNA, 1456 bp, Triticum aestivum
  Clone ID: PAT_TA_18828
gaagaagttaaaacagaaaaggtggcccagctcctaggtatgatcattcggctgctgtttatgctgaacattatcttttaatgctttggcggttcctctcactccacatgcttcaacgatctgtacttacttgacttgcaaactctggagtggtctcaacctgacactcaaggtgcacatataactcctaggagtggccatgctggtatgatgattgacgaagattggtacatagttggtggtggagataatgccagtggttccactgatacaatcgtaatgaacgcttccaagtttgtctggtctgtggtcactagtgtgtcagttcgagatccacttgcttgtgagggcctcactctttgttcaaccacagttgatggcgaaaagtttctaattgcctttggtggttacaatgggaagtacaacaatgagatctttgtgatgaaacccaaaccaagaaactttgtgcaacctcggcttttccaatctccagcagccgctgctgctgcagcttctgtgaaagctgcctatgctgcaataactgctactgatgagaaaactaaagatattgttgctactgatgatttggatgtgaagagagctgaacctggaagttcttccaaagaaatggttgccgaaattgatgcacttaatggggagaaaggagaactagagtctcgactggcagaagttcgcactgaaaactcaaagctaaaggataaactagatgtggtgaagttgtcccacaatgaattgacaaaggaacttagatcagttgagaatcagctagctgctgagggttcaagatgccagaaactggagtcccaaattgctgctgcgcataaaaggttggagtctgctagttctctggaaaatgaactggaagccttgcagcaacaaatatctcaggcggaacaaaccatgacgacttctcagagacggaaatcagggggcgtgtggaagtgggtgggaggaagtgcagaggtctccgacaatgaatagtaagtctgcgtgcaacatgcttgaatggaaaaatatctgatgtacttatgtgttactgtgctaagctattgtcagagcttcatggttatcattttgcgcaagaattttgtagaggttgatgtgatccctgctttcaaggatacaatgcatggttctagatcatatattatgtaagcaaatagttaatgcgtaatgtagaatgatttttgcacagcaaaaacatggtagtaatcatacatatgacaagtatacttaagattgtaccggtctggaaatataattggtttgggatgttaggtcttgttttttggtttttacctttctggagttggtatacaaatatgttcattggttcaggcgactgggtggaaaatacattgtttacagcgtaaatttacagactcgatcaggtgtttctggtccaggtgtgagcatgttatgtgccagtgcaatc

SEQ ID NO: 18829 - DNA, 568 bp, Triticum aestivum
  unsure (1)..(568): unsure at all n locations
  Clone ID: PAT_TA_18829
cgtccgcggacgcgtgggcggacgcgtgggctttcctaagccctccccgctcccacccgacccctcgaccatgtcccccaggaaggacgccggcccctcgccggcggcggcgcccgccaccgcgcctgccctaacgccttccccattcatgcccatgtgtcagatgcggcgggatgagtgcgcagacctcctcaagctgatctcaggcgtctcgcgccctctcgaggacgtcgtggcggatttcctcgcccgcgtcccgcccgagcgccgcctccgcttcggttccgccatcaaatttctcctcgaggacaaggtgatgtttcaaccagctgagcgtttaattgcactcgcaattcttcatcaagggtattcctcacaagctgacaaatcccgttggttccattcttaataaatgttgcctgtgatgaaatttctgagagaccagaacgtgtttttctccaacttttggctaactccagcctatgggggcgacaacnaggagatcttntaacatccngcaaaaagatnatntaaggnccttcttaagaccaagggttgctgcaaaaaa

SEQ ID NO: 18830 - DNA, 1087 bp, Triticum aestivum
  unsure (1)..(1087): unsure at all n locations
  Clone ID: PAT_TA_18830
gcccacatctctccagtccagccggctctgcgccacgagatttccgtccggccgccggcaccgcgtgcgcctccgacgattctgtcctggttgacacctaaacatgtctgatgtcgtggatgaagctcgctggcgtgagcaggtgtttagagaacatgagttctccgtggtgcgtctgcattctgttgctgcaaatgattttcgtgccaatggctttattgtctatcacagtaaaacgaggtgtctcatagtgtcatgtcaacatgtcgttaagatagttgaagatggtggaaccatgtatgcttatttctccaacagtgtcgccccatacaatgcaagagtattgtataccgatgagcaccgggatcttgctttgctgtgggctgaagaggtggtggaaccaatgacttctttgaggttctttgactcaccgtatgcttctggatggaatgttgtcgcactctcttttatctcattgggtgcttcatccaatcctattctagaaccagggaccttttctggtgacataaccaatgaaccagatgaaccacaccttcactgtagttgttcatctaaggaagcggcatcaggttcacctattattttggcaaatgtaaacgaggtagttggggtgcttggcggagcttcacgtgcgtctgtatacgctgttccggtcagaactataaaggagttcttaggacagcgccttggtggagtcaatatggacatgccaatcgctgggatggttaggcttgtcgcactgcagcaggcatagcacgagggtgtggttctcgtcaaggaggacacgaacaatggatggaaagttgtcaaggaagaaccatgagaagttgtaggaaatggtcttaataaaagttgtcgtgcgcacgacatagtcctaggcttcataattagcatgttggaatattctgatcctactagactttgtagctatataagccattgactgtgctcgttttagaacgtattgtagtattgtactacaaatttgtttcttaattgtgctactttattgtctgcgtcttaattatannnnnnnnnnnnnnnnnnnnnnnnnnnnnnnnnnnnn

SEQ ID NO: 18831 - DNA, 984 bp, Triticum aestivum
  Clone ID: PAT_TA_18831
ccgcggcgtcgggcctgtgcacgaggaggtgctcctggtagccgagcccgacgccccccagcgcctccgcggccgacgggcggaccacgcccggccgagtcttcgcgatacagacactgctcgccgtgcaccagcccccccgctggtgggtaacgtcggccccgcggcggacggctgcccccccggctggtccagagggtggagacatattggagtggggtgatctttcattcataccgcgccctcccacagctcctcgcgtgatttggaaggtccgtcaggcggcacaaagtagtccccctgggcccgaccccttttgcggtatcgctggcgcggtccgcttggtcctcatcgctcacccccccgtcaacatcgatgtccggtttgtgtttgcgccccacctgctcgtagtaccgggctacctggctctggccctgcgggtacacggaaacgaaaggtaaaacgatcggtctatcgagcttgtcgagaaggaaggcatcgactggtatgaagggaaccccggaccccatagttcttccgactaggggggcccaagagaataccccgtcctggagcatgacagcgattctgactgagttaaagcctcgcctcgtctgtttttggtggagcctgacatagatttaacagccgttctaatctatgtatctctcctgtatctatctgtacttacatgtcctgtatgtaattatggataggtgacctaggttccggtgtagtacgaggtagtttctgacacagttcgggaatagcaaagagaagatgggcgccgtctgatgtcaccatcattctaggctgctaacattgtatcgtactcttgaagctatgtgcctgttctaattgttttatgttgagggcggaaggaacaccagacagagctgctggtcgtcgtcgccggctgcggccatggttgttgggacttgggagtttggatttgggtgaggattgggttggagtggggcctcg

SEQ ID NO: 18832 - DNA, 598 bp, Triticum aestivum
  Clone ID: PAT_TA_18832
cgtccgaaatcagaagatcgctcctcttcctcattgtttggatcgaaagacgagagagcagagatggagcaggctatgctggctagggtattggccgttactagcgtcggtttgtcgtgggcagtagtgtggagcctcttgtcgcaacagctcaagcccttctccacgcccgccatcctcaggaccttggacgccgccgcctccgatccagtcatcggccgcgacgacgacatcgaccgcgtcatctgcatcctctgccgccgctccaagaactgcgccgccctcgtcggccctgccggcgtcggcaagacggccatcgtcgagggcctcgctcggcgcatcgctgctgggacggtccccgaagccctcgccggggcccgcgtggccgagctcgacgtcggggccatggtcgcgggaacccactggcgcggcatgttcgagcagcgcttgaaggatgccatcaagaaggccgaggattccgccggcaagctcatcctcttcatcgacgagatgcacatgattatcggtgccggcgatcaacgtggcggcaccggcgacgcggccaacatcctcaagcccgcgttggcccgtggccgca

SEQ ID NO: 18833 - DNA, 2053 bp, Triticum aestivum
  unsure (1)..(2053): unsure at all n locations
  Clone ID: PAT_TA_18833
tccttagatcccctggcaccctcttgctctggttccactccccctggccaacggcgtggagtggccccgcgccggacagacgcaagctttccttaggcaaaggttgccccaccgcctgccgccttgcgcccccgtgctcgggcgcggctcccgtcggtccgcgtctcgaccccgggtcaatgtggtgtccccccccagcggttgcggcgggtgcccccgccccggttatgttctcacttctaatgcggggagaaaatctcgagatatttgactaggtagcaatttgctcccaggagtttgataagacatagtacaagtatacaacagtggggaagtggcatgctggaagcaaagtggcagctttcttatactatatcactcctggcttcagaaactgcatacgaagatgcaaaagcgaacacaaaattactgataaccggggatttcaaatcaaagcacaaatcttgtgcaaacatccagacaacacctgaagctacaggactgcagattgttctcaggacagaacattacgattattaattaacttcgagtattcactgcctcatataaacgcagcaagccacctcatctctgagccatttccatttgacaaatagtatatctttttccacttctcttctgaaaaactttcatgtcgaataatcttttgcctcatataatagtggcacacagtctctgcttcatctacggtgtaccgtggaaaaatcagacgagcatcagaaggaacatccgggagctcctgtcttagtttgccaactgcggttgaatgtgagaaggctcctaccatcatatcattgtgaagcattgacctataagcattgaccgttgtaagctctttcgcgtggattgatcgacaggatctaacagttacaggctcctggtactcggtgaatgtaaaccaactgttatactgatcaatggcaaacagtacaggcacatctttaacaagtgatagctcctttcttaaacgaactacaacaccaactgcagcatgcgagtgggttatcccagtttgaatgagatcatacaatgtggacccttctggcatttccactgtgtcagcccctttcatcattccaacaccagtaccttctcccaggggaataggctcaagaatttgacatggtaactgctgtaagcgggtttcgttgtatttcaaaaaatcctgcaaaacctttccagcctgtacaggagtatcaaaaagatcactgtaggtatttctatagaaaaatcctccatgagtccaatccttcccttggggaacatagaacaccagccatccctcagtacgggcccaatgcacaagcatcgcaagtgcaatgcttttaccacaactccgagggccatccaagataatttgtcttttggtatctttgcatttggctgtaatagccggatcaacaattctccggaagttatcccgcaggtctaggaagctttccctcaccatcaccgcgcaccgcctcgtgtcttgaaactccttcagcatccctgctggcaatccttctggtaacatggctttccattcatccaaagtgaaatcgacgtaggcattggcgccgcggtgggagaaggacgcaaaggtgtcggtgaaggcgaagagcggccgaccgccgggcccgacgtcgagcgccgggtcgtaggtcgggggcagcgggtcggtgggcatctcgaactcggcgtcgatctcgtctgccccgccagcggatgcggcggattcccctgaagcggaggcgtcctcagacgccacgcctttgggatccttgacacggaccttgccacggttactagtggacgccgccggcttgcccccaccacccttggccttcgcctcgggccgggtgccccgcgggggggaagctagggaagcgggcggttcagagcgcgcggcgggagcgcggacgccgccggccgaaaccgcggcggcgccgcggcggaggagcgagcgaaggagcatttcggcggtggggcttaggcagggcggcggaagagggtttcgagctcggtctgtccctgccnnnnncccnnnnnn

SEQ ID NO: 18834 - DNA, 178 bp, Triticum aestivum
  Clone ID: PAT_TA_18834
cgggtcgacgggacatccaaaattgataataaaacaacatggaacaatcgaaaattatagatacgttggagacatatcagttattcttaagatgagtgtttattcacttgtcattgcacaagagtacggcggtaataggaattcccagtcccaaagtaacaacacgtaggtatgaaaa

SEQ ID NO: 18835 - DNA, 1825 bp, Triticum aestivum
  unsure (1)..(1825): unsure at all n locations
  Clone ID: PAT_TA_18835
cgtccgcggacgcgtgggcggacgcgtgggtctgtccagaatgcaacaaaatctctgttacctttgacccattcatgtatttatcgctaccattaccctcaactgttactcgaatgatgactgtgactgtatttagtggtactggggattctcttcccatgccttacactgttacagtaccgaaaaatggagtttgcagagatctttgtaaagccctgagtgatgcgtgctgcttaaaacagtctgagatgttgttacttggagaggtatatgattatcggatataccgttatttcagtccattggagctactaaatattataaaagatggtgatcagcttgttgcttataagcttcctgctggccatgaaaaacttttgaggattgagatcctacatcggaatgtggatagatttactccagagccccagtttaatgctcggaagctcattggaagccctcttgtgacttgtattcccaatgactcaacaagaaaagctgatatttatgcggctgtctctgcggttctggctccatttgtacgagcaaaagtgcatgctccaggtgagtctctgttgaatggcagcaggccaagtctggatggtattgtactaagggataatggagcctcatgtgagaagggtctttctacgtcaaatgtggatgaagcaacgagtgatgctgagtttttgccgtttaagctttacttgagtgatgataaaggtcatataagaaatcctgtagaagaagattctgatcacgtttttggtttgcccatgaggctattgatgggttggtctgataaagaacatgaaatatataaccttaaatacatggatgatcttcctgatgttttcaagccaggattcatgtcaaagaaaacacggcaagaagcagtcaacttattttcatgcttggatgcttttctgaaggacgaacctctaggccctgatgacatgtggtactgtccttgctgcaaggagcacagacaggctagcaagaaactcgacttgtggaggttgcctgagatattggtggtccacttaaagaggttttcatacagccgttatatgaaaaataagcttgatacctttgtgaactttccaatccatgatctcgatatgaccaagtacgcaaagcacacatcaggaggcgaccagccccacatctatgaactctatgcggtgataaatcattatggtggtttgggaggtggtcactattctgcctatgcgaagttaataaaagaagatagctggtatcacttcgatgatagtcatgtctcctctgtcaatgaagaggaaacaaggacatctgctgcttatctgctcttctatcgacgtgttgatggcaattcctgtgcaatgtccgatgttgttccagtcgacacccatatggttgattcacttgaggcatagatttaagtccgaacatcagtatcatgtggttttgtggcacttatggtgctcgtgctacgaatattgtttgactgcaattttgctggttttggggcactattggtgtatggtaggtcgttgaacaattgaaggttagggtttccagtatctccagtcttgtcggtttaaaagtaggattcatcttgacaagtaaactctgaagtgtagctggctacagctacaggtagtatgtcgaagtaacttctgaggatgcgttgtgggcttgggtaatatatatactgtcactattggtgtcgatgaggttggtaaactggtaatgtatccagctgaatggaaactattgaaactgatatgctgtatgtaacttaatattttaaaaaaaaaaacnagaacttcggacaacgagc

SEQ ID NO: 18836 - DNA, 517 bp, Triticum aestivum
  unsure (1)..(517): unsure at all n locations
  Clone ID: PAT_TA_18836
cgtccgcattagtccagaggctgcggcgtgcgcatggaacaggcgctgacgggcgagcagatggtggcgttccaggaggccttctccctcttcgacaagaacggcgatggatgcatcagcttggaagagctggccgcggtgactcgctccctcggcctcgacccgaccaaccaggagctcaatgacatgatgcgtgaagtccacatggatgggaacggcaccattgatttccaggagttcttgagcctcattgccaggaagatgcaggacggagacgccgacgaagagctcaaggaagctttcgaggtcctggacaaggatcgaaatgggttcatctcccctattgagcttatgacggtaatgattaatctcggggagaaaatcaccgaccatgaagttgagcaaattatcagggaagcggacaccgattgtgaccggcgagttaactacnattaatcgtgctcaagattaaaaaagctaacgcaaagaaactggttaacaaaattattatcctggt

SEQ ID NO: 18837 - DNA, 531 bp, Triticum aestivum
  unsure (1)..(531): unsure at all n locations
  Clone ID: PAT_TA_18837
acctggggacctgtttcgaaataaattataatacgagcaaggtgtcgaatgcaccgccggacagcctgttcccaaagactccggatgactgttgtgaatagtaattgtgcggtgaaattgctccacacacgacagagtgtggccgatctatgcacgaccaaacaatcgagcggcgtccgcggacgcgtgggcaagattccctggctggattttatcgtcatgcgctggtcgtccaagttttgtcgtccgcctagcactgctcattgtgcagtttagtctcgggccctgatgctcttgatgcggtatcttgatgtgaattagttgcataccttgcaaatattttttcctttctgaaaaaagatctttgcaatctcaacaaccccttgtttgcaaaactataaaaggaactgggatattttgttgccaaacntngccgtttatatcaaaggtttcaatgtcaaggacanaaagcctnaataaccttggttggggtngaaaaatatgcctcctaataaaagctaatgtttcccc

SEQ ID NO: 18838 - DNA, 997 bp, Triticum aestivum
  Clone ID: PAT_TA_18838
ctgagtcgctcgccggcggccccgctgcaccccgctggggcggctgcggcagcaagacctccacccttcttcccactctcgacacgcaattcgtcatggccgattactttgccgggcgcagtcctcagctgtggcccagtgctaccaaatctgacgcccccacctcccggcttgacggactgaagcgttagtgttgcgttttccaacaccatgccctcaggcggtgtgcctatagcagctcgtgactgtcctcaaaatgattttttcttcactcgcggtcatcagcacttgatggttactttgagatttgactcgcacaagtccgcggggggggattaaaacttccattcttgaagccacactgaaggggtcattcgtcatggccgattatttcttcactagcggtcatcagcacttgatggttactttgaaatttgactcacacaactctgagatatgggatttgaagacacgaaaagttgttcacactcttagcgtgagtgggcacaaaacgacctgggttgcttgccacccaaagcttccaatactggttacaatgttagatgacgggactgtatgtttgtgggatgccagtacatacaggcttgagaaaatggttcacattaccaacagcgagtgtcgtgatttggtatttgtccaagacacaaatggccgacccaggctcgttatcgcatttgagacaatgatagcaatcatgaaagttaatttgccaattgcgaatacaagcaatgcaagtggatgaatacaagcaaggcaacggaggccatcacggagattgggataaagtatttatgtttttggggaattgatatttcgtcttgtaattaatcttgtaaaaatattgttctggataagaatacttttgtgagtattgtaatatttttattatatttttctgaattttattttatttgttatggattttctcatttgaactcaagtttgaataattcaaacctcaattttgaattcaaaa

SEQ ID NO: 18839 - DNA, 2457 bp, Triticum aestivum
  Clone ID: PAT_TA_18839
ccgaacgccgccgccttcggcccagccgcgactccgccccctccgggtcgtactcccgcccgccctccacgcgaggccggtcgtcgccacctcggccccgactacgtccgtgggcagcagctgaccgagaagtcagacgtctactccttcggtgttgtcatgctgcaggtgccctgtgcgtggccggtgatcgacccttcactcccaagggaaatggtgaacttgtgcagagtggtgaatgaagtggcagaagagaggggagctgcaccagatcgtcgaccacaggctttccgggcgcgatctggccggactatctgatggagtccggtgagcgtgtgggagaagggcctgccagactccgggcgtggaagcgtccgcccatggggagacggccgctggaacttgaggtcattcctgcagctacagggcgtgaattcgttgaccatgtcggacgtgaacagcatgaaccggatcgtcgacctgtcatcgcaggttcagcacgtcagtgcaatggagagcatcagcgtgacgatggcggaggacggagctttgcacgagcctgaccacgacctctccgacgtgtcgatgagccgggttttctctcagctgatcaaagcgtaggggaggtgaaaaggcgccagatgacctgtagggtaccggttgtggtgtgagcaagccttgacttcatcttcttctgttgacatataactgaggtgattcacgtgtaattggttgttacatcgatttggatcgcactgaaaatgatgcttcatgcaagctcgccgtcagtattggaccctccaccttgcacaatgcattgcctgatgggattctgaatggccttgagattatgaagatgggcagtggctctggttctgctttcactgttgggaataacggttcaaacaaaaagttgcccataattattggctcagtccttggggttgttgggcttctgataattgtccttgttgtggtactgctttgccggaggaagaagaccgacgacaagcagcactccaagacctggatgcctttctctatcaatgggctcacgtctctcagtacaggaagtagaacttcttatggtactacactaacatcaggtctgaatggaagctatggatatcgcttcgccttcaatgtgctccaagaagcaacaaacaattttgatgagagctgggtgattggagttggaggttttgggaaagtctacaagggagctttgagggatgacacaaaggttgccgtgaagcgaggaaaccccaagtcccagcaaggtctcaatgagttccggacagagattgagctcctttcacgtctgcgtcaccgccacctggtgtctctgattgggtactgtgatgaaaggaatgagatgatcttggtctacgagtacatggagaacggaaccgtcaagagccacctgtatggttcagacaacccctcactcaactggaagcagcggttggagatctgcattggagcagcaagggggctacactatcttcatactggttctgcaaaggccattatccaccgtgatgtcaagtctgcaaacatcttgcttgatgagaatctccttgccaaagtcgccgactttgggctgtcaaagactgggcctgagctggatcaaactcatgtcagcactgcagtgaagggtagctttgggtaccttgaccctgaatacttccggaggcagcagctgactgagaagtcggacgtctactccttcggtgttgtcatgctggaggtgctctgcgcgaggccggtgatcgacccttcgctcccgagggaaatggtgaacttggcagagtgggggatgaagcgccaggagagaggggagctgcaccagatcgtcgaccagaagctttccggcgcgatcaggccggactctctgaggaagttcggcgagacggtggagaagtgcctggccgactacggcgtggagcggccgtcgatgggggacgtcctctggaatttggagtatgtcctgcagctccaggatgtggattcttcgaccgtgtcggacgtgaacagcatgaaccggatcgtcgacctgtcgtcacaagttcagcatgtgggtgccatggagagcatcagcgtgacgatggcggaggacggagctttgcacgagcctgaccacgacctctccgacgtgtcgatgagcagggttttctctcagctgatcaaagctgaggggaggtgaaaacgcgccggatgatctgttagggtaccggtagaggtgtgggcaagccttggatttttattttcttgttgaagtttacctgagatgtgtcacgtgtaattggttgtttcatcccttgtaattgtactgaactacggtttggatttctgatggccttaccttacccacttctgcgggcacatgatttagcggatataggtatcttcttgtatggaatctattcggctctagccatattcatgtactgatgg

SEQ ID NO: 18840 - DNA, 735 bp, Triticum aestivum
  Clone ID: PAT_TA_18840
gcgtcgccccccccccgcgccccgcccgcccgccccccccaccccgtcgtccgggagagagtgccagatccggccgggagagccgctgtagagcctccacgtcggtggagcagcacctcctgccacgggcgccgccgccacctcctgcctcacgaccctttgccgcgactccgcccccaagcgccgctcccgcacgcaacccgaaccctatcccgccatgcttcgctgcctcgccgcttgaaccgcgctgatggagcccgagcagcggtggccgaccccgtcgccgccgccgagcctgtggacgaggagaaggagaaggaggaggagacagaggcggccgaggacgaggaggacacgctgctggaccgcgcgcagcctgatctcacgggtccctttgcacatgtgcagttcgtcaatggaccaatgcctaatctccccaagtttgatgtatcactggacccatttaaggagttgagcagagtaatatctgagcgaaaaagctttgtatcgtaaagatttcaccatcccaaggtaatggaaataagttcacaagattcgcatgttgaggtctgtacaaagagatacaaggcaatgtctgtgtgctggaaggagaaactcactgccaaagctataatccctgatgctaaagcctgctggttcgagtctcccgcggccactcatattactgtatgaatgattaatacagagggagcccttttgtcaggtcatttaatc

SEQ ID NO: 18841 - DNA, 439 bp, Triticum aestivum
  Clone ID: PAT_TA_18841
cgtccgcggacgcgtggggcatttcccgcatcgtctccgagaccttccgccttgggctcccaggagtgcgctggttcgtcatgggcgacgacgacacggtcttcctcccggacaacctcctcgccgtcctcgggaggctcgaccatcggcagccatactacatcggctccccctccgagagccacctccaaaacatcttcttctcatacgggatggcgttcggcggcggcggtttcgccatcagccagcctctggcggcgaggttgagcggatgcaggacgcctgcatccgccggtacccgtggctgtacggcagcgacgaccggatccaggcgtgcatggcggacctgggcgtgccgctcacgaggcacccggggttccaccagaccaacgtgtccggggacttcttgggcctcctcgccgccaacccgggggccccg

SEQ ID NO: 18842 - DNA, 2043 bp, Triticum aestivum
  Clone ID: PAT_TA_18842
gctgcgcgcgctgcgctatcctaccgaccccttctggacgtctctcgccccccgccgcgcctccaccccacgcggttcattcgcaacccgcggcggctcctctcctcgctttccgtcctaccccaggacggaggggtctcgccggcgacatggctccctcaatcgcgccgccttcttctccttcgtgcctccgtgggaaactctttccacggttcactggtaccaacagtcagcccatcaattctgtcttgcgctgcgatatttcagtttcaccaactttggcatcaaacagcttaaggagaaccagttcgcttcacttggcaaataataatcgaatcaaaagctttcatgtatgtcatgctggggttgatccgtcagaacgtattgttataaatggtcaggccagtccatctaaaactgttcaagctgatgctgctgcattggggaccatatctgctgacatggctcctgtcgtcgatgggttttcagctgatgatgatgaacttgacctagatttgcctacagagggtttctcatctatacctgaagctatcgaagatattcgccaaggaaaatatgtgattgttgtggatgatgaagacagggaaaacgaaggagatcttataatggcagcatccacggtaacaccagaggctatggctttcatagtgaggcatggcactgggattgtatgtgtcagcatgaaggaagatgacctggaaagactacaacttcctcttatggtagtggcaaaggaaaatgaagagaagctgcggacagcctttactgtttcagtggacgctaaagagggcacaacaacaggggtttcagccaaggatcgggcaaacacagttctagcacttgcatctccttattctaagcctgaggacttcaaccgtcctggacatatctttcctcttaaatatagagaaggtggtgtcctcaaaagggctgggcatactgaagcatcagtagaccttgccatgttggctgggttacctcctgctgcagttctttgtgaaattgttgacgatgatgatggttccatggctttgttgccaaaactgaaagaatttgcagagagggagaacctgaagatagtctcaattgcagacttgattagatataggagaaagagagacagactggtagaacgtctttgtgtcacaccattacaattacagtgggggtcatttgaatcctattgctaccgatctcttattgatgggatggagcacattgcaatgatcaagggtgatgttggggatggccaggatattctagtgagagtccattcagagtgcctaactggagatatatttggatcggcgaggtgtgattgtgggggccaacttgctctggcgatgaccatgatcgagaaggctggtcggggtgtggtggtttacctacgtggccacgaaggcaggggcattgggctgggtcacaagctccgggcatacaatttacaggatgctggacgggatactgttgaggctaatgaggatcttgggttgcctgctgactcccgggagtacggtataggtgcgcagatactgcgtgatcttggcgtccgaaccatgaggctgatgactaacaacccggcgaagtacactggactcaagggctacggtttaagtgtcctgggaagagtgccgctgttgacaccaataactaatgagaatcggcgttacatggaaacaaagaggttgaagatggggcacatctacgaagaccctcctaatggccatacaagtggcatgagtgacgaggagcaatatcaggaggatagtggcagcgaacaagatcagaccctagagcctcaataaatgtcttcatgtttctcccggcaataaaaataaaaccctcaaatttgttatgagcacttctttctccaattttgattatacctacgtagttactatttgtagatgatgtatattagtctggtctgagcatgtgccatgtgcaaaaatatattctcatgtactccctccaccttggtttgtaaggtttgcacgcatttcaataaaaacttgatccaat

SEQ ID NO: 18843 - DNA, 868 bp, Triticum aestivum
  unsure (1)..(868): unsure at all n locations
  Clone ID: PAT_TA_18843
cgtccgcccacgcgtccgcccacgcgtccggaattatcctgcaggatgtcactgtgattttcagaaggaggggaggagatgatttagttcaaagtcattctgagtgggcaagaactgttaactcagcgcctgatgttatacatatgaccctttttcctataatgactctgttggaagcagccatccctggaaaagaccatctcatccgggcgatcaacctttatctagaatataaacctccaattgaggagctgcgttacttcctagagttccagcttcccagagtttgggcaccaattcgtgatgagcaccctctccatcaaaggaaagagcctgtgtgcccatccttgcagttcagcttgatggggaaaaagctgtacatcaaccaagaacaggtgtcagtgggtcgcaagccaataactggcctaaggttatgcttggaaggtgctaagcagaacaggctatgcatccaactgcagcatctagcatctcttccaaagatcctcaagccttactgggatgcacacatcacgatcggtgcggcaaaatggcaggggccagaggagcaggacagccgctggttcgagcctgtgaagtgggatanttctcccacgtcagcacactccatttgagcactacaagtgttcatcggggatncttccgggntttcaattttcacccgggcanaattgggggtttggaantcgtttngaaaanttcccgttaaataacnttctanccaagggnccccgttcacacccgggatttcctcggantaaaaccttcnccccananacatccaanggtgccttctaaaaccnttcctgacccggncntnggggcaaggccaacancaggatttattaan

SEQ ID NO: 18844 - DNA, 1444 bp, Triticum aestivum
  Clone ID: PAT_TA_18844
ccagtctgcttttaatctaggctagcgctactaggaattttctccgtatgaaatctgaagcgtagcttctctaagcaatggatgacggtgtacgcttcatccctaataacagcttaaacaaaaatccagacgtaggccaatcggaacctacctccagcgccgataaacaaccgccgagttaaaagaaaaggtcagccctatcggatattgcccacaagatcaccaaaaccaacagaaagattacgatgttcattcgcggaactcaacataggctctagcttaaggcaaaagtgccaaatgacaggccgtacaatggttgtcatgtcccgaggacctaggtggagcaatgaccgagatatagtcaagagtgaatcttgtttaaccttctcgatagccgtgggatgcgagtcaccagatgttgttaagagtggctttcgcttttctctcgtgctagaggggggacggacgccttcctgtgagggtgagcctcgccatgaggagagcttcaggggtaactttttgcacggcagaagccgtctgttgctcctcgtggtgatacagataaagaaacaagatggcgacatgtctatgggggcgactacttgtagcatggaagacagacctggtgacatggaagccacacagtggactttctgaacatcccaacagaggacttaaccctggttacacttaaccgaacatctctgcagatttcaataatagccataacgtcagcaaaaataaccaaggaaggcaatgtacagtcgctatcctcaacgactgatgaccacaggccttgaacgcttgtcacagccgacacttgggttggctttctaacggaatggtgtcgacctcaccatttatcgtcaagagtgacgttgctttagcctcgtgacgagctttggttataacatgtccagcgatatagttccccgcgtttccgtgttgcagagggtcggcgccccacctgccacaagctgtcagtttgttgtcgtccgtggagcgacttcgggtagattcagccatgtcctcggcctatctcttgtccccacggtgacactcccctgacactctgctggtgtctccagtgtcgcttagacctggcacagcacttaggccacgcttggttgacctgggagctccagtgtacttgaaggaaaactctctgggacaggcacaaccatacttcgtaggcatccttcctgacgtcgcaaccacagccaccccccctacggcaggccactcagggacgaccgaccaccggagagggctccaccccagcagcggccgccatgcctgcagcggcggcgaaggttgcctcctcctccttgcctgcctcctcctccggtcctgcgttggacgccgcaagcttggtggacggcacgacctttgtggatggcaggacatccaagacagtcaaggtagtagagatatttgattctgt

SEQ ID NO: 18845 - DNA, 815 bp, Triticum aestivum
  unsure (1)..(815): unsure at all n locations
  Clone ID: PAT_TA_18845
cgtccgcacgtttcccgttcggaccctcgcgtggccgctcccctaccccgcgcgcgctctctccctcgccgctcccatggcgtccctctttagggctcgccggcggcgatcgccggagcacgagggggacgacggcgacggatccggatccgggcggggcaagcgccgccgcctctcgccggaggagggcgcgctggtgccggcggaggggggaaggagccccgggtggctctccaccatcgtcaccggggccaagcgggtcatatcctccgtgctcttctcctcgtccgaggagcaggcctccggggacgaggaggaggaggaggaggaggacggctccgagcaggactccgatggaaacgaagatacccgtgatactcatggaaaaatagttccttacagcgagtcaaagcttgccattgaggaaatggttttgaaggaaacattttcaagggatgaatgtgataagatggtaaagctattacagtcacgtgttacagattcagcatttcctgaagcctatgagcatgggacaccaaaagaaaccccaagaaggaatggccatgattttactggagcttggcgttccttgaatcgcaatagaaatggccctgggtcaggtccattttttagtaccggacctggtaacttttctcctggctctcctctccaagcatcacctgagctatgtagtgcagcagttatggaagcaaagaaatggttggaagagaaaaggcagggattaggctcaaagcctngagatcatggaccttgcacatttgacactgatgtgcttaatgctgacctcaaatctg

SEQ ID NO: 18846 - DNA, 304 bp, Triticum aestivum
  Clone ID: PAT_TA_18846
tgttggatttgtgtgtgtttttcacgctgtctggatatagatccctactgaggtagtcttaggtttcaagtattggttcatttggtgagatggatggggtcggtggcagagcaagattttgcactcgtctccactgactatgaggttagggagtgagcagatgaactcccttttcataggtccgagccgtggggttgattatcaattaccgtgtatgatgactcagaacaccatcaagcctttatgtaatgttatacatatattatatactagctcatatgctgatgcgttgctacggcagaag

SEQ ID NO: 18847 - DNA, 1186 bp, Triticum aestivum
  Clone ID: PAT_TA_18847
gccggccgggccgggaccccaccccagcaaaagcaaggcagcctcacctcggcctcggcgtgcgcgttcggtcaaaacccaccgcgccgctgcccgcctccccccaaaacgccactacaaatctcgcacattcctcccactcccagcagccgctcgccagcgcggggacgacggaagcggaaaggcggcgcctccgagctcgagggactacgagctagaggcaccgaaggatgggggacgactcggacggggaggcggaggagtacctgttcaaggtggtgatcatcggggacagcgccgtgggcaagagcaacctgctctcccgctacgcgcgcaacgagttcaacctccactctaaggccaccatcggggtcgagttccagacgcagagcatggacatcgacggcaaggaggtcaaggcccagatctgggacaccgccggccaggagcgcttccgcgccgtcacctccgcctactaccgcggggccttcggcgcgctcctcgtctacgacatctcccgccggggcaccttcgacaacgtcggacgatggctccaggagctcaacacacattctgacactacggtggccaagatgttggtaggcaacaaatgcgatctggaaaacatccgtgaagtgccagtggaggaaggcaaagcacttgccgagtctgagggactcttcttcatggagacctcggctctagactcgacgaacgtcaacacagcattcgagctcgtcatcaaggagatctacagcagcgtgagcaggaagatcctgaactccgacacttacaaggccgagctatccctcaacagggtgagcattgacgatggtgactcgaaagacagccagaagcaaactagccggtttgggtgctgctagccaatcttggtacattgtcgactattgggttttgctgggatgtgatgatttttttttctggtcatcggtattgtttgtaaacatgtaacccaaaattggattctactagttctgttacacatctgagtcacagaggaggatagttgtgttaatgcaagagtggagacgaactgtttcttgctattaaccgaaaagccatgcggttcagagttgtcacaaaaaattaaaaaatataaaaaaaacaaaaaaaaaaaaacataaaaaaatagaacaaataaggaaaaaaaaactacatgcaaaaa

SEQ ID NO: 18848 - DNA, 1288 bp, Triticum aestivum
  unsure (1)..(1288): unsure at all n locations
  Clone ID: PAT_TA_18848
gcccgcgcggcgcgccacgccggcgcgcgaaagcgcgccacccccagcgcctcgctcgctcactcctccggctgccgccaacgccgccgttctgcacgagcgaagacgatggcgagcggggagaaggtggactatgtgtttaaagtggtgctgataccggggaccggccgtcgggcaagtcgaggacccggcgcggttcgcgcgcaacgacgttcagcctggcccccaaggcaaccatcggtgtcgagttccagacgcgcacgggtcctcgtccaagacagggcccatcggggacaccgccgtgggccagcgcgccccgggaggtagagagctgccacgagtgcatattacagaggcgggcgctctgctcggctaggagatcaaggccccaagcgccgcacctgagctcacatacctcgctgccctgagctggaggaacgccgagcaggcatgcagacaaaaacattttgtcagcatgctaggttggcaatacctaggggcgcatcgaagatgagcgggctgttagcgcgggcggcttccacagaggtggaccatggtctgccgagagacatcacctcttcatgacaccgctgtaggccacgaatgtcgaaaggccttgccagagatcttcaaaatacacgttaagaatccacaggaagaagaacaaagtgaccgacgcgaagggccgccgctggctgacgaggaggtccgccccagacgcgccacacggcagatccccaagagcaagtgctatagagcaaatctagcacttctatgtaatgttttttattagctctgctacttatatgtgtgggctttatgtctgtctggagagaaatcacgatggtggtaataaagggattcaggtgttagttagatgggttaggtggctgggagtcagtctgagaacatgttcgaccactgggttctgctgagtttggattaagttcttctgtagtataaggtcctgttgttagataccgaacccagtgttggattatcaataaccgtgtaacatatctcagaattccatcgagagctatatgtaatgttatacatatattggatactaactcatatattctattaacccaaaagcaatacggttcagagttgtcggattaaataaaattttatgggcggtccgggcgactcccctccggtgccccatgggtccccctctggtttggctatccagcccaatgcaccacccgaatgattgcccctgnttctttttcctatatccggacacttcaaaatatttaaagataaaaaaaaaaaaaaaaaa

SEQ ID NO: 18849 - DNA, 1287 bp, Triticum aestivum
  Clone ID: PAT_TA_18849
cacgactccagcccccattccgcacggcgccgcagtccgcaccaacccctccccctcgccccaaccgccgccctcctcgcctccaccggaagagctgctccccccgcaaccgggcggatcccgctaggcggaggcggagatccggcagccgccatggcggcgagcgacgtgcccatgagccccgagctcgagcaggtcgacggcgagatccaggacatcttccgcgccctacacaatgggttccagaagattgacaagatgaaggactccaacaggcagtccaagcagctggaagaactcactgggaagatgagggagtgcaagcgcttaatcaaggaatttgatcgtgtactcaaagatgaggagaaaagcaatacttctgaggtcaacaaacagctaaatgacaagaagcaatttatgatcaaggagttgaattcttatgtcaccatgaggaagacgtaccaaagtagccttggtaataagaggatcgaactattcgatgctggtaatgaccaggtagctgaagataacgttcaaatggcatcagaaatgtcaaatcaacaactgattgattctggaatgaaacaaatggaccaaacagaccaagctattgagcgttcgaaaatggttgttgcacaaactgttgatgttggagctcaaactgctacaactctaacacagcaaactgaccaaatgaagagaattggcaatgagctagattccgttcacttctcattgaagaaagctagtcaaatggtgaaagagattggtcgtcaggttgcaactgacaaatgcatcatggggtttctgtttttgatagtttgtggctgtgattgccatcattgttgtcaagatcgtcaacccgcataacaagagcatcccagacatcccgggactggtcccctcctgcacctcctttcacaagatccgaaaactcccatacgtagtttctttcagactgctcttagcattcgggcatggaaatctcgttgcatgcatttctctggctcttaattcaaaacacccgatgtcatctgtttcattggttgcttccttcttcctattggttgcagttagtttcgtttgtatggtgcacttcggctgtgtggtcttttaattgcctggtattgttgttgtgtacatgcgtcagtggtggttcagattgccttgatgtgcataaatgttttcactcgtttatcttgactaaagcgagccgtgcgattaatgtttgctcgtgtgaatgttgtccatccattatcctagaaatgtgagcatgtttcaaaaaaa

SEQ ID NO: 18850 - DNA, 1132 bp, Triticum aestivum
  Clone ID: PAT_TA_18850
ccccctccatcccccttcccgattctacccccgtagaatttgtaagaggaacggcctcctggtgtcggggtgcataaggccccccctcctccgcccgtccccgagcccgcccatccctctcccacccgcccgacccctacccccccggccgctccgtctcccccctggcgtctgtcccccccctccacccccgtgccccgccgccgccgccgcctcccccgtgcgccgcctctgccgtacggtcgccttcgggcggcgttccagctaggcctgcgcagctatggccctcgctccgcctccgcccgtgggttcgccgctgccaggtgctgcggccgctcgccgggcggtggctgcatgtggagggggtgcttctctctcttggcgtttcctaatcatcccctgggacctgcgaccgctctcccccctgcgactcgtctgagccctgcttctcggcctctgccctccgcccgtggctcgtgcctcccgcctcaggccgcaagctcgatctctgcccgcctgccctcttcatagccatacacatcctcatcattatccttcgcccacggccacgaatgtgatgtggtggaattgaaggatagttgttggtatgttcaggttctactatggttttgtcatgcttggatattacaaagatttgagtttgggatggaacaacttttccaaagggtagcacaatttgagttattttggagacgttttgtaggcaagtgtagcttccttgataaaacttctgccaagcgagtggtgtcccagctgctgtccttgtgattctgctctgttcccaggaaggatttgtctatgatatggcaacacagatctgcatgtagtgagcgattcagagaactgaatcgaaagctgagtcattccatgaacggtttgcgacgagaatcccaaactagcttaagggaggctcactagcgtgcatggtctctaacttttgtcttcttttccttccaccatgaggatcttatctccttttcgggcttggcttccctgtttccctcctgacccacttgttctgcttgagtgttgggatactcattatcatttggtacacctattctatcattggtgaacgactgcatttattttcaaaaaaaaaaaaaaaaaa

SEQ ID NO: 18851 - DNA, 883 bp, Triticum aestivum
  unsure (1)..(883): unsure at all n locations
  Clone ID: PAT_TA_18851
cttccccacccttctcctacctatccactcttctgccctgcggccacacctcgcccccgtcgccgccgtccacatcgccgccgcagcaaggtccgccgcgcctcgctgctgtggagttcccttgcaccccaggtttcagagttatggcgagatttccaagagcccgaaacctcccagctcgtcgaggtaggtcatcttcatctgatgcgcgttccagctgttggaagacaaaagaagcagacgaacagagtgatttgccattggcctgtgagaaaagagaatggaaaggtgcaacttgcccagtttgcttggagcatccacatgatgccgtcctcctcctctgtacttctcaccacaagggttgccggccttatatgtgtggcaccaactaccatcactctaactgtcttgaacacttcaaagaagcttatgcgaaagagaaattggcccttggtgattccgccgagtccgcacttaaccttccattttctccaaacacagaaccagcaaacaagcatccatctacaatggaacttgcatgccctctgtgccgtggggatgttaaaggatggactgggggttgaacctgctcgtcagtatctcaaccgcaagaagagagcatgtgtgcatgatgcctgctcgttcgttgggtcatacagagaactttgcaagcatgtgaactccaaacacccttcagcaaaactcggaggttgatctccttcagtgagtgaaaagttgatgtgaaaaacncngatcatcatctttaggggttaaccagactggatntgggatatnccttaatgaaggggggnacacggttttcccnnggataatttcttggggganataatttttnttctggtngccctnacaaggnnntttt

SEQ ID NO: 18852 - DNA, 493 bp, Triticum aestivum
  unsure (1)..(493): unsure at all n locations
  Clone ID: PAT_TA_18852
cactgggaagcgcccatggtacaaactctcaactctcaggtacacagnatactgatctcctccagcaggagtaccagcaagccagctggagagagttcttattcatattcagtataaactcgcataactagtgaccatactacatagggatagaggctgcgcgcttcaactccacgtggatggatgagctgagcnccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccanacggnccggngccgncctgaacgtanctnangcagggtctnaccaagctgtcaacgnggccgnannnnatgg

SEQ ID NO: 18853 - DNA, 1387 bp, Triticum aestivum
  Clone ID: PAT_TA_18853
ggccggccacctgtggctccccggcgccccctccttctccgtccctgccggagtctcgcgcccccgaaaaccctcctcctcccgccggagcctgcctgccatctcgggccgagggaactcttcctcctcccacccatccacccggacgcggttcctctcgctggtaaggcagccctagccggctagccccgcgccaagccgatggacgaaaccctagcccccggagccggtgccgccccccgcggcggaggtggaggaggtcccggagcgggagccggcgaagcttctggaggagatcatgaggaataggtaggagaaatccaaacaccaggataaggaaacaagtctgaagaaagcagctgccaaaggcaagcaaagcctgagcagaaggccaagaaaaagcaggtcgaggaacgagatatcgcgcctctcacgctgcattacaggcgaaacatgctgcaagagcttgctacttttgggtacaaacctgcagaaagctctgaaaaggggaacctcgacaccttagtgaaggccatagctggcgtttctgtttctagcaatgcagattctgcgaagccggggaaggctgcaaaacggcgagagaagaaggcaaaggaagaagctgctcgagagcagcgaattcaagaagaacaaaccaatcttgtcagtgatcgcatgttagaagacgagaaacttggaaggaggcttgagcccttggggctgaccattcatgagataaagccagacggccattgcttgtaccgtgctatcgagaaccagctgtcactccattccaagggcactacacagtacaatcaccaggagctacggcaaatgacagccaagtatatgagagagcatgctgcagatttcctcccatttttcctatcggagggcaaagccgaatctggaccagacccctcggagagctttgaaaagtactgcgaggagatggagtccaccgctgcttggggtgggcaactcgagcttggtgctctgacacactgcctaaagaagcacatcgtcgtatactctggctcctttccggatgtagaaatgggcaaagaatacaacaagtcaggaccaggaggtgaccctagcatcaggctttcctaccacaggcatgcctatggcctcggcgagcactacaactcggtgatacccactgagttatcttgaggcaggaaaccaaatgtacttggcatgtgtttatccatgagaagtctttctggtcattctctggttgagtgtaccaaatcatagaatatgtttaaatgggattttacttcccaaacaattttgcctgtaaaacggttttgtttacttattttgctgtggctgcgtactgtgttgactcttctcatcagctatagtatgtttccttcct

SEQ ID NO: 18854 - DNA, 1682 bp, Triticum aestivum
  Clone ID: PAT_TA_18854
tgaaacaatccaaaatgagtttggggcaacagtaagtcgtattgttgaaggggaaacaaaggtgtctaagctagggaaacttcaatgcaaaaatgagggtagttcaaaacaagatgtcaaagctgaagacttaagacagatgtttcttgcaatgacagaagaggttcgtgtaatccggctcgagcgggccgtccggtgccattactggcgttctcttccccaggtgcctccgcacaggcccttcgctttcgccacgctgtccctgctgggttgtgcgccccttccatttcttctcgggctctttccaataaagtctgagttagagtatctgtccttcatgtacatgaatcctggtgatttcgctgaactaaggaaaagagttgatgatatcttcaaagcccatgaacaagaattggaagaggcaaataaaatcctaaagcaaaaaattgctgaggatcaatttcttgatcttgtgagtgttgaaacagaagtgcgctcagtgtgtaaagaactttacagcatttataaaaccgctctcaaatccaagagttcattaaacgaggtaaatcaggttgctcagctgcggatcatcataaaaccaaaatcctgcaatggtgttgggccactgtgcaccgcacaacagatctgctaccatgtccttggtcttgttcatggcatatggacacccatacctcaagctgttaaagattatattgcaactccaaagcctaatggctaccaaagtctacatactacagtgataccgtttccgtccgagagtatgttccatttggaagttcagataagaacagaggatatggatctgatagcagaaagaggcattgctgcacactacagtggaagaggggtggtttcaggacctgttcatcctggaatatctagtggaagaaatttagatgggaaagtgatctgtcttaacaatacaggctttgctctgagggtatatgttttattacttagtataattgcagtagtttgttaaagcttattgcagttcacattatttcttttacctcgcttgactaaaaaaaatcctccaattatttgtcatctcccatagattggttggctaaatgcaatccgtgaatggcaagaagagtttgttggtaacatgagctctagggaatttgtggatactattaccagagatcttctgggaagccgtgtctttgtgtttacacctaaaggcgagattaaaaacctgcgtccggggggccactgtgattgattatgcatatctgatccatacagaaatcggcaataaaatggtagcagcaaaggtgaatggtaatctagtttcaccaatccatgcgcttgcgaacgctgaagtagtggagataataacttacgataaattttccagtaaatatgcattccagcgtcatcagcagtggctgcaacatgccaaaacccgcagtgctaggcacaaaattatgaaattcttaagggagcaagctgctctttctgccgctgaaataacggcggatgcagttaataactttgtcgctgatcttgaagatgaaagtgacagcgagcagttaattccaaccacacaaaacgaggactataaattcaattggcagaagatattaagttccaacaagttatcctttgtgaataaaaatagcgatggctttttaccagttaacaacattcacacg

SEQ ID NO: 18855 - DNA, 719 bp, Triticum aestivum
  Clone ID: PAT_TA_18855
cgtccgcggacgcgtgggcggacgcgtggggcccgcggcctcctctccccctctccccgccccgcccccgccgccttcgcgcgccgcctgcctgccgccggcgagatgggggtcaagggtttgacgaagctactggcggacaacgcgcccaagtcgatgagggagcagaagttcgagagctacttcggccgccgcatcgccgtcgacgccagcatgtgcatctaccagttcctcattgtagttggaaggacagggatggaaacccttacaaacgaagccggtgatatcaccagtcatttgcaaggcatgttcagccggacaataaggttgctcgaggcaggaattaaaccagtatatgtttttgatggcaagcctcctgaaatgaagaaggacgagcttttaaaaagacacgcaaagaggaatgaagcaacagaagagctgacgaaggcagtagaggcaggagatacggatgcaattgaaaaattcagcaagagaactgtaaaggtcacgaagcagcacaatgatgattgtaagcgtctactaagactgatgggtgttcctgttgtggaggctccttgtgaagcacaatcacaatgtgctgccctttgcaagaatgacaaggtgtatgctgttgcatccgaagatatggactcacttacttttggagctacacggtttgttcgtcatttgatggatccaagttccaggaaaatacctgt

SEQ ID NO: 18856 - DNA, 1241 bp, Triticum aestivum
  unsure (1)..(1241): unsure at all n locations
  Clone ID: PAT_TA_18856
tagcgtggtcgcgcgcggggccggtgccgctgcctcctgccccttcctcgccgctgccgcaccgtgcccgtgcacaagccgacctcgaccagaagctctcgcccccagctccccttccgaccatgcgcctcgcctcggtggccgtcacccccccgctactcctccttctcgttgccggcgcagtggcgggcccccccggcgcgtagcccacgtgactgcgagggcccggcccggcgtcactcgacgcgctcagatcccgcttccgctgcaccgccagcatcaggctatccccctccccccagttgcgtggatttgcgtttgatagcgagtgggcactgcgctgtacggatgagccatgctacgtgcccgtttactgcgcatagtgtccattcacgagcaatttccgaccattgtttcccgctttctgctccttgtgaccgcggaacaatccctttgctctgtcagaaccctctgcgacgccttcgtgattttgcgagttaaggtctccaaggtaggacacggtatgggctcgacacatcttactacacgggcttggtctgtgcgtgcaattcatttgctctgctccgcgcctgttctatccagtaggactacaggcctcgatcaaagttacaaataattgttgatgatcatcctagagatcgctgggagtttaggatcagccatgccaggacggccggtctctgcgcaaaatggcggatgacgagccctttgtgtttcttggagcgctttttataatcatgaaggtcgtggcacacttcatacccactgtcatctctcaactcagagccttcttgatcgtgcgtgttcagaacttgaacttaagaattcgtaggggatcaagccaacttacggaacgggctttgactgtgcttgatgttaagaggctttggagcaagcttagactgagcagtaagacaagggacctaagtaaaggggcgagtaatgctcgagcttgggctccctcgctcccgccccgcgcaccggccgctccagccgccttccggcccgcctagccttgttcccgatgctggtcgatagtctagctgctgatatatggcccaaaattgtttggtcttgcttccccatcctgctatgtacttgcatccgcgcatgtggggacccaggaatgtaaattttcaggatttcatcttgttgtatataggaacgcgtttcgctttgctgacgcgatagcnatctccgacctttgtgtcagataactc

SEQ ID NO: 18857 - DNA, 1094 bp, Triticum aestivum
  Clone ID: PAT_TA_18857
ccctgctacggtgcctggtgatgcctgctgttgggactgcaatccagcacatcccgctgcacagaccatacatgcacatcaacaatgcctggttaagccagctaatggaagtgaaatccatcacatccctacaaggcctaaatctggtggtcttgtggataatgactctgacaaaaattataacccatctcccaagcgacccgtaaaagccgatgaagccttaaatatacccatggcaagccgtagctcattggacagcaaagatgcagatgggaatattctaaagaagcccaagctagaagataagccgtcaccactctcacctgcttcaagcataaacaattctgacggccccgatgatgtagggaaggcaagcccaggctccccaggtcaccaccaacacgccccgctctgccccgtctccggccggctgactcgtgtcgctccttcgattggccctgaggaaacaaccgactctgagccttctacagcaggatgagtcatttttctccatcaattggcttcaacccggtctttccttgcagctacaaggataaggaatcacgtttggctccaatgaaggctagatccataatatgctaaactttcaagcccgcaagcttgactggaagtgagaaagctttgggcacagccatatatatcttggatgtgatattgactgaacgtgtaaaattgatcttcaggaatggattctgaagctgagaatgagcgcagctttcgtcacggcaacataggaattttttggttgcattagtctaagtaatggcacaatatgacatttcacaagggcacggaatgtgccctttgctagaagcttccacccgtgtggaatgaaaggcagaggagatgttatcttgtaaaactgccggtagagattagaatggttcacaacagcttgctctattttgcaagtccaaattaatggtagtctagcaatctagtttctggttgtacggtgtctatgtaacacgggctgtgcgctgtgcattagtgcatacgttgtttcctggtttgccactctggtgcggccgtctcatatttttttcaaaggtttattaatcctaggccatttc

SEQ ID NO: 18858 - DNA, 1563 bp, Triticum aestivum
  Clone ID: PAT_TA_18858
gctggaacttctggaccctgagcataatattaattttttggaccactaccttgatgttcctattgacctatccaaggttctgtttgtttgcacagcaaatgttatcgatacaatacctaatccgttgctggatagaatggagatcatttcaatagctggttatataactgatgagaagatgcatattgctcgggactatctggagaagaatactagagaggcttgtggcattaaacctgaacaggttgaagttacagatgctgccctccttgcccttattgaaaattactgccgagaagcaggagttcggaaccttcaaaagcagattgagaaaatttaccggaagatagctctgcagcttgtccgccaaggggtatcaaatgagcccgccctggaggctgtaattgtcacaccaagcgtagaacctactgatggtggtagtgcaacaatcgtgaaagatgaggagttgaatgatcctgctgtcaaagatcccgaggaagctaaagaactatctctgaaagaaactcttgtaactgagccagctctgtcaaccgacacattgagcacaccagagggcaacaaggacacagacggagtaaaagaggaggcagtagacaaggcagttaagaaggtactaattgattcatcaaaccttgacgattttgtcgggaaacctgtatttcatgctgagcgtatatatgagcaaactcctgttggagtggtcatgggtttagcttggacttctatgggtggttctactttatacatcgaaacaacgaaagtggaggaaggaggaggaaaaggtgcacttgtgatgacggggcagcttggagatgtcatgaaagagagtgctcagattgctcacacagtcagcagagctatactacgagatagagagccagataatcaattctttgcaaactcaaagttgcacttgcatgttcctgcaggggccacccctaaggatggcccgagtgctggatgtaccatgattacatcaatgttgtcgttagctatgggaaaacctgccaggaaggacttagcaatgactggtgaagtaacattgaccggaagaatcctcccaatcggcggggtaaaagagaaggcaattgctgcccggcgaagctcgataaagacgatcatatttccagcagcaaacaaaagggatttcgatgagcttgctgataacgtaaaggagggtctcgaggttcactttgttgacacatacagtgaaatatacaaggtagctttccagaacgagacagaaacaagctagcaagcaattcaaacagagtattcagattgcgcaaggtctttggggcaagactgaatactgaacgaagtttgcagctaggccattctttgcaagatcaggagtaactttttgttgtaatgattttttttcctagtgccccatgtgactgtttaaggaaattttgacgagaatgtccctagatagctgaggagccatgtcaaataagaaaaattagaggtttgttgcaaacccaagaatgtacaagtttcgctttttctttaatattttacgattgttttaaaaaaaaa

SEQ ID NO: 18859 - DNA, 894 bp, Triticum aestivum
  Clone ID: PAT_TA_18859
cgtccgcccacgcgtctgcccaaatcagcggaaccctgacctcgccgagatggagacggagacggagtggatcggcggcctggacgacatggaggtggggaccgcggtgaagggggtcgtcctcccagagcacgccgccgacctcgacgagatggacgcggaggggaccgccgacgccgacgccgacgccgggggcgaagcgacggcgacgacggaggagaaggagtgctgggagtacgtggcagagtgggagtacgagcaggccctcaccttccgcgatagctggatttccatctggggcgccaaattcggctccttcgaccaaaccaccgacattcagcccatgcgctacacggacgcggaggctccagggggctacgcccagcccctcgattccctgcagatctactccatcaaagtagcggagatcagagggggcctgcgttggcccatccatgtctatggtatgatcgccgcgcgcgacatcgtcgacagaaaccgcaacatcgtcttccaccgctccagggatcactgccaaaccctcaccaaagaggattcgtgcttggtaatgacaggtcctacccgtcccattgttatgttgggtgccatgaactttgagattacgctaaaagtgaaggaaggcagcacggagtctagggataaagttttaagcttcctggctgttcctcatgacactgttaactgtttggagctctcctgcgcaacagataggaaatacatcagcaagctcagcacactggagtttacaatgagtcaaattgctcgctccgtggaggcgacaatcagcgtgcaaatggtcgatgggtcgtcatggccacacggtgtccgaggtgaattttccgcctgtaccaccagtatggccgacaggaaagt

SEQ ID NO: 18860 - DNA, 850 bp, Triticum aestivum
  Clone ID: PAT_TA_18860
gccggccgggtccggagccgcccgcctccgctctccccatacacggccacaacccgactcaccaccgcgcctcttcctcctcccgctcacccacccatggcgacggctatgatggctgcagccaccacctcctgctccccgcgccgagcgctcctcaagcccgcggcctcctccagctccgcgccgccgcccaggccgcagcctcggtccttcctcaagcagctcccggggctcgccgcgacggcggctgcggcggccgtcgcctccgtgcctctcccggccctggccgtggagatggagaaggcggcgctgttcgacttcaacctgacgctcccggcgatcacgatcgagttcctgctgctgatggtggcgctggacaagctctacttctcgccgctgggcaagttcatggacgagcgggacgccaagatccgcgcggagctcggcggcgtcaaggacgcctccgaggaggtgcggcagctggaggagcaggcccaggccattctcaaggcggcgcgcgcggagatcgcggcggcgctcaacaagatgaagaaggagacgaccacggagctggaagcgaagctcgacgagggccgccgccgcgtggaggcagagctcgtggaggcgctcgcgagcctcgaggggcagaaggaggaggccatcaaggcgctgttggcgcagatcgtgtcgctcagcgacgagctcgtcaagcaaggccctcccatccgcgtaaaaacattagagttctacgcatcgcgcagcatacgccgcaatcggcccgttttcccctaagattctaactgaatcaaacattcctgtgaacgggtataaatgaatgatccttttgtac

SEQ ID NO: 18861 - DNA, 1779 bp, Triticum aestivum
  Clone ID: PAT_TA_18861
cgccccgcgtgtcgcctccgtcgcctggccaaccacagcccaccccgttcggctcgactcaccaccgcgcctcttcctcctcccgctcacccacccaccgactcaccaccgcgcctcttcctcctcccgctcacccacccatggcgacggctatgatggctgcagccaccacctcctgctccccgccccgagcgctcctcaagcccgcggcctcctccagccccgcgccgccgcccaggccgcagcctcggtccttcctcaagcaggctcccggggctcgccgcgacggcggcggcggcggccgtcgcctacgctgcctctcccggcgctggccgtggagatggagaaggctgcgctgttcgacttcaacctgacgctcccggcgatcacgatcgagttcctgcttgctgatggtggcgcgtggcacaagctctacttctcgccccgctgggcaagttcatggcaccgaggcgggacgccaagatccgcgcgggagctcggcggcgtcaaggacgcctccggagggaggtgcggcagctggagggagcagagcccaggccattcctacaggcggcgcgccgggaggatcgcggcggcgggtcaacaagatgaagaaaggagacgaccacggagctggaggcgaagctcgacgagggccgccgccgcgtcgcaggcagagctcgtggaggcgctcgcgagcctcggaggggcagaaggaggaggccatcaaggcgctggacgcgcagatcgtgtcgctcagcgacgagatcgtcaagaaggtgctcccatccgcgtgaaaacattagtagatcacgcagcgcgcagcagccggcgcaatcccccgtttcatagtaaagatttctagttcttgatgtgtaatgtatacgcccactgggctgcctcccctaagaatgtaactgaatcaaacattctgtgatcgggtataaatgaatgatccttttgtacaaaaaaaaaaacagaaaaaaaaaaggcccctacacggagcctacaagctgcggtggtcgtattcgcagagtggcaacccgtctgtgatggtgaagtcaaagatggcaccatgcatgccagcgaccaacatcattataacctgctgtctgagctgagcggcagcgacaccgcaccgacattgcagaaccttcctatggcataccccactataagcatagatggcgacattgtctacttgttttctagtacgaaaaccaggcacatggaaaaattggagttggtcattgctgttgatctgaggaataaaacctttcgaggagtagctgagcttgatgtccagaataattatgttgtcaaaccagccttctgcaccagtgagatctgcatatacctgaggaagagtgcaggcacatcagtagagcttaaacggactaaaagagaagctgttaagccagttggcaaaaaagagggtaaaccaactagggtgcatgtgaatgaactgacctgcagaaggcgcccggtgaagaagggtgtactggaggttgttaagctgctagaagctacttggtaaacagatgcaggatgcagaagttggtgctcaaggagcttgttgcattgatttatgaaaactatgccaaaaataatcatctggattgcgttggttcctatctgtagagtgcttgatttatgtggaatttgtgtgggctcagctcagtagagctgaccttgtcagatagtataatccgtgcagggaccttttgttttatttctgtgagcaatgttttccgtcaatattttctttcaaaaaaaaaa

SEQ ID NO: 18862 - DNA, 576 bp, Triticum aestivum
  Clone ID: PAT_TA_18862
cgtccgccgtgaaaaagatgtagccacggctgaccaagaggaaggtgtctcttggcaaagctattgcctccttcttccttggtccatgcgtgggtgtgtgtgttttctgagaattttttccattgtgtgtgtttgagagaaaccacaagagagaaggttgagctgtgagagacagccaagaagaagaagaagaaggcgctgcgaggaggcggcgccatcaattggcatcagagccttgttgatccgtggtggctatggtggccggcgtggcggtggcggcggcagcggcgacgtgatggattccgtgcgaggtggaggtcgtcggcggtgcgatgccgctggtggcctgctacgatgcgatgccgcaagatggtgatggtggtgcgacgttgccacaaggacggtgtgatgccgttacaaggaggtgtcatccacgtcaagagctggctgcggtgttcggcaagacagtgtgatggcgcgtgcgtacgtcggggcggaggttcatggggcaccagcgggaggctaggtgctgcaccatgtgtccatgaacacgacaacggacagtccatggtgaag

SEQ ID NO: 18863 - DNA, 1493 bp, Triticum aestivum
  Clone ID: PAT_TA_18863
ccccgcctccgcgctgtgccccactcctctccgccccccgctcttacctcctcccccgcgcccccccacccgtcccgcggcgccggccgctgcccccggagtctgaagtgcccacccgcgcccccgcccgcccccgccatctccggtcccgactcccgccgtcccgtcggtgcactcacattgtactctgaacgcacggctttttgtatattagaattagcattagaccctgcatgataagaagccatggcaccaggaagcaaggcagagaaaatagcagcattggatgccggggcatggatgttcaatgttgtaacttcggttggcataatcatggtcaacaaggccttaatggctacacatggttttagctttgccacaacattgactgggatgcattttgcaactaccactttgatgacattggtaatgaaatggttaggatacgttcagccatctcatttacctctgtcggagctagtaaagtttgtattttttgcaaacctatcaattgttgggatgaatgttagcttgatgtggaactctgttggcttttatcagattgcgaagctatctattattccccttctatgcattatggaggtcctgttcgaaaatttccgttactcgagggatacaaagcttagtatagtggttgtccttgtaggtgtgggagtgtgtacagtttctgatgttagtgtaaatgcgcaaggattggtagctgccgtaatagcagtttgcggcactgcattgcaacagcattatgtcaattaccttcaacggaagtactcgctcaactcactcaaactcttgggtcacactgcaccagctcaagcagcttcactgttgatattaggcccatttgtggacttctggctgaccaggaatagaatcgacacttttcactacaccagcacagtgacgttcttcattgtactgtcatgcgttatttcagtcgggaccaatctcagccaattcatatgcattggaagattcaccgccgtcacgtttcaagtgatcggacacatgaagacaattctcgtgctaaccctgggatttctgttgttcgggaaagaaggcctgaatttccacgtggcgtttgggatgatcctcgccattgttgggatgatatggtacagcagcgcgtcttcgaaacccggaggcaaggagcggcagggtctggcgagcgagaaggcccagaagtcgccacagtcggagctggacgataaagtatgagatggaagcctcgaagttcctatcgtcagctatttatatggaccccgtcttatatatcaaaagtaaaatgatcgtgagaattttcctcattgtacacggttccttggaggaatgtttctacagggatgttagaaatgtaggccacaggagaaagacagagtttacactttcgcaggaaatactcctacataggttacgtgggcagacgttttcagtttcaagacttgttaattttatcgccggcgttccttcaaaag

SEQ ID NO: 18864 - DNA, 1776 bp, Triticum aestivum
  Clone ID: PAT_TA_18864
tattggtaaacattgttcaaagaaacgtaaaaatatatacaagctccaaggtctggaactcaatgatgcacatgacctcttcatacaaaaggtttttgacaagactatggatttggatgagcagtatcctgagttggttgaacaaacaaatatgattttaaagaaatgcaagggacttccccttgcaatagtcaccataggtggtttcctggcaaaccagccaaaaacagccttggagtggaagaaactgaatgagcatattagtgctgcagagttacagatgaatccagagcttgaggccatcataacagtccttaataaaagttatgatggtttaccatatcatctcaagtcttgtttcttgtatctttccatctttcctgaggactataacattaagctcaaacgtttgttgcggcggtggattgctgaaggttacccaggtgtagtgcgtaacaagtctacagaggaagtagcagagggctacttcatggacctcataagcaggagcatgcttttgccatcccaaagatcaatttgtgatggaaaaaggattgggctcctgccaagtccatgatctcatccgtgaaatcggcatctcaaagtcgatggaaggaaatcttgttcttagattggaggaaggttgcagcttaaacacccagggcacagcacgccaccttgctgtaagcagcaactgggagagagatcagggtgcattcgagagcatagtggacatgtcccgtgtacgttcaataacggtctttggagaatgggagccatttttcctttctgacaagatgcggcttctgcgagtgctggacttggaagacacgacaggtctagttaatcatcaccttgagcatatcgggaaacttcttcacctaagatacctttcgctaagaggatgtgaatctatctgtcacctgccagatacattaggtaacctgaggcaactggatacactagatatcagaggtacctccattgtaatgctaccacaaacaatcatcaagcttcagaagctacaacatctccatgctgggtttccaacaaaaggaaattatttatgtacaaggcatctgctgcacacttatggcttcaaccagcctgatgcatgcacttctttatgctgtggtgccgcaactccttgtatcatgatggacaaagattatggtggtgttgtgttgccaggaggggccaggaaactgaaatccctgcacactataaggggtgtgcacgttgcatatggagatgccgttatacaggagattggaagactcagcgggctacgcaagttaggagtgatgggcatcaatgagaaaaatgatgtaaagttttgttcagccatttccaatcttagccacctagagtcattatcagtgcagtcagacaagggatgcctagatgacattacctcgcctccgaagaacctccggagcctcaaactggagggccgcctgggcgtattgccagagtggatcaagaagcttcagaatcttgtgaagttaaagctgagcttcacaacatctagccaggttgagcaggacgctgctatggaagtcctgggacatctgccaaacctatccattctccgattgtcggggtgtttattcaaggcttgagagctccatttccaaaaggatgctttcagaagcattgtggtatttgatgtcgaaggcttaggggggatcaagtcggtgaactttgaccaggagcaatgcccgaactcgagcagctcaaggtaaccgatgcttgtaaaagaggtggaattgggtt

SEQ ID NO: 18865 - DNA, 808 bp, Triticum aestivum
  Clone ID: PAT_TA_18865
cgtccgcccacgcgttcgcccacgcgtccgaaaacgcgtccgcaaaaccgaaatatcccccccgcctcctccaccttcccccgtctccactcctcctcctcccccccgattcctccaccgaattcgcctcccatttgcccgtcccccgcttcggcgcagtctgcccgtacgcgacatcgccggcggcggcgggacggaggggcggggcggacggcgggacggaggccggtgctgctgggcctgggctggcgtggagcggaggagatccgcccccgacctgggatgataccctcgttcgctgctgatcagaaggaatgatggagtggtgggggtgttgatattatctagtgcttatcaatgtgaaagaagctttcgcaatggctccaggaagcagcattgtgagtgtgactgaagtccctgagtcagattgtggcgaccgtgggctctccgaggcactcagtagtattaggcttgatggagattctacaagtaagccctcctgggctgcgtcacttgtcaatgttggtttgtcatcattgactggcttgaatgatttgctcgagtgtccagtgtgtacaaactcaatgcggccacctatacttcagtgcccaaatggccacacaatttgctccagctgtaagcatagggtagacaaccattgccccacttgccgccaggagctgggaaatatcagatgcttggctcttgagaaggtggccgaatcgattcagcttccatgcaaataccaaagcctgggctgcaccgagatccatccttaccagaacaaacttaagcatgaggagctctg

SEQ ID NO: 18866 - DNA, 581 bp, Triticum aestivum
  Clone ID: PAT_TA_18866
cgtgcgggagcgctggtgcataggctgcgccatccataagaagaagatcggtatccgctcccgtaaggaccgcaagaaccgcgcacctgcggaaagcgtccgccgcagggggccaagacctgagggccaagctcctcgtcctggtggcgtcggcgggggtcctggtggtgtcggcgggggttctggtggtactggcggtggcttcggcgccggtggtgctggcggtggcctcggcgccggtgctccagctcccaacgtcgctggcgactggccccagaattagcttcctagagtgctctgcttttgatcagtctatcgtaaaatctagcatgatgccagtatgttgttctgtctagtcttacatggccgtatggtttcttgctccttgcactttgaccgcctagagtgagccatgtgttgctcgtttggtattttcctggtaaacactcatgagagtccaggtactggatgagttctctacttttgttcagtctactacgtagaagattctgttaagagaccagatgttgatctttatgtaggagatctacctattttgagaatcggatttgaacatggct

SEQ ID NO: 18867 - DNA, 1461 bp, Triticum aestivum
  Clone ID: PAT_TA_18867
gctcccaaacaaagtcgcccctccttccctcgtcgcgcccctccggggcggagcccccgccgcccaccccgcccaaaaccccgggccggcccgcacgcccccaccgcgcgacgccccgtcggtagacggggatgtcggacctcggcacgctgtcgcgacctagcgctaccgcggcctcgccgccgacgcctcaaccaccccccggacgagcccctcgcctctgccgcgcgtcgccgccgtcgtccacgttcctgtcctacctcgccgcgtagacgcggaccctgcacccgcccgactccggccgcgactgcgccgttggtcttcgaggattttcagacttgctggtcttgtataaccttttcttcgtgggtgtatcaagatgtctggaaatgattctcaggctgcagctgacagaataaaggcacaggccttatcaaatgcaaagggattgagcagggctcaagccgaacgtgcagcggaagctgccgctcgcaatgtcaatgcctatgggcaaaagggaagggggcccaagtcgctggcaggagaggaaggaagctaagaggcagatgtatctgatgagtacagagacggctgtgaggctgggtgtgaggccaaatgctgcaccagcttctgcaactgctgggggccaatgtcagaagtgcttccagcctgggcactggacatacgagtgcaagaatgaacggatctacatatcgccgccttcaaggacagatcagtttgaggccccgtatgtttccgatgccgaggccaccggcaccctctagatgtgcgaaacgcacggcgacaagcgccgatccggaagaactggagaaggcgccagatacggccaaattctgcccacatatcatgtccttttcactgcagccctggcttcgtgtgccgagcgccctttcaagagatgtatcgcgaatgtatgagttgatttcctgaacgctagatgatttcctgttattgttctccctgtgctaaggagtaccctcttttatcctaaagattactaagaacttggaagtgcttgaagctatggattgtttcctatcccgtaatgcctgtgagcatcagaaaaccctgccactgtattctcccatcatctctgagcccgttgcgctcggctgcggccgccggtcgaagagcaagaagcacggcgacaagcgccgatcctgaagaactggagaaggcgccagatacggccaaattctgcccacatatcatgtccttttcactgcagccctggcttcgtgtgccgagcgccctttcaagagatgtatcgcgaatgtatgagttgatttcctgaacgctagatgatttcctgttattgttctccctgtgctaaggagtaccctcttttatcctaaagattactaagaacttggaagtgcttgaagctatggattgtttcctatcccgtgatgcctgtagcatcagaaaatcctgcaactg

SEQ ID NO: 18868 - DNA, 1285 bp, Triticum aestivum
  Clone ID: PAT_TA_18868
ctctgccgggcgcggcctctccccgccagcaagatcccccaggcatcgctcccattcacgcttttagcctccttgaacgtgcatgccgcccaaaacgcacgacctcccaggacagccatatcctctaacgtgtctccccagtgctccacctgttgccagggctgctgtctatttgggtcttccacaaaaacggccacgagatcctagacgcacggccccggactgtagatcaataacttacctcttcaatctcagatcaaaaatctcacaatggaagacatggacattggcatcgtctgtgacgacggttccccgggatcaacagcatcaaggacagcaacgcctgcgcccaatgagaatgactatctgatagtaattccttatgcccacatattcgccctgatgctgaaagctctgaagttaccccctgcaacttactatcacaagatatgcccaggcgcaaagaatcgtgtgacggttactttcatttcttctttggaattgctcgatggtgcacttgttccaagttctctgtcaggtgcaatcttagatagctatgaagatgctgaagacagtgctgctattgaagctattagatacatggaaaatgcatatggcaaagaaatgagggactaccactacactcatgtcaagaagcttgaaaatcaagtgacggacctggtcaaatggttggttgcatcaaataaaacaatcaagaagctgcgcaaaacatgctactacgctgtcaggtatatgagctcatattctgcccaaatagaaaacacaacgactgctcggcatttgaaagggcgggatagcaccaagggagttatgaaaacagcgccggcaagcattgaaggactgacgcagaggctacgctacattgctatgaagtttgagcagcgcctcgaagcaaccagaaatagtttccggtgagctttggtcaatgtgtcctgaacaacatgcttctgtgcttactaaatcaggcaccttttgtttcgtatcgatcagacaaggatctttcgcattttggcgtactccaagcaagatatgtgtacactttagtcttaacttgctgcctctatgctgaaaagtagtgtatgatatagtctatgatctttaaactttgttgttatctctgtactcagaagcgggttatcatcgcttactctatatatgtgaaggcctttcctctgcttaactttccaggccactgcttctgtggtgaaaagtactgtataatgtagtctatgatctttagattatattgttctcctctgtagtc

SEQ ID NO: 18869 - DNA, 824 bp, Triticum aestivum
  unsure (1)..(824): unsure at all n locations
  Clone ID: PAT_TA_18869
nnnnnnnnnnnnnnnnnnnnnnnnnnnnnnnnnnnnccggccgggccgggctgttagtccgcacacacctcacagaagcccagagcagagcgagagcggccatggcgtcgtcgagcttcaaggtgacgcggatctcggagggcgcggtgaagccggcgtcggagacccccgaccacacgctgccgctggcgtgggtggaccggtacccgacccaccgtggcctggtggagtcgatgcacatcttccggtccggcgccgacgcggcccccgccgtgatccgcgaggcgctgggcaaggcgctggccttcttctacccgctggccgggcgcatcgtggagcagccggagaaggggtgccccgccatccgctgcaccgccgacggcgtctacttcgcggaggccgtggcggagtgcagcctggaggacgtgcggttcctggagcgccccctgctgctccccaaggaggacctcgtcccctaccccgccgacgatctctggcgcgtcgaaccccacaacaccatcatgatgatgcagatcacgaagttcacctgcggcgggttcgtgatgggcctgcggttcaaccacgcgtcggcggacggcatgggcgcggcgcagttcatcaaggccgtgggcgacatggcgcgggggctcccggagccggcggtgaagccggtgtgggacagggagaagttccccaacccgagcatcaagccggggccgctcccggagctccccgtgctggcgctggactacatcgtgctcgacttcccacggggcacatcgacgcgctcaaaacgcagtacaaggcgcacagcggcaagttct

SEQ ID NO: 18870 - DNA, 1684 bp, Triticum aestivum
  Clone ID: PAT_TA_18870
gcctcacaggaagcccagagcatagcagagcagagccgagcgggagcggccatggcgtcgtcgagcttcaaggtgacgcggatctcggagggcgcggtgaagccggcgtcggagacgcccgaccacacgctgccgctggcgtgggtggaccggtacccgacccaccggggcctggtggagtcgatgcacatcttccggtccggcgccgacgcggcccccgccgtgatccgcgaggcgctgggcaaggcgctcgccttcttctacccgctggcgcgccgcatcgtggagcagccgggaggacgagtgccccgcgacccgctggaccgccgacggcgtctacttcgctgaggcccaggccgagtgcagcgtggccgacgtgaggttcctgcagcgccccctgctgctccccaagcacgaccgcgtcccctgcccggccttcgacctctggggcggagagccgcacatccccatcatgatgattcacttcaggatgttcacctgcggcgacttcgtgatgagaaccctggcaagcatcgagtgggatagggattggacgcagctcgttggagctctggcttgatcgcggttggcttgggttcgatatattggtggctaaatgttggtttgtatttgtacctgttttcgttgtatttacttactttgtttctacatcttttgagcaatacgttaccattcttagagtgtagacagccaatttgatttttttaatcatttgatacgagacaataaaaatgatacatacctgcatatggttactacagctaaaaaaaaaaaacggccacgctctgccagtgccgcaccccggcgctgaacctggagccggacgccacggtgaagctctgcttcttcgccagcgtgcgccacctgctgaagctggacgcggggtactacggcaactccatcttccccgtgaagatgtcccggtgaagctctgcttcttcgccagcgtgcgccacctgctgaagctggacgcggggtactacggcaactccatcttccccgtgaagatgtccgggagcagcaagaaggtgctggagtcgtcggtgatggaggtgatcgacatgatccgggaggcgaagcagcggatggcggtggagttcttccagttcgccaaggaggagacgcggcaggaccccttccagatgagcttcgactacgagtccatctacgtctccgactggagcaagctggggttctccgacgtggactacggcttcggcccgcccatgttcgccggcccgctcgtgaacaacgacttcatcgcctccgtcgtcatcctcaaggcgccgctgccgctggacggcgccaggatgctcgccagctgcgtcaccaaggagcactcccaggagttcgcccgcggcatgaaggaggacctgccctgagcgagctgcttcgctttgctttgctagaccgagaaaaccttggcatgcatgcatgcagggggatggggatggaagcatcgtggagctgtgctgatgcggctgtttggttgatatattgttgctaatgttgttgtatttgtacctgttttcgttgtatttacttactttgtttctacatcttgagcaatacgttaccattcttagcatgtagacagccaatttgattttttaatcattcgatacgagacaataaaaatgatacatacctgcaaaaaaaaaaa

SEQ ID NO: 18871 - DNA, 888 bp, Triticum aestivum
  Clone ID: PAT_TA_18871
cggcacgaggctcctcttcttcattgctgcttcgtcgtgtcggctggccattgcagacaaggtgtttgtttggcggcagcgggcgctgctgagctaggttgctcgctggcttcttcattggtgctcggaggtaagccaggtaggtagatctgctcggacgcacggccattcgacagttgctgtatcaaagctagatagacaggcagatcttgagagacgccgttcagtgttctgccgctcgggcggaccttgttgattcgtagctctcaagctttaccatgttgagaaatccctgctgagtgtggataaacttcacataggaggtttctgaggctgaaccaatcgcttttgacttgtgagggctgaggatcagtaattaatcaaatcatgtggagaccgttcaggcagctcatgcccaaaaagcattccgggccttctggcggcctcgagggccgaaccatcgatgtcggcaatgtgaaggtgcacgtccgggaagccattgccgagggtgggttctcgtgcgtgtacctcgcccgggacctgaccaacccggcgaagcagtacgcgctcaagcacgtcattgtccaggacaaggagttgctggacctggtgcagaaggagatcactggtgatgagggcgcttaaggggcacccgaacgtggtcacgcttgttgcgcacgccttactggccgggaggaggcctctgtgtgagtctgcaagacgtggtttgcttgacctaaggactgagggtctatataggacaggtgcttatctccggatgttgaatgggcttccgatcactgcagacccactgtgctacaggatctaaagctgaaatgtgctctggtgctgacggggcttggaaatatgtgatttttgtagtgtatc

SEQ ID NO: 18872 - DNA, 686 bp, Triticum aestivum
  unsure (1)..(686): unsure at all n locations
  Clone ID: PAT_TA_18872
cgtccgaaattttctaaaaagctagagtcagtatacacagcttcaggagagaaaaagatcaatctaataacacattcaatggggggattgcttgttaaatgcttcatgtctcttcatggtgatgtctttgaaaaatatgtgaagagttgggttgcaattgctgcaccatttcaaggtgcgcctgggtacataaatagtggtctgctgaatgggatgtcttttgtggaaggatggcaatcaaaattcttcatttccaaatggactatgcagcaattgttgattgaatgtccatcaatatacgagttgttggctagctcaacctaccactgggaagatacaccattgctacagatctggagagagagcttagatgacaatggcaagaaaagtgccatactggagtcctatgaaccaagatgaagcaataaagatgattcaaaaagctctttccaagcatgagattatctctgatggaaatcacattcctctgccccttaatgaggatatattaatatgggcaaaggaaactcaagatatcttatcccaagccaaagcttccaaaatcagtgaagttctacaatatttacgggattgtttatgacactgctcacactgtttgctaccggagcaaacgggaccctatttcaaaatcttaggcacctcttatatacccagggggtgnactt

SEQ ID NO: 18873 - DNA, 694 bp, Triticum aestivum
  Clone ID: PAT_TA_18873
gtccctcaatgaacctgaggggacagagtaagtgctctcaatcatattttcaacacatgacaacattttcttattgtacacaatggaatcatttgattcttttgcaaaaactggattctcttcgcggaagggccgtaaaccgaacggccttatcactgtcctgttgaagaagttttggcctggcctattctgcccgcggccagacagggacccgcagcagcgggttttggccatgagctgggcccactacgaggcttgcagcaacgcggagtacgtgacgaccgctaaggccgtgatcaccaaattttggcaactctatagagttgttgacgagcacaacgccagagccgacgtggtcttgcttgcggctgcgaagaagaaagctcgtcagttgcagtacgaggtgcgctgggttgccgtctcgcagtactaccactactacctgcaccaaaagatgaccaaaactcaagcgcagatgctacgacttaccttgagaaaggagcagttcatgatggttgttcctcgttggtgctatggaaggcatgatggatgggcgagtttggtggataggtgtctcggcgtcgatgcagagtttgctgcaagagcatcaaggcccgggctaaccgtggagacgacgggacacacggccaaggaaacaggaaccactggggcttcaaggccatgaaggaggaca

SEQ ID NO: 18874 - DNA, 1757 bp, Triticum aestivum
  Clone ID: PAT_TA_18874
cgcaccaccaccctcccattccccaacgcaagcgcaacgccgcagcagctcccctctagcaggtgtccccgcggcccgcccctcccccacccccccgcccccgtccccgcacacgccaccccatggaggcgccgccggggccggatcccatggtgctggacgggccgcccccgctcgccgcagccgtcgtccgggcccgcgcggccaccgagaagacgaggacggaggggggcgaccctgtcgccggccacaggatccccacaaccatcgacgggaagaacggcgagccgaggaggacaatttgcaacatggctgggctgctggtaggaactggttcatttgggattgtcttccaggctaagtgcttggagactggagcgactgtgcccatcaagaaggtgctgcaggatcgccgttataagaaccgtgagctgcagcttatgtgctccattgcaccatcccaatgtcgtctctctgaagcactgcttcttctcgaccacaagtagggatgagctgttcctgaaccttgtcatggagtatgtccctcagactctataccgtgtgctcaagcactacagcaatgccatccaggggaaagccgcttatctatgtcaagctttacatgtatcagctttttagatgggctagcttatgttcatactgttccaggagtttgccacagggatgtgaaaccacaaaatgttttggttgatcctctaacccatcaagtcaagatctgtgactttggaagtgcaaaagttctggtacctggtgaacccaacatagcatacatatgctctcgctactatcgtactcctgagctcatatgaggtgcaactcaatatacaacttcattagccatatggtcatctagatttctccttgcatgcgctacttctcggtcgatgtctgtttccatggagactttgacggttgaagcaactcgaaggcgagtatcaaggattccttggcaaccccacctcccgtgaacggaaattctggagcatggaaccccaaccatgccgagttcaggtttcctcagattaaggctcatgcttggagaacaagattttccacacgcatgatgcccgctagaatgctatagatcttgcctcttgcctactctatgtattcaccaaaccaacgttgaagtgctcttgatgcatgtgcacattccgtctttgatgagctacgtgtgccgaatgcacgcccggcgaaaggccgcccattccctaatttgttcaacttcaaacctgaactagctgatgcctctccaggagctcatcaacaggcttgttccggaacatgttcgacggcaaaatggccccaacttcgcccatgctgggagctagacgggcgcgcccgcatcgcccatattttttgtttgtccgccatcatcgaagaatcaactctctctcctaaatcctgaggagagaccgatccagtgccagtgccagtgaaagaagtacaactatgtaaattacctgaccttggaagaatcgttgttgttgttgccggtgccggccatgtttaagtacatggcggcacatgttggttgagttgttacttattattagtaggtaagagcaatgatgtaggaggtggagacatatgttaatgctaggtctgtgacctgttttaagtacatttttgtaatgcttggtagtggtactgtaatgcggcagtagctgctccatgttttgtcccttgtccctgatgtaaatgtcgtcgtcctgcagcaaatgactcttcttctc

SEQ ID NO: 18875 - DNA, 648 bp, Triticum aestivum
  Clone ID: PAT_TA_18875
cgtggaatccgagtctcggccagagctggcggcgaatccccattctccggcgagcggcagcgcggccctccgctgcttcctgcagcatccagatccccgtcccgctgcctcacctccgcagcctcgatgcagcctggatctcacctccgtccgttccgccacgctggattcccctccccctagctggcgacttgatataagttcatctgctagataagctcaaaggagatatggaacctcggcagtggatgaccacaatcgtactaactgatgatttggtggtggagatcttgtctcggctgccactgaagtctttttgccgtttcaaatgtgtctccacgtcttggcttgccttctcatctgatctgcactaccgccagaagctcccaagaactcccgtcggtctcttgtaccaaaaaaagagagcatggcactgccatccatcttgcggggacttccctcaagtgacagggatattgactcaacacttagctttgtgcaatgttatgagcgtcccttggagcttaagcattgcagcaacggcctacttctttgttatcatggtggtatgccctcgaaaggaatttccgacgccatcgtgtgcaatccagcaactcaagagtggatgtcacttccagatactgaacc

SEQ ID NO: 18876 - DNA, 419 bp, Triticum aestivum
  unsure (1)..(419): unsure at all n locations
  Clone ID: PAT_TA_18876
catcctggtccacttgccatgcacgcagaactccaagggagagtccccccggtcgtcacgccgcagtaataatgacgaatgagccatcaaatcacaggcccaacctttcccactgtgaagttgctcggacgaaggaaccatcatgacttcgttgaattccgcttcttgaagaaaactactgtaccaactgtcctgctagctacagtagtactgtactccaccagaggcctcctttggttcataggataggaattttataggaatatgaaaatcataggaagtgagatgacaggcatctcaattcctatagagaaagagatgccatttgaatcataggataggaatttttccattgagtctaggctaatgtattggtaatttgctctanaaactacaatagtaactagtactggtacatg

SEQ ID NO: 18877 - DNA, 937 bp, Triticum aestivum
  Clone ID: PAT_TA_18877
cgtccgatttgggttcagttctccatctcaatctactggtctgagcacaactgttggtggcagtacctctcaaccatctcctgctagcacgatctttggtagcaagccgccacagccacagggcacaatgtcacagccgcctcagagttcagccacacagtttagctcttcgttcccgattgtggctagtggagtggcggcagcttcgtcatcgggacctggcactgtctcttttggagcgggagcttctccccctgggaccttgttgtttggagcaggggcatcttcatctggtcctggtaccgtgtcttttggagcgggggctgcctcatcaggaggtccagggagtgtttctattggaggagcttcctcatctggcactggtgtcttctcgtttggagcaggggtttcgtcatctggacctgggactgtatcttttggagcgacgccttcctcatctggatctgggactatgacttttggagggacaccttcctcatctggacctggaactgtgtcttttggcgtgacaacttcctctaccgggcctgtgtttggtaattcaccgtttggatctggagctgccgccttctctggatctggaagtgggtttgcattttcatcacctagctcttccactgcctcgtccttggcagcggctagtacaagtatgttcagcagtagctccacggcttcatcgtccgctgctctcagcaacccttttggttcagcttcgtcctctcccagcatgtttacatttggacaatcagcatcttcagggggtgctttttcatttggagcacagtcagctccagctttctcatcgcaagctcctccagtttattcgtttacctcggcgagcgcaagcatgaatttgtctacaccacagcctgcatttgggatgacaaatgccaacacaggcttcggaatgggatct

SEQ ID NO: 18878 - DNA, 816 bp, Triticum aestivum
  Clone ID: PAT_TA_18878
gcgccgctaaggtccccctcgccccccggcctccctccgtccgcccgagttcccgtaacctcccgtgctctgccctcccgcccccggcctccacctccattcctgcgcgcgtcgttatctctccaggctgcagcagagcggagcctcggcgctgcgtctcggggggcgtgtcgaggtggtcggatctatctccggtgaaccttggtctgcataacagaaaggattttcttatattctggtgaagatgaaaggaactcaagggtcacagttaaggaaatcccgttcatggtggtgggatagccacattagtccagaaaactccaaatggctctcagagaacttacaagagatggagatgcaagtgaaagagatgctgggacttgttgaggaggaaggtgaatgctctgcagaaaaggctgaggtgtattgccaagaacgacctgtgcttgtcgcccacatcaaaaaattctattgcatgtatcgcgcccttgctgagcggtacgacaatgtaactggagaactgcgcaaaaatatcccatcatcactgcagccacatggctcttttggtgcccctgaatcagattctgagacacagtctcctccatctacagagcaaaagccaaaaactcgatcagattgctttgatgtgtccattggcttctggtgtgagctctgacgtatggcaacagcatattttatgccttttcatcgtcttcagagtctgagtcagagcttgatgaaagcaaaaaggaaatgggcacagcatgttttatgccttgagccaaagaatattgagcttgaagttgaccttcatga

SEQ ID NO: 18879 - DNA, 734 bp, Triticum aestivum
  unsure (1)..(734): unsure at all n locations
  Clone ID: PAT_TA_18879
tcgagttttttttttttttttttatccagttgcaaggaacccactatcaatggtgcaaatgtacatcactacgtatctccagttctccacgcatataatgtatacatttttcttttttgcggaagaggaatggcatgtctctactctgaatagttaacagtttctaagctctaactagcagaaaccacaaangaaacagcttgcaagcgctgctctggtgaaatcatccgggcaagtcgatgccttctagggtctacgcacaagagagtaaccgatacccttcagtcctcaccatttcagggtggctgccaactccaagagagcttccacttgacgtatagtccgcagcttctcttgctgtttcaacatggtcgcaacagactccgggtcgtatccagtttgcagcttactcttttcttgctcagcttcaacttctttcagcagctcatcgacttccctcacaaactctcctctcagaagcacatcatcgtcctggggaggcagcttgatctgcccatcatgcttttccatgtcgaacccaggaggaaagaccatggtgaatgggtcctctcttggaaaaacttcaatcatgtgctttctacatgccttgagccatttgtcatcgtcagagccatcatgaatattcagaagttcatcaagtaatctcatggcgggagttgcttcacttcttaaaatctcagtctctacccttctgtacctgcccgggcggccgc

SEQ ID NO: 18880 - DNA, 778 bp, Triticum aestivum
  Clone ID: PAT_TA_18880
cgttgcgcccagtaaatgtcatcagaaataaattccctaccgacgatacattatcttcataaaagaaaggaagttggaggagttattattgaagagggattcagtggtatgtgcttctcaagagctaaactggaacaagaagtgcatgactctcatgcctacactaactaatcagacttcccgaaggagaagaaggaggtgcggaaagaggatgggagcaacaaatctgaatcaaagagggtgagaattacttatcgatgactcgggcatcaactcttgattttcggcggaagacacagggtcagaacaactggtctgggccgttgcgcctagtaaatgtcgtcagaaataaattccctacctacaagaatggtacgaatgggatagtcatcaaatttgctgatgagccagaaacgccatgacttaaggagtctgttgccaaagggacagcagatctgcttgatcggcgtcagcgtctttcagtccgcgagctcgcaatgaaatttgagaagggcctcagtactgccacattattatctaatgaggtatgggtcttcctgattcctgaacactcatttagcaattggtccagttattacagaccttaagttattgcattggctttaactctcaagttaaatgtaaacaagtggctttattggagcgagacatccttctgaaggatctaaagagtgtattggagtcactgagaggacaagtagctggcaaatataaggatgaatttgagggatcagtatctatgggggatattttagca

SEQ ID NO: 18881 - DNA, 719 bp, Triticum aestivum
  Clone ID: PAT_TA_18881
cgtccggggggaggggaagaggggaactgggaagggcgaagctgccgccgcccatggatcgggagctggaggaggcgaactgcaagttcgcgtggctcaagctcgcctgcgcggagtacgagctcgactcctgcgccaccctgctctccgagctcaaggttctcctcacaaagtttcctagcatgccaccatcatttgagaggacacctaatgcagttgcggagctgagactcgcaagggccatatacgagtttgctgttatcttcagcatcagagttaaggaccaagatgcatttgagaggaacttcttccaattaaaagttttctacatggatacaagaggcatactcccaccatcaccagaagaatatcgaattttgggacttaatcttatgagactgttggctgagaacagagtagctgaattccacactgagctggaacttctgcccccgagagcccttgaccatccttgcatcaaatacgcagtggagcttgagcaatcctttatggaaggtacctacaaccgattaactgatggtcgacaagctgtgccacatgagacatacctctacttcatggaccttcttgctgaaactgttagagatgagatagctgattgcagtggtcaggcatacgatcacttgccagtggatgataccagaaaaatgctgatgttttcctctgagcaaaagcttctggagtacatatcagagata

SEQ ID NO: 18882 - DNA, 1622 bp, Triticum aestivum
  unsure (1)..(1622): unsure at all n locations
  Clone ID: PAT_TA_18882
cgaggggccaagnctgcatatttgatgaagcatccacttgccgtagaaaggatattttatgattctgtaccagaagttctgttctggccagtatttgtgattgctacacttgctgctatgattgccagccaagctatgatatctgcaacgttctcttgcataaagcaggctatggctcttggttgctttccgaggatcaaaataatccatacctccaagaaagtcatgggtcagatttacatacctgtgatgaattggtttctcatgatcatgtgcatcatcatcgtggccactttcaggagtacgaacgatattgccaatgcatatggcattgctgaagttggagtcatgatggtcagtactgcactggtaaccttggtgatgcttcttatatggcaaaccaatctgtatcttgttctgtgcttccctatattttttggtgcaatggagttcatttacttaactgccgtcatgtcaaagctgctagaaggaggatggttaccacttgctttctcatcattgtttctttgcataatgtatacatggaactatggaagcgtgttaaaataccagagtgagatgcgtgggaagatatccctggactttattctcgacctgggatcaacacttggcacagtaagagttccaggcattggacttgtgtacaatgagctggtccagggaatcccatcgatctttggtcatctgttgatcacactgccagcaatgcactccacgatcgtttttgtttgcatcaagtatgttcctgtcccatatgtgccgcttgaagaaaggttcttgttcagaagggttggccagaaggactaccacatgttccgttgtgttgcacggtatggttacaaggatgtcaggaaagaggaccatggctcatttgagcatctcttggttgaaagcctagagaaatttctgaggagggaggcccaggaactcgcgctcgaggtgagcacaatggaggcagagcgtgatgatgtgtctgaagtgtccgagatagttccatcatctcctgctattgctgctgaggatctgcacactccactgctttctgatcagagaccgggcgatgacagtcgaatgttgggcatggaaggcagcgttcctttgctcccctctagctccatgtccgcagaagaagaccccagcttagagtacgagctcgcggcactgagggaagccatggcatctgggttcacatatctcttagcacatggcgatgtgagggcgaggaagcaatcattcttcacgaagaagttcatcatcaactatttctacgctttcctgaggaggaactgcaggggtggcaccgcaaccttgaagatgcctcactcgaacatcatgcgtgtggggatgacgtacctcggccgcgccctcccctactgcgcctgtgctgcaaaattgaaccttgttctcgcgcctcgtctttggtggaatgctacaccaccaggtagtttagggatttgtaccgccgcagtgaacaaagtcactgcagcttccggccaactgcccaaaattttagttgcagaattggccttgtgtcttccctgttgtattcttgccaaccttttcggttaactttatgctaagttatctgtgtgcgatttgca

SEQ ID NO: 18883 - DNA, 813 bp, Triticum aestivum
  Clone ID: PAT_TA_18883
cgtccgctccgacaaacgcccgcccgcccgaccgcccatcactcctcttccccgaaccctaccctcccatggcggctaccgcggcggcgtcgccctcctcctccctgctcctctcccgccgccacggcgcgtcctcctcctcgtcgtcggcgtcccgcgccggcgcctcccgcctccgcgcgccgaggtgcgtgctcgggacggcggagcagctgcgggtggtcgaggcggggaagccggtgggcggggccgacccgtgggccgcggcctggacgcccaagacgcccgcgcaggaggccaggctcgccgcgctgccgcaggaggcgcgcgactccaggctcaagatcttctccggcaccgccaaccgcccgctcgcgcaggaaattgcttcttatctgggcgtagaccttggcaagatccttatcaagcgctttgctgatggagaaatctacgtgcaactgcaagagagtgtgaggggctgcgatgtcttcttggtgcagcccacttgctctcctgtcaatgaaaacctcatggagctcttcatcatgattgatgcatgtcggcgggcctcagcgcgatctattaccgttgtcattccgtactttggatatgccagagcagacagaaaggctcaaggacgtgaggcaattactgccaaactggctgcaaatttactcacggaagctggcagtgaccgtgtcattgtatgtgatatgcattctgcacaagcattgggatacttcgatattcctgtggaccatatatatggacagcctgtgattctggattgccttgctagcaagacaatttcta

SEQ ID NO: 18884 - DNA, 1203 bp, Triticum aestivum
  unsure (1)..(1203): unsure at all n locations
  Clone ID: PAT_TA_18884
cgtccggaaaacgcgacccgacttcccaatttccccatttcccgtccccattccatagcccagccgccgcctcgctgcccgttgctcccctttcttcttcccccgagagccaactcctcgcccgccgcacccacagccggagagagagagagcgcgaagaaggcaaagcgccgccgcgaggacgaccgaggccgaggagagatggcgtcgaggatggcgtccaaggacatcatcacgctcaagggctccgccgccatcgtcagcgagttcttcggttacgcggccaacagcatcctgtacaaccgcggggtgtacccggaggagagcttcggcaaggtgaagaagtacggcctccccatgctgctcacgcaggacgaggccgtcaagaccttcctcaccaacctcacctcccagctctcagagtggctggagggtgggaagctgcagaggattgtgctggtcatcatgagcaaggccaccggcgaggtgctcgagcgctggaacttcaacatcatcactgacggcgaggtcgtcgagaaaggggcggtgaaggagaagagcgacaaggagatcatgagggagatccaggccatcatgcggcaggtcaactcctgcatctccttcctcccctgcctcgatgagccatgcatattcgacgtgctggcctacaccgactccggacaccaccgtgcccttcacctggatggagagcgacgccaagctcatcgaaaacccgcagatggtgaagctgcactcgttcgacaccaagatccacaaggtggacacgctggtgtcgtacaaggtggacgacttggacgagcagtgacctgtgggtgtgacccagagcgtccatgacatcccctgtaggcgtgaagctctctctgtgtgaatcgttcattcacgtctggccgtccgttatccgtactgttgcccccctgcctccaaaaatataccaaaacctgtactgttatttctcaagaaaaaaagtactgttatgttatacctgaattggatgtatcgcctgccgttttccacgcacaagctctgaggcgaagtttgccaaacaaaccctatgtgttagttttgccaaataactactcctttgtaaagaaatataagagctactttagtgatctaaactctcttatatttctttacgtgtcagtnctgcctcatgaacatgtaaacaacagcataagcaat

SEQ ID NO: 18885 - DNA, 675 bp, Triticum aestivum
  Clone ID: PAT_TA_18885
cataactgctttctctgtctgtctcgcacttcgccgagcgggatggccagcgaccgggagaggccgcgccgccgcccgtcgccggaccctgtggcggtgctccggggccaccgcgccgccgtcagcgacgcctgcttccaccacgccctccctctcctcttctccggcgcggctgacggggagctcagggtctgggacacggcgagccaccgcacagtctcctccatctgggctcatggtggcgcggctggggtgtattccatcgccgctggctccggacttgggaacacgatcattagccagggcagggatggtttgtgcaaaggctgggcgattgaagaagctgggctctcaaggaggcccatatttacaattaaaacaagtacataccatttctgtaagatgtcactggttaaggttccatgttctgcacatggcacacaaaccaacttgagtggctcaaatagtggcactgagccacaaagagtacctattgaagataatacaggatcagatggtttaaatcctgcagaaggaacacaggaatatgaacaaggaagttccttggatggacaaaatatattgacaatcgctgctcaagaatcgtttgaggttgaactttgggacattaaaaattcaacgaagataatgtgtttgcccaaaagatgcagtgct

SEQ ID NO: 18886 - DNA, 881 bp, Triticum aestivum
  Clone ID: PAT_TA_18886
cagacccgcagaccgccttcccccactccgctcgcttccagactcgtccccgcccctctcccccgcccggattcgtcccgccgccccatccgctccgccgcgccgccatgtcggtgacgctgcacacgaacctgggggacatcaaggtggaggttttctgcgaccaggtgccgcggacggcggagaacttcctagccctctgcgcgagcggctactacgacggcaccgtcttccaccgcaacatcaaggggttcatggtgcagggcggcgacccgacgggcaccggcaagggcggcgcctcgatctggggcggcaagttcgcggacgagttccgggaggcgctcaagcacggcgcccggggcaccctgtccatggccaactccgggcccaacaccaacggcagccagttcttcatcacctacgccaagcagccccacctcaacggccactacaccgtgttcgccaaggtcatccacggcttcgacgtgctcgacctcatggagaagacccccaccggccccgccgaccgccccctcgccgagatcaggctcaaccgcgtcaccgtccacgccaaccccctcgccgggtaggcctttcttctctcctggatggctggcctggcctggcctggcctctgctgctaatctaggaaccggaaccaaatttggctctgtaatatcatcatcgtctggttacctgaattctacctacctgcctacccgcaagaacatgatgctgctagtatactggtgtgttgaatgatgatactgcaatgcaagcgtttggttaagtgaattaagctgcgggaggatttgtcacctgaatttagttgcctgaattttacctgcctgcaagaacaacatgaaactgtacggttatag

SEQ ID NO: 18887 - DNA, 2067 bp, Triticum aestivum
  unsure (1)..(2067): unsure at all n locations
  Clone ID: PAT_TA_18887
gaattcggcacgagccactggccatcaaacgggcgtcatcttcccacatggccggagccgcctcgggatcgccatggccatgagatcctcgacagcgacgtcgctgctctcctcgacagcgacgtcgctgctctccagaaccctccgcctcctcgaaccttccgcgcaccgggtcccgcgggtcgaatcgagagccgcgtcgtcgtcgactggcggtggggatccgtcgggccaggagccggcgccggcgcccatggactccccgatcaaggtgttctccgatctccgcggcggcggggcccgcggcgcggcgatcgacgcgggcgggtcggcgcggaagccgctcagcctgtggcccgggatgtaccactcaccggtcaccaacgcgctgtgggaggcgcggtccagcatcttcgagcgcaagatggacgccgggggcaacgccgacgcgggcccgcagacggagctgctcaccaagaagcccgcgcagagccggacctccatcgtctacaagttcgccgccgacgacatcctccgcgagcagtaccgcgacccctggaacgaggtgcgcgtcggcaagctgctcgaggacctcgacgccctcgccggcaccatcgccgtcaagcactgttctgatggtgatagcacaacaagacctcttttgttagttactgcttctgtggataagatggtcttaatgaagccacttcgtctggacactgaagtaaatattattggggctgttacttacgttggccgctcttcgattgatatacagattgaagtgactcaggttgatcaagatggtgatgtgcagtcagacccaattgcattgacggctaacttcacatttgttgcacgagattcagtaaccggaaaatctgctcctgtgaaccgcctttcaccagaaaccgagagagagaagcagttatatgcagagacagaagcacaggataaggtgaagaaaaggaaaagggaagaacagaagggagtgcttgagaagggggtacagaagcttggtgctgaggctgagaggctgaaggctttactggcagagggtcgtgttttctctgattttcctgctttggctgatagggatagcatattgatgaaggatactcgcctggagacctctatgatctgccaacctcaacagcgaaacttgtatggacggatatttggaggtttcttgatgcaccgagcatttgagcttgctttctcgactgcctatgcctttgttggacagagaccgtgttttcttgaggtcgaccatgtcgacttcttaaagccggtggatgttggagacttccttcgattcaaatcatgtgtcttgtttacccagcttgagaataaatggcagcccctggtaaatgtcgaagttgtcgctcatgtaacaaggcctgagctccgaaaaagcgagatctccaacacattccacttcaccttctcagtcggcagcgacgccctgaagaatggagttaacatccgcaacgttgttccctcaaccgaagaagaggcacgccgtatattagaccgcatggatgcagagggtttgttcgattgatccttcggcggggtcactggttccagccataattttagcaactttttactggccatgttaactagtgggagatgtaccctatgatttgaatgaacatcagcagcagataagaagcatgctggcagcagaccggcgaaagtgtagctttttggcgtttcttttgggaaattatttggagtatagtagtataggatatataataaccccaacctcgagacccaaaaaatgtgccttttgtgagggcactgtccattaattatatatgtaattgcttttttgttccagcatgtaaacaaagatagaggccattgccttcaggtcagaggggaatgcagagataattctcttgtcacccctcatctcggcgtgcgggagccaatcccgacccttccggttcctgtactcttggactgcagtgagtgtagttcggctcgctactggcactctacttgataaaaggggggcccgtancaaatcgcctanatgatctataccgcgccacg

SEQ ID NO: 18888 - DNA, 1073 bp, Triticum aestivum
  Clone ID: PAT_TA_18888
tcacatatgatggtgtacgccttctctcaatgctggatgaatacatgattgttcgccaggagaaagaacaagagaagaagagacaaagggatcagaagaagctccacgatcaactcaaagctgagcaggaagctctctacggttcaaagccaagtccatccaagcctcaaagcataaagaaggcgcctagacactcgatgggtggtgtaaaccgcagggtgtccatgggtggagccacgatgcaagcacccaaaacagacatactgcattccaagaatgttcgtgctgccaagagaactgaagacattgcccatttgtcccctgccagcagaggcttggacattggcgatcttcccatcaagaagctatctttcaatgccactgccttgcgggatccccaggcacctccctgcccggttgcgcagatcatgccgccgccaagcagtgtcccctccactcctgcgcgctctgtcaccaacgacaccgaggacgagaaccggacccccaaccccaagacatttggagcagcactgaacctgaagaccccgatgaccgtggcggctccgatgcagttggcaatgacgccagctgtggctaacaaggtcacggctgctcctgtctcccttgtctacgagaaaccagagccaacattgccggaggcgatcgagtattccttcgaagaaaggcggttggccgtctatttgtcaagagaagttgtttaagctgctgagacatgtcaagatctccactctctgcgcgaggtgaaagttggaaacctgacggctgttactgtgagacactagctgctgcctttgttggtcgacgacagtcgcccagtgctgttctgattgttcccctgccacatttgattgtttccatactcagcaaaggaagcttgcgcttcagcagcttccgttcagtactgccattggttagatataattaatgtgtataggtttctttctcggcactgaatcatcttgaatctgtttgattaatgtagatctgcactgtttttaatcctcaagtgatgatgtgtttctcaaaaaaaaaaaaaaaaaaaaaaaaaaaaa

SEQ ID NO: 18889 - DNA, 891 bp, Triticum aestivum
  unsure (1)..(891): unsure at all n locations
  Clone ID: PAT_TA_18889
gtcacgtctgcccccgtcccctcccctcgcctccctccccggtcctctcctccccttggcccctctcgcccccagcatccccaacccgagaatctgccagaagccgtcgaggccctacgcccgcagccatgtcagcgagcagcacgccggtggacgcctcgggcgagccgatcccaacgtcgtcggtgctgatggcggcgtccaagcacatcgcggtgcggtgccggccggagaacgtggccttcctcaactgcaagaagaaggaccccaaccccgagaagtgcctcgagaagggccgccaggtcacgcgctgcgtcttcaacctgttgaaagaacttcaccaaaagtgccccaaggagatggatgcgtatgctgggtgcatgtattactacacgaatgaatttgacttctgccgcaaggagcaggaagctttcgagggtgcgtgccctatttccgagtagcccgtcctctgagagcgagttttacccccagtgatctcttgagaaataaggagaaaagccggcaaaccctccaagttgacgatctcccatgtttattgtacccagagagttttgtttgtatgggtgaatagcgcgtcattgagctgctcatcccattcgctcgtctttcttcagcaattacatctctgttttaaccttcgagttggatgccaaacttgactcagctgtagtcccaagttgttgttgatgatgatgattcttccgttaaaaaaggaaaaaatcaccccttaccgctcgctatacaggaataggtggccctatcaaatccatgtagaaacnaaaagcaactggtaggaatataagcggtcatttcanggtttaaaaaananaaaaanaacnaaaaaaggaagaaattgaanaaagnaaaaaa

SEQ ID NO: 18890 - DNA, 914 bp, Triticum aestivum
  Clone ID: PAT_TA_18890
aaaaaaaaaaaatttttttctccacccggggggaaaaaattttttttttttaaagggggcgccccctttttttttttttttttttttttttttttttttttttttttttttttttttttttttttttttttttttttttttttttttttttttttttttttttttttttttttttttttttttttttttttttttttttttttttttttttttttttttttttttttttttttttttttaattcttgggcaaacattttccatatatattcttgacatgacaatcagtatatttcctttcctttcccctcattttcctaagacaacataggtgtatatacccctatcctttcctttctctgtaagaactaacaacaaaacacaacaaaatggctacaagcatacagagttgtgagggtctgcggttatgttagaacattgtatagctgcacagcgccgttactagcaatacaaacaaggacttgtgccactgaaatctccatccagatgagatatcatgcgcgttcacagtgtatattgatccagtcttgtcatccttgattttaatgctggaggagcagttgtaatcggtccatccaataacttgattttctaaatcataaagaaccagcctgtttgaaaatgctagatctcccaaaagcaccatatcttttccatccttggtttgtaatccaccagtctggaaccccatgcagtacagctccccattttgaaaaagatagtcatgtggatgaatattcagtggaaggccgccctcaaagtgaaaggtgattataggaaatccatcgtctacacttccagaatatctgaaacattggaaatcttgatcattttttaagggcatatctccataccgagcaaataccttagacattatagcattataaaccacct

SEQ ID NO: 18891 - DNA, 700 bp, Triticum aestivum
  unsure (1)..(700): unsure at all n locations
  Clone ID: PAT_TA_18891
ccacgcgtccggagagaacaaaaaannntgaaaaggaagaagctgaagtaaagaagcgacaaaagaggcaggaagaagaagcactgaaagagcagaagcgccgtgaaaaagaagaagctgaaatgagaaaacaagaaaagaagcagcaagaggatgctctgaaagagcagaagcgccgtgaaaaagaagaagctgaaatgagaaaacagcaaaagaagcagcaagaggaagctgataaagaacaaaagcgtcttgagaaggaagccgcgcaactcaagaaacaactggccattcagaagcaagcttcattaatgcagcgccttttcaaaagtaatgacagcgaaaaacctaaatctggagagaatgactcagatgtgcacactgttgatccaggcactacgaaaaaagagatatcagctgctacatcaataattgattcttccttctctctgaaagagagctggactttggagtaccttcagaggttgcagatcactggttggcaaaagttatcaagctataacaggtcctccagatggggtatcagacacaaacccaaggaggcatttaaagagctgaagcttcaaaaaacctcagatgacatgatcgatgaaatactttctactccaaatgaagatgcttgtcacaattcaggtcaagaaaatgaaccagataaactaggaaatgacattgatatgct

SEQ ID NO: 18892 - DNA, 613 bp, Triticum aestivum
  Clone ID: PAT_TA_18892
cgtccggctcgctgctcgctgctctctgctctaggccgcgcgcagggcacacgcttctcctcactcccccgcctctcgtcgtgcctgcatcgaggcgagctgcttccagccggccaggcagacagagagtgagccacccctgccggggaccagaggaggaagaaggaaggcagggcgagatggcgggtgcgctgggcgtgaaggcgacgccgttcacctacgcggcgcacgcgctgggcgcggcggcggcggccatggtgctcgtctggtgcatccacttccgcggcggcctcgccctcgaggcggtcaacaagaacctcatcttcaacgtccaccctgttcttatgctcatcggcttcattatccttggcagtgaagccataatggtctacaaggtatttccgggcctgagccacgacacggccaagctgacccacctgatcctccacgcgatcgccatcgtcctcggcgccgtcgggatctactgcgccttcaagttccacaacgagagcgggatcgccaacctctacagcctgcactcctggctcgggatctgagccatttgtctctacggaattcagtggatattggggttcgtgacggtcttcttccc

SEQ ID NO: 18893 - DNA, 1167 bp, Triticum aestivum
  Clone ID: PAT_TA_18893
cgaagcggaagaggcgaaagcaaaagccaagactcggctttcctctcgctcgccgctcgctgctctctgctctctaggccgtgcgcagggcacacgcttccctcactcccccgcctttcgtcgtacctcgatcgaggcgagctgatagggagtgagctacccctacggaagaaggaagaaggaaggcacacaagttcgtgtgcagcagggcgagatggcgggcgcgctgggcgtgaaggcgacgccgttcacctacgcggcgcacgcgctgggcgcggcggcggcggccatggtgctcgtctggtgcatccacttccgcggcggcctcgccttcgaggcggtcaacaagaacctcatcttcaacgtccaccctgttcttatgctcatcggcttcattatccttggcagtgaagccatcatggtctacaaggtatttccgggactgagccacgacacggccaagctgacccacctgatcctccacgcgatcgccatcgtcctcggcgccgtcgggatctactgcgccttcaagttccacaacgagagcgggatcgccaacctctacagcctgcactcctggctcgggatcggagccatttctctctacggaatccagtggatatttgggttcgtgacgttcttctttcccggggcggcgccggacgtgaggcgcggggctctgccgtggcacgcgctgttcgggctcttcgtctacgtgctcacgctggcgacggcggagctcgggttcctggagaagatgacgttcctgcagagctccgggctcgacaagtacggcgcggaggcgctcctggtcaacttcacggccctcgtcgtcgtgctcttcggcgccgccgtggtcgtcgctgccgtcgctcccgcggctaaggtggaggagccggagggatatgctccgatcccagtcatcggttagtagcatcctagtacgtggctacgtgctactgatcgtcgaaagtccagaagcgagaccgcgtgtgcgattggttccacgagatcgggtgtaagcacagaactcacgtctgatttgtgtgtatcagctgaaccgtacgatttgattactgaaaactgcagtggtacctttgaaagatcatgagatggcttgataagttgattgtttttataaaggacgttttatatcgactcaaaaat

SEQ ID NO: 18894 - DNA, 1487 bp, Triticum aestivum
  Clone ID: PAT_TA_18894
aagagccaggagaaaaagagccgcgcggtagaacgcatcccgccgtccacgtgggggcggcggcggcggcggcttaggagaggcgggtgccgcaggagatgtgagagactgcccgctgcgagatggcggcggcgggcggcgaggccgcggcggcggcgctggcggcggcgaagaagcgggcggcgtcgcggagctggatcctgttcgacgcggcgggggaggagcgggagctcgacgccgacaagtacgccatcatgcaccgcgtcgacatcaacgcgcgcgacctgcgcatcctcgacccgctgctctcctacccctccaccatcctcggccgcgagcgcgccatcgtgctcaatctcgagcacataaaggcgatcgttacttctgaagaggttttgctcagggatccttcagatgaaaatgttattcctgttgtagaggagctccggagacgactagcaccttcaagttctgctcagcatgatggaaaggataatttaagtggccagcatgatgcggaagctgctgaagaagatgaatctccctttgagttccgtgcacttgaggttactttggaagcaatctgcagctttcttgatgcgcgcactactgagctggagactaatgcttacccagctttggatgacctgacatccaagattagtagccacaacttggacaaggtacggaagttaaagagtggcatgacgagattgactgcaagggtccagaaggtgagagatgagcttgaacaattattggatgatgacgatgacatggctgatctttacttgtctagaaagttggccggggcatcatcccctgtcagtggttccggtggaccaaattggttcccagcatccccaactattggttcaaaaatatcaagagctagtagagccagtgcagcaactatacatggaaatgagaatgatgtggaagagctggagatgttgctggaggcatatttcatgcagatagatggcacattaaacaaattgacaacgctgagagagtatattgatgacacagaagattatattaacattcagcttgataatcaccgtaatcagttgattcagctagagctattcttgagttctgggaccgtctgcttgtcactctactcattggttgctggagtctttggtatgaacataccttacacctggaacgacggccatggatatgtcttcaaatgggtggttattgtatcagggctgttttgtgctttcatgttcgtcacgattgtcgcttatgctcggcacaagggccttgttgggtcctgaatagctggaataaccgcattactcgctttcttcaactgtaaattttgagctagagcatcaactttgcggatgattcatctcttgtaccaaattcattagtatggaattagggatgatgaaaaggaacaataaatagaaatgaaataggaattcggatgtaaaaaaaaaaaaaaaaaaaaaaactcgagactagttctc

SEQ ID NO: 18895 - DNA, 623 bp, Triticum aestivum
  unsure (1)..(623): unsure at all n locations
  Clone ID: PAT_TA_18895
ggaagagttttccggctcctcttgttcaaccgagggaggataagaggagagtgagtcgcagagcggacgcgtgggcggacgcgtgggggagcttctacggataccaccatccctaccgattcttggaggaacagtgtttcctttgctcagacagtaccgggtctatggaacacatcattccctaacctggagcagcttacaaaccaccgggagaaagcagaacctgaatgggggtcggtctgcgcagtgtgcgacgagtcacggtggagcttctgtctcacatgcaaatggtgctccaaaggattcgcctttgccggatagtttgcttcgtgatgctcgcatcctctattgtgcatctcctgccatgggtcataacaaggaagcacatccagaatcaaacaaaagagtgccagcaatagttgatgctctcgaaaaattggagcttacaccaaagcatcggggttcacaggttcttgaaatccaaaatttctaccctgcttcactggatgatgttgcacgagttcattcaagaacatacatcactggacttgaaaagctatcagtaaaggttttagatagaaagttttgatattcantcgaaggaactggaccaacatatgcta

SEQ ID NO: 18896 - DNA, 1837 bp, Triticum aestivum
  unsure (1)..(1837): unsure at all n locations
  Clone ID: PAT_TA_18896
ggaatggttttccggctcctcttgttcaaccgagggaggataagaggagagcgagagcgagagagagagagcgcttcgcctgaggtgatggagcttctggggataccacgatccctaccgattcttggagacagtaccgtgtctatggaacacatcattccctaacctggagcagcttacaaaccaccgggagaaagcagaacctgaatgggggtcggtctgcacagtgtgcgacgagtcacgatggagcttctatctcacatgcaaatggtgctccaaaagattcacctttgccggatagtttgcttggtgatgctcgcatcctctattgtgcatctcctgccatgggtcataacaaggaagcacacggagaatcaaacaaaagagtcccagctcttctagattgcctctccaaattggagcttacacaaggaagcacatccagaatcaaacaaaagagtgccagcaatagttgatgctctcgaaaaattggagcttacaccaaagcatcggggttcacaggttcttgaaatccaaaatttctaccctgcttcacttgatgatgttgcacgagttcattcaagaacatacatcactggactggctacggccgccggttcacgtctttcagctggtgctggaattacattggttgattcagtgtgctcgtttcccaagaaatgttgtatgttttcctaggttgccgcatcaaagctgggcctaagtccacctcttggatttgcgctaataaggccacccggacaccatgctgttcctgaaggtcccatgggcttntgcgtctttgggaacattgcagttgcagctcggtacgctcagcatcaacatggattgaagcgagtaatgataatagattttgacgttcaccatggcaatggcacatctgatgccttttatgacgatccagacatcttcttcctctcaacccaccaggtctatcagaccatcaccttacatactcactgctggcttattttaccattaccatgatagtcattttcttttctgaatttggtgtatgtagctaggaagctatcccggtactggtaagatgaacctaattggtcagggcagtggcgaaggaacaacgctcaacctgccattgcccggtggctcaggtgactactcaatgaggtgcgcctttgatgaggtcattgctccatctgcgcagcggttcaagcccgatatcatcctcgtttcagctggctacgacgcgcacgcgctggaccctctagcgggtctgcagttcacgacgggcacgttctacatgctggcgtcgagcatcaagcagctggccagggagctgtgcagcggccgctgcgtcttcttcctggaaggtggttacaacctgcagtcgctctccagctctgtggctgacaccttccgcgcgttcctcgacgagcccagcctcgctgctcagttcgacgacccggcaatgttgtacgaggagccgacgcggaggatcaaggaggcgatcgagaaggtcaggcatcttcactcgctctaggttacgcgccgggagatgaggtgtagactctactgcttgcagcgcacgcaccatgaaatcagatcacgtgttgcatttgcaggttcagagagtgggtgtgtgtgtttgaaacatctgcttgctggtcatacacacttggttaactgctgtcaaaagcattgatttattagggatcctccacacataatacagctgtgtgtgcaactgggccatacatagaattgtgtgtgcgcgcgtgtgtgtgtatttattgtggatcatgcgtgtatataatactgcattttgcccttccaaacaaaaattacgttatct

SEQ ID NO: 18897 - DNA, 550 bp, Triticum aestivum
  Clone ID: PAT_TA_18897
atcgatgggggtgtgctgggtgcggggtccgcaggttttccccgccgacggttgccccgcccgcggggctatcggtctgctgggcccttggtacgggccccccttcgcgcgccgtgtgctgagcacccgacccggtgttgttccggatgtcctttttaggtggcccgggagggagctcgggcggttggccgcacggcaggtcctttgttggtgccgccttgtgctcccggtggtcgccttgctggctcggcgtatagtgcccggagagctacattcgcgcgaggctgtctttccggccgcctgggttttgctttgtttcacgccagtggagtggtccgtgtgcgggctcgtgccctgtgcgcaggccctccccgtatctggtgccctatggtgctatcagtggatgtccttaagtgagcatatattcctcgcgttctctccagcccctggcccccgcactccctgacccccttcatccttcactgtagggcttggcataaagaacacataaatatatattcatgtgaaattgaaattcagacaaccttag

SEQ ID NO: 18898 - DNA, 833 bp, Triticum aestivum
  unsure (1)..(833): unsure at all n locations
  Clone ID: PAT_TA_18898
cgtccggacggaaacatggcagagaaacaactagcagccgccgtaaagagaaacttctcaagttcttcaacaagtatgatacgacactagacattttcattttcctcagattagtagtagctatccagatgtgctcgcacagggaggtgtatgaaccgcttataccagggctcagaggaaattacaatctggaagattggtgcttttggcgcgtcactccagctcgtcggttcacggatcatgttatgatgttggccttggccacagcgcttgaggtacccctcagagtggagcgagtccgaggaggatatgatccagatatctacactgttcctggagttctccgtccaagagtgaccctgctgtactccggagatcactacggaatcatctacccacgtgctcctcctgctgagaattcaagtcatcaggcttcctagagagaacatggtgttgatcaggcttcaagccaacagacttcccagatcagagttcaagtcaacagactccactggattaaagttgagttgggctgctgcctatgaatgagagtgtttccgagtttagtggtagagagttaggggtaggcatctacatgcagtgatgaagttggggtaggcatagcatatacacttgtgacttcttctttgataggaagaaaaacttgtgttgtgtgaattgttggctggtatacggtgatccttttttcgttcacagggagaaccccttctgtggcggtgtatattgttggctggtatacagtgaatcntgtgtgatcagactgaacttcttgttatattgccagctggtgtataatagatctcccatgcaga

SEQ ID NO: 18899 - DNA, 616 bp, Triticum aestivum
  unsure (1)..(616): unsure at all n locations
  Clone ID: PAT_TA_18899
ttttttacaaactattgtatccaaacattagagcagaaccggcatgtatcttacaaatatcctctctaaattccgcctttctaactaaatagcagaaccggcttgccgctgtctaaccagcaggtgtacaatcttacattcacacaaagtttacaacacttgtcctcacattcaccacagggtttaaacacttgaaaagctatgaaaaatagggtttatccctcgcttgctttgttagaaatagtaacatcagcatatttgctttcggtgagggtgcatcaccagcataacggtcgtgcttcttgatagatcttcgcgagcccagttgcgtttattaatttcgctttcaccctgaatcggatttgcctaatttcagtttcaccctgaatgggattggcagatccgagttacgttttctccttgcttttgcagtttcaactgccaatccttttttttttcaaccccgacacccagtttcgccctttagtcctactgccggacctttgcccttggtcatctgcccctctacgcaggtccnggatccttanaaggtcaaagnaccgttgatacccgagnnnactcacanaaaccgcttgcannttacgcccntaaggaa

SEQ ID NO: 18900 - DNA, 683 bp, Triticum aestivum
  Clone ID: PAT_TA_18900
cgtccgtttatcagaattgtgcaaaagcgagaatggccttgttgccatacctgttcatggtaatgcatatggcaagggtttgccctatgctcctgaaaattggccgtctcctggagatcagtggcaatggaaagtggggaacagaattgctgcaggtgggcattgggtggacagatatcttgccccaccctcgcgttttcgtgatgctactggtaaaaagacgacattcacaagtagactgaaagttggagagtttatcaagagcaactttccagatgttgatcctagcacatttttctctatgtcatatggaagatccctgctgcagaaggcgggattcaaagaggaactcttcaagtggaacgcgttgaacctgaagatggcctggcggatcctgatggaccatgcaaggctcggaataaggcgtgcaatcttgggaaagaagggtttattgaatcatcaccagcagggaattgtgacatctgctgcgtacatcctgatttctgtcgtacatgctgttgcattctctgtggcaaggctgttaacaattcctttggaggttatagttacatcaagtgtgaggcagttgtggcagagaactacatctgtgggcatgttgcccaccttgactgtgctctgaggattttcatggctggaactgttggaggaagcattgggttgga

SEQ ID NO: 18901 - DNA, 1081 bp, Triticum aestivum
  unsure (1)..(1081): unsure at all n locations
  Clone ID: PAT_TA_18901
ggagctccttaaagttggggtgatatacgatgatggcgtgaatgatgcccttgacctctacgccattgctgtggacccaagaaatccatatcgtgtggcagtctctggatccgatgagtttgtgcggttatatgacacccgcaagtatctgcatggggatttcggttgcccaattgattacttctgccctccgggtttgatcactaaaaaccaagatggaataaccggtctggcattctcacagaccggcgagatattagcgtcatatagttgtgacaatatctaccttttcgcgtccgagcatgggttgcacttcaacgattttaaggttggcgtattgcccctgtttggtgacggtgtgggtgccgccttacccctttataaagacaagttgcctgaacctcggtctttcgtgggacaccgtaacaagcaaaccgtgtagggagtcaacttccttggtcccaattgtgactatgttgcctctggatcagactgtggccatgtatttatttggagaaagaaggatggggagctcatgcgagcgatgaaaggagataaacggatcgtcaactgtgttgaacagcatccttctgagattgttgttgcaagcagcggcattgctacagacgtcaagatttgggcacctggtgattgtgacccctccatgattgactttgatgaggacgacgcagacacgttcatgttcagcagcatgagcgacgatgactcggacatctcagacttgatggacgattttatctttgcgcccccgggctccggctccggctcctccgatggggatgatgatgttgaggacacggacgacgacgacgacgaggtctttacggtgggatatcagataactgggcaacatcaacctggaaataatcgtggaccatctgcccacttgctggattacctgcatttgaatgtttcgaactttcaattcaagaagctaccaatcgatgggaacaacttctgcaaagcaggaactggaggaaaaccgaccatcatagctatttgtgctatgcagttcagcactttgtccataaattgttgtacctcggccgcgnnnacgcta

SEQ ID NO: 18902 - DNA, 1842 bp, Triticum aestivum
  Clone ID: PAT_TA_18902
aattcgccgcgccggaaagcgaccgcagagccggcccgtctcctctcctcctcgatatatgagcaccagtcctgtgtttcccacgcctaaccagcggtctcctcccttctccccgcggcagccgccggccccgatctgacctgcctcccttcgcctgcctctccgacgcgtgacagccgccggcgccgatctgaccagcctcgcttcgcctgcctcgtacgcgcgccggggaaagggaaagtgaaaaggaaagaggatcaggggaagatgtgctgctgttgcggcggcggcgaccgcgaccacgaccacggtcctcggctccctcatctggcgcagcggctggcccagcccgtgcatctcccgtcgcgcggttcgacgcggggtgccctccgcccacgccccgactgccggccgctcgggttcctgctcggcctgcccttcgcgctcctcgccgtcctcgtctccatcgtcggcgccatcatctggatcatcgggctgcccatctcgtgcatctgcccgtgctgcctgtgcgtgacgctgctgctggaggcggcggtggagctcgtcaaggcgccgctgcacgtcatgacgtggttcacctccaagataccctgctgattccgcggtgaccaggggccgctcgctcgccccctcgctcatggcttagtcgtcgctgcacatgcccgcagattcttgttgttttttcccacctggaaacatatatgttcgcggattgattggtgtatattcgtaccgtggctgatgattcctgctcgtttccccctctggttcgatcgtttctgtgatcccttccggatgtttggtgattgtgactttacttttcgcgactgttagcgactgcatgtagttctgtttccgtcagtttcttcggtgttggttattcacttataaaaaaaaaaaaaaaaaaaaaaaaaaaaaaaaaaaaaaaaaaaagaaaaaaaaaaaaaaaaaaaaaaaaaaagaagagaaaaaaagaaccaaaacgaagccggcctgcttgccaacctctcacgaattttcccccaaaaccctcaatccgcccatctccatctccccggagtcaccccaattgagcctctaccagccattcaaaatgctcatccaactctccagggctacgcgcgctcgctccgccgttgcggctgtttctcgtgtcgccagacccaatgccgtccaggtgaggggcttcattgctcctaccgtctccaggaaagccgattttgttcaggagctttaccttaaggagctcaaggcctacaaggtccccgtcgtcaaggagtccgatgccgagggcaacgtccagactttcagcgtccccaagacccccgcttcccccgaggagaccgacctcgctggcaacctgaaggagtacgagagcatggccgttgagatcgagggtcaggacacctccgctcagtctgccggcgcccccaaggttgccgactggctcgaggctgaggaggatgaggagcctcaccactaagcggtttattttctctctccattaccatatgagggtggctcataaaactatctgtaccgcagcaatttttcgggggtgtctcatttctcaccgcccagctgccgttacttggggatagcaaaaagagggagggctgacactaaaactcagcccggggatgaagagccggaagcgaccaggaaggagctgaagcaagtggattgtggacgagaatcctgtgtacatttttcctaaaatacagccttcggttgcctgtaggaactaattgcgaaatgccaacgttaaatgaagctcaagcaaacttttactattaactaaaaaaaaaaaaaagggcccta

SEQ ID NO: 18903 - DNA, 1302 bp, Triticum aestivum
  Clone ID: PAT_TA_18903
cgtccgctaggttgatatgttatttgtctgcaacttatgtttgtttattagttaatttttagtattattaaatatgtttgtttattcttgtgagtagatttatttgagttatatattccttgtgtttgtcccgctgctcgctgccgccggctctccccccgctggctggcgtggcctgccctggtgctcggttcccgggtcccccggctgggccccgtgcggtggccggccttctccagtacatcccctgcaatctgagaaatgtcttagctgagtatattgaggagtagagagacgaggctaggactctgcagttcaagaaggcggagcctgaacttcttaggtttgaaagcaggacttacccagccacattcaagcaccgagcaaactacagcaagtttgttggtagttcatggtttgacttcacccatgactatggcctgtgtgctggagatctgtgtttacgccggaccatctgacttttgatgtgaagagaccaaacctaccgtgggggtgattccattctccctcggccttacttgaggtatctcgggggtccctccaacttgcgccgtcgcccgtgattttcggttatcgagtgccctcaccacttatttgatgtttttctgtagcttttgaaaacctatccgatgccaattatgagtatgctatttatgttgtattgccgcgcaagttgttgttcaactaccataagaaccgctacttactccattgtcttttgttgggcaatttcctgcggtgtgtgcctttcatccatgtcatgactcccactaacacaatcaagaatatcatgaaaattccaaaaattgttgtgtcaagcttgaagagattcatggatgtccctctaagtgcatctgtcactcttgaatatctggatgaaggtgtgcacgtcatcacgtcatttcatacactttgtgcagacaagatgggaggatgatgttcgagaagacaagtttcaatgagttcatatcagcagcttctttgggtgaagacaatgttgtgctcatcacattcaaagaacgcaatgatcgctcagtttctgttgtgttccagcggctcatgcaggtggagtgttgcgcgtttagagtctgaactttagatcgttgaaacccgaacttttttatgtgtaattatctatgactctatggttagttgtctagatgactgtttgatgatagaggtagtggtgcctctacgtatccaagttcagactttatacttttggatgcaaggattaccgaacggtatatcttttgatggttaatatgtcaagttttaagg

SEQ ID NO: 18904 - DNA, 572 bp, Triticum aestivum
  Clone ID: PAT_TA_18904
cgtccggtgaaatcggaggagccctcccccctccccgcgtcgtcctctctgggcgactcgggggcgaaaccctagccaccgcgtcgaggcctacttctgctcccccctccccccgccgtcgccgggcctggctcgcgcggtggtgggcggcggcggggcgtccccttgcgccatcttctcgggccttggtcctccgatcccctcttctgcagcggcactctcccccgtctctggccacgatggaccttgtcagctgctcctggagtcgcccatccgccggatctggggctggtggtggtccctgaggctgcgacctgctcgatccggcctcctcgccatgggccagggtggcggcactacgcctgcttagactggccgcagctgtcccctagtcgccggatccggtgctcgggcggctgctggcccttgattccggccggatctggtcgatgggatcgccgcagacgctcttatgtttcgcggggtgtgttcggtggctttggaggtgaacctggtggcgtggcggggttgctggctggtggtggatgtgatgcgcctggttggtggatgcc

SEQ ID NO: 18905 - DNA, 2166 bp, Triticum aestivum
  Clone ID: PAT_TA_18905
aacgtttgattacaactatgttcgtgtatctggtgctgctcctcaaaaatgcttttgtggcactgccaaatgccggggttacattggtggagacatatcagggtctggtatcagcatccaacatgttgcagaagcagagcattttgaacccatggtcacttacaaggatgctgaggaaatgctaggaaatgcatgttcgcatggtgcaaatccaagtgttgctgagcttcagcatgaaacctccatccaacaagaagattcaaatagctgcccacctgtaaccccagactctgaacctcaccaaacttcccctatcttatttgatgatagtgagctagaaaattcctgggaaatgtggagcccacaggatgccgaagaccccacccgtacacctgtccatgtgccccgaacaatagatagcactttgcagcagttaccagtacatgacactgagccattagaattgttgccaaaggctcctaacacaatggatggatcaaatgctccaaatgtgaatcaatcagcaggtagctccgatttggggctcaacctggtggtacctggtttccatgctaagaagaaaaacaatctaaaagatcagagagatgtaaaatcatcatcatgttctattaacaatgaaaatacgtctcggagttgaaggaagactgaacaacctactggatcgagatggaggtattagcagacgaaaagattcagcaaatgcatatttgaagcttcttatatttgtgaccgcagcggcacgtgacaatgccgcggccgcagcggcacgtgacaatgccgcggccgcagcagcacatgatgcgaccgcaatggaacatgaaaatgctgcgaccccagcagaacgtgacaatgctgggggcacatctaaaagtgcaagggatctgtcgttaattcttgatgcacttctaaaaacaaaatcacgctcagtcctgttggatatcatcaatacgaatggattgcaaatgcttcataatatattgaagcagaatcgagacacctttcttcgaagacctataatacggaagcttctgaaggtgttggagtttcttgctttgaagggaatcctgagagctgaaaaaataaatgaagaagccccacgtgaggaaatggaaagattcagggactcgatgttgaaattgacccggcatagtgataaacaggtccaaactattgctcggcacttctgtgagaagtggatccatccttatatggatggacctgtttcaacttcaaaatggtgtacagattcatattccaatagaagaaagcgcaagagccgttgggattatcaaccagaatcccactataaaatggttggatcactagttcggaaagtctatggagaattgggtcttcaggctggcttgaccagaaataggtcgcagcctgtgatgggaagcagctcaacaggcacagacgatgatgtgcctcctgggtttgagcctcagcagggtcgttctgtagctccaggattctgccaccctaacttgaatatttcatatgggattcccatcgctcatgttcagcacttgggaaccccagaagttgaaggaggtggcaaccgtggccagaaatggaaagtcgcacctggtgtgccttttattcctttcccacagttgcgacgagggagtccttgtccttctacttcaactcagatgtcctgtcatgacgccatgaggcagaacaacagttcaggacatcgaggaagaggtttcgacagaggtggaagggtgcaaaggaatgggaggaatggggcaagaacgagatatccgtatgatcatcaaggaagaagattcccaagcaatcatcatagatctgaaagatggcagccctggccccgacgaacatgatggtggtccaggatctaggggcagacaatgaatgacccagcccctggcatcaaacatcaattagttgtgtgtatacatgggaattccttcctgttcaccacaagtgtacacaagcaaactgtgttagcttctcattctatgtaacagaagttttccactgattccaacagtagcagaacatgtgctacagataggcaaatgctattactgctttcgttctcaccttcttgatgttcagtgtgagcggcaatcaatcggaggaagaggacgagtacctgcccgggcggccgctcga

SEQ ID NO: 18906 - DNA, 1667 bp, Triticum aestivum
  unsure (1)..(1667): unsure at all n locations
  Clone ID: PAT_TA_18906
ccgcatgccaaacgagggcaaggccgggcctgccgccagtgaggagcgtagggcggccactctactcccgccagggaggtggccgggaagtcggagtcggcgtcgccctgcgccctgccccggccgcgcagcttcagggtgttgtgggtcctccgggacggagaataagtaaatgcctcgaccccgtggagttggtgcgaaggaagggggcgccgatgagcaggcggaggcttgcgcgggcccgccggtgctcgacttgtttggtcgcgcccaaccgaccacaagttggcgggaggccaacgtgagtgctctcctggggatgtggaggtgatgcacacgttggtgcgatctacgcacggactcttggttgtccgttgggtgaagggggactccatttcaagtctctcaccttctctcctcttcaatcccaatgcgattgaaattgtcttttccgcaacgtaatttggattctccagttactgatggaaatgctgttccggactgcggcgaaacaggaagcttccacagggtcttgcaaggtcaagaattgttgatgggctctagggctcagggcgccgcgcgctcccggtcaccagacgtcgcaaagtttcgccctccggatcaccagcggttctctgcaaatgcggggagctacatgccgcagcagagcccggcggagtttccctaccattcctcaggcttcggcgaatccctcgggttcccagaggtcttgcaaggtcaagaaatgtctcgagcacttcgcttctactcccaaggaagtgcttttgacgcccgcgcgcagcacggcccgttcggctacgcgcaacggtcagctgcgccgggtggactgtcgcctgcagctcagggctatgctctcgggcagttcacgccgtcggcggcggcggcggcgaaagtgtcctctccctcctccgtcctgatgttcaaccaggcgacggtcccgcagttcgacttggaaggcagaaccagcggctacagaggcgcgtatggcggccagtgtcctcccggcatagagatggtgagggagacggaggaggcctggccgtgcgcacagcgccggacgccaagcgtgacggggacggggtgccgccggttcgaagaatggataaaggcctcgactccggcgagtgctgacggtggcaggcccaggtcggcggctgccggagacgtcgtcgggcggagcagttgcaggctgtttgggttctccctgactgatcagaaggtgctgggaggagcaggtgagggtgctgccaaggaaggggacgcggatgatgaggcggcggagtgcgccgacccgcgggtgctcgacttgtttgggcgcggccaccctgcccctgctgctctgcatgccatcgtcgccgctcccctggggatgtgatggtgctgctcagctgcgtgcgttgtagacttgcagtatcggacaattcgttttccgttggttgaagacagacgccatctgtaatccctcacctaggctactcttaaattctactctagaatcttctagtacttggcattcacttgcgtggatncttgatgccttttctttttcttccggcaaacctgatgctgcatgctgctgcttatgaatcgtcaccttctgaacatgtacgtgagcgtggaacctgatgataccccctgagttcttc

SEQ ID NO: 18907 - DNA, 449 bp, Triticum aestivum
  unsure (1)..(449): unsure at all n locations
  Clone ID: PAT_TA_18907
gcccaacccaaanatatatgtggacgccactctggagcgcgtgtccaaattaatactcccagcaagagcatcacgtccgctggtcaccgcagcgcggtctggggctatacaattctctggctcctgcttgttgcgattcgcagattctgcaaagaagaggggttgactgtattccggccttccgggagttcgaaaattcttggtttcttgatgtgtatactgctaccttgcaatgacaacgggtggcaagaagggaattctgtgaggctgtgagcacatggttgccagaggtgcgtccgcccccgttctgtagcccggaagatgtggtctccgttgcatgacctttaatgagttgctacgtggtcagctctagcggcgttgcggtctggttcgccgtaaaggagaggatcgggcactggagggtttgcgcatgcaagatgttcgatgtc

SEQ ID NO: 18908 - DNA, 610 bp, Triticum aestivum
  unsure (1)..(610): unsure at all n locations
  Clone ID: PAT_TA_18908
anacccnttcccaaaaccngggaaacaaggnttggntaagccaggngaccccgccgcnnccaaattangatccccggattccctcacccccccccttanntaangaaaantcaacccaatccttcaaaaagaaaattnttggacccagcagcagccaccccaaatccattcggcttcgatccgcggcaattctaatcgaactcctnggagcaatcccggacgcgaatgggggagatangttcgttcgttccgatttcccaancaaaccgggcgggaggcggaggcgccgggagccgagagcaaccgacccggcccaggcggcgtcgctcgacctatccgttcatggcggcggtccaggaggacgacgcgacggccgtggggtggcagtacgttgcgaagagcagcgggccgccgtcgacggcagcgcagccaggagcaccagcagctgcacggccttttggatttggattcggtgctttcagtgttcgtggggacgcatggctgttgttctgataaaacaaacaaaaaggagttacgaatgcacgattgacattatcaacaattgctcatgtacagcttacgcctacacaaacttgagcagtaacggcgc

SEQ ID NO: 18909 - DNA, 741 bp, Triticum aestivum
  Clone ID: PAT_TA_18909
aaaaccaaaatatcccctctttcgtctcccccaagagaaaccctcacccacactctgcatagtgcatacggtacaccaaaccccaatcggcagttgaccaatcccgccggggacgacatggcccgccgcagccgccgccgaccttcctcgccgtccacggtaacgccgcctccgctggaagacgacgatctcctccacgagatccttctccgcctccccccgcagccgccctacatcctgcgcgcctccctcgtatctaagcgctggcgactccttgccaccgaccccaagttcctccgccgcttccgcgtccgccaccggaggcctcctctcctcggcgtcttctcatcagattacaaacggaacatttcgttcagatccactctggacccgccgtaccgcatccctcccgagcgcttctccctgccactcgagccctgggcgatgctcgactgccgacacggacgcgtactcttcgttgagaagaagcggcatcagctcattgtgtgggaccctatcactgaccactgctgcttcgttgccgatccgccgctgttcaagattggggtccttggcggggcagttctctgcgctgccgccgaccagggacacgttcatggcgactgccgctcgagcccttttaaagtggtcgtgctgggctacgccaagcacgatgatcaagaggcgggatgcgttgcaagtgtttactactcggagactggcatatggggcgatctcatt

SEQ ID NO: 18910 - DNA, 1847 bp, Triticum aestivum
  Clone ID: PAT_TA_18910
ccttgtcacccaaccatcccatatccgacccccgccccgcccgaaccgttcgaaccctagctcgccttcgcctccaatctccccacctcgccgtcgccatgggcaagaagcggaagctcgagccgaaatccaccttggcagcaaactcccccgccgctaaggctccagctgccgcaaagatcgccgagccggcagctcctcccccccagcccgaaaccctagccgagtactaccccacttcctcccaaaccgtggcccaggagagcgggtccatcgctgggggcgcggcggtgaagcaggaggtgggcggcgaggaggacgagtgggaggaggtggaagaggaggtggaagaggaggaggaggaggaggaggtcgaggaggaagaacagcagcaggcggaggagggcgacagcgaccccgcctcgatccaggcgctgctggaggtgttccccaaggagcagctcgtcgagctgctccgcgacgccgccgtccgccacggcgacgtgcgcgagtccgtccgccgagcggccgacgcggatccagcccagcggaagatcttcgtccacggcctcggctgggacaccaccgtggacatcctcaccgaggctttccgcccctatggtgagatcgaggatctcaagctcgtctcagaccgtaacacgggcaagtgcaagggctacgggttcatcctcttcagccgcctttctggcgcccgcgcggccctgctggagccccacaagaagatcggcaaccgcactacctcctgccagcttgcttctttgggccctgtcccacctggcggtgcggccaacaatcctatgttggctacagatccagctccggctccagcagccttgatactaccgccagtttctgagtacacacagcggaagatttttgttagcaatgttggcgcagatatcgacccacagaaactgctgcagttcttttcaaagtatggtgaaattgaggagggtcctcttgggctcgacaaggcaaccggaaagcccaagggttttgctctgtttgtttacaggacccttgagagcgccaagaaggcgctccaggagccgcacaagtcatttgagggtgttatgctgcactgccagaaggcaatcgatgggccaaaacccaacaaaggaggaggatatggtgccacaactacaagtgggaggaagggcgctgctggctatggtgctagtagccattctctgcctggtagtgttggtgctggttatgggatggcatctccagcgagcctggcttcaatgcctgggtctgtacctggtggtccagggatgaatcctgcactgggccaggctttaacagctttcttggccacccaagggggagggttgggtctgaataacatccttggagttggtcctaatagttcaggggtgccaaattcagggtcttctggagctcttggtggtggcggtgtacctggaatgcctggcagttatatgggaggctatgggggtggtggcgggtatggtggtccaccgggaggtccaggaagaaattacatgggtcattagatgattctacgtgttcctgcgtcgcacttataaacatgctgttttaggctgcttctcgcaagttgcttactctagcggtcaaagttttcataagaactttgatttcctcaatcctatgttttcaaaattgaacaaatctatgtacaattatttaaattttcgaaaagttactagttgtcttgtgaccctattgtaaaagactttctatcgatttaaagcaccgtggaatttttactgcattttatacaagaattttcagtcattacgagtggcattaaaaaaaaaaaaaaaaacctgcccgggcgg

SEQ ID NO: 18911 - DNA, 582 bp, Triticum aestivum
  Clone ID: PAT_TA_18911
ccagtgatccttccattctactgctgctcattattatcacatgaaggaggtgttcttccgttacaatactcctgacgtgttccatgaaatgtctcgtagctggacgcgtgagatcctttcaagttcactgatgtggttaccactacaacacacgtccctccaaggaccaagggtgggcatgatcttctacaaggttgttgtctgtaactattagtataggatcaactttgcggtgtccacaccgcttcaagtcaagctaatagagataaatgggtatccaattttagaaagcacacttaagaaacatgcgcgcgtgtctttagatcctatggagcattcctaataatgaccatctatttaactaccttggatcattaccattacaaaatgcagcatggcattcataatgtccagttattcataaatgtggcatttacttattctcctggcatgatatttaagcatgttgcatataccaatctgttgatgattcaattattgattctgatgtacaaacatgcaaaaccattgcctgtttggatgatgcacatgagtatgtttttgtcaggtttcggagatgta

SEQ ID NO: 18912 - DNA, 586 bp, Triticum aestivum
  Clone ID: PAT_TA_18912
cgtccgaaaaaagggtgaataaaaaggcgagcgagggggaacgcggcacgagaacccccccctggccctctgcgacggaccccggaattccgccgccgcgccggatcgaggcttgctcgagcagaggtttggcacggttcgagatgagcgccagcatcacggtgacctacaagaggaagcgtggcgcgtcgcgcgcccaggcggctgatgccgccactccggagcctcgtcctgtttctagcggtggggttgccgaccccgaagccccggaagacggggcggacgctgataaagacctgttgaaccgatatgatcatcacacaacagcatctctgcaagtcaatgcaagaaagcgccagagaagaagcacctaagccatgtgcacatgcaacagagaaagaacaaaaggaaatcccattgtgcgaaccattgccacggatggagcgacctgagatttgttctgtcaccactctcccaatagcagaggcgtgtaatgataaattacaatgcaccaatgatgcagttaatcccatccttgctcccagttctgtatgctatctcagacatgctgatgggacaactaatc

SEQ ID NO: 18913 - DNA, 576 bp, Triticum aestivum
  Clone ID: PAT_TA_18913
cgtccgcggacgcgtgggcacacacctagatccagcaaccaccaatggcatcgccgccgccggcgctcccggacgaggcaagatcatcctcctcctccgcctcccacccgacgacccggcctgcctcctccgcgcctccgtcctctgcaagacctggagccacaacgtctcccgccccggattccgccgccgcgcccacgagctccaccgggcaccccccgtgcccggcatcctcctccaggaccggagaaacaagcgcgtcccccgcttcaaccccagcaccgctgcgtccttctccctcgccgtaccagaggttccaccagatggggagaagatgctctagagtctaccactaccagcatggtctatggtctatggacatggacgagtcttgctatgtgaagctcaagagcagactcatcctttgggtgatgttcctaagtttaagagcgcacggaatgaagaatctgcaaagagttcaggtagggccagcaaagttgatgctgggaaccgaaaagacatcaagtagcaatgttgatggtgctctaccttcagagaaatgtgattctgaataat

SEQ ID NO: 18914 - DNA, 1917 bp, Triticum aestivum
  unsure (1)..(1917): unsure at all n locations
  Clone ID: PAT_TA_18914
cggggagctgctgctgccgcccaaggcggcgccgaggcggctgcggcggcggcggtgcggcacgaggggtcggcgcggcggtacgggcggcggaagatcgggaggtccttcttccacacccgctacttcgtgctcgacaacaagctcctcgcatactacaagaagcagcccaaggacaacaacatggtgccacttaagtctcttctagtagatgggaactgcagagtggaggatagagggcttaaaacacatcatggacaaatggtttacgttctgtgtgtctacaacaagaaagaaaaggacaatccaatcacgatgggtgcacgtaatatcgaggaggccctagtgtggaaaaagaagatagagctccttatcgatcagcaacaggacactatgacagctaaaaaccgtaaagcttttgcgtcactggactttgacatggatcttggaggaccgctttcattctctgaccctgatagtggacctgaagacgaagaggaaccccgtcccatgctgcttcgtaggacaactatagggaagggccttcctgattctgtacatgactggaccaaagagcctgatattggtctgtcaaatcagaacgacaccaatcaagctaattctagaaagaactggcggctgcttagatgccagaatgggttgcgctcctgtgccgtacctgggctgggccatccccttgcgaccacccctggcccatctgggagggcggttggtgtcgtggttccctcctgggcagccttgcgcggcctggtaatgagtatggatgtaacaagatatgagtgggattcggcccgccgggatgcgaggtttgttgtaggggttgttcgtcgcactgcctcactttttcttccgcgtctgctcaactgggcctccagggttgtctggccacgagatctttgttatgtacgatattggcggcgcaacgatgatggaagttatgttgtgctgtttcgatctactgaacacccgaactgtggcccccaaccaggatttgcgagggcttctattgaaagtggaggtttcaagatcactcctctcaaacccgtgaatggaagacctcgcactcaagttcaacaccttatgcaaattgatctcaagggatggggtgtgaattacgtcacatcattccagtaccactctgtgctgcagatgctgaactgcgttgctggattgcgcgtatacttttcccaaaatgatgacgttcacacaattccgaggattcctgtgatgaatactatggctagtgtgcccacttttagaaaggatcagaaacatcaaaaggctgactcaaagaccaaacaagcagactcggctaacgaaaattcggatatgatagatgatgagtcagaagatgatgatgactttcaagctcccgaatctagcttggaggaagatggcaatgttgacagtgacgcaaagggctctgatccaatagatttgtcctgcttttcgggcattattcgtcaggatgcaaatgagaaaagccgtaacagttggtcagtacctgatagcaatatcttcaaagtccgtagcaagaacttttcacatgacaaatcaaaggtatctgcaccgaggtaccttatggagcttgtcgcagctgactggtttaaggataccaagcgtatggatcatgttgccaagcgtaaaggatgtgctgctcaggttgctgctgagaaggggatgttcagctttgtagtaaacatacaaattcccgggtcaactcatcacagtttgatcctctacttcgtcacaaaatccttgaaaaaaggatcgctcttgcagcgttttgccgatggcgatgatgatttccggaacagcagactgaagcttatcccatctgttccaaagggatnttggntaatgcgaaaaancgttggaagtacctgcccgggcggn

SEQ ID NO: 18915 - DNA, 839 bp, Triticum aestivum
  unsure (1)..(839): unsure at all n locations
  Clone ID: PAT_TA_18915
cgcgctgccgctgcacctcaccaaatcagacacaggtgtcgcgcgcgcgcgagcatcgcaccgcccagggcccgcagcccgcagcgtctgaagcaagatgtggacgcccgcatcgttccgctgcagccgccgtcgctgggtccagggcagcacctccttcgtgtcgcccgtcaaaccaccgccccggccccggcgccacccgcaacagcccgacgccgtgctgccgcgcccgaacccggcgaggcggcctccattctcccaagcgagcacgccttccatcttatcgtcttccgccgcgacgcctcgccccaagcgagaaggccagccgccgggacgcctcgcccccttcctaggctcgggcggcgcggacgcccgccgcgacacctctccccttccttggctaccgcggcgacgcctcgcccattcctgggctcgggcggcgcggacgccgccggcaagatgcggtggtggaggacaccgcgccctcgctgccgccgagcaaactcggcaacgctgctgcaattctctgtagggagcaagcttgagacctaacttcttccgccgggangcttcgcccangcaagaaggcaaccnccggaagcttcnccctttctaggcnggggggggnngganccgcnggaaaanttttnccttccttgggnaangggggaaccnaacattcttgtcggggnggnaaancccccgnaaatcgttgttgagangccnaangcccggcgcaaggcttcccgcgtggttaggaattaaacccggggaaangaatgnccaggggttttgaaatcacgttttagcanattatagaggngttgtttaaaaaaggt

SEQ ID NO: 18916 - DNA, 999 bp, Triticum aestivum
  Clone ID: PAT_TA_18916
ccacgcgtccgcgatttttggggctttgactaagagtcttgagctaaaaagcttcatttttttagagctccttcctcctccccccgcggctcgagccggggccgagggattcgcaattcgggggagctcgtggcctccaatccgccccgattcctgcgcctgctccagccgatccgcatggatcaatggagttctcatagctctcaaggttaagatcaacagtactgtgcagtgaactcttgttcatttctttggtcctgggcttcttcattcttgctcaagtccagctgtctgttgatccaattccaaggtggagatgagtgtggagtacaatatggatgaagctttgaaagcacgaaatactgcagagagcaagtttcatgcgcgcgacctcaggggcgcacgcaagtacgcggtcaaggcccagaatctctgcccatcacttgagggcatatcccagatggcgtcgactcttgaagttcatcttgcagcggagtccaagattgatggagagagtgactggtaccggatcttgtccctgcccgcctttgcagatgaagaggatgtgaagaagcagtacaggaagctagctctccagctgcaccctgataagaacaagtcagtcggtgctgaggaggcctttaaactgatctctgaggcgtggagtgtgttgtctgatactagtcggaagacaatttatgatcagaagaggtcagatcattctgttgtcaacgtaaccaatggcatgtatacgtatgacaagaaggcgaccaagagagctcgaaagatgctgctgctgccgccgccgccgccgctgctgctgcggctgctgctgaggctactgctcgtcctgctggtgttgatactttctggacatattgcaatcgctgccgtttgcaatatgagtacttaagaatgtatcttaatcataaccctctgtgcccaaactgccatcacgccgtcatggcggaagagactggatttccttgcacggaagca

SEQ ID NO: 18917 - DNA, 1434 bp, Triticum aestivum
  Clone ID: PAT_TA_18917
gccgcacctctccttcctccctccttcctcctcgtcgtcagagccgccgcacctctccttcctcctctccacacccctgccacagcgcacatccctccgatcgtcaggcccaactccccttcccatttctcctcctcccagaaccacatcccgtcgcttaggctccatggtggcggcctgctcgaggtgagcctggtgcaggcgggcagaagcagtggggcggcggatgccggtgggagagtgctggacaggtccgtcattgtctccccactaagacgcatggaagaaggaccaggatctcaccctcatcccttctggatgcacctccccacagatgttgcgccaccgactgcagtagccagggttggcgttggtgatgtctataggtattttcgtcctcgccggtcacaaaattccttaggtttgatcagtataattatcctttgatttctccaatattttccttccggttggcgttggtggtgtcgctaggttatgggatcggatctccattttcaagattcttagctgacaagtatattgtgcggaaaaatctctgctgaatgatgttgtgcacatccaaatccaagcaatgcttttcttcttggactggctgcttgactggaacactagggctcgttgcttcatcaatttcatccacggaacattcgcttaggatatcatccttatcactatctacattagatgcagacaccccgaggatcaacctctggaagttactgagcttctcgacatgatcggggtggatggtcaatggaagcgatatgaaatggaagaccatgataacactaagattatcaggaaaggattcagagctttttcttaatccagattaccacacatgatgcaaaattaacaaccacgagtttgaaatacggataatggtgcttattatgtgctagaaatcaaatatgaaaaggagaagataatgtttgcgaaggagaggggagagacatacaggttgattctgggtaaactttgcttaatttgttggagaaaatgctcgatagatctcatggatggacgaggttgtggcactagttctcggctgcaatatctatcttgatcgataagggcacattagaagcggaagaagaggaaacatttggggtgtgtatggcattgaacattgagtgcttctgtattgtgtacatgcacgaccagttcagtaactagatggccttttcaactgtactggtgctgctagttttcacatgctagcttctttgaaaagtgccaacagtgtgtacaaaattttaagtccatgttgaaagaacagaagtagaagcagagttgatgtattaacggccagtcagggaattcagtctcgatgagcttaactaatgatgtgtgagttgagccttacgtcattttcaaagtaacggaagtacaagagattacttaaaatacaca

SEQ ID NO: 18918 - DNA, 1493 bp, Triticum aestivum
  Clone ID: PAT_TA_18918
gaggaatggggtgcaagtttatctccccggacccattgcgctcggcctcttcgacctggacgatccgacaaccaacagcatcctcaagagcttaggagtagttcccactcagctagcaaagcaggctcttacccgagtcaaaggggagctagcgaaggatggcagagagcctctgggtttgtcttctttcaaattgcgtgataagtctactgctggaaatgggaggactgccattgccaaatactccaataaaaagaaagagaagagcgcactagctcaattttgtatagatttgactatgcgagccagtggagggtttatcgatcctgttattggtcgcacgaaggagattgaaagagtagttcagattatatgccggcgcacaaagaacaatccaattcttttgggtgaagcaggtgttggcaaaactgccattgctgaagggttggctcttaaaattgctaatggagatgtacctatttttcttgtgggaaaacgtatattgtcactagatgttgctttactgatggctggtgcaaaagagaggggtgaattggaagccagggttacaagtttaatacgtgaagtgcgcaaagcagatgatgttattctctttatcgacgaggttcatactcttattgggtctggatttgctggaagagccaataagggagctggtcttgatatcgctaatctgctgaaacctgcacttgctagaggtgaattgcagtgcattgcatctacaactctggatgagcaccgtttgcatttcgaaaaggataaggctttggcccgccgattccagccagtatatgtaaatgagcccagtcaggaggatgctgtgaagatattacttggtctgcgtgaaaaatatgagacttatcacaaatgcaaatacaccttagaaggcatcaatgcggcagtttatttatcagtgaggtatatccctgacaggcatcttcctgacaaggctattgacctaattgatgaggccggtagcagagctcggatggaatcatttaaaaagaagaaggaagagcagtgctctattattttgaagtcaccagatgaatattggcaagagattagagctgtccaggccatgcatgaagtggcactgactaacaggttgaaatattctctaaatgaaaatgaccaagagaatgaggttaatgttgaagtactggatgatagcaagacaagcccgacagcaacaccctcagcttcagctgatgaaccatctgtggttgggttagaggaaattgcaagagtcacatcattgtggtcaggcataccagtccagcagttgactgcagatgaaagaaagcttctagtaggactagacgatgaactcagaaagcgtgtcataggtcaagatgatgctgttgtggctatatcaagagctgtgaagagatcacgcactggcatgagtgatcctgacagacctattgctactctacttttctgtggtccaacaagagttggaaagactg

SEQ ID NO: 18919 - DNA, 572 bp, Triticum aestivum
  unsure (1)..(572): unsure at all n locations
  Clone ID: PAT_TA_18919
cgtccgcagcagccaaaactaatcaggagacagagccgctcgctggcctcgcctcctccgccgcattcctccgccggcagcgacagcacaatccgcttatccccgccggcagcgactccccaacccgtcggtcggtgccgctcgagcccgtaaggccgtaccggcatccacacctgcatggctctccgcgcggcgtcgccgccctgcgccgcgggccgctgcctcccctcctccccgccgcctcgcgtcggcggcaggcaattcttccgacccctcccccccgccgcgcctgcgccgctccggaagtcagcagtttgtaccaaagcaatttcaaacagtgatggcacccctggaacgagcgattctccacatgtggtgtgttttggggaattgctgatcgacttcgtcccaactgttagtggggtgtcactggcagatgcaccagccttcaagaaggctccagggggtgcaccgcccctcgctgctgttgctctcncgtggtcaanacttcatgggaagtgggatgatgaattggtaatcatctaatctaaggnnatactganataaaggtc

SEQ ID NO: 18920 - DNA, 1238 bp, Triticum aestivum
  unsure (1)..(1238): unsure at all n locations
  Clone ID: PAT_TA_18920
agtcactccccacaccggcgcggcgccacctcccccttcctcctcatatggtctcccgccgcgcgccccgcacccaccgctagcgagccgccccactccagcccacccatggccgcggcgtcgctcgcccgcctcttgccgctcctcctctccctcctcctcctcctcctcgccggcgccgcgcggggcaagacggtgaagagagacgtgaaagcgttgaacgagatcaaggcttcactaggctggagagttgtctactcatgggtcggcgatgacccttgtgggcatggtgaccttcccccctggtccggtgtgacatgtactcagcaaggggattacagagttgtcacggaactggaagtctatgctgtgtccatagttggtccattccctacagcggtaacaaacctgctggatttaaaaaaactggatctccacaataataagttgacggggccaattcctccacagattggacggctgagacacctcaagatattgaacctgaggtggaataagcttcaagatgtgctaccgcccgaaattggtgacctaaagaaactcacacacttgtatttgagcttcaataacttcaaaggtgaaattcccgtggagcttgcaaacctaccagaactacgctatctttatctccatgagaaccgctttactgggcggatcccccctgagctcggaactctcaaaaatcttcgtcaccttgatgttggtggcaaccacttgataggcactctgagggatgtcttcagcattgagaatggcttcccctccttgagaaacctatacgttaacaataatcaattggctggagtggtgccagatcagattgcgaatttgaccaaccttgagatcttgcacttgtccaataataggctgattggatcgatatcgccaaagctagttcaaattccaagattgacatatctgtatttggacaataacaacttcattggaaggattcccgaaggattatacaagcatccatttctgaaggagctgtacattgaggggaaccagtttagaccaggaagcagatcaaaaggaatgcacaaggtgcccgagttgcccgaggccgacctctcggtttaaccggagctcataaagtgtgggcctgttgtttattccgcacgacagcagccacctttctacatctccacacgacgcggtcgcgaaatgcacgtgtattttaggacatatatgtanattagtagtaacatcagcta

SEQ ID NO: 18921 - DNA, 543 bp, Triticum aestivum
  unsure (1)..(543): unsure at all n locations
  Clone ID: PAT_TA_18921
cgtccggcgagtggagcgcggcacaagtggtggaggaggaagctacacaccgagcttgcactcccagcgccacgcgtnctccggctcggaggtgccgaactacatggcggccacggaatctgcaaaggcacgtatccgctcccagagcgcgccacggcaacgccctgcaaccccggagcgcgaccggccacagaccgtctataaccccgccggagggagcgccaagaagcggctgtcgttccccgtcccgcaggacccgtacggcgttgggtacgcgcagagcctgcggagcccgagcttcaagagcgcgacggggcggttcacctccgagcagcggtcgaccgtctcgtctctgtcgtgcgcagagagcgtcggcggggaaccagtctccccgtcgtccaccactgacctccgccgctggctccgttgagttgagcccccggcgaggtgttcgttgtaatacctgcgttgctaattttctcgtaatctcctcggagaaaaacgacttctcgtaancaatttttttgcngcaaaaaaaaaaaa

SEQ ID NO: 18922 - DNA, 1721 bp, Triticum aestivum
  unsure (1)..(1721): unsure at all n locations
  Clone ID: PAT_TA_18922
cgtccgcccacgcgtccgggagtncgcgccctctgcgaccggctaacccacatcccttcccctgccgcctcgccgccggccgccggccgccgtctcggtcgaaccgaccggcccaaaggaagaagacgaggcgattcctctccgcgtcgcacccccatggacatactcgagaaaattcgcggaggcggcgacaagccggccgcgatggagacgccccggaggccggagtcgtgggtggagatttcagagtccgtctcgcggctctgcagcttcgacgccggcgggggcggggccgtatctgtaaaacttatccaggatgacaggatggcacatgataagttggttgattctttcttgaacaagttttttccatctggttatccatacagtgtgaatgagggttacctaacatataccaaattccgagcactccagcatttttctagtgctatgctgcatgtgctatcgacccagtctttattatttgctgcaggtctacgacctacccctgcgcaagcaacggctgtaagttggattctaaaagatggaatgcagcacgcaggaaagctcatctgtagcggcatgggggcaagaatggattcagagccaaagagttggaggatatttgctgatgttctctatgattttggtactgccttggacttcatttcaccactgtgtccacaactttttcttgaagtggcaggcttgggaaattttgcgaagggaatggctgtggttgctgccagagcgacaaggctaccaatatattcatcttttgcgaaagaaggcaaccttagtgacttgtttgctaaaggggaagccatctcgacacttttcaatgttatggggataggagctggcattggattatcatctacagtatgttcaacgactcaaggaaagctaatcataggcccgttgctttctgctgtgcatatatggggagtggtgcaagagatgagagcaactcctataaacacacttaatccacaaagaacagcaatggtggtggctgattttatcaagagcggaaaggtttcaagcccagctgagctaagatacagagaagatcttctgttccctaacaggttaatagaagaagcgggaagcgtgaaagtcgggcaaccatttcgcagggttttgagcccacggcgtgtcgaagagctgaggtctattttcccaaacgagaaatttctgctcacccaaaaaagcgacaaggcgtacatggttcttgagcagagcgcaaccggggaggatgcgctgagggggtggctggtcgctgccttcgcttcggagatggagagatcaggcgctggaccacgtgacacggtcctgaacgacgcctatcagaagatggagagcgtgttccccgtgttcgtttcggaagtcaagagcaggggctggtacacaggccagttcttggatggaaatcacagtcggatcgcgtacgcgaaatctgaatgaccgtgctggaggaagagcactatcgaccacgacgcatgcggtgcatcccgcctgcgatttttttcagagttgcagagttcaattttgtttcacgaaaaaaaaggaattgtttgtagaaaaccgttttcttttgtcttccgtcactcatagggtcgccactctatctttctaccttcagtgcagtgtatgtatgacagaaatgagtggatgctttgtcttcagatcttcctgaatcatacacgagatggccaacc

SEQ ID NO: 18923 - DNA, 715 bp, Triticum aestivum
  Clone ID: PAT_TA_18923
ggccagtagtcatatgcttgcctcacgtccgccgcccgtccgcccgcacaaacaagcctgcacattcccccctccctcggagcagcgatggcgcccaaggcggagaagaagccggcggggaagaagcccgcggaggaggagcccgcgacggagaaggccgagaaggcccccgccgggaagaagcccaaggccgagaagcggctgccggcgggcaagaccgcctccaaggagggcggcggcgagaagaggggccggaagaagggcaagaagagcgtggagacctacaagatctacatcttcaaggtgctcaagcaggtgcaccccgacatcggcatctcctccaaggccatgtccatcatgaactccttcatcaacgacatcttcgagaagctcgccggggaggccgccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcttagattcagtctctggcagctgtagttgggtgctgtttacctagaattagcattgctcaatggaaattggtggagtattgtttagttcgtagttggtttggtgatgttaccgtgtcatcatgggactatcgatctaaatactagcaatgatctggtgcatcttttgggc

SEQ ID NO: 18924 - DNA, 995 bp, Triticum aestivum
  Clone ID: PAT_TA_18924
aattcggcacgaggcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcctttcctgcgcagcttaggtggaaggcgaagaaggcccccttccgggggggcccgagccatcagtgagataccactctggaagacctcggattctaaccttgtgtcagacccgcgggccaagggacagtctcaggtagacagtttctatggggcgtaggcctcccaaaaggtaacggaggcgtgcaaaggtttcctcgggccagacggacgtccggaagaacctcgagaggatgatcgcgtccctcaccggcccctctctgctcggcaaggaggacagcgcgtggagcctcgccggagagatgcagcaccttctggtcaaggtcgacagggtgctgaatgccggcggggcagggccttccacctcagttgctgctcatcaccattgatctctcagcttggatcagctctgcctcagctcagctacatggagataagctctccctacctcctagtatagttaagagttagtgatccaggtgctcttgtatattattagctctagtctagttccacctcagctgctgctcatcaccattgatctcagctcagcccagccatgctctggtctggtctgctagatggagataagctcctcctaccccctagtatagttagtttagtcaatgatccagttggtcttcttgtatattatgaactctagtcctgctaggtactgctactgctcgaatcatcgtagctgctagttctcactcggtatgtttcggtgtcgatccatactggctgcagcgacgatcttgcgacgatcgagcttctaatgctcatgtgtaatatatatctacctgctaccaat

SEQ ID NO: 18925 - DNA, 604 bp, Triticum aestivum
  Clone ID: PAT_TA_18925
cgtccgcggacgcgtgggcgaattactctgttgtatccacaactgttcgttgtttcactatgaattgttgcgtattttttatgcaacgattagacgcttgcacacgacgtccattcttattcccgcgatcaataacattggtgtcaacgagttccctctatgtctaatcacgcacggagactgggcgatggaaataagaagaattgcaacttggtaaggaccgtgtggccgtagttgctgggctgcaccaagctcctggatactgggcaaagactgctgattcgcgatatgttgcgatgtgtaagtattattttttgcgggagtgcaagtaatttatatggccgtgtgccagtacagctaaagtcattagctagttgtaagtttttacacgattagattcttacagtaagcgactgtcgtggtcgtttgttttggtttggtgaggtaataagaatgatgtttccagtgatttttttttttttttgtgaagtgttacacagcggggatccggcagtttatgtaacttaatttgtgcaaagcctatgtataatgaaccgattgaatctctattcatgaatgaaagatttcatcttctttaaaaatt

SEQ ID NO: 18926 - DNA, 1211 bp, Triticum aestivum
  Clone ID: PAT_TA_18926
cgtccgcggacgcgtgggcagagaaaccagcattgactgcagatggagatgagtcaagtggattagcagcagacaagggtgagtttctgatgaaagatcagcctcaggcatgtggctcaaaggagttacaatgcaatgctgatcttgctgtagcacaacaatgccagagcccagagtcaggatgttctatcaagacagtaatggtggatggtggagctgatccacatggtgcaccagagagacatgattctgtggcttctcttggtggcctactgcttgatgtgggaatgatcagcaagccttctgaaccttctattggctcacccttatcagcagagggaatgtctggttgtgttgcacatgctgaatcagggttgagtaaagtgggcacaccgtctccattgggttctccttgtttggaacaacaacgcctttctccgaagataccctcccctagcagtggcgctttcagcggcgcctcttttctgaagaagcggcgcttttctccgaagaaactttctccaaagaagggaatacttaagaggcatacaatggggtgcaggggcatctgcatgtgcttggactgcagtgtgtttcgtctacgtgctgatagagcttttgagttctctaggaagcagatgcaagaggcagatgatataatagtgaacttactggaggaggtggcaagtcttaggagtatggcggagaaatcttctggcaaacaggagcagatggaagcttgccagagggcgttgcgggtagaggaggtggccaaggagcgtcggcagcagatgctggccgagctcaactctcactgcaaaattcctggcccaagggtgaaattcgctcagtacgtcgagggaaagatggcctcttctccttccagcagcaggaggcaataaccacatttgcgaagacgccggtgattgattcgctgccggatgtttgtggtagtgctggattttgtgggaattcagcgcagttcagtgcaattgttgtctcatgattagattatgtagagagaggtggaagctctgttggttccactgaaggaagaaggaacaaaagctggttgtgatgtgtctgttcgcatgtaaatcaaagttttttttaaaatcaaagctgtgaaactggaacatgccaatctggtctgtctttgaacttttttccttctgagatattttttcttgggtcgatgaaattcactcatc

SEQ ID NO: 18927 - DNA, 559 bp, Triticum aestivum
  Clone ID: PAT_TA_18927
cgtccggatgaaggtttcgaagagttcctcgaaggcatgttcccatgatctggttatcttagtggctacaaaaagttgttccatgctctttcggggaaaaaggagcacggattttgtaacaaagccattagcagtggagtggcaaatcgttgcaaatccgacccttgatgtgctttgactacaagtcaatgtaggtgtgttatctgtaattatgtgtgcccgtgttgtttcattttcacatggctttccgctttcgtagccgtgagagatgcctgttactctgtcagtcaaagaaaagatgaatgtaactactcgtgggtctactttacttactgttacaccgaaggagtgaaggacaagttgagcaacattgacttgtgtgtatctatatcagtgttgtggctggagaggttggtgatgaacttgtgtatctatatcagctagcctgcctagtttcaagccaaaaaaacagtgatgaacttgatgttacatttgcattatacctcgacaattgaaaataagcaaattgcagctttcagttacttatttcttattaagc

SEQ ID NO: 18928 - DNA, 1582 bp, Triticum aestivum
  unsure (1)..(1582): unsure at all n locations
  Clone ID: PAT_TA_18928
cgtgcgatatccctcatcccacgccgacgagcctccaccgccgccgccacgtgcgagcacgcaccggaggatcggcgcgagctgcccgcagaacccagaggggacccgcttgatttgacgcaggcgcgggcgcgcagccagatggcggcgccctcggggaaggccgcaatggagcggcaccagtcgatcgacgcgcagctgcggctcctcgtccccggcaaggtctccgaggacgacaaactcgtcgagtacgacgccctcctcgtcgaccgcttcctcgacatcctccaggacttgcacggcccccacctccgcgaattcgtgcaggagtgctacgagctctcggcggagtacgaaaccgatcgggacgaggcccggatagccgagctcggggagcaagctcaccagtctgtcccccgctgactccatcgtcgtctccagctcgttctcgcacatgctcaacctcgcaaacctggccgaggaggtgcagatcgcgttccgccgccggagcaagctcaagcggggtgacttcggtgacgaggcatcagcgcccaccgagtctgacatcgaggagacactcaagcggctggtctccgagctcggaaaatcccgtgaggaggtgttcgatgcactcaagaaccagactgtcgatcttgtgttcacagcgcaccccacgcaatccgtcaggaggtccctgctccagaagcacgggaggatccgaaattgcctgaggcagttgtatgcaaaggatatcactgccgatgacaagcaggagctcgatgaggctctgcagagggagattcaagctgccttccgaaccgatgaaatccgcaggacacctcccactcctcaggatgaaatgcgtgccggaatgagttatttccatgaaactatatggaagggtgtaccaaaattcttgcgccgtattgacactgctttgaaaaatattgggattaatgagcgtcttccttacaacgctcctctcattcagttctcctcctggatgggtggtgaccgtgatggaaatccaagggttacaccggaggtcacacgtgatgtttgcttgttagcaaggatgatggctgctaacttgtacttctctcagatagaagatctgatgtttgagctttctatgtggcgctgcagtgatgaacttcgggtccgtgcagatgaactacatcgttcctcaaaaaaatctgcaaagcactatatagagttctggaagcaagttccttcaaatgaaccttatcgtgtcatactcggtgatgtcagggataaattgtattatacgcgcgaacgttctcgccatatattgacaactggagtttctgacattcctgaggagtctacttttactaatgtcgagatgtttctcgagcctcttgagctatgctacagatctttgtgtgcttgtggtgacaaacctatagctgatggaagccttcttgatttcttgcgtcaagtatcaacttttgggcttgctcttgtgaaacttgatatcangcaggaatctgatcgacacactgatgtccttgatactataacaacacatcnttggatcggatcctacgctgaatggtct

SEQ ID NO: 18929 - DNA, 632 bp, Triticum aestivum
  Clone ID: PAT_TA_18929
cgaaggcggagcaacaacgcctgccgcattctcgaggtgaagagggacttcgggtcgttcggcaagtacgtgtgggggttcgtgaaccagaggccgctgtcgccggggtacaaatacagccggaagatcccggtgaagacgtccaagtcggagtccatcagcaaggacatggtccggcgaggcttccggttcgtgggacccaaccgtgctcaaatctcgaatgcacgcagtctacgagatcaacgaccacctcgtctcttgcccgatgggagtagtatgatcctctttccgcgcctgtatgtgagcgtgctcggtcggcccgggtagaccacaaaaatagcaaaaataattatcttctcgaagagacagatgacacgagatagcctcagccctcaactcatgggggtagtatacgaaatccgcgtgtgtatgtgtgctctggtcggcacgcgtagattaactgcgtgccgcccctaattagcttgcttggtaatcactgccagttcagttggtacgtgcgtgcgtgcatgtaatcggcggggtgctgctgctgctgccactgctcggtgtatagtcattttgtgtgattgatcgggttcggatcaaaaaaaaaaaaactagttctctctctc

SEQ ID NO: 18930 - DNA, 1979 bp, Triticum aestivum
  unsure (1)..(1979): unsure at all n locations
  Clone ID: PAT_TA_18930
taccgtccggaattcggtcgaccacgcgtcggacgcgtcgccacgcgtcggaccgccgtccgcttcccgactttacgcgcgcctgccggctcgccccgcccgctgtacctctgcgtcaagggccagctccccggcgaggacctctactcgctcgtctccgtcaccaacgacgaggacctcgagcacctcgtcatcgagtacgaccgcctccacctcttccgcgcccccgccgcgccgggatctggcggttcttcccggggcggctccacgcccaggctccgcgtcttcctcttccccgtcgccccgcccccgcgccccgcatccccgcccaagccgccgcagcaggagctgcagcgcgagtggtacctcgacctcaagtccgccagcccgcctccgctgccgcaggccctgccgccgcagatgcagaaccagcagatgcagcagccgcaggtcatgatgaagcaggaggcggcgcccgtccagtcgccccctcccgcggcgcccatggccgtgccccagtcggtcgtggcggcgtccaagacgggccccgactacctcttcggcttcgactacggcttcatgccgccgccggcggtcaaggtcaaggacccggccggcgagccgcccaagatgagggagaacgtccccgtcgagatcccgcccaaaaatgaagaccgacaccccaaccccgccgccgacaacaacaacaacgccatggtctctcccgccgtctcgcccgccgagttccctcgccagatcccggacctcgacaagctccagctcgccgacaacgccacccagcagcagcagcagccaccaccagctcctgctcctgctccggctccccaggccgcccctgctcctgctccggtcgtcgccccggctgcccctgtcccagcgcccttgtccaggaacggcagcgacgactccctcacccgcgcctaccctccagccaccgccaccccgaccgccgctgcagagtactatgtcaccaagttcccggagaagcccccagtcccgcccccatcatcggctccccctgcggcggccttcctgccggtgccgggcaggtatggatctgttgcccctggctctggcgctgaccctggccctttcttcttcatcccggcgccgccccacggttactacaccagcgccaaccccggcggcacctcctactacgccgtcccgcacaacaacggcaatgccaacgggaacggcaccgcacccgcccccgccgcgtcgagcgctcagggcttcccgcaggtggcgtacgacagcaacggccgcgcggtctactacaccggcctgctcccacagtacccttcggccgtcaacggcggcggcatgtcggcttcctcggcagtgctcggcacggagccgtcgaagccggtggcggtgaagccgaccgtctcgtgatcgatcgccagccagctcaagccgcctacctaaattcagtatgggttaacagagtctgtctgccagccaattttcgttcgttcgttcgttggatcctccaagtcaatatgggttaaatatgtctagttggaattcgttattgtgtctagtaattcacctataattttcgcctttttgtttagaagaagtttttggtttggggttcgttcgttctgtgatatgcaactaggagtgagtgctgctgcttggtgtgcttaagatgtacatacaatcctttgtggacataatggatattatattagctgttgcgaccgacgactccaagacttnggacacacacaaccgcccgggcgatgatggcgatactacttcgggaatttaagcgacacgataccaccaaggcaataacgcgccaacaaccnactaaacaangacaaaccccnatngtcacaannctcaatctggccctcccanacggccggcntccntaggtnaacaaggaaatcgtcanactactaacagtatngtatcgaagtcanacgaaaatttanggattnaat

SEQ ID NO: 18931 - DNA, 632 bp, Triticum aestivum
  Clone ID: PAT_TA_18931
cggggggggggcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatgtacatcatttccattcccaagactggtgagaactacaggcttctgtatgacaccaaggggtcgctttcggcctcacttttgtcagggaacgagggatgcctaagttcaaagcttctggcaagggtcagggtcttgtccaagttttgggcccagaaaggggcaatccccattacccttcaaccaaccctatgaattgggccggacccaatcccggcttaccccaggacccccaacttcatatcaaggggcccaaatggaccaacccattccaagcctttggacg

SEQ ID NO: 18932 - DNA, 881 bp, Triticum aestivum
  unsure (1)..(881): unsure at all n locations
  Clone ID: PAT_TA_18932
aggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacacttggcgtggtggtggatcaagaacagggagaagcataaaggaaccttcgagaccattcacgttgaggatgcccagggcccacagttcgnccaccgtcttgggcatgtattcaccatttgcaagggcaccaagcccatggtgagccttcccagggccaaggtattaagcttaccatcattgaggaccaaggaagcggattgccgttgcccaggctggtgccagagctcgatttttagggcgtaaacc

SEQ ID NO: 18933 - DNA, 836 bp, Triticum aestivum
  unsure (1)..(836): unsure at all n locations
  Clone ID: PAT_TA_18933
gcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaaaggcatccnctacctgaacacctatgatggccgcaccatccgctacccagaccctctcatcaaggccaatgacactatcaagctcgacctggagaccaacaagattgttgacttcatcaagttcgacgtttgtaacgtggtcatggtgactggcgggcgcaacactgggcgtgttggtgtgatcaagaacagggagaagcataggggaacctttgagaccatccacgttgaagatgcccagggccaacccattcgccaccccgcttgggcaatgtattccacctttggcaagggcaaccaagccatggggtgaccctccccaagggccaggggtatcaaactttaccatcat

SEQ ID NO: 18934 - DNA, 864 bp, Triticum aestivum
  Clone ID: PAT_TA_18934
ccggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgactttatcaagttcgacgttggtaacgtggtcatggtgactggcgggcgcaacacttggcgtgttggtgtgatcaagaacagggagaagcttaagggaaccttcgagaaccattcacgttgaggatggccaggggcaccaagttcgcaacccttttggcaatgtattcaccattgggaagggccacaagccattgggtgagctttcccaagggcaaggggttttaagctccccttctttgaggaacccaaggaagcgggatgcc

SEQ ID NO: 18935 - DNA, 837 bp, Triticum aestivum
  unsure (1)..(837): unsure at all n locations
  Clone ID: PAT_TA_18935
gcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctgggttcatggacatcatttccattcccaagactggtgagaactacaggcttctgtatgacaccaagggtcgcttccgccttcactctgtcagggacgaggatgctaagttcaagctctgcaggtcaagtctgtccagnttggccagaagggcatcccatacctcaacacctatgatggccgcaccatccgctacccagacccactcatcagggccaatgacaccatcaagcttgacctggagaccaacaaagattgtgacttcatcaggtttgaccgtcgcaacggggtcatggtgactggtgggcggcacacttgccgtggttgtgggatcaagacccgggaggaacctaaggggaaccttcgagaccattcaacgttggggattgccagggcccaccagttcgcaccccgcttgggccaacgggttcaccatcgggaaggggcacccaaaccgtggtggagcttccccagggccaaggggattaaggctaaccttcattt

SEQ ID NO: 18936 - DNA, 822 bp, Triticum aestivum
  unsure (1)..(822): unsure at all n locations
  Clone ID: PAT_TA_18936
cggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgncacactgggcgtgttggtgtgatcaagaacagggagaagcataagggaacctcgagaccatcccgttgaggatgcccagggcaccagttcgccacccggttggccattgattcaccaattggcaggggaaccaagccatgggtgagcctccccaagggcaaggggtatcaact

SEQ ID NO: 18937 - DNA, 1065 bp, Triticum aestivum
  Clone ID: PAT_TA_18937
ccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtgggcaatgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaagttgcaagatagaaagttcgcaacctctgattttgctacaaaaaaaaaaaaaaaaaaaaaa

SEQ ID NO: 18938 - DNA, 1141 bp, Triticum aestivum
  Clone ID: PAT_TA_18938
cggcaccagccaccgcccgctgggaggggaatagaaatcgtgtatcgtagggttgcgcaaatcgccgcctccagcaaccaatccccaaccctcgagctatctaactatcccgatcccgatcccgatctcctaccatggtgtccgatgccagcaagaagcttgctcgtcaggctcagagcaaggagaagactcttgcaaagatggagcgtggtggtctcgccgagaaggttgtcaatgacaggattcttgttttccgctttacagatgttggcaaactcccaccaccagtgctgcagtttgctgatgtcacatttggttacagtccggataatctcatctacaagaaccttgactttggtgttgaccttgactcgagagttgcactggtcggtcccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcactgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagattttctgtcttttcattctctcggctctttggagatctagacaaccccaaagttttgcctgtatcagaaaagtttccatcatttagcgtgacaagtatgagtactattgtatcgcttaaaacatatcttctctacactattttaccagacgatccgtgtttattttcatatcttttaacattgttgatccatgatggtttgtttt

SEQ ID NO: 18939 - DNA, 1779 bp, Triticum aestivum
  Clone ID: PAT_TA_18939
tacccacgcgtccgccacaagccgccgccaccgcccgctgggaggggaatagaaatcgtgtgtatcgtagggttgcgcgaatcgccgtctccagcaaccaatccccaaccctcgagctatctaactatcccgatcccgatctcctaccatggtgtccgatgccagcaagaagaaagccgcgcagaagaaggccgccgccgccgcaaagaggggagccaagtccagcgccgctgcctcgtcctcgtcggcgtcgtcagcggccgataaggccgccaatggcatagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttactcgtgagattgaggcttctgacatgtctgcgctgcaagctgttatctgttgtgatgaagaaagagtgaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaagggcgctgttcatgaacccgaccatccttttgcttgatgagccaaccaaccatcttgatctcgaggcttgtgtctggctggaagagaaattaaagaattttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaagagaagactcttgcaaagatggagcgtggtggtcttgctgagaaggttgtcaatgacaggattcttgtattccgctttacagatgttggcaaactcccaccaccagtgctgcagtttgctgatgtcacatttggttacactccggataatctcatctacaagaaccttgacttcggtgttgaccttgactcgagagttgcactggtcggtcccaatggggctggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagattctgttgcttgatgagccgacaaatcatcttgacattgagaccattgactcacttgctgaggcactgaaggaagggac

SEQ ID NO: 18940 - DNA, 2114 bp, Triticum aestivum
  Clone ID: PAT_TA_18940
cggcacgaggccacaagccgccgccgaccgctcgctgggaggggaatagaaatcgtgtatcgtagggttgcgcaaatcgccgcctccagcaaccaatccccaaccctcgagctatctaactatcccgatcccgatctcctaccatggtgtccgatgccagcaagaagaaagccgcgcagaagaaggccgccgccgccgccaagaggggagccaagtccagcgccgctgcctcgtcctcgtcggcgtcgtcggcggccgataaggccgccaatggcatagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttacgcgtgagattgaggcttctgacatgtctgcgctgcaagctgttatctgttgtgatgaagaaagagtgaagttggaaaaggaagctgaaattctggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaagggcgctgttcatgaacccgaccatccttttgcttgatgagccaaccaaccatcttgatctcgaggcttgtgtctggctggaagagaaattaaagaattttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcccgatttggtcatggatctgcgaagcttgctcgtcaggctcagagcaaagagaagactcttgcaaagatggagcgtggtggtcttgctgagaaggttgtcaatgacaggattcttgttttccgctttacagatgttggcaaactcccaccaccagtgctgcagtttgctgatgtgacatttggttacactccggataatctcatctacaagaaccttgacttcggtgttgaccttgactcgagagttgcactggtcggtccccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcgattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcactgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagatttcctgtcttttccttctcggctctttggagatctagacaacccaaagtttttgcctgtatcagaaaagtttccatcatttagcgtgacaagtatgagtattattgtatcacttaaaacatatcttctccacactattttataaccagacgatccgtgtttaatttcatatcttttaacattgttgatc

SEQ ID NO: 18941 - DNA, 2221 bp, Triticum aestivum
  Clone ID: PAT_TA_18941
tcgacccacgcgtccgcacaagccgccgccaccgcccgctgggaggggaatagaaatcgtgtatcgtagggttgcgcaaatcgccgcctccagcaaccaatccccaaccctcgagctatctaactatcccgatcccgatcccgatctcctaccatggtgtccgatgccagcaagaagaaagccgcgcagaagaaggccgccgccgccgccaagaggggagccaagtccagcgccgctgcctcgtcctcgtcggcgtcgtcagcggccgataaggccgccaatggcgtagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttactcgtgagattgaggcttctgacatgtctgcgctgcaagctgttatctgttgtgatgaagaaagagtgaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggtttggcgtatgaggattgcattggcaagggcgctgttcatgaacccgaccatccttttgcttgatgagccaaccaaccatcttgatcttgaggcttgtgtctggctggaagagaaattaaagaactttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaggagaagactcttgcaaagatggagcgtggtggtctcgctgagaaggttgtcaatgacaggattcttgttttccgctttacagatgttggcaaactcccaccaccagtgctgcagtttgctgatgtcacatttggttacagtccggataatctcatctacaagaaccttgactttggtgttgaccttgactcgagagttgcactggtcggtcccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcattgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagatttcctgtcttttccttctctcggctctttggagatctagacaacccaaagttttgcctctgtatcagaaaagcttccatcatttagcgcgacaagtacaagtactattgtatcacttaaaacatatcttctctacgctattttataaccagacgatccgtatttaatttcatatctttaacattgttgatccatgatggtttgttttgctctgtggttctagatttgaagattatcattttataaggtgatgagatgtagacatatttcattcaattgttatgttc

SEQ ID NO: 18942 - DNA, 1324 bp, Triticum aestivum
  unsure (1)..(1324): unsure at all n locations
  Clone ID: PAT_TA_18942
ctgtgcggcgctcgaggcggccgttcgggcctcttctttgtatcccggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttcgagaccatccacgttgaggatgcccagggccaccagttcgccacccgtctgggcaatgtattcaccattggcaagggcaccaagccatgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagaactatgttcctggaaccatcgtttttaagttttgcctgatgtttgttgatttgcgaactcgtggttgcctctagatgtaatgtggatgtttatcttattaagtgctatttcgagacctcatccggttatcttaaatgttatctgataaaatgctctctgtttaaagttggaagatgtttgcaacctccaaaaaaaaaggggggccggtaccaatcgccctatatgatctattaccgcgctcactggcgtcntttaaactctgactgggaaaaccngcgttaccaactaacgctncagannccccttccaacngcgtatacaanagccgcacgatgcctcaa

SEQ ID NO: 18943 - DNA, 1362 bp, Triticum aestivum
  Clone ID: PAT_TA_18943
tcgcggccgcgtcgaccggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaaggggtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaagaacagggagaagcataagggaaccttcgagaccatccacgttgaggatgcgcagggccaccagtttgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggcgttgagtcgttttgctatagccagttatcttcaaggatatagacctatgttcctggaaccgtcgtttttaagttttgcctgatgtttgttgatttgcgaactcgtggttgctgctagatgtaatgtggatgtttaccttattaagtgctatttcgagacctcatctggttatctaatatgtttcagataaaggttaggcattatctgaaaaattgctttatcttcaaagtttgaagatggaaagtttgcaacctctaaaaaaaaaaaaaaaaaaaaaaaaaaaaaaactcgag

SEQ ID NO: 18944 - DNA, 1237 bp, Triticum aestivum
  Clone ID: PAT_TA_18944
ctcgaaattaaccctcactaaagggaacaaaagctggagctccaccgcggtggcggccgctctagaactagtggatcccccgggctgcaggaattcggcacgagggcggcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggtgttgagtcgttttgctatagccagttatctgcaaggatatagacctatgttcctggaaccatcgtttttaagttttgcctgatgtttgttgatttgcgaactcgtggttgctgctagatgtaatgtggatgtttaccttattaagcgctatttcgagacctcatccggttaccttaaatgtttgagatctaagttagccattatctgataaaagctctcttcaaagttaagtttgcaac

SEQ ID NO: 18945 - DNA, 1027 bp, Triticum aestivum
  Clone ID: PAT_TA_18945
cgtccgcggacgcgtgggttcaagtacgcccccaagagccctgcctccgcccctccctcccttccaagttccgccgacccaccgccgactccggcgccgccggcgacccgccgctggacccatccgccccgccccgacaaccagagtttgttgatgcgcaggtcaattgttcccgacctcttgccagaataattgtagcagcagttgagaagcagaggttaaagtggttgtgcatgtgtttctgaagcaaactgaagtaagttgagatatcgggatgtatgattggaagaatcaacaaaccttgaaatattactactgctagaactgctctaagatcaggaagatgatggaccctttggggttgttccctgcctcatcaagccagctgccagatgatctgctcatcgagatatttctctgcctcccagcacaccccacctgcctgattcgcacgtccctagtctgcaagcgatggcactgcctcatcaaaaaccgccaattcgtcagccgctttcgcacacttcatcagaaactccctgtgctttgcttcttcagcaactccactagcatcccccgttttatccccacaggggaccctcctaattgtgtctcaacggcaagccttctccctacctgacccctgctggcaggtccttggctgccgccacagccttgtcctcctcgttagctcaacttggactcaagctccaggtatggaaccccatgactggcaacaggcaatatgtaccggctactccggatgctgatcggcgttttaatcatggcattgttcctgagagccaagctacagtgctttgtgcagctggccacaaggacagtggtgactgccactcttgcccttttctcgtagtgtgggtattcacttgcacacgctatgcctatgcctgtagatactcgtcagagagtagcagctggcaccaagatggtttcttcaccaacaccatctgatattgattcaaggcctagtgtccttgttgggaacatcttgtactggccgctgaagtca

SEQ ID NO: 18946 - DNA, 1006 bp, Triticum aestivum
  unsure (1)..(1006): unsure at all n locations
  Clone ID: PAT_TA_18946
ccaccaatggccctctcctcgcgcgccgccgctttcccgcacgtctccctcccctccccccgcccgcgccccgccgccgggggtgacgtctccgacgtctccgcgctcctgggggagatggactgcgtcggcctccgccccgggtttagcctcgtcgagaaggccgtcgcgctctactgggaccgcagcgagagggcgcgcgctgttgagttcgtcagggacgtgctcaggagggggagcgtggccgcgggaggggagtacgacggcgagcgtggaggccccgtcggttacctcgcctggaagattatgatggacggggactacagagatgctgttaaattggtcattgaattcaaagagagtggactgaaacctgaagtctatagttatcttattgggttgactgccttggttaaagagcaaaaggaattctcaaaggcattgcgtaaattgaatctgtcagtgaaggatggctcaattgccaaactggatactgagagcatgcacaacatcgagaagtatcaatccaaattattaggggatggtgttcttttatcaaattgggcagttcaggaaggcagcagtgaggttctaggacttgtgcatgagaggctcctttcattgtacacttgtgctggttgtggcttagaagctgagcgccaactttgggaattgaagcttgttggtagggaacctgatacacagctctatgatgttgtcttggccatttgtgcttctcaagggggaagctgctgctgttagacgattgcttgcaagagtcgagtcaaccaagtgcangaagaaggaagaagtctaatgtcatgggctccngccaanggctacccttaaaagggtggtttccnatctgggatgcctcnggaaaacactttttgccgggatgccttgatatggggcnttatccnccctgaattacccttggacnagaaccggctgtnctgaactgcncttgcaanaaaaaacaataaaaggnatcctnggcaaccta

SEQ ID NO: 18947 - DNA, 796 bp, Triticum aestivum
  Clone ID: PAT_TA_18947
cgcttcgcccccccctcccccgaaactgtgcacgcctccgcggagctccgagcagtcggaggcaggcagcgatggcctcgccggcggtggcgatgcggcgcccgtcccccaccgtcctcgcctccgcccctcgccgccgtccccgccgtcacgagtattcaccttccaacatgggctccccaagctcggcttcacggttaaaagttactgcactttttgggtggatcaagggagatagatattcgaggactcgtgaattgatcccttctgctgaatcgtacactctcacagggtcagcctcagaggtggacatgaagccacgtgaggtatcgatttctgttgtctcttctatcatggacatacctccggcagagtgggatgcatgtgcagttgattcagttgagcctgaaaagtttaatccttttcttacacatgcatttctctcaagcttagaggaatcaggttctgcagtgaaggaaacagggtggttacctctgcatgttgttgcacgggacgagaaccaaaatattttaggtgttgttccgctttaccttaaaagccattctaggggtgagtttgtattcgatcagtcatgggctgaagcttaccacagctatggacttgaatactatccaaagttgcagtcttgtgtcccttttactccagtaactggtcaaagaatattacttcgggatacatcctaccgggatcaaggttttgatgctttagtaaaagctttgaagaatttggctaccaagttgaatgtgtcatcactgcatataacttttccatctga

SEQ ID NO: 18948 - DNA, 1056 bp, Triticum aestivum
  unsure (1)..(1056): unsure at all n locations
  Clone ID: PAT_TA_18948
agcgtatcacaagatgggtgtgggatgcatacagatggtggagtgtcttgtcctcaccttactccctgatggaataggacagacaaaccttgagggcatggactactacaacaatttgatagacgagctgatactacattgcctcacccaacacctcccctagcgagttgccacccagccccttcctccatggctcacctactctccctccacccccgaggtcctcccctgcaagtccacgttggagtgccgtctttcgcagcagagcggatgaccagggacacgagtccctgctggagcgctccttctcaaccagcaatcatgatcttgagaggctcgctgtcaagactaaaggtcttcccctggctcccgcccttcctccgatgtcatccactttgaagacactgacgcaccccatcaggtcatggagcaagcatgggaaaaaagggacttgcatcccgctgtcgtgcaagccctgcttcccgctggcgcccatctccacgttagtttgatctgggctctgccctgctcgtgcaacccatcgtcgccggcagccgctgtggcctcgtgcctagcgctctctgtgcgcaacgcctaggccattcactgcctccacacaaggccgtttgacgacgcaatgctcaagcagttcacccttaccaccacaagtcgttaacctccgccacacggggccgtgcgacaatgcagcgatcaggccattcacctctgccaccgccctgcacctcgacgtcgagcatggccctcccgtgagagatcggagagataaggcgctcctaccaccttcttccccgtggatccagctcctgttccccgtcgacagcaggagacacgaggtcgcctccggcgctgctggtggcgtgaaggcgtcaaaggggatatatttggccactgcctcgtcaagtacaacaacacgctccacangccgtcaagggnaagattgcatgcaaggcacctctgctcctccccatcgggcgggattcctccctctctcccgctcgttgnttgtgaggagtgaagaatatgagggagtggagg

SEQ ID NO: 18949 - DNA, 889 bp, Triticum aestivum
  Clone ID: PAT_TA_18949
ccttaatccaagggtttgtgaagatgtggcaagaaaagctggactgctaccagactcagtgtgaagcaatatcggaggcgaaaaacctggattcggctatctccggcgggatcagtcgggatctagcgatggagcttgaagtggacttggttaaatggattgtaaatttctgctcttgggtaaatgcgcaaaggagcttcgtgaaggcactgaacggatggctggcactgtgtctcaactatcagcaggaggagacgcccgacggagctcctccttattctcctggaagggtgggtgcgcctcttgtgtttgtcatctgcaacacctggtctcaagccatggatcggatttccgagaaggaagtggttaccgccatgcaagcccttgtctccagcgtacgcaaccagtgcgggcacagagcctctgttgagcaaagcgagctgatcttcgtaacccgggaaagagaaaagtggaacaggattctggggaggaagtccgtggagattaacagggaggcagacacactgaacaagaagctggcccttgtgccaggccggcagagcctgcttccaacggcgcaaacgtaccaggcgcattttcttgaagcagacaggctgcacgtaagcttgagccgggtgcttcagtccttggagagcttcgcgtgcagctccctgcaagctttccgggagaccctgatacatgccgaagaagaaatgctgtccagagagagtgctaaagtttcatagcccggttttgcatctgacagacactagagccaacaaacaaagcttgtggaatataatcatcatctcctcatcaggtggcatcggggctgaatgtgctgggcaaatgcttctgacagattttaggtttgggggagaaattctga

SEQ ID NO: 18950 - DNA, 1576 bp, Triticum aestivum
  Clone ID: PAT_TA_18950
gatagcaccattttgtcccaactttttcttccaccaatatctaaacatccgtcaggtgttaaaaacatccaaggcggggccagcactgcggtgctactatatatatatgtccatcacaaggcttagaaagagttgctagcattttccagttgctgtccacaaaaaccaggtttgtgacatttgtgccgacagcagcaaaattgtgtttcccaagttcgaagggaaacacacgccacgatggccaaaaccaggtccatattttaaagcttgcttgggaactgcggtgctagttactatatcaagtcatgacgctgattggtaatataactcgactttgcgatgatatatcgagcaacaggcagggcagaagtcagatcctgaggtcttcgatgtctgacagaagggtggccccgcctgccgatctttcgtcgggcaggctaaccaccaactgcccacaagcaccggctatgtcttgacccatctcctggcgaacggtggttctgatgctgtagatgcctctcaggaccttctgaaacttcttgatgctctggtcactgcttgtcttgaacgtgcttgctgagccaattggattgattggtatcaggttaacaaccgctttaaaattttcaagtagtttaccaagcttgtgggcatgctcctcctgatcgttcactccatcaagcatattgtactcattgaatattgtctgcttgctcgcgttttgtatgcgattgtaatgcatccattagcttttcgtaaggaatgccccgtgcagcgggccgtttgtgacgccgtctgtcgcgttccggagcgtgaggtcccgtgcagcaggctttatttggcaacgtatgtcttggtcaggagcatgcaatgacacagctaaatttatatttggaagatcattgttgaacttgttgatcgagtggataatcccaacagtagattcggtttgcttcaaccgaaagcagtatagttgtttaatggctcccccattcccatgaaaacaatgtttcgaatttgagaataacgggttgcatggaccagctgctcaacaatttctccagaggaaaggttgcttttgaatcccattgttccggtagcacagaatctacagcccatcttgcacccaacctgtgacgatacacacagggttgaacgcactcctccagggcgtgtcttcccatcatacttccccagtcgtgaatcataccgcatgatcactgcttctacagattctccattctggaggcggatgagcagcttggtggtggtgcggtccttggattcggcggcggcggtgagggtcgaggtggtcggccggaacttgttccgcaggagcgcgtacgcggccgccgagagcgacgggacgccgtcgaggtcgctgcacctagggttctgcagcacgtacttccagatggtagggatgaaggtgggggagatgccggcggcgtcgaactccgcgcggatgtaggcggcgtcgaacacggagcggcgcgccggcggcgacgaggacgacgacgccattgggaatcgggagcggagcggagggggtggggagaggggaggcggggaaggc

SEQ ID NO: 18951 - DNA, 517 bp, Triticum aestivum
  Clone ID: PAT_TA_18951
cgtccgcccacgcgtccgcccacgcgtccgctcatccacagaccacgccgtgcgccacgccgcctccccccaaaaacctttcgaaaaccgccgcgccaaccgccacccagcccgcccctcaccacccccccccccccccccccacgccgccggacaagatggtgcggctgagcaacaccatgatcgggatcctgaacgcagtcaccttcctcctctcggtgcccatcctggcggggggcatctggctgcgggcccgcgccgacggcaccgagtgcgagcggtacctggcggcgccggtgatcgtcctgggggtcttcctcatgctcgtctccgtcgcggggctcgtcggcgcctgctgccgcgtgacctgcctcctctggttctacctcgtcgccatgttcctgctcatcgtcgtcctcctcggcatcaccgtcttcgccttcgtcgtcacgcacaaggacaccggcgaggccgtctccggccgcgggtttcaggagtaccggctcggggactactc

SEQ ID NO: 18952 - DNA, 1611 bp, Triticum aestivum
  Clone ID: PAT_TA_18952
ccacaccctccgccacgcccccttccccaaaaacctttcgaaaaccgccgcgccccccgccgccccccccccgcccccgtccgagaacccccgcgccgacccccgccccccccccccctcgccccgctgacccccaccatgatcgggcgcctgagcgccagctcctgccgccgcgcggcgccgtgcccggcagccggcacccggccgcccgcccccgcccggggccccgcctgccagggggcatctggcggcgggcccgcgccgacggcaccgagtgcgagccttgcctgccgggggcggcgtgcgggcggcgggtcttcctcatcctggctccccttgcgccacgccccctcccccaaaaacctttcgaaaaccgccgcgccaaccgccacccacgccccgtccacagaaaccgcacgccaccgcggacgcgaccccccgccggcgccaagatggtgcggctaagcaacacggtgatcgggatcctgaacgcggtgaccttcctgctctcggtgcccatcctggcgggcggcatctggctgcgggcgcgcgccgacggcaccgagtgcgagcgctacctggcggcgccggtgatcgcggtgggggttgttcctcatgctcggtctccatcgcggggcctcgtcggcgccgtgctgccgcgtcacctgcctccttctggaattctaccctcgtccgccactgttccctgctcaatcgtcgctccgtcctcgggctcaggccgtcttcagccttcctcgtcacgcacaaggggcaccggggaaggccggccccgccgccggcagtcaacgagcacaggctcggggactactccaactggctgcagaaggccggtggagaacgacaacaactggaacaggatcaagtgcttccgccttgcacgccaaagcctgcaagtcgctcgaggactgggcggtcgaacgaatcaagtcctgccgtctcccccccgtccacggcgggctgcttcaaaacctccaatcagcggcggcttaccccacgattagcagcgcgcattggtccacctcttcctcgtcgacggggcccgaattcggtctgtgttcgagcgatggggccctctgatacggctgccagtcgtgcaaggccggcgtggtggccaccctcaagcgcaattggaagcgctccgccatcatcaacatcgtcttcctcgtcttcatcatcattgtctactccgtcggctgctgcgccttcaggaacaaccgccgcgaccaccgcaacggcggcgggtacaagcagcagggcgcgtacgcctgatcgtttggctcggttatttattgcttggattggatggatgcgatcgtcgtgtcattttcattcatcgtcgtgcttctcttaggatggcctgatctagctttgtacaggcgagattattctgtgctctgatcatctactagttaggttctatactccgtggtcatgaggagggttgtgtatatatcttttctgttctttgatatgtatggcagaccattatatatgtaacagattattctggagttatttatttcatattaaaattccactatagttcctcgcgccgcttgcggcacgagctcgtgccgaattcggcacgag

SEQ ID NO: 18953 - DNA, 1063 bp, Triticum aestivum
  unsure (1)..(1063): unsure at all n locations
  Clone ID: PAT_TA_18953
cgtccgccaacatcgtcaatctaaatagatgaatgatggagagagggtacttttgggcttttctagaagatgctcttaagttaactgttcattgctgcttgtttgtaatgtgttctttgaaatctaatcgatccatatttgtgatgttttttaggtgtgtgctcatgcctaggtttgtgttctcaacttgagtatatggtgcccaaattgtgatggatatcaaggagtgaccacggtgcttgctttgctcatcccctcgggcctcatgcgttaactcgaggatggcgccgatggatcggccaactccgtcctggccgacagcaagggcgaatgctggtttccgaggtggttctcccagtcaatgaggtggtatggagcagcaaaccatggacgatttggaggctgcttaggcatgaagcagtgaaacatgctcctctgccatgctttttttctccgaagaggagcagcaggtaaggagcacaacccttcatgcatcatgctccatggtgcagcagccagaacaggcgaccacagctatgccagggttacggacgatggcaggagcgagcagtggcaagtgttttctcatttccaatatgtttaatgttcagttcatacgaacgtcctggaccacctttggaaaaaccacagccttcactaccccagcaaagcatggatgtgccatagaaatggtgtcatccatcaggaccttaaactagagaacttacacgcaaataagaagagttctcctctaaaggcaattgattttgggctatctgtgttcttcaggactggtattctctggaacatacctttgcaccttacaaattgtttttgatggttgtgaangaaactgaacagatatacaagagcatgagctctttgtcaggggctacctttancttgtgtggcctctggctggaggagtccttttaggtactacttccttactgatttcaaccaagaacaaaaactccattcgtttctatcagtaggatatcatgtttaatctacataactttttattcagtgtatttgcagacccattgcgaggtattaccta

SEQ ID NO: 18954 - DNA, 570 bp, Triticum aestivum
  Clone ID: PAT_TA_18954
cgtccggggccgcgtgggggagaaggaaacccatcttcgcgagatcccgtcgggcgccgacggggccggcgcggcgatggtgcggccggcgggcctcctcgacccggcgacgaggcggcgcccgttcctcgaccagcgccgcccgtccttccggcgccgctggcagcagcgcccgctctgggcccgcctcctgctctcgctcctcctcgccctcgcctgcgccctcctcctcctcggcctcgccggctcccccgacccctcctccccgccctccaccgacgcctcctcctccggatccgccgacgccgacgccgatgccgtctcctcccctctcctccgccagagatcttacctcgaggttatcacggacacgcagaacatgacggacgaaatgatgagcgctcactcgctttcccgccagctcatggaccagatttccctcgcaaagacctacatcacggtcgcgaaagaagccagcaacctgcagttcgtggcggagcttggtgcgctggtgcggcgggagcagagcatcctcgcgcgtgctgcggcccatggtggaatggtagtcaa

SEQ ID NO: 18955 - DNA, 1474 bp, Triticum aestivum
  unsure (1)..(1474): unsure at all n locations
  Clone ID: PAT_TA_18955
ggcatggcttcccctcgtgcgcttgatatatctgatgaaagcgaacaacctgctgaggcatccgtgttaggccgaagttgggtgcacagtatgttcagtagggacagaagcttaagagctagctccttcaatcgagccagtgatacaaaggctggtgctactgcaggcaaaacagacctagctgctgcgcagaagaaaactcaaacaaatatgaggatccttagaggacacacagctgccattactgcgcttcattgtgtcacaagaaaagaggtgtgggaccttgttggtgatcgtgaagatgctggatttttcatcagtggaagcacggattgcacggtaaaagtttgggatccaagtttgcgtggttccgaacttcgagcaacacttagagggcataccaggacagttcgggctattagttcagatcgtggcaaaatagtttctggaggtgatgatcaatctgtcatagtctgggataagcaagcttttaagcttctggaagaactgaagggccatgatgcaccggtcacttctgtgcggatgctctcaggagaacgtgttcttactgcatctcatgatggtacggtgaagatgtgggatgtccggactgatacttgtgttgctaccgtgggtcgttgtcaaagtgcagttctctgtatggaatacgatgactcgactggaattctggcagctgctgggagagatgtggtggcgcatgtctgggatattcgttcaagtaagcagatgttcaagcttcaagggcatacaaagtggataagatcaatgaggatgactggggaaacgataataactgggagtgatgattggacagctagggtgtggtctcttacacggggaacatgtgatgctgtattagcatgccatgctggtcccatactttgtgtagaatactcaccttcggataaaggaattatcactggttcctctgacgggcttatacgtttttgggaaaacgaaggaggcataaaatgtgttaagaatctgacgcttcactcggcatcggttctgtccattagtgctggtgatcactggcttggaattggtgctgctgacaattctatgtctcttttccatcgaccacaagaacgattcggaagtttctcaaatgcaggatcaaaagttgcaggatggcagctttatagaactccccagaaaacgtctgcagtggtgagatgtatagcatcggacctggataggaaaagaatatgcagtggtggccggaatggacttcttcggctgtgggatgctaccacaagtatctaagacattactaggatatatatgttcatgtaaagaaatgtcaattgccctgtgatgttgtatgtcattttctgtttttggtcgtcttgtagaaataagacagaaactctatttgttccatccattatgtaatctcaaaagctgttttgatgncctcgtgnaaattttgtctataattttaaggtgtagg

SEQ ID NO: 18956 - DNA, 1296 bp, Triticum aestivum
  Clone ID: PAT_TA_18956
ttctccgcggccgacggggtcgcctccaaggacctccacatcgaccccaactcggcgctctccctccgcatcttcctccccacgccgccgccgcaccacccgcacctcctccacccgcgccgcgccagcgaccccgccgccggccaggcgggcgcgccctaccggggctacctcccgcacgccgtctcctccccgcgggccgccgcctccgcgcgccgcaggctgcccatcgtcgtgcagttccacggcggcggcttcgtcaccgggagcaactgctccgcctccaacgacgccttctgcaggcgggtcgccaagttctgcgacgccatcgtcgtcgccgtcggctacaggctcgcgcccgagagccgctaccccgccgcctttgatgacggggtcagggtgcttaggtggatcgccaagcaggccaatctcgccatgatgagcaaggttgggggcggggtggacacgttcggtgcttccaccgtcgagccctggatcgctgcgcatggtgatccggcaagatgtgtcctacttggtgtaagctgtggtgccaacattgctgattttgtcactaggaaagcggtggaagatgcaaagcaatttgagccagtcaaggccgttgcacaggtcgggacgagtcccttcttcacaggaagtgttccaacacactcggaaataaggcttgcgaactcatacttctacgacaaatccacatgcttacttgcctggagactacttttatcagagaaagagttcagcttggaccatcctgctgccaaccccctggcccctggcagaggaggccccccattgaaatgcatgcccccaaccttgacaatcgttgcggaacacgactgctggggagacagagcaatttgccttactccgaggaactccgcaaggtaaatgtggatgcgccagtcctggactacaaagatacagtccatgagttcgcaacactcgatgtgttcctcaagacaccacaggctcaggcctgtgcccgaagatattgccatatggatgaagaaatacatatcccctgagagggcacgagttctcgtattagctgtagcaaaagatcagcattgtgaaatagagtctttacgggaagcatcggtgcattctttttcacctggtgatgggaggcactgcaagttaaaaggcgaggaaccagttaggcgtaatgtgagtgctgagtacctttcccctttattgatgatccttgtggaagaatgtagtgtgcaaattgtagactgaactcaaagacagatgctcttccgcctcgtagagctcaaa

SEQ ID NO: 18957 - DNA, 808 bp, Triticum aestivum
  Clone ID: PAT_TA_18957
agccggccgggccggggtctccacctacgaatcacaggacgctcatttctctcgtttcgtttcctcttcaatcgcttgacccgcacccaccaccgcaccgcaccaatcgccgacccgcgcgcacccggccagcgttactagctagcgtgacgtatatgagatccccatccggcgcccgtcccagcagcggagggggcgcagcagcagacgacgacttcgccttctactactctttcttccaggacgccgccgccgcgtcgccgctcccgctcgcgctcgacggagccgccatgcctaacaaccgccggaggaagcgcggaggggacgacgactccgccgcggcgcccatcaaggacggtagcaacaacggaaggaagcgctccatcgccaccataataacttcgctcgccgcgctcgaggccgaggaccacgccgacagcgcgggggccgccgacgcctcccgccgcgagctcgcgctcctcgagtccaacgccgacaacaagtcgcaggccatgatggactacttcgccaagatggagggcagctttgatggccgacgccgactccgcggccgctgccgcgctccaagcggcgcgctctcggcgtcggcagcggcagtggccgtcgtggctgggcaggaggccgccccgaatacggccgcgtcggcctcgccgccgcgtgcaggtcaccaccaacgtcggctgtgggtcacaagatgggtcgcagcttcgatgcgcaacagccccgacttcccggacgcagagtttcgcgcgcctccaagcgctcgcggctctcggcgtcggcagcg

SEQ ID NO: 18958 - DNA, 1386 bp, Triticum aestivum
  Clone ID: PAT_TA_18958
cccccggcgcgtgcggcttttgagagagtaatgcatgaattccgctgtgcgacatattccatggagtgcccacaggtgtcaagagagacggttgcgaacatattactggcccatgctggaagaggtgggagcagtgggatgactgaggcagctgctgagatagcacgcgcagctgcacgatcatggcttgctcctcttactgaaactgcttgtgatcggcttgcatttgtcctgcaaagcctatttgaccttgcaatggagcgcagccgcactgatgattcaagatatcaaaatgttgaaaatatggatggatatgttggcttccttgctgctctccggtgctcctattataagtttgtcaaggatttgtccaagcaatgcaagcagatagtacgacatcaccttgattcagtcacgagcccctactcccatatttgttatgagagcgactttcttggcggcgttggaactgtagcaaacacccttcacaggtttaatcagttcagtggagttgcatcttttgacctatcagaccgtggatcactggaggaaggccaggagaatctaccaccaagagatcagcaacagatgactccacctgctaaagcaaatgagagggaaattctgaaagaaagccagctgacggttcctgagacgccttctcctgatctgccagctgatatacatggcggtaagaagaaagacaacgggaatatgaatgatggtggggcaaggaaaagacatgcaaggatggcagcatatgcaaacaggggtcaccataacaatgtgactgttggtggtgatgatctggtctcaaggtcagggtcatcgtactccagcatatgttccatatctgctcagtactttgccaaaatgcgagaagtcctgattgaaaggaatgttccctctgcattgaattctggattcttaacaccatgccgtgaaaggttgtttttagcgcttggattcgagctgtttgctgtaaatgatgagaagttcatggacatgtttgtgtctcccggcgcgattgattgtatccagaatgagcgccagtctctgctgaagcgtcaaaagattctgctgtcctgtttaagcgagttcaagaacatctcacggactctgtaaggaagatgtttctggcgcttcttccactggcatgtatttcatgagcttcagggtattcccctacaatacaacacagttattgaaggttgttttattgttgttgcacatcctcctgagcctccatgcttctgtaccttaatgcaggctgttcgttgtattctctgtgtgtcaaattccttattgacaatttgtgtgctactacttggcatttgttgaagatgtatgttttatccctatcagatattggggctatatacaact

SEQ ID NO: 18959 - DNA, 1067 bp, Triticum aestivum
  Clone ID: PAT_TA_18959
ccagcgtgaggataagtgcgcatctattctgaatctccctcaagttttgctgtgcatccttaggtgtagctaggctctcttctgattctcccccaagttttgctgttctttatctcatgaccacgatgatcgcagctagctccatagtgaaagccaaccttccttgctcgtcaaggatatcctcctgctcagacttctcatctggtcattcgtggcgcccattagaggctgcaaaacattaccgggcgcatggtgtgcgctcgctgcgggtaacatgtgctgccactaagactgcgaaatctccagctgaagaagaatggaagatcaaacggcaattcctagtagagaagcgggtacgtagtgttgatgtgaaggaagcactgcgccttcaaaacgaaaacaactttgtaattctcgatgtcagaccagaagcagagttcaaacaggctcacccacctggtgctgttaatgtacaaatatacagattaataaaggagtggacagcatgggatattgcaaggagggcagcatttgctttctttggcatatttgcaggaacagaagagaatccagagtttataaaaagtgttgaagaaaaacttaataaagattcaaagataattgtagcatgttcagctggaggaacaatgaagccaacacagaatctacctgatgggaagcaatctaggtctctgatagcggtcgtacctgctggtcctaaacggctacaagaacgtgttccatttggacggaggactctacacatggttcaaggaagacctaccttctgaaggagaagaagattgagcaggaaatgacctgtcagttattagttgctacgatattgttgttgttcatacgacagcagtttgcgatgagttgtaatgatgcgcgttacggataaaattgtccgcactagttttgagaaaatctcatatccttcccatctttactttttgctggtatgaaggtgcgctagatttctctcggatgtcgaacttacgctcagtgttgtttgaattgagctgctgtttttggcgaaattcatgtgaatcccatgcatccct

SEQ ID NO: 18960 - DNA, 499 bp, Triticum aestivum
  Clone ID: PAT_TA_18960
cgtccgcttgttgccagaccatttcagactcaccatactgtacccagccagggctacgtcatatactctgttagaagaaagttgaaaaaacaatatgcccatttgaagggaagtcaaatagtaaaattaaagcaatcaggctctgagattacagataccatactgtacccagaagttgcctttaccggagatacaacatctgattttattcttgacccacggaatgcggatgccttgagagcaaaggttcttataaccgaggcaaccttcctagatgaccaagttgatgttgatcatgctcgagagcatggccacatgcatctgtctgggataatggagcattcccaatggtttagaaatgaggcaattatactcactcatttctcaaatcgatatagtcttgaggatattcggaaagctgtttccaggctacagccaaagttaatttcgaaggttgttgctctgacagaaggcttcaaatctgaatatagctaagtgt

SEQ ID NO: 18961 - DNA, 585 bp, Triticum aestivum
  Clone ID: PAT_TA_18961
gtccgaggccacgacggggtcccttgccggcgggcgtgacacgtcggaggtgggcaggggctccctaatcgtcgccggcgggggcccgggggcggcgttctgggggtccgtgtacccgaccgacgtggtgaggagcaagctccaggtggacgacttcaagaacccaaagtactcgggctccatggacgcgttcaagaagatcctcgccgccgacggggccaggggtctgtacagggggttcgggccggccatggcgcgcagcgttccggccaacggcgcctgcttcctcgcgtacgaggtgaccaggtccctgctctaggcgacctgcaggctgctggtcattcttgacttcgttcttgttcctccaccctgatggttcagttatcgtcgtcgggacagtcctctgtctctgtaacagaaaaccaagccatgtgtgtgaatcgaacgaaatttgcatttgcattttctttctttctttctgcagtccttcaaggtcatcagtaaaccaagccatgtgtgtcaatcgaacgaaatttgcattcctttccttttaaaaaaaaaaggatcgaccggctccgcacttca

SEQ ID NO: 18962 - DNA, 890 bp, Triticum aestivum
  unsure (1)..(890): unsure at all n locations
  Clone ID: PAT_TA_18962
tagcgtggtcgcggccgaggtctccgctcctcctctccccctttatagccgctgcgcggcgtttgatcctccatcgccaacgcaccagcacaaccgatcgctgatctcagatcacctgcttctctccttgctccgtttggtctgctctgatcggcatggcgacccagatggacgcgtacgtgatgttccgccgcgccgcggagatgatgatggtggcgccgcccagggccgcctacgacgagcaggacgaggacatcggctccgcgtccgactccgagtgcacgtcggaacgtcctcctcctccgacctcgccgacgacgccagctcctcgtcctcctcctccagctccggtgaccacttcgagatgtccgccctcatgacgcagctccccatcaagaggggattgtccatgttcttcgacggcaagtcgcagtcgttcgcgtcgctggcggccgtggcctccctggaggacctggccaagccgaccaagaagcgcctcaagccgtcgcggagctgcgagggcggcctggacgcgcaccgtggcaggttcctctcgccgcgccggcattgtcccaaggccgccgccgcagaagtaaggcgtccgcgagggccgccctctccgtgctcggcacctcgccaaggacggcgaggctggccgccaactccctcatctttagctaggttctgttccactgttaggtgtccgtgttcttcccagagggaggggtatttggagcccccaatggtgattccatccgccttccgcccaaggggaaacaaccaaattnanaaatttnaaccnaaaatttggttttcaaaaacaattcaaaggncaaagtnaaatgnaacntggncaatccttaaaaanangaatggaatnnaaccncaan

SEQ ID NO: 18963 - DNA, 1124 bp, Triticum aestivum
  Clone ID: PAT_TA_18963
gcccgggcgggcgcaccgactcagcaacgaacccaacccaatatcggcagcccttgactcatctcctctgcgccctatctaatcctcccgcgtccgcagcgcaacacacatctcatctccgccgcatctagtcctccaccatccgacgcgcaggagagagggggacagccaccatcgatccgcgggactcacagttcagcccaatccaagcagccggccagccagatccgacctccgcccgccgccatgagcttcctcttcggcaagcggaagaccccagctgagctgctgcgggagaacaagcggatgctagataagtctattagggagatcgaaagggagaggcagggcctccagactcaggagaagaagctcatcgctgagatcaagaaggtccccaagcaaggacagatgggagctggaaaagttaatgccaagaagctcattctcacaaggcatcagattacgaatttttgagccttgaagtccagttacacggtgtatcaattcgtgtacagaccctgaaatcaacacaagcaatggatgaagccataggggcgtcacaaaagacaccacacaaatgaacaggacgatgaatctaccagcgatgaagaagataatgcgggactttgagatgcaagatgagaaggtggaaatgttcgacgaggtaagaggtgatgccatcgacgaagccttggaaggggttgtggaggaggaggaaacagaagggctagtgagccaggtcctcgacgaaatcggcatcgacatcaactctgagcttgtcaagactccggctaccgcaggtcgccgatgccggttgcagcgggaaaggcgcgtggtcatgctggaggtgcgggcgggatggcctgtgcgaacagacgatgacttggaggcacggcttgataaccgtgatgaagaggtgagccttcacggatagttcacgcccgcgcgattctttgcagatttgccacacctgcatacctctccggctattcttttgacatatcattgccagtgcgtttggtatttagacttatcatatagactgatcttcatattttccataagtaaataaacaaatcatcatatttcaataaatcacatactccccccgtcctaaaaaa

SEQ ID NO: 18964 - DNA, 1392 bp, Triticum aestivum
  unsure (1)..(1392): unsure at all n locations
  Clone ID: PAT_TA_18964
cgtccgggggaggggcacactgagctggattcatttggatgagagtgagcgggatgacctcgcggctttcttatctgcaggccctcctcaacatcaagataaagttgtcacaatcccatctgctggcgatattcaggtgggcagcaacccgacaagggtgaggaaaaatatttcagctgacagctccaatgattcatctggctctgcagacttgagttcagcgagagcaaaagaagatgcacatcgtgggcacaggaggtcagtcagtgccagtgctgatattggatcgtcgcctatgtcatttccaaatgaacgagacggtgctgctgaacaatcatctcttggcccacacagagcacctttgctgaatattgtcaaagcgtgcggattgccgagtgccttgaaacctaagcctgcagttaagtacaaaaaaggagctgtggacccacgcgtccgcagacaaacaggatcttgaagcggcaatccctctcacaaatcctcagttgggtcagggcttagatggatactctgaaagaagcatcggttacttaaatacttgcgatggggttacatacaataagaaactctatggttggcttggagcactgcgtaagaaacttcagagatcacaatatcaaattcgatatgggcggcctgctcaattgattgtatttgcacttgctgttctcataatatttgtgtttgtattcaagacaatatggtgagaaatttgcatgggctcgtgattgggttagaaaagccccaccagatcagcataaattgcatgtggacaggagtgaccatgcacatatgggaagttgggaaccatggcagactgtttctggtaatccacattgaaacaaatgaagaatgattgtggagcaattcaccacgctacgtctgtaactcagtggctttgccattggatatgcactggacggtggacggtctgtgcggcatggtgtatctcaagatctcagttctcacagtgaccagttggcttgtgcttaatggtatgccctgaacttcaaattagggtcatgctgcactagtggtgatgcaggtgcagctagcaacaggaatgcgactgggagtgccgactggtgattgtgctatcgcctatggggccttacttgagacttgagaaggcttccctttggttattttattgaacctgtgataattggttccagatacaaatagagatttgttctcaagtgctgtagaagaggctggaatagttgtaccgggatctgcttgaactgtaataatacctaaacaacagagttagaggctcggaaaaaaaaaaaaaaaaaaaaaaaaaaaaaaaaaaaaaaaaaaaaaaaaaaaaaaaaaaaaaaaaaaaaaaaaaaaaaaaaaccccnngggggg

SEQ ID NO: 18965 - DNA, 2341 bp, Triticum aestivum
  Clone ID: PAT_TA_18965
cccactccatctccttactcccccgcgtgtcggaccggtctttccgctaaatcccgcttatccccccgtctttcctcgcccgtacagcccccggaaccaagatcgatccttcctcgaggcccagtcgccggattggagcatgaggctccgatccgcgccgccggcgacgccgcggcttgctgctggtgctggccgtgctcctgtacggcttctgctgctgctgcgaggggagattcgtcgtggagaagaacagcctcaaggtcacggcgccggactctcttaagggcagctacgagtgcgccattggcaacttcggcgtgccgcagtacgggggcacggcaggtcggcgtcgtcgctacccctaagtccaacccgaaggcctgcaagagctttgacgacttcgacatctcctactgggccaagaccgggtccttgcccaccttcttgctagtcgaccgcggagattgcttcttcacaaagaaggcatggaatgctcagatcgcaggagtggcggcaattctggttgctgatgacaaggaggagcctctaattacaatggatactcctgaagagagcggaagggctgattatttatagaacatcaccataccatcagcgctgataacaaacagcttttgggacagactctcagctgcagtctttggcgtttacattaggagtagagatgccaaaccatgtcatgtgtgcttcttttaactactagcttctccaatacgagttctggaccaacagtaacgatgaatgtggtcccaaatgcgacagccagattgatttcgttaagagctttaaaggaccagcacagatacttgagaaaaagggatacacacagtttactcctcattacattacctggtattgcccggaggccttcacactaagcaagcagtgcaaatcccagtgtatcaaccatggaaggtactgtgcacctgacccggaacaggatttcagcaaagggtatgacgggaaagacgtggtggttcaaaatttgcgacaagtctgtgtttataaagttgctaaggagaacaagaaaccttggttgtggtgggactacgtgaccgattttgcaatccgctgcccaatgaaggaaaagaagtataccaaggaatgtgctgatggagttatcaagtcacttggacttgatcacaaagcaatagataagtgtattggtgatccaaatgctgatgaagaaaatcatgtgctgaaagctgaacaggatgctcagattggcaaaggcgctcgtggcgatgtcactatattaccaacattggtcattaataatagacaatacagagggaaacttgacaaaggggcagttcttaaagcactttgtgcaggtttccaagaaactactgagcctgccgtttgcttgagtgaagatatacaaacaaacgagtgcttggagaacaatggtggctgttggcatgataaggctgctaacatatctgcatgcaaggatactttccgtggtagagtttgcgaatgtccggttgtgaaaggggtaaaatttgttggtgatggctacactcactgtgaagcttcaggatctggtcgctgtgagattaacaatggtggatgttggaaagagaccaggaatggccggacacactctgcctgcactgatggtggctgtaaatgtccagatgggttcaaaggtgatggtgttcacaaatgtgaagatgttgatgagtgcaaggaaaggactgcatgccagtgcaaggaatgcaaatgcaataacacgtggggaagctacgagtgtgggtgcggtggtggctttctgtacatgaaggagcatgatacgtgcataagcaaagatgcaggagcacgggtaggctggaatttcctatggtttctattgtttggcctggcagcagtaggaatcgcaggatacgcagtgtacaagtacaggatccggagctacatggattcagagatccgcgctatcatggcgcagtacatgcccctggacaaccaaggagagatccccaaccattctcaccatattgagatgtgaagagcagcagcacagtcggtatgttttagcttattggaaggatgattagaggaagagaagaacacttgtcttgcatatgttgtgtgtatcgtactcggtcagaccatcctgtaaattcgttggtagatcaaactggaagagaaacacttgccttgaatggtgtgatcagctctttcttttctgttttttaatcggaggagagatggcaaaccaaaaaaaaaaaaaaaaaacatgtcatgtgtgcttcttttaactactaggttctcctttttacccatggtgatgattatactaaattagagatttgtt

SEQ ID NO: 18966 - DNA, 505 bp, Triticum aestivum
  Clone ID: PAT_TA_18966
cgtccgaagatatcaatgagaactctgattgctcggctggcgcgtcggcgtttagacttcggcggcaggggcaggtttgtgcccagccaggtccccccgtggcggttagagatgttcggccacattgtatccttcaacaacggcagtgccacggtccaggtgccacagtcagggcctggagcatgaggagagcacaagtgaatgtgaaagggatggagtgatgatggttaacaaaccagagcaactctaattgacctatgattggaggaccggatcaatcattctgatcacttgtttagcacacttcactattttgaaagaacaaattactcccattcatgagcacttctagtaggtagaaataaatggaaattcaacagggaagaattagctgctcatttccttgacctctaggattcaatttcatgtattatagtctaccggtacttggtcactaagaaggaaaaaatgtcgctgttttaaagtagtagtagttggcaattgg

SEQ ID NO: 18967 - DNA, 1759 bp, Triticum aestivum
  Clone ID: PAT_TA_18967
cgtccgcccacgcgtgcgcggacgcgtgggctactaaatacatatggaatcgtggatgaacaaagtttgcaagcagtagtgtaccagtctgtgcattgctcggctcgcgggcgtcccgcctggtggccttcgccgagagctgcagccacgttcttcaggggggcccttggatctccggctggtgcaggggccctgcctctgcattttgtctcctcttcacgtcctcgacccctacacctgcacggccccccatgcatccgttgtggaaccatcctcgcaccccaaccatgcgtggacttggatgacttgctattgctggggtccccccactgcattctgcctcctctccgagttcttccccttgaagttttttgtcatactgttccatcttctgtcgatgcaaccggactccgcatacactagggctttatgatttttgtatcttcggtatgttgcagatccaaagatcctatggacatggtatgagccctacttgaaggatgatgaggaattctcccctggatctaatggtcgcatgacaaccatgggtgtatatgtgcgtgatcttatacttggacagaaactatgccaactagctggacaaatttcttagtcagtactactttgatagtatccttccaagagttcctgttccagtagttcgtcaagtaacagccaatcttgagaagatgaagctgcctaccaagctttttggggtgactggagactcgactcgtcacggatcagaagacactgcccgccgccccccttccgttaaggcttctctgtcagtttcttttggacggcgcgcgccgctccgtgcctccactccggtgtctgcccccgtccggcggtccctctcccaggaggtcctccggtgaccaccttcaccatttcgtcgcagtgtaagtcgggaggggccttacaatgaccgttcaagtcacgaccgagaaggtaaccgttcaagccgtgaccgagatactgaccgttcaagccgtgatcgagatactgaccattcaagccgtgaccgagatactggccgttcaagccgtcaccgagagcgtgatcgttcaagccatgacagaaagcgtgattatgaccgtgacagcagggattgtgactattacaggtccaggcattcagaagaaagaagggattaccgaagcgagcgtgacaatagtagacacagacgctccagctcatgtcataggagcagaagccggagtcgtagcaggagcaggagccggagtcggagcaggaatgagcatcgatctagtccatttggggatacaagcaaagaaaaggctgctgctgcctcgagcaacctagctaagctgaaagacctgtacggcgacgtaactgagaagaaggatgacagtgatgccaggtggcttcaccatgattcatgtgccgaggaggttatcaggttgggaggccctaggtggagataaatttgaaccgccgactctgtcatcaaggtcatgttactccaccgtttgatctaccggcttctgcattggcattagtgagagtttagtctttgtaaacacttgtactttatgttggttcatcaatccatgtctttcggacgtgcagtcagtctaccaaattcatcaacacaacgttatcatgttaggctgaatgtttgacgtgtaccaactgggttacatgatgtctggcactagagcaaaaatgaagaatgcaatgatacatctctttcatttgaagaaagaatcatacaaaaaaaaaaaaaaaaaaa

SEQ ID NO: 18968 - DNA, 861 bp, Triticum aestivum
  Clone ID: PAT_TA_18968
cggagctccgcacgcggcggcctccgtccggttcccccaaatccctagcgaggctctgtgctgcattcggcgcaatgggacggaaggagatcatggagctcggcatcggcgggccgaaggagatcctggacctcgtcagcggcaagccgacggagatcattggcctcggcagcggcaagctccaggactatcccttggtgaggcggctccgcaaccggcggctcctcacctacctctggctccagggcttcgacgccgcctacgacagcgttgtgcatgagtcgggtgtgcagatgagcaggctacatctgcggcagctgctgatccggggccagtggagagaggccatcaagtacataacgcgcgtcatgccgcgggccgttgaccagggcgtcgagacccgtgacgtggacactgtcctctgcgcgctctggttcctggctaacggagccggcagcccagcgggcggcttcgctgaccgatcggtgtgcagcatcctgcgctattacgttaccgacttgaggagactcgcaagtctcctagccagaattacgcacgtttgcaactgtgcttccaagtgctcgctgtcctgcggtacgttgttagtggatcgggaatcggacctaaaccaggtcatgctgcagtggtgtcctgtcttcggccgcgtctgccctttccccggccatttggagatctgatagatatacattaaaaacaaatgttctcctggtgaacgtttgataggccatgttgttaactcattctgttttaacattattttttgaggtacggtctgttttgatgtgggtgtggatgatgagttgcaaaagtaaagtccaaaaaaaaaaaaaaaaaaaaaaa

SEQ ID NO: 18969 - DNA, 1537 bp, Triticum aestivum
  unsure (1)..(1537): unsure at all n locations
  Clone ID: PAT_TA_18969
attgngtattacnttgacaaacaaaantccaatccccaaaaatgattgcagttaacaagccaaccagtgatccccccttctgcatgtaaaagaggggacggcaaaagaatgatgttcaacccaatgatttttcacaaactttacaccaacacgatatcgcacaacacaagagcacctgtcggtcaaacgagcccgtaagaactgcggcgggaggccatgaacagaaaaacatcgagatcccccggccacgacaacagatgaaacaagccaggccaaatcgcgtgccacgttttccttttcctttccatttcttttcttttcaaggatatgaaaggcgcagagaggtgttgctgtgctctagctatgtacacatcttccaaggtcttcacacgagcgggatggggctggggcaatggctggcttcaggagatggtatgaagaaggacgacgtcagggagctggagatctgcgccttcaccccttgctcctgggacagctcgtggatgtctctgacaatgtcgaacacagcttccggctgggccaatttcaacgcgttctccgacatcctcttgcgttcctccgcgcctggaccgaaccagcgggcgacaagttcggccgtttccttagggctcttggagaacacgcccgcgccgttgtccacgacataagggacgttgccaacttcctgtccaggtatgaagtcattaaggatgataggaagacccctaatcaaggcttcagcaatggtgcctggtccagcctttgttataatgcaatcacaagcccccatccatttctccatttgggtctcgaatcctctaatctttattggcattttccattcaagagcctgcaatgaggagctcagtgttttgttccgaccacaaatgacaacaagctgtccgattggttttccgagctctttgtcaaacaatgcatctccaagggnantttgcggtcttctttacaggacccatgccctctccacctcccatcagcaacactgccggtaggtcaggatccaattcaagttccttccgcaaatcatccttaacaagaacagcacggcagaatgatggtcgtccgggaagaccgaacacacggatctgagaactttttaggtcatccagttctgccctcttggctacttcctctgatgggcagtaacacctattcacatcagcatggaaccatgtaggatggcaagtgttgaggtcagtgatgacagtggcgaagactactctgttctgcagaccttgccatttgagtacccatagaggaatgtgttgcattagggggtgaacactaattattatgtctggcttgtacttcttcaatccagcctcaaccttcttggcgtanaaggaggcgagggcggcgaggtagaagttgtggacccatcggggcgatgtgccgtggaaggccaccttccagagctgcacgtgcctcaccatgaacttgtaagagctctccatgttgttgagcggccaagccgcgtggtccttgcacaggtncttgacaacacccggtagtcgtc

SEQ ID NO: 18970 - DNA, 689 bp, Triticum aestivum
  Clone ID: PAT_TA_18970
caaggatcatgcctcgagctctactgatgctattatggctgaagcggaacttacctaaatgctcctgctgatgttgacgcagatctactgaaggatgatgatgatgctcagctactacagcaagcactcgctatgtcaatggatgagggtgcttcaggatctgcagctgtggctgatgctgctatggcagaagctgctgcagatgaccaggatttggcattggctcttcaaatgtctgtccaggacgcagaggtggctggtcaatctgatatgagcaaagtgtttgaggacaggtcatttgtgacatccatccttaattcgcttcctggtgttgaccccaatgacccatctgtgaaagatctactggcttctttgcatggccaaggagaggaggagaagaaagataaggaggacaagccagacaagcctgaagatgggaagaactaaagttccctttgttgcttcatgcgcatgaagaagtgaggaagattgcttacattagctgcttttacactcgggctatgaatttacttaatcctcttgtaactgcgttgataactcaaatgccgatagaatttgtattatgtttgctctcatgaacgctcctccatgtttgtcttaagtgattacatgttgcaaattcatttgtacgctttctgttgaatgtgaaactgactacattgacagct

SEQ ID NO: 18971 - DNA, 730 bp, Triticum aestivum
  unsure (1)..(730): unsure at all n locations
  Clone ID: PAT_TA_18971
taggnaatcaattcagccgtcagcgtgtggccgacgcagacctctgctcttcacccccagcccacccccctccctctcccccaccccacccacagcctgactctcgcaacacacctaccacgcgcagcgcgcagagcgagatcgagatggcgacggagctgacggcggcgcagctgcgggcgtacgacggcaccgacgcgtccaagccgatctacgtcgccatccgcggcaaggtcttcgacgtctcggccgggcgcggcttctacgggcccggcggcgactacgcgctcttcgccggccgcgaggccgcccgcgcgctcgccaagatgtccaaggacgccgccgacgtctccggcgacctctccggcctctccgacaaggagctcggcgtgctcgccgactgggagtccaagttccaggccaagtaccccgtcgtcgcccgcctcgccgcctgatgtgaagtcaatcgggccaccggcacccctcttccgtcctcagctactatcgtatcctcctgtgaccagcagctccaccgtgtgtgtctgtatcttgttgctccctgcgtatgaccgtcaaataataatctgagggcgtgtttgctggcggcaattggtgaactgaaataatagtgctgtggtctgttgttaagatcaatggagcaactgatgattgatccttataatttccacattgtttcagctttgaaaaaaaaaaaaaaaaaaggccccta

SEQ ID NO: 18972 - DNA, 1521 bp, Triticum aestivum
  Clone ID: PAT_TA_18972
cgtccgccgaaatggggccacctgagggacctgcacaaggccatcaagcaggccgagccggcgctcgtctccggcgatcccaccgtccagcgcatcggcaactacgagaaggcgtacgtgttcaagtcgatggccggcaagggcgtgcgcgtgcttgtcactcccacccagcgacctcggcaagatcctcgcctgtatgcacgggctggaagttggagctgaagcaaacttggccgcagctattcaggttgctcagctggcgctaaagcatcgccagaataagaggcaacagcagagaattattgttttcattggaagccctgtgacatacgacaagaaggttttggagacaatagggaagaagctgaagaagaataatgttgcccttgacgttgttgattttggtgaaactgatgatgaaaagcccgagaaactggaagcgctgatcgctgctgtgaacagcagtgatagcagccacatcgtccatgtccctccgggtgatcatgccctttctgatgttcttataagcactcctatctttactggtgaagaaggaagtggctttgctgcttctgcagcagctgctgcagccaccggagctactggatatgattttggcgtggacccaaatgtggatccagagttggcacttgccctacggttgtctatggaggaagaacgagctaggcaagaggctatcgcgaaaaaggctgcagaagacaacaaggatcaggcctcaagctctaccgatgctattatggctgaagcggaacttaccttaaatgctcctgctgatgttgacgcagatctactcaaggatgatgatgatgctcagctactacagcaagcacttgctatgtcaatggatgagggtgcttcaggagctgcagccgtggctgatgctgctatggcagaagctgctgcagatgaccaggatttggcattggctcttcaaatgtctgtccaggacgctgaggcggctggtcaatctgatatgagcaaagtgtttgaagacagatcatttgtgacatccatccttaattcgcttcctggtgttgaccccaatgacccatctgtgaaagatctactggcatctttgcatggccaaggagagcaggaggagaagaaagataaggaggacaagccagacatttctgaagatgggaagaactgaaggcaatgaacatctattttctcggaaaagtgcaggcgcatgaagtgaagaagattgcctgcattagctgcttttacactcgggctctatgaatttacttaatcctcttgtaactgcgttgatgataactgccgagagaacttgtattatgtctgctctcacgaatgctccttcatgtttgtcttaagtgattacatgttgcaaattcatttgtacactttatgtctgttgaaggtgaaattgaacacattgacagcttgtagctaaaaaaaaaaaaaagggcggccccgccgcgagggtcgtgtacaacggccggcggtacgacctcccggcctggtccatcagca

SEQ ID NO: 18973 - DNA, 2017 bp, Triticum aestivum
  Clone ID: PAT_TA_18973
tcggaacccggccccgccgcccgcccccccgtgccccacgccgccccccccccccccccaccggcccgctcgccaccccgaacccaaccctcgaccgcagcgactcacagcggcgccaaccatggtgctcgagtcgacgatgatctgcatagacaactcggagtggatgcggaacggcgactactcgccgtcccgcttccaggcgcaggccgacgccgtcaacctcatctgcggcgccaagaacccagtcgaacccggagaatacggtgggcgtcatgacgatggccggcaagggcgtgcgcgtgcttgtcactcccaccagcgacctcgtgcaagatcctcgcctgtatgcacgggctggaagttggagctgaagcaaacttggccgcggctattcaggttgctcagctggcgctaaagcatcgccaagaataagagggcaacagcacgagaattattgtttttcattggtagcccttggtcgacatacgactacaaggtctcggcagacaatagggaagaagcttaagaagaataatgttgcccttggacgttggttgattttggtgaaactgatgatgaaaagcctgagaaactggtaagctctgaaccgctgctgttaacagcagtgatagcagccacatcgtccatgtcccttctgggtgaccatgccctttctgatgttcttggtaaggactcctatgtggacaaggaaagataaggaggacaagccatgacatttctgaagatgggaaggactgaacgcactgaacatctattttctcggaaaaagtgcaggcgcatgaagtgaagaagattgcctgcgttagatggattgatattatggctctaagatgaacttaccttaaatgctcctgctgtaagttgacgcacggtctactgaagtagatgatgatgatgccccgctagtacagcaagcactcgctatgtcaatggatgagggtgcttcaggagctgcagccgtggctgatgctgctatggcagaagctgctgcagatgaccaggatttggcattggctcttcaaatgtctgtccaggatgcagaggcggctggtcaatctgatatgagcaaagtgtttgaagacagatcatttgtgacatccatccttaattcgcttcctgggtgttgaccccaatgacccatctgtgaaagatctactggcatctttgcatggcccaaggagagcaggaggagaagaaagatacggaaggacaaggccagacaagcctgcaagatgggaagaactgaagtcaatgaacttctattttctcaaacttgcaggcgcatgaagaagtgaagaacgattgcctgcattagctgcttttacactcagggctatatgaatttacttaatcctcttgtaacggcgttgcatgataactcaaatgccgagagaacttgttattatatcttgttctcatcgaacgctcctccctgtttgctctcaagtgattactctgttgcatgacgaggacgacactgagtgtgtgggaagaaagataacacgtgacgagaggataaagatgacttgtcgaaaaaattaataatcgggaaaaaaacagatataaggatggaataagagttcaggagcatacatatcagtacatacggcctggatacggatacggttggtatacgtacagtcgtacaaagactagtaggcgtaggatatttattcatggagagctggaaaaggggtgggggcctccctttccgatgtgcatgtacagccgcgtcggccggcgtcctgccggaataccagccttgatcatttccccatcaaaaataatcgataaaaaatgtacatcgagccgcttggtagaatgggtggatctgctctccggcctgcgcacgcaagtgctttctgaagtaaactgaatccctcttggtcctgggggaattattttctgaaaatcgtccattccttctgaacatgttcttcagaagttatatggcaaatccccagtggttcattgattccagacggacgcgtgg

SEQ ID NO: 18974 - DNA, 780 bp, Triticum aestivum
  Clone ID: PAT_TA_18974
cgtccgtttttttttttttttgcacaaaaacacaactgttttgtgtatgtgagattcaaaggagagatccataacgctgactgctagacacattttaagagatatataaaaaatcaaattacacaggacacacgatgaacacaacctaaatagctaatcacaacacgcatgaacggaaacactaggttgataggccaacacgataaaccagagcgtcaaggtcacaacaaaatggtatagcaagtccacaccacaccagaccaggcacgtccatcattgcttcccgcaattacctacagcaactaaacgacgaccaacgaaccaaaacacaccaccaaccagagaaccatgccagcgacagatacgcctgcgcaaaaggagtcgccagccctcatatgatccaagtgctcatgacttgggagcagaccgggagcgcagcctgctcgcgacgcagtcagggcttcttgcttcgacccacttcctcttcttcttcgactccggcttagatggagtgacgcagccgacatcctggtgacgttccagggtatcaaatgtcaccccggactcgctcgtgccatcatccttgcagaccacatcagcagtgatcttcttcctcggggccttggcttcatccttcacagctgctgccttcttcttcatgttcccttccttctgctcaacttcaccagcatcattcatcacgttgctgcttagatcagcatcctgcttggcaactggtgccttgtgctcagagacctcgccagcagatggcagctcgtt

SEQ ID NO: 18975 - DNA, 2922 bp, Triticum aestivum
  Clone ID: PAT_TA_18975
ctgcgcgaccgggaacgcgacagcggcgccagaaatggtgtagggagggtgctcaggcccgtccccgcacccagtcactaagcggaggcgggagaggagggtagggtagggtaggcgaaagagagcgagcgagagagggggcggcggggaggcagatgcgggagatcccacggggggtcgccgcagccggaggaggaggaggaagaagaagagatggacacgcccgataggccccgcgccggcgccgccgccggattcgaggactcccccgtcttcaattttatcaataatctatctcctataccacctcctaaacctcaagactcatcacataatgtgcacctattcaagtcgtctgacttggctcctgtttcttcaatctttgcctcaccccatgtcaatccaccaaaggaatctaaacttctgataagggatgattctgttcaactttctcaagattcaaactctcctaatagtgtcagaactcgattagggagtgctattaggttgatcaaatgcaaaaacattgtttcggagaattgcagtttcacctgccacctaaatcagggacctattgattcttctgccaatagatcaaactctacaagtaaattgcctcataccatagagtatgttggtgactcttcagaatgtggtaagaatcaaaatgccgacggtgaaaaagatcttgcttgagatcaggggagcataggactatacgggggtcctccttgttcacactggctttgataagattgactcatcacatcctggagataaccctattgtagacccgcaatgtaaacagcaatgggaccgatttacaccccctcatggggattacttgagttcgcacgtatctcctctcctgtggctgagaattagccccaccatgtgagccagatacacagttagtgaatgagacactaaacgctgataatgtgtgctctggcaattccttgctgaccgatgggccaagtggctcttacatcaaacaatgctgcacatgatccaaatctttactgggatggaacggttgaagggcccacgacagattataccccccaattgctccctggtgcttgtcaaagtcagtcagtgtcaaatgatcaaatctgtaatgcagttgaagagcccagtgatcacataccaatcgaccaaagtgccttgtcacagaatatgcgtggtatgcgcaggcgttgcctttttaatgaaaaggctggggctgttaacaaagctgccaagaagacctcggatcgccattctgcaaatacaactacccccagatgcaaaactaattctggtgataagcctgtgcgaacccctccatgtgcattgcctggtattggcttgcatctgaatgcccttgccccaatatcaacagacaaaatagtcccccaagctgctcaatcttccataaatcaagccagcaacttcccctgtgctgtcagttcttcaacatctgaatcaaatattgcaaatgaagattcctctcaggcaatcgtggttgcaaatgctgatgagtctggtcagggcagtcccaagaagaaaagacacaagtttgatgatggtgatgggacttcatgcaagcgttgtagctgtaagaagtcaaaatgcttgaaactttactgtgagtgttttcatgctggagtcttctgttcagaaccctgttcatgtcaaggctgtcttaataagcctagcaacatggagatagttctatctactcgagagcagattgaatctcgtaatccactagcatttgctcctaaagtgattcgcacatctgagcctggtcaggaattaggggagtactctaacaaaactcctgcctcggctcgtcacaaaaggggctgcaactgtaagaagtcatcgtgtctaaaaaagtactgcgaatgctatcagggtggcgtgggatgctccataagttgcagatgcgagggatgcaagaatgcttttggtagaagggagggactcggaccgttaagcattgagggaagctaagcagggaaatgaggaaaatagtgcttgtgtgaaggaagaaaaaaaggaagatgataataatcagctcgttatctgcccagctgctaatccagctcctgctgagaatgtactgacaacaccttcagctatggatatcagacccttggcttctcttccaccttcaagctctaagaggccacggtctacgacaaaggtcctcggacatccttctcgactatgcaactctcaagctcctctgaagacggacactgtgctctccccatttgaaaactatgcagaaattatgtttggggtgggtacatcagatagcctgaaaggagggttatctcctcaaacttctgtcaaggtcgtgtcaccgaataaaaagagggtatctcccccgcgcattggtactgggttgtctccaatttgcaagagtggcaggaagttgatcctgaaatccatcccttcattcccttctcttggtggtgatgtaaataacgcggataccaagaccaccttgccagctccttgaattcatcaagcatttgtcactgaggtcatttcattagttccttgttgattccccagatggccaatgcctcgtagctgcatcagctccttatccttgagagtttaatgaacatccaagggagttttatttcgccagttctttttagagcctgataagtatcccatgatcctatagtggaccgttgaataataatgtaccaaaataccccctcgagagtcttcggcatgctagtaattatatccacacctgtggagacagagtccttgttgagttgcacatccatgttcatctgtataattaatttatatatttttgaatctatgtaactgtaactgagatcaaatcaccgagccttagatgtacttatggtcagaaacctttatgatttatataaaaaaaaaaaaaaa

SEQ ID NO: 18976 - DNA, 1185 bp, Triticum aestivum
  unsure (1)..(1185): unsure at all n locations
  Clone ID: PAT_TA_18976
aggaattcggcacgaggccggagcgacgccccgacccccgcttccgcccgcgccgctggatcgtcctcgacgaggtcttccagagccaaggaaagatgctcctgttgaacaccgactccggccgctttctccacagagaactcccgctgctcaacgaccaccacgtcgtggcaaccactcgcaatggctacctggtcctggcggacaaaagccctcctcacgcggtcaacgtcctcaaccctctcacccgcgttgtcatccgtttcgtggcgccggtgccccccaaggtgggatccgccgctgtcgtcttctttgacgactcttctcccacgctcaccttgttctgcgattcatctcacaatgtttacacggctgacctcagcgatattggttttgacgtcctagagggtcccggaccggaagcagagtatgatttcttccgtaagacggtcctggctggtgtttacgcagacatagagccggcatttcatggtgtgcttgatgatttatgcagtttgctcatgtctggtgatgttgccaagtttttccccggcggtcttccagatgcaaccgacctcaaatggtttccagtgggtttgggtaaacatatgctgcttgttgtgaacgtccggggatcgatctttgttttaaaaaagaacattcagataggtaagcttgtggctttggacagcatcagcaactatgccatcttcatgggtcttcagaggtgcctggctgtcgatgctgagaagttcccaggcatcgaggcaaactgtgtctactacattgaaaatctgggttcgtcagctcacatctgcaagtgcaacatcaagaacaggaaagtagagaggatctctgaagctgccgatttcgtgaagcacggcaagcagtttgtcctggttgctgaccgtcctttgacgatcatccaccttctctccagctacaccatcaacatccctgattctcaaatggccttacaacagattccataaggcgctggcagatgttcaactttggggagattgatctcgatgactgacagacaaaggctatggttttgctaagtaattgctcctaattactctctatcctttgctttggttattttgggatatccttgccatgttacgtgttaagaaacagatgatcgtagnttaatcaccttttagtgggaaaaaaaaaaaa

SEQ ID NO: 18977 - DNA, 1244 bp, Triticum aestivum
  Clone ID: PAT_TA_18977
tcctagtcttgcagtccacccacggcggcgatggcggagctcaagagccggcgggtgatcctcaaggactacgtggagggctaccccacggaggcgcacatggagctgctccccgccgcgcccgtcgacgaggccgaggagggctcggtgctggtcaagaacctctacctctcctgcgacccctacatgcgccccaagatgtcccgcccgctgcaccagtcctacaccgccgccttcgtcccgggcgccgccatcaccggttacggcgtgtcccaggtcgtccgctcctcgcgccccgggctcgccgccggcgacctcgtctggggcatgaccggctgggaggactacagcgtcatcaaagccgccttcacggccaacctcgagaaatctcaaccacatcacacacgggccgctcttacaccgagatcgatgcatgcaacaaacactgttttcactcgaggaacatgcaacagcattactattgttttggtgatgggaggtgctactccaacagtacatgtagtaattgtgtggccgtggcacatgtctctgccactgccactgccactgccagagccagactgcagccgctctctgaactgaagctctggtctgtcggccctcccagtttcacatggagggtcagcgcttcagcggcgcgtttctttcagctgtcggcggcggcggtgaccaggttgaagtagacggtgtagaactcgtcctggaggctgcgcagcggctccagcacgaagctcctctccgtgcccttggccacgaagctcagcgggtggtagcgccgcagcggcgccgcctgcgtgaagctcgccgccttccggaacgccgcgtcgtcgccgccgctcgtccggcagccgacctgggccttgtcgccggcgcggtagccccttgcgccgccgggggccgtcacgaagcaccctggcctggtgccgagctccagggacaccgagccggggagcccgtccagcccgggcacggcgttgaacagggcctccggccctggatgcagcttgacctcgaagccgttggtgatcgccatgcccggcctgtcgaacggcgcgatcgtcacgttcggcccatgcagaacaggagcggcggcgccgtgctcagcggcggtgctgtcaaccacgtacgtgtcgaccacgatcgtggcgcgcacgcacgcgtcgctgccggcggcgggcatctcgtccattgtcagcgtgccgtccggacgcgtgggcggacgc

SEQ ID NO: 18978 - DNA, 1763 bp, Triticum aestivum
  Clone ID: PAT_TA_18978
gcatgatggtcctctttccctacacccgcgttggcggcgcccgagagctgcagcggggttattattgttttggtgttgggtgatgccgctccaactgtaccggtagtaatagtgtggccgtggcacgtggctctgccactgccactgccagagccagagccagagccagactgccgccactctctgaagctctcttccgtctgcacatgggtcgtcagttcagcagcacgtttcagctgccggcggccgcgctgacccaggttcacgtagacggtgtacaactcgtcctggaggctccgcagcggctccagcacgcagctcctctccgtgcccttcggcacgaagctcagcgggtggtacaggcgcagcggcggcgcctccctgaaggtcgccgccttccgggggcgcgccgacctcgcccccgccgctcctcgtcgggccgccgacctgggccttgtcgccggcgttcaagcccgcgggctccctcacgaactgctccggcctggtgcggagctccagggacaccgaggcggggaacccgtccggcccgggcacggcggtgaacaggcccgccggcctcggatgcagcctgcccaagtaaccagtcgaggtcgccaccggcggatagtttaaccccgtcacagtcaccctcaagtcaggtaacctcgtaagctcccacaggatcgatctcgaggtcactctcaccggcgtgctctacacaacgatcctggccggcaaggacgcctaccccggggagatcagcaggaagctgcacggtcccatgcccctcgacggcatgttgcgcgagcacaacgctgtctgcggccaccaggacccctacgacgtcgcggccggccttgactgcctcctgacgaagcgcggcgaaaccgcgggccccatggagccggcccactcgcgacgctaacctccatccagcccgggggtaagcacctcgttgaagagctcggggccgggacgggtccttgttgccgtgtgtcgggggggcgaggacgtggggcccgaacaccactcgcccggatccacgcacgcaccggcccggtcccctttcatcggccccatcctcaagttaatgggaaattggagcacctaaggtatcatcgccccacagttttgtcaaagtgaggaaatcacctgcagaagtcaggttgagtttttggccattcagagttgccgttgcgtcaactgtggatgtccatgaagggatcctcacgctcacctttgctggctgggcatctcccttggcagaaatggagattgtaacctcaaagtaagaatccgttgacaacagtggcttggcctgctgcacgacggtgaggcctgccgccttccagtcgaaggtgctcggtatgtgctgagcgatgtagagccccggcacttcaccctcctccaggaagtatatggtgtcccccaactttgagaacgactctatccctgtcccgtagcagcaccagaaggtgtcatttggacctccccaccctcctgggttcttgggagggaggccggaagggggcccgccgctgatgctcttggatcgcccaggacccatgggaaggaagtagatcatgacaccaggctgcgttcccctctggttgcccatgatcccgttgatgagcagcctctcgtagtgatcggcgtacttgacttccttcgtccacctgaacaggtttcgggacaccttaagcaagttgtaggtggtgcaagtctcctcgttcgagctgattttgatctcgtctactagtcgc

SEQ ID NO: 18979 - DNA, 1311 bp, Triticum aestivum
  Clone ID: PAT_TA_18979
tgcaggctgtccggccagagcaacgactggccatgggttccaccaagccactccggctgatccagcacaagaaggaggccctctggttctacagcttcatctccttcggctacgaccatgtgttcaacccaggccaatacaccgaggacatgcgcgacatctccctggagcatgctcgcctccatagccgggccctcaaggtggtcgacgtcggtggtggcactggcttcaccacgctcggcgtcgtccggtatgtcgaccccgagaacgtgacgctgctcgaccagtcgccgcaccaactcgacaaggccagaaagaagaaggccctcaggggcatcaagatcatggagggtgacgccgaggacctccccttccccgccgacaccttcgaccgatacgtctccgctggcagcattgagtattggcctgatccgcagcgggggatcaaggaggcctacagggtcctgagcgccgacggcgtggcttgtatgataggccccgttcgcccgacgttctggctatctcgcttcttcgctgacatgtggatgctcttccccacggaggaagagtacatcgagtggttcgagagggctggcttcaaggatgtcgagctcaccagaatcgggccaaagtggtaccgcggtgcccgtaggcatggcctggtcatagggtgctgtgtcacaggcatcaagacacaaagcggggactcccctttgcagcttggtccgaaggccgaggatgttagcaagccacatgtgaaccccatcttcgtcttctttcggttcctcattgggacaatttgtgccacatacttcttcctagtgcccatttacatgtggatcaaggacaagattgtgccccaaggccggcctatctaactgaggatgctacctggcaggaggagacaagattggagtcaatatctgatctaagctgtgaaaataccacttttgtttcatgttgtgttctgtagctataaatatgtggacgcacgtgccgtcagaagatcgatcggtcatgggcttcatgcatcaaccgatacagaggcagatgctcgatgacgtgggaaactgattgaccagacttgtttcctgctcatgtatctctcttcgacttgtgtggaccctcccctaagaaggtccatcatctccgtgtataaataaatcaagtagaagtcattcgttgtaacacatagtgagtatataaacaatggagaagtcagtcacatcttctctacgtattaaagtacataaacgtgtgctcattgtcatgcaaagatgcgcaacatcgaaaccacgtcctcttttaaaa

SEQ ID NO: 18980 - DNA, 593 bp, Triticum aestivum
  unsure (1)..(593): unsure at all n locations
  Clone ID: PAT_TA_18980
cgcgtccgcagattctcactcttgagaatttcagggaaaatgaacagctatctaagtatgggcgagcaaaatctgctcgcagtattatgctgattgagctaaaaaaactaatcgaagcaaatccccttttccgggaaaaacttgtctttccaacccttaaagcatcccgtttgcggactttaattaaccaaagcttaaactggcagcatcaactttgtaaaaaccctcggccaaatccagatatcaagacgttattcacggatcacacttgctctcctcccaatggagcacgtacatctcctgtatctgtaccattggcagctgttccgaaggctggtgcagcataccaagccactcacaggccatgctccattccaagcctcctcctcctgccggtccatctttagctggttggatgacaagtgctgctgtttcttcatccattcagtctgctgccgtggcagcatcatcaatgtctgttccaccaaatcaaggnatgatgaaacgcccaagctatatcaaggctatcaaagtgcagaatctgaggcaactaatgaagcgattganggccactggacaatggnaattgatgg

SEQ ID NO: 18981 - DNA, 2073 bp, Triticum aestivum
  Clone ID: PAT_TA_18981
cggacgcgtgggtgcgtgttagtggatgaaagctcaaaacgctttcatagatccggacggttttgaagtaatagcaggcctggctttgcttttcttcaaagcatcttgagagaccaaaatctgcaatttttggcaccatgttgtcatcaagcaatatatttgcaggtttgaggtctaagtggagaatatggatcttgtggagataatgcaaaccctcacaaattcccttgattatttcatagcgctttgtccattgagattctcttcattgagaaattgtgtggcatgggacaattgcaatgcatgataaaaaataagagcaaaaatatagtatgatctattggatattgtgttgactcacaaggaaagaccaaaatacaaaaaaaggcaaatgattgctctgcgttgcatgtctacctaggcgaatctacatgcctatgtaacaaattcaagatgcatgggtctgcatgtagagagcactatcaaataatcaaggaatttgcgagggtttacattatcttcacaagagatatattaacccgttcgcccttagacctgcaaacatatttctagatgacaatatgatgctaaaaattgcggatttttgtttctcacgatgcttggaggaaaaacaaagccaagctattgcttcaaaacagtttggatctatgtaatctagccagccaacaatcttcaaaagctcaatttctttgtgtattttatgagtttatgccttcctttccccattcattaacaagttgatatggacttctatgcagggcatcagactcttaagatggaaaatcacattagagctacacatatagtttttgcccttactaatgggaaaaaggggattgatgaaatgggtgtgcccatgtagatttacctttgttcatgtgtaattgcatgttaatatcaaatctgtgtatgtgtgtacatattacatctcttgctgtcataacatatgaatgcaataggttcttgatactttgggggttaggatggagaaatcatcaggaggatatttgatgcctgtagtacgcacaggctgtagtcattggcttgacaaaacagttgtgcaggtaagctcacttatggacaacggctgctccgagctggtggatgagatcaagcctcgctggttgtccaacagaaaaagggttccggtgggctgcagcgaaatgcacccaagatatattgggaagccattccatctaactgtccgtccttcatggatatcattactgaattagaggtttccggcagcagatcagaagcaagcatgaagatgctgtggagacaagccaagaagaaggaaccgtccaggcaatgcagagtggcccctctgctcatactccatgacagttcttcccattaactgatcggccaagcgaggataggggttgatggcactagaaaagtagcatcttgcccgattttgtcattgcttcttcggacctgattttcacggtctcattctcaatttccgttacagctctcgtctggattatctcacatagagcaaaccggagtgacctttatgtctagttttctggtttcgttaacatttggataattggattgatggatatgtcatctatggatgtattggttacgacttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccttttaaagaacccaattttacaccccggggatggcaacttaaaacttttttattggggcccccaaatttcatttcttggccccgtttttaaaaaggggggcgggggaaaaccccggggttcccccatttaaaccccctgggaaaaaacccctttttcccaagggggggaaaaagaaaaaagcccccccccaagcccctttccaacctgtggcccccccgaatgggcaaagggaccccccctttaacgggccttttagccgggggggggggggggtttcccc

SEQ ID NO: 18982 - DNA, 1362 bp, Triticum aestivum
  unsure (1)..(1362): unsure at all n locations
  Clone ID: PAT_TA_18982
ccccgcgtccggccatttacgatcctttcctaagttgctcttgaaggtaactggttcgtacaggagaagagctgtaagatattaactcacttaataagtgcgagacctaagcttcagaacggcatggttccaaatggagaggcttcaaattcaaagagcaagcttacatcaattcatgatgtgttaaagggcttggttgattggctctgttctcagctcaggagccccacccatccaaactgttctattcctactgctacccattgtcttgccactttgctgaaggagacatatgttcgaaccttatttgttcaggcagatggtgtaaaactgctcattcctttaatatctccagcctcaacacagcagtcaattcagctcctctatgaaacttgcctttgtatctggcttttatccttctatgatgcagccgttgattatttgtccactacaagggttatgccaagacttgtagatgttgtcaaaggctctactaaagagaaggttgtcagagttgttgtgatgtccttccgcaatttgttggcaaagggtgcatttgctgcccaaatgattgatcttgggttgccgcatatagtacagaatttgaaagctcaagcatggagtgatgaggatttgttagatgcattgaatcaactggaagtgggtctcaaagagaaccttaagaggttgagctcatttgataagtacaaacagcgagtgcttcttggccatcttgattggtctccaatgcacaaagacccaaatttctggcgagaaaatatcactaactttgaggaaaatgatttccagatcctacgtgtccttatgacagtcatcgacacatcaaccgacaccactgctcttgcggttgcctgctatgacctctcacagttccttcagtaccacccttctggccgcttagtggtggcagacctcaaggcgaaggaccgagtcatgaaactcatgaaccacgacaatgccgaagttaggaagaactccctgctctgcgtgcagaggctcttccttggtgccaagtatgctagcttcctgcaggtttaagaccaagaagttttgtatttatatgaagtgttagatccaccgaaccccatgccattttttcagaatggcgaaacagtgattgagaatgtaagacctctgaaatttcctgtccggtatatcttgctgttatttgatttaattaatggactggtgtataataaataatctcagctatggcttgctcgatgtaataaaatgtccatgggcagtatttctctcctctgaacagtgttgtccgaggaaagaaagtaacacgatttatgntaatgtatacgtttttttatggggactgattggcagcct

SEQ ID NO: 18983 - DNA, 1790 bp, Triticum aestivum
  Clone ID: PAT_TA_18983
ccgggccggagtcttcctgagatccgtccccaacctacctcccccccgtcctgatcctacctcctccccctcatcggccctacgcctggggcctatcggcggcgtgcagcggggctttcaggggggtggagcttgacctgccgggatggatcgcgccgagctcaccaccgagcaggttctcaagcgggacattccatgggagacatatatgtcaactaagctgatcacttcgacatgccttcagcttttaaggcgttatgatcacaaaccagaaagtcagagaggtccgttgcttgatgaggatgggccatcgtatgttcgtgtttttttgaatattttgcgaagcatctccaaggaagagactgtggaatatgtgcttgccctcattgatgagatgcttgcagcgaatcctaaacgagcagcactgttctacgacaactctctctctggtgaagacatttacgatcctttcctaaggttgctcttgaaaggtaactggttcgtacaggagaagagctgtaagatattaactcacttaataagtgcgagacctaagcttcagaacggcatggttccaaatggagaggcttcaaattcaaagagcaagcttacatcaattcatgatgtgttaaagggcttagttgattggctctgttctcagctcaggagccccacccagccgaactgttctattcctactgctacccattgtcttgccactttgctgagggagacatatgttcgaaccttatttgttcatgcagatggtgtaaaactgctcattcctttgatatctctccgcctcaacacaacagtcaattcagctcctctacgaaactagccattctatctggcttttatccttctatgatgcagccgcacattatttgtagtacccaacgttctggccgataagtgttggtatacccaaaggctatggaccgagtcatgaaactcatgaaccacgcacaatgccgaagttaggaagaactcccgggtattgtgtgcagaggctattcctcggcgccaagtatgctaggttccgacaggtgtaagaccaagaagttttgtatttatatgaagtgttagatccaccgaaccccatgccattttttcagaatggcgaaacagcgattgagaatgtaagacctctgaaatttcttgtccagtatatcttgctgttatttgatttaattaatggactgatgtataataaatattcgcagctatggcttgctcgatgtaataaaatgtccatgggcagtatttacaccaaccgacaccactgctcttgcggttgcctgctatgacctctcacagttccttcagtaccacccttctggccgcttagtggtggcagacctcaaggcgaaggaccgagtcatgaaactcatgaaccacgacaatgccgaagttaggaagaactcgctgctctgcgtgcagaggctcttccttggtgccaagtatgctagcttcctgcaggtttaagaccaagaagttttgtatttatatgaagtgttagatccaccgaaccccatgccattttttcagaatggcgaaacagtgattgagaatgtaagacctctgaaatttcctgtccggtatatcttgctgttatttgatttaattaatggactggtgtataataaataatctcagctatggcttgctcgatgtaataaaatgtccatgggcagtatttctctcctctgaacagtgttgtccgaggaaagaaagtaaacacgatttatgtaaatgtatacgttttttatggggactgaaaaacagct

SEQ ID NO: 18984 - DNA, 587 bp, Triticum aestivum
  unsure (1)..(587): unsure at all n locations
  Clone ID: PAT_TA_18984
gtcgtgctctgtcagtcgcgctctccgcccgccccgatgtccgcctccgataacctcgtccatcggatcgccgccttcttcccgctcccgccgcccccgcagaagcagcagctctccggcgtcgccgcggccgtcctcagcgcgggcggccgcctcggccgcgccgtgggcgacgtcttccgccgcctgcgcatcgacgacggcctcgacatcgcgtacgcgcgccggcaccggagggtcgtccccggcagaggcggcgcgacggccgaagacgacggcgcgcggagcaagcaggaagggatcgccgcttggcggcgatcgtccggcggtaggcggctccgggaggttcgcgcggtcgcaggggagcatggtcctgtcggcggcgttcgacagccggacgaacgacgtggagagctccgtggcggcccgcggcgaactgtggcgcgccgaggcatcgcactccaacgccggccacaggcggggcggnnacgtngcgccgggcccnttcctggncaactcggnccgtgtctctcggganaganctgtctcccgggnactttcaagncacttattggtangttcaanca

SEQ ID NO: 18985 - DNA, 573 bp, Triticum aestivum
  unsure (1)..(573): unsure at all n locations
  Clone ID: PAT_TA_18985
cccacgcgtccgggaggccgtcctgcgacatccatccctttcccgcctcaaagcccctaaccgagctggtcacagaacccagcaccgcgtccgcaccgtccctcgccgtcctcgcgtccccaagcgccgcctcgccgccgccgccgcgctgttccaggaccagaccaacccaagaaccgcggcagcaagcaaggggggcgatgaagaagacgaggaggggtacggagaggtggaccgcatcgtctccagccgaaccgtcaagaacgcggtgttcgcggaggacggctcggccaccaccgtcaccgccaccgagtacctcgtcgagtggaaggacgggcacgagccgacctggatcccggcggaggcgatagccgcggacgtagtggcggagtacgagacgccgtggtgggatgccgccaagaaggccgacgcggatgcgctgggcgcgctgctggcggacgaggcgctgcggcgggacccggacgccgaggacgcgcaggggcgcaccgcgatgcacttcgcggcggngctcgggtccgaggagtgcctgcgcttgctcgcggaggcgggggc

SEQ ID NO: 18986 - DNA, 555 bp, Triticum aestivum
  unsure (1)..(555): unsure at all n locations
  Clone ID: PAT_TA_18986
cccacgcgtccacgcttctccgacgaggccgaggcgcgtgcgccaaagataaacccgtgcatctcctccgatcctcgtggagacctgcaggcgatcgatggagggtgccgcagccggagagccggcaccggcgggcgtgcatgccgtgccctcccgcaggctgatcgccggcttcatctcgggcacgctcaatggcctcttcgctctcgctggagcactaaccggagcagtcaccggcgcgctggcgggcagagcctccgatagcggcgttctccggggagctagatctggagctatcaccggggctgtcctctccatcctggttctccaggcatctcgcgcctactggtgctcagaccggctcggcgcgtcatccatgtccatgacagatttcatagagcagctccttcatgcccggtttgagcaacagcggcttggattttcagcacatacatcacaccagtcacaggtcancatatccggctttggtcaggatgatgtgtatgaaatcttccgagacatttcgttgagagggctttcgcccgagtccctgaa

SEQ ID NO: 18987 - DNA, 1291 bp, Triticum aestivum
  Clone ID: PAT_TA_18987
cccgtccgggttcagccctctccctctttctgaaaaccctagcgccgcagcccgagagagccatccttaggtttccgcgcaaggcgtcggggaattttcggctcgattggattggagatgacggagaaggaggtgggacggatcttcgtgggcggactgtcctgggacaccacggagcgcacgctggagcgagctttcggcgagttcggcaaggtcatcgagacgcaggttgtaacagaaagagacacaggccgctcccgtgggtttgggtttgttacattcttggaacctcgggctgtggatgttgcgatccgggaaatgcacaatggagaactagatggtcggaccatttctgtgaacaaagctcaacctaggatgaacagtgatgatggtggctatggatatgggggtagtagttactcatctggtgctagaggtggatatcgtggtgcagctgacatagtacccgctgcaagtgatgattgctttaagtgtggacgccctggacactgggctcgtgaatgtccttattctgatggaggcaggcctggaaggtactctcccccatccaggtatggcaatggcgctggtgggcgtggtgaccgccttggaggatcagaccgttttggtaatcgctatgttgatgatcgttatgatggtggccactatgctgatgatcgttatggtggtgggcgcgatcgctatcctccagctgctgatcgtttttctggcgacagatatggtggtggtgatcgttatgcatcagctggctttgccagggaaagaagctatgagagagatggagggcggacaggtggaagttattaccgtgatgaacctagaggcactggtggttatggcaggggtggtccacgtgtggcgaatggtgacagatatgggagtggtggacctgctcgccttggcgcaagttaccgagataggcctgctccctatgatcgtcccactcggggtgctcgctcatatgatgaccgctactgatggaaggtcaccttggagcagaccggagatttaatacaagattcaattcccagttgctaccacctactttatttgtgtccactatgttgatgcttcaactctcaagtatcattctttcaagcagtttgtttagttacttcagtccatatggcagtacttaattattattattattattatggtcaaactgtacactctaggcaatgggcgacacctgttgcttattgttatggtattgtgtaactactctgcagtcttaagtttgagttgtactactgttttagttttgact

SEQ ID NO: 18988 - DNA, 877 bp, Triticum aestivum
  Clone ID: PAT_TA_18988
cttaggactaattggtacaacaactcaaggagcatgcttgttgctctctgatccaccaaaaattgctagacatgtggtagaaatgtcctttgataggcagggcagaggtaaacagctggccgctttacatgcctttggaagcatatgtggtgttgatcgacaagaagaccagatgaaactggatgatcatcaagcagaagagtgcctgaagcgcttagtctacagtgccgcatcaaacagtccaaaattaactccttcagctcttcttctatcaattctacaacaagatccagacgttcggattgctggttatagagtactgtcaggactggttgtccgagaatggtgcctaagggaagtttgctcaaagccagagataatcggaattgttacggatccaaaaatggagacaacaaaacttggcatggaggcacggtacgcttgctgtgtggcaatcaacaaggccttgtcatcgtcgcaccttcttcatgaaccgagcctttctgaactcattggaaagctgaatgaggcggtcagaaggggtccctatctttccgagaagaggcagcgtgtggaggcacagccggtggtcggtaccatggagaggttttaaggtggcctttcgagctcttcggccgagaaaccgagcaccctctgtgcttgatgcatgtacattaggtgcaactgtgtatcttcttacctgaacttgtgtgacgaggatgatgatgatatcagaggttcagttctgttgggttttgtgatataaatcggtggatgctggttcatgccattccatcttacaattacagttaccagtaatgttaagcggacgacatcttcagcaagggaaaaaaaaaaaaaacggcacgagctcgtg

SEQ ID NO: 18989 - DNA, 810 bp, Triticum aestivum
  Clone ID: PAT_TA_18989
atcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagcgctggaagatccttccctggtaaacgtgtcatgctgctgaagctgagttgatcgccaccgtgacccggagttggtagagatcggcctgtgatctgtttgccgtgtcgttagaataaaagtcgtgtgcggttggtgatgtgtccgtgagtgtgtgtttagtttctgtcctgtcgttgtgtcctgctatggcgagctatccgatgtaataagcatttggcacttgtgcttgtttttcaaaccatggatcgtgatgagaacctctgtactgtggtgcaatcctttcatctatgc

SEQ ID NO: 18990 - DNA, 585 bp, Triticum aestivum
  Clone ID: PAT_TA_18990
cggtccgcctcacggcgagcaccgacctactcgacccttcggccggcatcgcgctcctagccttaattggccgggtcgtgtttccggcatcgttactttgaagaaattagagtgctcaaagcaagccatcgctctggatacattagcatgggataacttggacaacctgcggaggcttgctgagcagttccagaagcagatgcctggtggtgaggctggcggcgccagcatcggtgctgcccaggacgatgacgacgatgtcccagagctcgtcccaggagagaccttcgaagaggccgcggaggagaagaaggaacccgaggcgaagaaggaacctgagccggaggagaagaaagagtcgtcgtaatcttgtcacgccattcattgttgtgaagggttccttgttggttcagggttgattggcatcttattactgtatatgccagagacatggtcctgtgagaactctggcccatctttcatttctagcgctcctccggttggttttgtctcggccgtgggttctgtccgaaccgacggcggaactgagttttacgacaattatcgtttaccattccaaagtgt

SEQ ID NO: 18991 - DNA, 495 bp, Triticum aestivum
  Clone ID: PAT_TA_18991
tgggcatttgatgggcgcgaccattgacatggcggggcataccacggaggccacgattcatattgccggcgatatcacggatgcggccaatcatattgccggcgatacggccgatgccaccaatcatattgccgccgatgccaatgacaagatggcgcatacggcgcatgcggccaaggatattacgtacgatacggcgcattcggccaatgatcgcgccgcccatggcaaggaccatgaccgccagcaccctcggcgagattacggatgcggccaatcataatgccgtcgataccacggatgcggccaggcataatgccgccgatgcgatcgatgcggccaatcagaatgcgtcggatacggcgcattacaccaaggattccgccgtcgccggcaaggacaagatcggcagcgtcctccatcatgcaggggatatcggtggtgaacgccgtgggtgggcgcctatgacgccgtggccaacacgctgggcatggg

SEQ ID NO: 18992 - DNA, 766 bp, Triticum aestivum
  unsure (1)..(766): unsure at all n locations
  Clone ID: PAT_TA_18992
attcggcacgagggccgccgccgccgtcgtcgcctgcccaagatgaatgtcgacaagctgaagaagatggccggtgccgtgcgcaccgggggcaagggcagcgtgcgcaggaagaagaaggccgttcacaagaccacgaccactgatgacaagaggcttcaaagcaccttgaagagagtaggagtgaacaccattcctggtattgaagaggtcaacattttcaaggatgacgttgtcatccaatttcagaacccgaaagtgcaagcatcaattgccgcaaacacatgggtagtcagtggaacaccacagacgaaaaagctgcaagatttactgccgacaattatcaaccaactgggaaattcctttttgccaggcccggataacttggacaacctgcgaaggcttgcggagcagttccagaagcagatgcctggtggtgaggctggcggcgccagcatcggtgctgcccaggacgatgatgacgatgtcccagagctcgtcccaggagagaccttcgaagaggccgcagaggagaagaaggaacccgaggcgaagaaggaagcggagccggaggagaagaaagagtcgtcgtaatcttgtcacgccattcgttgttgtgaagggttccttgttggttcagggttgattggcatcttattactgtatatgccagagacatggtcctgtgagaactctggcccatctttcatttctagcgctcctccggtggttttgtnctcggccgtggttgtgtccaaaccgacgg

SEQ ID NO: 18993 - DNA, 691 bp, Triticum aestivum
  Clone ID: PAT_TA_18993
atggcctccaaccagaaccaggcgagctacatggccggcgaaaccaaggcccgcaccgaggagaagaccgggcagatgatggacaaggcggggcaggccacggaggccactaagcagaaggccggcgagacggccgaggccaccaagcagaaggccggcgaggccaaggacaagacggcgcagacggcacaggcagccaaggaccgcgccgccgagagcaaggaccagacaggcagcttcctcggcgagaagacggaggcggccaagcagaaggccgccgaggcaacagaggcggccaagcagaagacgtcggagacggcgcagtacgcgcaggagcggtcctccgacgccgcacagtacaccaaggaatcagccgtcgccggcaaggacaagaccagcggcgtgctccagcaggccagcgagacggtggtgaacgccgtggtgggcgccaaggacgcggtggcgaacacgctgggcatgggcggcgacaacaccaacaccgccaaggacaccaccaccgagaaagatcaccagggatcactagctaatttgcttcctttactcgtttggtcgttcgcgggccttttacataattgtaggtttccctcttgtgtgatttccgcccatttggtgtaagtttgccttcgatttgatgtactcgtgtcaggttctgtaatgaattacttagagc

SEQ ID NO: 18994 - DNA, 372 bp, Triticum aestivum
  unsure (1)..(372): unsure at all n locations
  Clone ID: PAT_TA_18994
gaattcactaagtgattagcgtggtcgcggccgaggttcaaagacaactgggtttcccaggtttgacctccagcttcttggcatgggccctgacggtcacatcgcctctctcttcccaggccatcctcttgttaaagagaacaagaagtgggtcacccacatcttggactctccaaagccgccaccacagagaattacattcacttttccggtgatcaactcgtccgcatatgtcgccatggtggtaactgggggctgggaaagccggtgcagtgcagaaggcgatttccggacaagaagacttctgatttgctccctgttgagatggctatacttgatgatgggangaattcacctgggttcactgacaaa

SEQ ID NO: 18995 - DNA, 842 bp, Triticum aestivum
  Clone ID: PAT_TA_18995
ttttgcacacaataagaatccggttatggagcccaattcaacaacaaactatgtaactatggtgtatttcccagtggtgggtgagattaatcacaagccattacgccacctgacagttggggcctggcaatatatccagttgtaaaaggaaacatcagaatgattctctaggtagtaagcctgcgtgtacatgtctgagctactatctgaactcaccggaaacagtatacaggaggagaggccatgatgcattgctgtatgagtgataattgctccctgaatcaagacgctgtgcagctcgcgactctgatgaagaacagtttcttctgaagattgggcataacgcccactgcagtagcaactcagccacaatgcgatctattagtgctaccaattggaaggtggccgtgtagactagcccttgtgttatatgggctcatttgtactacaacttgaactcacaaaagcaatgttcagggagagctaatcccctccccatgatataatcctctcggtgagcatcccacatggccttagctagttggtcccctgccagtccagcagccgtgtagtttgcgaaggccctcctactcaagaccaatgtcttctgcagcccttgcattgttctcattgcagttaccatcttatccatatttccaaagaatgtggtaacataagcatcgctgttgactgaaacatagtagtcgagagcagcttttgtgttgccatgcatcctctcaaaatcttcatgagtcaggagagacgatttagtatacatatttttgtagatcgaagtgaagccctcgagttccattaacccatccccagcagctaaataaatg

SEQ ID NO: 18996 - DNA, 645 bp, Triticum aestivum
  Clone ID: PAT_TA_18996
cggcacgagggtactgtcgagcagaagcctaaagcgagtgacatttcccccttccgagctagttcaagaaaccaaaatggcctccaaccagaaccaggccagctaccacgccggcgagaccaaggcccgtacagaggtaagcgtttttttacttagtgtgcactctgctgcgcgcatgcgccgttgctccggcggtgatctgagatgttctatctgttggatgaactgcaggagaagaccgggcagatgatgggcgcgaccaaggacaaggccgggcagaccacggaggccaccaagcagaaggccggcgagacggccgaggcaacgaagcagaagactggccaggccacggaggctaccaagcagaaggccggcgagacggccgatgccaccaagcagaaggccgccgaggccaaggacaagacggcgcagacggcgcaggcggccaaggagaagacgtacgagacggcgcagtcggccaaggagcgcgccgcccagggcaaggaccagaccgccagcaccctcggcgagaagacggaggcggcgaagcagaaggccgccgagaccacggaggcggccaggcagaaggccgccgaggcgaccgaggcggccaagcagaaggcgtcggagacggcgcagtacacc

SEQ ID NO: 18997 - DNA, 1055 bp, Triticum aestivum
  Clone ID: PAT_TA_18997
tagcgtggtcgcggccgaggtactgcaaccgagcacttgatttctgcatccaatgggatgtttgacagtttggagtttgccgacgcttccatgtttctacctggctcatttgacacagctggagtggtgaccgaaaaccagtttggttatcttggtgatagtggctcccagaaccagggattccagtatacatctgaatcgtggacgcacaaccaggttgctctgaatgtgcggaaccacatgaatcataaccatgtcgtcttctcacatgcatcaggcactgcgaatttccacacagtgaatgagcaaccacataacctgagcccagcggattcacagtcatggttcaattcagccgtatcagccctgctggatgcggtacctgccaatccagctctggcggctgaaaacaatgttctcaacagaacactccaacgcatttytagctttaggtcagaccaagctccgaagaaggaagcaagcsccccagtttatccaggttagaagaaggggcgcagggctgatctcggtctcgctactggttttgcttgctgccatcatgtggacctttgctgctggcaccgggtacgcaatcaagttctgcaaggggttatggaagtcctcctctacatgacaagatgatgcacaaagtttgctcgacttaccctagccgttgatcctcatcattacccctcagttgctagttattgttttgctatcattcccattggaaaaaggcgaagaggtagaagcattcccattggaaaaaggcgaagaggtagaagcatttccaaagtgtgatttgaggtgttagttttaagctcatgcaggaggcttggaaaacccaaaaaagaaagaaaaaaaataactaatggtaatatatatatataactactactcctacttagctattgccctcatgtgggtgtgagacatcttatgccggatgtgattaaaccacgaagagggatgcgacctatgtgcatagtattactattatagaattattatgattttgctcaaaattcatgataatgtgtgcctggttagtgctt

SEQ ID NO: 18998 - DNA, 562 bp, Triticum aestivum
  Clone ID: PAT_TA_18998
gaaccgttggggagttgtcatgtcgaggaatgcgggctactctgaccaggttgtagagttggattttctgtatccaagtgaaggactccatcggcgatgggagagtggttacagaataacttcatccgcaggcacacctgaccaagctgcttttatcttgagcataccaaagaggaagccactggacgagacccaggaaacccttcgaacttctgccttccccagtaaccacgtgaaggaaaagtgggcgaagaacctgtacatcgcctcaatctgctgcgggcgaaccgcgtgttgacgacgtacttgagctcgacggcgaaatcacccgagttttaccactggagccagaagagagttcgagacggaacaaactcagcgtcaaccttattatctaggtttcgagcgcaattggctgggcgctgacactggcccggcctcttttggttggcggcacgctattctaattgtaaagaatcttgcgaagatccttggtgttgttgtatcagtcctcatcggatggatatgaacctgttgataagctaaggtcatattattggcc

SEQ ID NO: 18999 - DNA, 799 bp, Triticum aestivum
  Clone ID: PAT_TA_18999
gattcatccaagccagagttgagcaatactagcagtgagatttacagtgatttcacttcgtgtttgttggtgagagagaagagcagagaagacaagatggcctccaaccagaaccaggcgagctacgcggccggcgagaccaaggcccgcactgaggagaagaccgggcagatgatggacaaggcggggcaggccacggaggccaccaagcagaaggccggagaggccaaggacaagacggcccagacggcgcaggcggccaaggaccgcgccgccgagagcaaggaccagaccggcagcttcctcggcgagaagacggaggcggccaagcagaagaccgccgaggcaaccgatgcggccaagcagaaggcgtcggagacggcccagtacgcgcaggagaggtcctccgacgcggcgcagtacaccaaggagtccgccgttggccggcaaggacaagaccggcagcgtgctccagcaggccggcgagacggtggtgaacgccgtggtgggcgccaaggacgccgtggcgaacacgctgggcatgggcggcgacaacaccaacaccgccaaggacagcaccaccgagaagatcactagggatcactagacgcatacatgcgtccaatcttgctaatttgcttcctttactcgtttggtcgttcgcgggccctttacatatttgtatgtttccctcttttgtgatttccgctcatttagtgtaagtttgccttcgatttgatgtactactcgtgtccggttctgtaatgagttacttataatccatgttttactttggtgt

SEQ ID NO: 19000 - DNA, 720 bp, Triticum aestivum
  unsure (1)..(720): unsure at all n locations
  Clone ID: PAT_TA_19000
attgttgacttcgacctctgaagtttatggtgatccccttgagcatcctcagacggaggcgtactggggcaatgttaacccaattggatgtcaggagctgctacgagtgagggtaagcgtgtacctgagacactgatgttcgactaccacaggcagcacggcattgagatccgtattgccaggattttcaacacctatggacctaggatgaacattgatgatggccgtgttgttagtaacttcattgctcaggccattcgtggtgaagcactgactgtccagaagcctggaacacagactaggagcttctgctacgtcgctgatatggtcaatggtcttatgaagctgatgaatggagacaacaccggacccattaacattggggaacccaggtgaatcaccatgctggaacttcccagaatgttaaggagttgattcaacccagaagtgacaatgacgaatgactggaaacatcctggatgacctccccaagaggaagcctgacatcaacaaagggcaaggagtctccnactgggagccaagncctccctgcgccnacggttngtgctcatggaggacatttcaanggancgtttggnatgcccaagaagaccaaggctattccctccctaacnttggggttcaacatcacaattnccaanacatancataatgggtgggtcctcaatatcnttgctgcgttcctacggaattgantca

SEQ ID NO: 19001 - DNA, 728 bp, Triticum aestivum
  Clone ID: PAT_TA_19001
tcggcacgaggattcatccaagccagagttgagcaatactagcagtgagatttacagtgatttcagttcgtgtttgttggtgagagacaagagaagatggcctccaaccagaaccaggcgagctacgcggccggcgagaccaaggcccgcaccgaggagaagaccgggcagatggtgggtgccaccaaggacaaggcggggcaggccacggaggccaccaagcagaaggccgtagagacagccggggccaccaagcagaaggccggcgaggccaaggacaagacggcccagacggcgcaggcggccaaggaccgcgccgccgagagcaaggaccagaccggcagcttcctcggcgagaagacggaggcggccaagcagaaggccgccgagacggccgaggcggccaagcagaaggcgtcggaggcggcgcagtacgcgcaggagaggtcctccgacgccgcgcagtacaccaaggagtccgccgtggccggcaaggacaagaccggcagcgtgctccagcaggccggcgagacggtggtgggcgccgtggtgggcgccaaggacgccgtggcgaacacgctgggcatgggtggtgacaatgccaccaccaaggacaccaccaccaggaatcactagacgcatcgttcgcgcttaatttgatctcctttagtcgtgttcggccgttcggtcgttcacgagccttctacagtacatattttgtatgtttc

SEQ ID NO: 19002 - DNA, 757 bp, Triticum aestivum
  unsure (1)..(757): unsure at all n locations
  Clone ID: PAT_TA_19002
gccggcatcgcgctcctagccttaattggccgggtcgtgtttccggcatcgttactttgaagaaattagagtgctcatcgggcttgacaccaacttcacggtcacgagcaaggccgcggaggacggtgatttcgctgaactgtatgtgttcaagtggacgacggtgctgatcccgcctacgacaatccttgtgctcaacctcgtcggcgtggtggctgggttctcggacgcgctcaatagcgggtatgagtcatgggggccgcttttcggcaaggtgttcttcgccatgtgggtgattatgcacttgtacccgttcctcaagggtctcatgggccgccagaaccggactcctaccatcgtcatactctggtccgtcctgctggcctcggtcttctccctcctctgggtcaagatcgatccctttatcaccggtgccgagaccgtcgccacgggagcctgcagcagcatcgactgctgagcaactgccactgcttggaggtccaggcaattgtttgctggttagcggatgtgtgtatttgatcaatgtaaagacctttgcccaccattacagaggtgatgtcggctactattttgtgtcgattttttcattgctgttgactctcttatggaaagttttgatgttaaagctgctggaattgtgagcggccaaagttgaagttcttgtaaagcatatgtacttgtagaaggaaacatgtacttccatgnacagagagaacaaaaaaatggcatnagagca

SEQ ID NO: 19003 - DNA, 761 bp, Triticum aestivum
  Clone ID: PAT_TA_19003
gaaaagaacttctatataacagcaatagctggagcaaccaatggaagctcattggttgtgatgtccaaaggaactccgtacacacagcagtcatacaaagtcagtgaatctttgggcttataagtggattaataaaaagtggaaagaaggttttcatgtaacagggcatgggtactgctgggaaccgttggggagttgtcatgtcgaggaatgcgggctactctgaccaggttgtagagttggattttctgtatccaagtgaaggactccatcggcgatgggagagtggttacagaataacttcatccgcaggcacacctgaccaagctgcttttatcttgagcataccaaagaggaagccactggacgagacccaggaaacccttcgaacttctgccttccccagtaaccacgtgaaggaaaagtgggcgaagaacctgtacatcgcctcaatctgctacgggcgaaccgcgtgttgacggcgtacttgagctcgttggcgaaatcacccgagttttatgactggagccagaagagagttcgagacgggacaaactcagcgtcaaccttattatctaggtttcgagcgcaattggctgggcactggcactggcccggcctcttttggttggcggcacgctattctaattgtaaagaatctcgcgaagatccttggtgttgttgtatcagtcctcatcggatcgatatgaacctgttgataagcgaaggtcatattattggcagatttgctgttgctcaaa

SEQ ID NO: 19004 - DNA, 609 bp, Triticum aestivum
  Clone ID: PAT_TA_19004
cggacgtttggggcatttctagctttaggtcgcaacaagctccgaaggaagaagcaagcgccccagttatccaggtcagaagaagaggtgcagggctgatctcgttctcgctactggttttgcttgctgccatcctgtggacctttgctgctggcaccgggtacgcaatcaagttctgcaaggggctatggaaaccctctacatgacaggatgagaggcaaacctttctcgacttatcccggtggctgatcatcgttagaactcaagtctgtcctcagctgttagtcattgttttgctatcattcccattggaaaaaggcgaagagttagaagcatttccaaagaagtgtgatttgaggtgttagttttcagctcatgcaggaggctcggaaaaccgaaaaaaaatgaaaaaaataactgatggtaatatatataactactaccagtacttagctattgccctcgtgtgggtgtcagacatcgtatgccggatgtaattaaaccacgaagagggatgcgacttatgtgcatagtattaatattatagaattattatgatttcgctcaaaattcatgataatgtgtgcctgtttaggtgtttaaaaaaaa

SEQ ID NO: 19005 - DNA, 722 bp, Triticum aestivum
  Clone ID: PAT_TA_19005
gattcatccaagccagagttgagcaatactagcagtgagatttggcccttccgatcgagtgatttcagttcgtgtttgttagtgagagagaagacaagcggagatggcctccaaccagaaccaggcgagctacatggccggcgagaccaaggcccgcaccgaggagaagaccgggcagatgatggacaaggcgggccaggccacggaggccaccaagcagaaggccggcgagacggccgaggccaccaagcagaaggccggcgaggccaaggacaagacggcccagacggctcaggcggccaaggaccgcgccgccgagagcaaggaccagaccggcagcttcctcggcgagaagactgaggcggccaagcagaaggcgtcggagacggcgcagtacgcgcaggataggtcctccgacgccgcgcagtacaccaaggaatccgccgttgccggcaaggacaaaaccggcagcgtgctccagcaggccggcgagacggtggtgagcgcggtggtgggcgccaaggacgcggtggcgaacacgctgggcatgggcggtgacaacaccaccaaggacaccaccaccaggaatcactagatgcatgcgttcgcgcttaatttgctttcctttagtcgtgtttggtcgttcacgagccttctactatgtttccactctttcgtgattttccgctcatttagtgtaagtttgccgccgatttgatcta

SEQ ID NO: 19006 - DNA, 1366 bp, Triticum aestivum
  Clone ID: PAT_TA_19006
gcgtggtcgcggccgaggtataaatatggatgtgccttgctatacaaatcacaggaggagaccgatcctttgggtaatgttccaaagagtgcaccagatgaagaaccagcgaagagcataacaaataaagatagtggaaactcaaaggcatccagcagcaatgtcaaagatgacgatccatcttcagacaaaggtggtcttgaagaaggtcaaaactcaaatgagaaagatcaggaggatgtagatggtgagagtgacaaggatggtgatgagatggcgggagaagaagatgattctgatttggatctagcctggaaaatgttagatattgcaagggcaatagtggagaagaacccagacaacactatggagaaagtgaaaatcttttctgctctagctgaagtctccatggaaagagaggacatagacaactcacttggtgactacttcaaagctttggccatcttggagcatttggttgagcctgaccatcgtcgaattgttgaactacacttccgcatttgtttggtctatgagttggcatctaagattgcagatgcgatcccatattgtgcaaaggctgtttcattgtgcaagtcacgtttagagagcctgaaaaaagcgaaggaaaccttgttggctgataaaggtgacagtgcatctactgctgatggagactcaaagaaattgtctattgaagatgagctggaggttgttactggtatattgcctgaccttgagaagaagcttgaagacctggagcaagcaattgcaaccccaagctctgaaatagaggagattatgaaaagcattgccgcaaaggcagggtttatgcagaaggctggcaatgctgtggcgccaagagctgcatctttgacttcttcacaaatgggtggagtaaacaatggctttgactccccaacaatgtctacagcagcaacatctggaagcactggaagtactgttaccgacctcggtgttgtaggcagaggcatcaagcgagctaatatcaagcctatttctgctgagccttgttcgaagagactggcagcagatgattcactgtctgtgaaatgcgacagcagcaacaactcagatgttcaccccacggtgcaagatggtgagggttccgtatcaaagtagagttcattttcgttcgccctacatggtgttagtaacttgctggaatctgtgagctccatatttggccctgtttagcttcatgcaaacttagagtcgttaaaatgtttgtgaattgtgggaaccatcttctcttaagttgtactagtaacttgaactggtgataagtttatcaagcgtgacagttgtttggtgtctgatgcgtgtaaaggtgatttgtgctttt

SEQ ID NO: 19007 - DNA, 646 bp, Triticum aestivum
  unsure (1)..(646): unsure at all n locations
  Clone ID: PAT_TA_19007
cagtggttggcctcccgacccctatcttctctcccactaatcccccccattcccctcgctgccgccgccgccgccgccgtcgtcgcctgcccaagatgaatgtcgacaagctgaagaagatggccggtgccgtgcgcaccgggggcaagggcagcgtgcgcaggaagaagaaggccgttcacaagaccacgaccactgatgacaagaggcttcaaagcaccttgaagagagtaggagtgaacaccattcctgggtattgaagaggtcaacattttcaaggatgacgttgtcatccaatttcaagaaccccgaaagtgcaagcatcaattgccgcaaacacatgggtagtccagttgggaacaccaacaagacgaaaaagctgcaagatttactggccgacaattatcaaccaactggggccccggataacttgggacaacctgcgaagcttgcggagcattcccagaacagatgcctggtggtgaagctggcggcgccagcatcgggtgctgcccaaggacgatgatgacatgtccaagagctcgtccaaggagagacctcgaagagccagagagaanaggaccgangcaagaagaacganccgaggaganaaatctctatctgtacgcatcgtgtgtnaggttct

SEQ ID NO: 19008 - DNA, 1586 bp, Triticum aestivum
  unsure (1)..(1586): unsure at all n locations
  Clone ID: PAT_TA_19008
cgtccggtccgcccacggtctaatccgattcaaacgcaccgcttcctcgtgtccgaactaagccccaatcccaccaccaccgccgctggtgagcgtccgttcattctcaacctccttcccccctccgtcgatcgcgatcgtcgatcagatcgtgtccaaaatctcggaaggttttgggttgggttgggctgctgcgtcgtgtggcttctgacgatctctcggcccggttggatctgcgtgtgcaggtgctcggcgcgatggcgcagaaggacgccgccaatggcaacggcgccaccacgcgcccgccgcccactccctcccccatccgcttctccaagttcttccaggccaacatgcggatcctggtgaccggcggagctggcttcatcggctcgcacctcgtcgacaagctcatggagaacgagaagaacgaggtcattgttgctgacaactttttcactgggtcaaaagacaacctgaagaagtggatcggacacccaagatttgaactcatccgtcacgatgtcaccgaaccactgctcgtggaggttgaccaaatctaccaccttgcttgccctgcctcaccaatcttctacaagcacaaccctgtcaagaccatcaagacgaatgtcattggaaccttgaacatgcttgggacttgcaaagagagttgggagctagaatattgttgacttccgacctctgaagttatgggtgatcccctttgagcatcctcaagacggaggcgttactgggggcaatgttaacccaattnggagtccaggagctgctacgatgagggtaagcgttttacttgaacactggatgttccgactaccaacaggcagcacggattgagattccgtattgcccaagattttcaacacctatgggcctaggatgaacattgatgatggccgtgttgttagcaacttcattgctcaggctgtgcgcggtgagcccctgactgtccagaggccaggaacacagactaggagtttctgctatgttgccgatatggttgatggtcttattaagctgatgaatggaaacaagactggaccgattaacttggggaacccaggtgaattcaccatgctggaacttgctgagaatgtgaaggagttgattaacccagatataacagtgacgatgaccgagaacactcctgatgatccccgccagaggaagccggacatcaccaaggcaaaggaattctagggtgggagcccaagatcgtcctgaaggacggcttgggtgctcatggaggatgattccgggagcgcctggcgttcccaaagaaaaccaaggcctaaactgccctgcngtgggcgaagaatatccacgggggagcataccatagtggctttgtcattattccgtggccacatttcattacngatttngantcccaataaacggatatacttcttcnattaccttgaaggattgtatcattaaattttcatacaggctggctttttanctctgcctaccaccaaatttgtggtcctgtgtttgtacctaaanttccccntgagccattannaaatttannccatttancttttgttcacaaaaaaaaa

SEQ ID NO: 19009 - DNA, 1216 bp, Triticum aestivum
  unsure (1)..(1216): unsure at all n locations
  Clone ID: PAT_TA_19009
ccgcatataacacctccatgtccgtctccgtctccgccgccgcatcttcctccctgcctcccctcctcgcccgccgccgctcgccgccggcgtccctcgccccggtccggagtctccggtcccggtcccgcctcctctcctccgcgcgcacgacccccgtcctcctccccgccgccgcgatggccgccccggcccccgccgcctcctcgaagagggacctgctcatcttcgacgccgaggagaacctcgcggtggccctggccaagtacacggcggatctctccgcgaagttcgccgccgagaggggcgccttcaccgtcgtgctctccggcggatccctcatctacgccctcaggaagctaacggaggcgccgtacctggagacggttgactggagcaagtggcatgtgttctgggtagacgagagggtcgtgcccaaggaccatgaggatagcaactacaagctcgccctcgatgggttcctctccaaggtaccaattcctgctggtcaagtgtatgctatcaatgatgccttgtctgctgagggagcagcagaggactatgaaactatcttgaagcaacttgttaagaatggcgtccttgcaatgtcaaagacaactgggtttcccaggttcgatctccagcttcttggcatgggcccggacggccacatcgcctctctcttcccaggccatcctcttgttaaagagaacacgaagtgggtcacccacatcttggactctccaaagccgccgccacagagaatcacgttcacgtttccggtgatcaactcgtccgcatatgtcgccatggtggtaactggggctgggaaagccggcgcagtgcagaaggcgatctcggacaagaagacttctgatttgctccctgttgagatggctatacttgatgatggagaattcacctggttcactgacaaggaggcggtgtcgatgctgcagaactagtgagtcccatggcggtctaagggtttaagctcgatcttaaaataaaagtgaatcccacggttgcattcctccctgggtgggtcacctgtacggtgaacttgagctttatgtagtgtattgttcagagtaatgtgtctcgggacactccctcggctaaagtcgggtttcaagcgttttangtaaataacatttggctgaggcattggcccaaccgggtgctcaaanttaatttccaaacctggtgctttttt

SEQ ID NO: 19010 - DNA, 1770 bp, Triticum aestivum
  Clone ID: PAT_TA_19010
gaaatctcccccctcgcccaaaccctcgccgccgccatggccgccgccacctcccccgccgtcgcattctcgggcgccaccgccgccgccatgcccaaacccgcccgccatcctctcccgcgccaccagcccgtctcgcgccgcgcgctccccgcccgcgtcgtcaggtgttgcgccgcgtcccccgccgccacctccgccgcgcctcccgcaaccgcgctccggccctggggcccgtccgagccccgcaagggcgccgacatcctcgtcgaggcgctcgagcgctgcggcatcgtcgacgtcttcgcctaccccggcggcgcctccatggagatccaccaggcgctgacgcgctcgcccgtcatcaccaaccacctcttccgccacgagcagggggaggcgttcgcggcgtccggctacgcccgcgcgtccggccgcgtcggcgtctgcgtcgccacctccggcccgggggccaccaacctcgtctccgcgctcgctgacgccctcctcgactccatccccatggtcgccatcacgggccaggtcccccgccgcatgatcggcacggacgcgttccaggagacgcccatagtggaggtcacgcgctccatcaccaagcacaactacctggtccttgacgtggaggatatcccccgcgtcatccaggaagccttcttcctcgcgtcctctggccgcccggggccggtgctggttgatatccccaaggatatccagcagcagatggccgtgcctatctgggacacgccgatgagtttgccagggtacatcgcccgcctgcccaagccaccatctactgaatcgcttgagcaggtcctgcgtctggttggcgagtcacggcgcccaattctgtatgttggtggtggctgcgctgcatccggcgaggagttgcgccgctttgttgagctcactgggattccggttacaactactctgatgggccttggcaacttccccagcgacgacccactgtctctgcgcatgcttgggatgcatggcactgtgtatgcaaattatgcagtcgataaggctgacctgttgcttgcatttggtgtgcggtttgatgatcgcgtgactgggaaaatcgaggcctttgcaagcaggtccaagattgtgcacattgacattgacccagctgagattggcaagaacaagcagccacatgtctccatttgtgcagatgttaagcttgctttacaggggttgaatgctctattaaatgggagcaaagcacaacagggtctggattttggtccatggcacaaggagttggatcagcagaagagggagtttcctctaggattcaagacttttggcgaggccatcccgccgcaatatgctatccaggtactggatgagctgacaaaaggggaggcgatcattgccactggtgtagggcagcaccagatgtgggcggctcaatattacacttacgagcggccactgcagtggctgtcttggtctggtttgggggcaatgggatttgggttaccagctgcggctggcgctgctgtggccaagccaggagttacagaagtggccattggtggagatggaagctgcctcatccacattcttgattaggccgtcaggccggattgaaaaaatatcagggttggggagggctattgatacaacctttgtgtggggaacggtggtgcaaatgtgaggataaggttattcaagggccagtcggacggcaaaaattcccttggcaatcccaaaacatagtgtggtggggatattttcttc

SEQ ID NO: 19011 - DNA, 1449 bp, Triticum aestivum
  unsure (1)..(1449): unsure at all n locations
  Clone ID: PAT_TA_19011
tctgccatttttaaccttcgcgaaattgacaactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagcttggttggatctatggttcagttacagaggatattctgactgggtttaagatgcattgccgtgggtggcgatcaatctactgcatgccgataagacccgcattcaagggatcagccccaatcaacctttccgatcgtttgcaccaggttcttcggtgggctctcggttctgttgagatcttcttcagccggcattgcccgctgtggtatggctacggcggtggccgtctcagatggctccagaggctgtcctacatcaacaccatcgtctaccccttcacctctgttcctctcgtcgcatactgctgcctgcctgccatttgcttgctcactggcaaattcatcattccaatcctctccaatgccgcaacaatatggtttcttggtctcttcacctccatcatcctgacgagtgtcctggagctgcggtggagcggcattggcatcgaggactggtggcgcaacgagcagttctgggtcatcggaggcgtgtctgctcatctctttgccgtgttccagggtatcctcaagatggtcatcgggctggacaccaacttcacggtcacgagcaaggccgcggaggacggcgatttcgctgagctgtatgtgttcaagtggacgacggtgctgatcccgcccacgacgatcctggttctcaacctcgtcggcgtggtggccgggttctcggacgcgctcaacagcggctacgagtcatgggggccgctcttcggcaaggtgttcttcgccatgtgggtgattatgcacttgtacccgttcctcaagggtctcatgggccgccagaaccggactcccaccatcgtcatactctggtccgtcctgctggcctcggtcttctccctcctctgggtcaagatcgatccctttatcaccggtgccgagaccgtcgccaccggagcctgcagcagcatcgactgctgagcaactgccactgcttggaggtccaggcaattgtttgctggtcagcggatgtgtgtatttgatcaatgtaaaaacctttgtccaccattacagaggtgatgtaggctactattttgtgttcgattttttcactgctgttgactctcttatggaaagttttgatgttaaagccgctggaattgtgagcggccaaagttgaagttcgtgtaaagcatacttgtagaaaggaagcatgtacttctgtatagagataaaaaaagagtcngcaccagaggaacc

SEQ ID NO: 19012 - DNA, 1548 bp, Triticum aestivum
  Clone ID: PAT_TA_19012
tgctgcgccgcgtcccccgccttcacctccgtcgcgcctcccgccaccgcgctccggccgtggggcccctccgagccccgcaagggcgccgacatcctcgtcgaggcgctggagcgctgcggcatcgtcgacgtcttcgcctaccctggcggcgcgtccatggagatccaccaggcgctgacgcgctcgccagtcatcaccaaccacctcttccgccacgagcagggggaggcgttcgcggcgtccgggtacgcccgcgcgtccggccgcgtcggcgtctgcgtcgccacctccggcccgggggccaccaacctcgtctccgcgctcgccgacgctctcctcgactccatccccatggtcgccatcacgggccaggtcccccgccgcatgatcggcacggacgcgttccaggagacgcccatagtggaggtcacgcgctccatcaccaagcacaactacctggtccttgacgtggaggatatcccccgcgtcatccaggaagccttcttccttgcatcctctggccgcccggggccggtgctagttgatatccccaaggacatccagcagcagatggctgtgcccgtctgggacactccaatgagtttgccagggtacatcgcccgcctgcccaagccaccatctactgaatcgcttgagcaggtcctgcgtctggttggcgagtcacggcgcccaattctgtatgttggtggtggctgcgctgcgtctggcgaggagttgcgccgctttgttgagcttactgggattccagttacaactactctgatgggccttggcaacttccccagtgacgacccactgtctctgcgcatgctggggatgcatggcactgtgtatgcaaattatgcagtagataaggctgacctgttgcttgcatttggtgtgcggtttgatgatcgtgtgaccgggaaaatcgaggcttttgcaagcaggtccaagattgtgcacattgacattgacccagctgagattggcaagaacaagcagccacatgtctccatttgtgcagatgttaagcttgctttacaggggttgaatgctctattaaatgggagcaaagcacaacagggtctggattttggtccatggcacaaggagttggatcagcagaagagggagtttcctctaggattcaagacttttggtgaggccatcccgccgcaatatgctatccaggtactggatgagctgacaaaaggggaggcgatcattgccactggtgttgggcagcaccagatgtgggcggctcagtattacacttacaagcggccacggcagtggctgtcttcgtctggtttgggggcaatgggatttgggttaccagctgcagctggcgctgcatgtggccaacccaggtgttacagttgttgacattgatggtgatggtagtttcctcatgaacattcaggagttggcgttgatccgcattgagaacctcccagtgaaggtgatgatattgaacaaccagcatctgggaatggtggtgcagtgggaggataggttttacaaggccaatcgggcgcacac

SEQ ID NO: 19013 - DNA, 663 bp, Triticum aestivum
  Clone ID: PAT_TA_19013
gtttcatgcgaggtggagggggagggacagggggcgcttataaatacggctcagatctgggagggctttccacctcgcctcgtcgtccgcccacggtctaatccgattcaaacgcaccgcttcctcgtgtccgaactaagccccaatcccgtcaccaccgccgctggtgctcggcgcgatggcgcagaaggacgccgccaatggcaacggcgccaccacgcgcccgccgcccactccctcccccatccgcttctccaagttcttccaggccaacatgcggatcctggtcaccggcggagctggcttcatcggctcgcacctcgtcgacaagctcatggagaacgagaagaacgaggtcattgttgctggaacttgccgagaatgtgaaggagttgatcaacccagaagtgacagtgacgatgactgagaacactcctgatgaccctcgccagaggaagcctgacatcaccaaggccaaggaggttctcgactgggagcccaaggtcgtcctgcgcgacggcttggtgctcatggaggacgatttcagggagcgtttgggcagtgccccaagaagaccaaggcctaattcccctccctacgtttggcgtacaacatcaccaatttgccagagcatactcatagttgggtgggttcgtcaatatt

SEQ ID NO: 19014 - DNA, 1309 bp, Triticum aestivum
  Clone ID: PAT_TA_19014
cgtccgcccacgcgtccgcacaccccgcatataacatgtccacctccatgtccgtctccgtctccgccgccgcatcttcctccctgcctcccctcctcgcccgccgccgctcgccgccggcgtccctcgtcccggtccggagcctccggtcctgcccccgtccccgcctcctctcctccgcgcgcacgacccccgtcctcctccccgccgccgcgatggccgccccggcccccgccgcctcctcgaagagggacctgctcatcttcgacgccgaggagaacctcgcggtggccctggccaagtacacagcggatatttccgcgaagttcgccgccgagaggggcgccgtcaccgtcgtgctctccggcggatccctcatctacgccctcaggaagctgacggaggcgccgtacctggagacggttgactggagcaagtggcatgtgttctgggtagacgagagggtcgtgcccaaggaccacgaggatagcaactacaagctcgccctggatgggttcctctccaaggtaccaattcctgctggtcaagtgtatgctatcaatgatgccttgtctgctgagggagcagcagaggactatgaaactatcttgaagcaacttgttaagaatggcgtccttgcaatgtcaaagacaactgggtttcccaggtttgatctccagcttcttggcatgggccctgacggtcacatcgcctctctcttcccaggccatcctcttgttaaagagaacaagaagtgggtcacccacatcttggactctccaaagccgccaccacagagaatcacattcacgtttccggtgatcaactcgtccgcatatgtcgccatggtggtaactggggctgggaaagccggtgcagtgcagaaggcgatttcggacaagaagacatctgatttgctccctgttgagatggctatacttgatgatggagaattcacctggttcaccgacaaggaggcggtgtcgatgctgcagaactagtgggtcccatggcggtctaagggtttaagctcgtacttgaaataaaagtgaatcccacggttgcattcctccctggtgggtcacctgtaaggtgaacttgagctttatgtacgtactgtagtatattgtttcagagtaatgtgtttcagacaccccctcggcttccagcgtttagtaaataacatttgttgaggcattgcccaacgggtgctcagattatttaccaaacttggtatttctaaatgttacggccccgtgactatgaaatgccatgcctgttgcatcctgttactgtcatgttccaaggt

SEQ ID NO: 19015 - DNA, 1060 bp, Triticum aestivum
  Clone ID: PAT_TA_19015
tgcaggattcggcacgaggccactccaagcacagtcgagcagaagcctaaagcgagtgagatttcccccttcccgttgattccaggtcgtgttccaagaaaccaaaatggcctccaaccagaaccaggccagctaccacgccggcgagaccaaggcccgcaccgaggagaagaccgggcaggtgatgggcgcgaccaaggacaaggcggggcagaccacggaggccacgaagcagaaggccggcgagaccacggaggccacgaagcagaaggccgccgagaccacggaggcggccaagcagaaggccggcgagacggccgaggccaccaagcagaaggccgccgaggccaaggacaagacggcgcagacggcgcaggcggccaaggagaagacgtacgagacggcgcagtcggccaaggagcgcgccgcccagggcaaggaccagaccgccagcaccctcggcgagaagacggaggcggccaagcagaaggccgccgagaccacggaggcggccaggcagaaggccgccgaggcgaccgaggcggccaagcagaaggcgtcggagacggcgcagtacaccaaggagtccgccgtcgccggcaaggacaagaccggcagcgtcctccagcaggcaggggagacggtggtgaacgccgtggtgggcgccaaggacgccgtggccaacacgctgggcatgggcggggacaacaccaacaccaccaaggacaacaccaccggcgccaccaccaaggacaccaccaccaccaccaggaatcactagacgcatgtgttcccgcttaatttgctttgctttagtagtgtttggtcgttcgcgggccttctacatatttgtatgtttccactctttcgtgatttcagctcatttggtgtaaaagtttgccttcgatttgatgtactcctcgtgtccggttctgtattagtacgagttatggtccatatactttggtgtaaatggatatcgaggacactcgaaggcggcaataaagtgtatttctttattccgatggtatacattccttcccctccaaaaaaaaaaaaa

SEQ ID NO: 19016 - DNA, 1129 bp, Triticum aestivum
  Clone ID: PAT_TA_19016
gcgcgtgtcctccctacgtggcggccatgtacgagcaccgccgcgcaacgtggctcacagcttctgcctataaaggccacctgctccaacctccttaccatatcacaagaagccgaaccattccaagtactgtcgagcagaagcctaaagcgagtgacatttcccccttccgagctagttcaagaaaccaaaatggcctccaaccagaaccaggccagctaccacgccggcgagaccaaggcccgtacagaggagaaagaccgggcagatgatgggcgcgaccaaggacaaggccgggcagaccacggaggccaccaagcagaaggccggcgagacggccgaggcaacgaagcagaagactggccaggccacggaggctaccaagcagaaggccggcgagacggccgatgccaccaagcagaaggccgccgaggccaaggacaagacggcgcagacggcgcaggcggccaaggagaagacgtacgagacggcgcagtcggccaaggagcgcgccgcccagggcaaggaccagaccgccagcaccctcggcgagaagacggaggcggcgaagcagaaggccgccgagaccacggaggcggccaggcagaaggccgccgaggcgaccgaggcggccaagcagaaggcgtcggagacggcgcagtacaccaaggagtccgccgtcgccggcaaggacaagaccggcagcgtcctccagcaggccggcgagacggtggtgaacgccgtggtgggcgccaaggacgccgtggccaacacgctgggcatgggcggtgacaacgccaccaaggacaccaccaccggcgccaccaccaaggacaccaccaccaggaatcactagacgcatgcgttcgcgcttgatttgctttcctgtagtcgtgtttggtcgttcgcgggccttctacatattttgtatgtttccactctttcgtgatttcagctcatttagtgtaagtttgccttcgatttgatgtactactcgtgtccggttctgtaatagtattgagttattattatgatccatgtactttggtgtaatgtgtaattcctttattccgatatagtatacattacttctaccgcggaaaaaaaaaaaaagtcgacgcggccgcga

SEQ ID NO: 19017 - DNA, 1430 bp, Triticum aestivum
  Clone ID: PAT_TA_19017
ccccacaccccgcatataacacatgtccacctccatgaccgtctccgtctccgccgccgcatcttcctccctgcctcccctcttcccccgccgccgctcgccgccggcgtccctcgtcccggtccggagcctccggtcccgcccccgcccccgcccccgcctcctctcctccgcgcgcacgacccccgtcctcctccccgccgccgcgatggccgccccggcccccgccgcctcctcgaagagggacctgctcatcttcgacgccgaggagaacctcgcggtggccctggccaagtacacggcggatatttccgccaagttcgccgccgagaggggcgccgtcaccgtcgtgctctccggcggatccctcatctacgccctcaggaagctgacggaggcgccgtacctggagacggttgactggagcaagtggcatgtgttctgggtagacgagagggtcgtgcccaaggaccatgaggatagcaactacaagctcgccctcgatgggttcctctccaaggtaccaattcctgctggtcaagtgtatgctatcaatgatgccttatctgctgaaggagcggcagaggactatgaaactatcttgaagcaacttgttaagaatggcgtccttgcaatgtcaaagacaactgggtttcccaggtttgatctccagcttcttggcatgggccctgacggtcacatcgcctctctcttcccaggccatcctcttgttaaagagaacaagaagtgggtcacccacatcttggactctccaaagccgccaccacagaggatcacattcacgtttccggtgatcaactcctccgcatatgtcgccatggtggtaactggggctgggaaagccggtgcagtgcagaaggcgatttctgacaagaagacttctgatttgctccctgttgaaatggctatacttgatgatggagaattcacctggttcaccgacaaggaggcggtgtcgatgctgcagaactagtgagtcccatggcgatccaaggtttaagctcgatcttaaaataaaagtgaatccgacggttgcattcctccctggtgggttacctgtaaggtgaacttgagctttatgtagtactccctctgttccatattagttgtcgctcaaacagatgtacctagcactgaaatacgtctaaatacatccgttttagcgacaactagtaatatggaacggaggaagtatattatttcagagtaatgtgtttcagacactccctcaacttccagcatttagtaaataacatttgctgaggcattgcccaacgggtgctcagattatttaccaaacttgtgcttttaaatgttacggcccccgtgcaatgtctgttgcattctgttactgtcatgttccaaggtgatttgtgatccgaaattgctatccggacgactttatatgc

SEQ ID NO: 19018 - DNA, 905 bp, Triticum aestivum
  Clone ID: PAT_TA_19018
cccctttcgcagtggttggcctcccgacccctatcttctcccccactaatccccccattcccctcgccgccgccgccgccgccggcgtcgcctgcccaagatgaatgtcgacaagctgaagaagatggccggtgccgtgcgcaccgggggcaagggcagcgtgcgcaggaagaagaaggccgttcacaagaccacgaccacctatgacaaggggctccaaagcaccttgaaaagagtaggagtcaacaccattcctggtattgaagaggtcaacattttcaaggatgatgtagtcatccaatttcagaacccgaaagtgcaagcatctattgctgcaaacacatgggttgtcagtggaacaccacagacgaaaaagctgcaagatttactgccgacaattatcaaccaactgggccctgataacttggacaacctgcggaggcttgccgagcagtttcagaagcagatgcctggcggtgaggctggcggcgccagcatcggtgctgcccaggacgacgacgacgacgttccagagctcgtcccaggagagacctttgaggaggcggcagaggagaagaaggaacccgaggcgaagaaggaagcggagccggaggagaagaaagagtcgtcgtcgtaatcttgtcacgccattcattgttgtgaagggttccttgttggttgagggttgattggcatcttattactgtatatgccggagacatggtcctgtgagatctctggcccgtctttcatttctagcgcccctccggttggttttgtctcggccgtgggttctgtccgaaccaccgacggcggaaccgagtttgacgacaattatcgtttacctttcaaatgtgtttgatatgcacagttccagtgtttgatggataggcgtcgttctcgga

SEQ ID NO: 19019 - DNA, 981 bp, Triticum aestivum
  unsure (1)..(981): unsure at all n locations
  Clone ID: PAT_TA_19019
agccgatccattccaagcacagtcgagcagaagcctaaagcgagtgacatttcccccttccgagctagctcaagaaaccaatatggcctccaaccagaaccaggccagctaccacgccggcgagaccaaggcccgcaccgaggagaagaccgggcaggtgatgggcgcgaccaaggacaaggcggggcagaccacggaggccaccaagcagaaggccggacagaccaccgaggccaccaagcagaaggccggcgagacggccgaggcaacgaagcagaaggccggtcaggccacggaggccacgaagcagaaggccggcgagacggccgaggccaccaagcagaaggccgccgaggccaaggacaagactgcgcagacggcgcaggcggccaaggagcgcgccgccgagaccaaggaccagaccggcagctacctcggcgagaagacagagatggccaagcagaaggccgccgagacgaccgaggctgccaagcagaaggcctcggagacggcgcagtacaccaaggagtccgccgtcgccggcaaggacaagaccggcagcgtcctccagcaggccggcgagacggtggtgaacgccgtggtgggcgccaaggacgccgtggccaacacgctgggcatgggcggcgacaacgccaccaaggacaccaccaccggcgccaccaccaaggacaccaccaccaccaccaccaggaatcactagacgcatgcgttcgcgcttgatttgctttcctttagtcctgtttggtcgttcgcgggccttctacatatttgtatgtttccactctttcgtgatttcagctcatttagtgttaagtttgccttcgatttgatgtactactcgtgtccggttctgtaatagttaaagagttacgatccatgtgctttggtgtaaatgtataacgaggacactcgaaggcggcaataaagtgtatgtggtcgattttnctttaaaaaaaacct

SEQ ID NO: 19020 - DNA, 1481 bp, Triticum aestivum
  Clone ID: PAT_TA_19020
ccacgcgtccggaacctttctccttctgtcccgcaaacccccgagagatcacaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccacccgtcgtcctctgggagtgggccaagggcgacaaccagagctggaagatcctcccctggggcgaagaggcctacgccggaggcagcgccaacgccccccgcggcggctcctcagagccccaccgtgcgcatcttctgcaaggcagacgacggcttcagcggccaccgtccgcaacgggcgcttgtggtcctcgcgcccaccaacccccgcgacgaagtaccagcactggttcaagggacatgaggcacagcaaccgcatcaaggacgagggaaggctacccggccttcgccctcgtcaacaaggtgacagggcgaggccatcaagcactcccaaggcgagggccacccttgtgaagctggtgccatacaacgccaactaccaggacgagtcagtgttgtggactgagagccgcgacgtgggcgccggctttccggtgcatccgcatggtgaataacatctacctcaactttgacgctcttcacggcgacaaggagcacggcgggcgtgcgcgacggcaccttcctcgtgctgtggaaagtggtgcgagggcgacaaccagcgctggaagatcctttcctggtgtaagtgccccctcactcgctcccattttcttgctagtggagaacactgacaccatctccataaacgggtggagtagtcggtagaagcggatggagttagcttatctgccatcttttcaattatttgcgttcccttttggcaaaaatattaatgtgtttttatcgttgcttgtgtttgcagaaacgtgtcatgctgctgaagctgagttgatcgccaccgtgacccggagtttggtagagatcggcctgtgatctgttgccgtgtcggtagaataaaagtcgtgtgcggtcggcggtggtgatgtgtccgtgagtgtgtgtgcttagtttctgtcctgtcgttgtgtcctgctatggcgagctatccgatg

SEQ ID NO: 19021 - DNA, 887 bp, Triticum aestivum
  Clone ID: PAT_TA_19021
taatgaagtcccttttcgcagtggttggcctcccgacccctatcttctctcccactaatcccccccattcccctcgccgccgccgccgccgccgccgtcgtcgcctgcccaagatgaatgtcgacaagctgaagaagatggccggtgccgtgcgcaccgggggcaagggcagcgtgcgcaggaagaagaaggcagtgcacaagaccacgaccactgatgacaagaggcttcaaagcaccttgaagagagtaggagtgaacaccattcctgatattgaagaggtcaatattttcaaggatgacgttgtcatccaatttcagaatccgaaagtgcaagcatcaattgccgcaaacacatgggtagtcagtggaacaccacagacgaaaaagctgcaagatttactgccgacaattatcaaccaactgggcccggataacttggacaacctgcgaaggcttgcggagcagttccagaagcagatgcctggtggtgaggctggcggcgccagcatcggtgctgcccaggacgatgatgacgatgtcccagagctcgtcccaggagagaccttcgaagaggccgcagaggagaagaaggaacccgaggtgaagaaggaagcggagccggaggagaagaaagagtcgtcgtaatcttgtcacgccattcattgttgtgaagggttccttgttggttcagggttgattggcatcttattactgtatatgccagagacatggtcctgtgagaactctggcccatctttcatttctagcgctcctccggttggttttgtctcggcccgtgggttctgtcccgaaccgacggcggaactgagttttacgacaattatcgtttaccattccaaagtgtttaatatgcgcagttccaat

SEQ ID NO: 19022 - DNA, 1476 bp, Triticum aestivum
  Clone ID: PAT_TA_19022
gcgcagtttctcatcgccccgtccagaacctttctccttctgtcccgcaaacccccgagagatcacagcatgttcggcttcggtcaccacggccaccatggccagaacccccctgccaacgctccggccgccggcggcggcaaccagcccaccttcaagatcttctgcaaggccgacgagggctactgcctctccgtccgcgacggcaacgtcgtcctcgccccctccaacccccgcgacgagcaccagcactggttcaaggacatgcgcttcagcacccagatcaaggacgaggaaggtaaccccgccttcgccatcgtcaacaaggccactggtctcgccgtcaagcactccctcggccagtcccacccggtgaagctcgtgccattcaacccggagtacctcgacgagtccgtgatgtggacggagagcggcgacgtcggcaagggcttccgctgcattcgcatggtgaacaacatccgcctcaactttgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgccccccgcggcggctccacagagcccaccgtgcgcatcttctgcaaggccgacgacgggcttcagcgccaccgttcgcaacggcgctgtggtcctcgcgcccaccaacccccgcgacgagtaccagcactggttcaaggacatgaggcacagcaaccgcatcaaggatgaggaaggctacccggccttcgccctcgtcaacaaggtgacaggcgaggccatcaagcactcccaaggcgagggccacccggtgaagctggtgccatacaacgccaactaccaggacgagtcagtgttgtggactgagagccgcgacgtgggcgccggcttccggtgcatccgcatggtgaacaacatctacctcaactttgacgctctccacggcgacaaggagcacggcggcgtgcgcgacggcacctccctcgtgctgtggaagtggtgtgagggcgacaaccagcgctggaagatcctcccctggtaaacgtgtcatgctgctgaagctgagttgatcgccaccgtgacccggagtttggtagagatcggcctgtgatctgttgccgtgtcggtagaataaaagtcgtgtgcggtcggcggtggtgatgtgtccgtgagtgtgtgtgcttagtttctgtcctgtcgttgtgtcctgctatggcgagctatccgatgtaataagcatttggcacttgtgcttgtttttcaaaccatggatccgtgatgacaacctctgtactgtggtgcaatcctttcatctatgcgaatggtctttattgtccaaaaacaaaaaaaaaaaaaaaaaaaaactcgagggggggcccggtacccaattcgccctatagtggg

SEQ ID NO: 19023 - DNA, 1625 bp, Triticum aestivum
  Clone ID: PAT_TA_19023
agatcacaccatgttcggcttcggtcaccacggccaccatggccagaaccccccggcccacgctccggccgccgccggcggcaaccagcccaccttcaagatcttctgcaaggctgacgagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgaccgccctcaacggcgacaaggacccacggcggcgtgcacgacggcaccaccgtcgtcctctgggagtgggccaagggcgacaaccagagctggaagatcctcccctggggcgaagaggcctacgccggaggcagcgccaacgccccccgcggcggctcctcagagcccaccgtgcgcatcttctgcaaggcagacgacggcttcagcgccaccgtccgcggcttcagcgccaccgtccgcaacggcgctgtggtcctcgcgcccaccaacccccgcgacgagtaccagcactggttcaaggacatgaggcacagcaaccgcatcaaggacgaggaaggctacccggccttcgccctcgtcaacaaggtgacaggcgaggccatcaagcactcccaaggcgagggccaccctgtgaagctggtgccatacaacgccaactaccaggacgagtcagtgttgtggactgagagccgcgacgtgggcgccggcttccggtgcatccgcatggtgaataacatctacctcaactttgacgctctccacggcgacaaggagcacggcggcgtgcgcgacggcacctccctcgtgctgtggaagtggtgcgagggcgacaaccagcgctggaagatccttccctggtaaacgtgtcatgctgctgaagctgagttgatcgccaccgtgacccggagttggtagagatcggcctgtgatctgttgccgtgtcgttagaataaaagtcgtgtgcggttggtgatgtgtccgtgagtgtgtgtttagtttctgtcctgtcgttgtgtcctgctatggcgagctatccgatgtaataagcatttggcacttgtgcttgtttttcaaaccatggatcgtgatgagaacctctgtactgtggtgcaatcctttcatctatgcgaatggtctttttttttttttttttttttttgcaaacagagtcaatccatgccaaggaacccataagagctccaacgaagcgcacatacacacaccggtcagtcaaatacgagctgtccgagaaaaagaagaaatccctgacaggttcccgaatggtcctcgacgaattactggacaagccgtgtcccatacactctgtcctactagataaaagcccaactcacagccttcgagcctgctaggtggttaggcaaattgctaagagcggagagactatcctcggaggctcaccctcaatccgatgttcagcaacgcccttggatgacgacgccgagatcccatcacctttatgagaaagacgagccgaggtcccacactatccgggcacctgcttccct

SEQ ID NO: 19024 - DNA, 1748 bp, Triticum aestivum
  Clone ID: PAT_TA_19024
ctcgcctcgtcgtccgcccacggtctaatccgattcaaacgcaccgcttcctcgtgtccgaactaagccccaatcccaccaccaccgccgctggtgctcggcgcgatggcgcagaaggacgccgccaatggcaacggcgccaccacgcgcccgccgcccactccctcccccatccgcttctccaagttcttccaggccaacatgcggatcctggtgaccggcggagctggcttcatcggctcgcacctcgtcgacaagctcatggagaacgagaagaacgaggtcattgttgctgacaactttttcactgggtcaaaagacaacctgaagaagtggatcggacacccaagatttgaactcatccgtcacgatgtcaccgaaccactgctcgtggaggttgaccaaatctaccaccttgcttgccctgcctcaccaatcttctacaagcacaaccctgtcaagaccatcaagacgaatgtcattggaaccttgaacatgcttggacttgcaaagagagttggagctagaatattgttgacttcgacctctgaagtttatggtgatccccttgagcatcctcagacggaggcgtactggggcaatgttaacccaattggagtcaggagctgctacgatgagggtaagcgtgtagctgagacactgatgttcgactaccacaggcagcacggcattgagatccgtattgccaggattttcaacacctatggacctaggatgaacattgatgatggccgtgttgttagtaacttcattgctcaggccattcgtggtgaagcactgactgtccagaagcctggaacacagactaggagcttctgctacgtcgctgatatggtcaatggtcttatgaagctgatgaatggagacaacaccggacccattaacattgggaacccagggtgaattcaccatgctggaacttgccgagaatgtaaaggagttgatcaacccagaagtgacagtgacgatgactgagaacactcctgatgaccctcgccagaggaagcctgacatcaccaaggccaaggaggttctcgactgggagcccaaggtcgtcctgcgcgacggcttggtgctcatggaggacgatttcagggagcgcttggcagtgcccaagaagaccaaggcctaagcacccttccccatttggcgtacaacatcaccaatttgccagagcatactcatagttgggtgggttcgtcaatattcgttgctgcgtttccgttacggaatttgagttccaataaaccaattacaccttcgtcgttcacttgaaagattgtattattagaaacttcatacaaggcctggctgtttgtattaccgtcgctttttgcggaacttgtgctccttatgttttagcctatgcacttcttaaatcaattatagcacaagttccgcaaaaagcgacggtaatacaaacagccaggccttgtatgaagtttctaataatacaatctttcaagtgaacgacgaaggtgtaattggtttattggaactcaaattccgtaacgaaacgcagcaacgaatattgacgaacccacccaactatgagtatgctctggcaaattggtgatgttgtacgccaaacgtagggagggggattaggccttggtcttcaaagtaacgatgccggaaacacgacccggccaattaaggctaggagcgcgatgccggccgaagggtcgagtaggtcggtgctcgccgtgaggcggaccggccgaccc

SEQ ID NO: 19025 - DNA, 1924 bp, Triticum aestivum
  unsure (1)..(1924): unsure at all n locations
  Clone ID: PAT_TA_19025
tgggccgggtcggccggtccgcctcacggcgagtaccgacctactcgacccttcggccggcatcgccctcctagccttaattggccgggtcgtgtttccggcatcgttactttgaagaaattagagtgctcaaagccacccgcagcttccggcgccgacagggaacgataccccccccccccccccccccccgngccggcgacgcccatggactcctcctccgataacttcgtggcgccggtagacgagcgccaggacccaccgctcccgaaccctagcgaggaggaggcgggcggcgaggagaaagagcggggagaggagaaaaccctagagcgggcggaggagctgtttgacaaggggtccaaggccatcgaggagggggacttcgtcgtcgccgttgactgcctcagccgcgccctcgagatcagggttgaacgttatggagaacttgcttcagagtgtgctagcacgtattataaatatggatgtgccttgctatacaaatcacaggaggagaccgatcctctgggtaatgttccaaagagtgcaccagatgagaaccagcgaagagcacaacgaataaagatagtggaaactcaaaggcatccagtagcaacgtcaaagatgacgatccatcttcagacaaaggtggtcttgaaggtcaaaactcaaatgagaaagatcaggaggatgtagatggtgagagtgacaaggatggcgatgagatggggggagaagaagatgattctgatttggatctagcctggaaaatgttagatattgcaagggcaatagtggagaagaacccagacaacactatggagaaagtgaaaatcttttctgctctagctgaagtctccatggaaagagaggacatagacaactcacttggtgactacttcaaagctttggccatcttggagcatttggttgagcctgaccatcgtcgaattgttgaactacacttccgcatttgtttggtctatgagttggcatctaagattgcagatgcgatcccatattgtgcaaaggctgtttcattgtgcaagtcacgtttagagagcctgaaaaaagcgaaggcaaccttgttggctgataaaggtgacagtgcatctactgctgatggagactcaaagaaattgtctattgaagatgagctggaggttgttactggtatattgcctgaccttgagaagaagcttgaagacctggagcaagcaatggcaaccccaagctctgaaatagaggagattatgaaaagcattgccgcaaaggcagggtttatgcagaaggctggcaatgccgtggcaccaagagctgcatctttgacttcttcacaaatgggtggagtaaacaatggctttgactccccaactatgtctacagcagcaacatccggaagcactggaagtactgttaccgaccttggtgttgtaggcagaggcatcaagcgagctaatatcaagcctatttccgctgagccttgttcgaagagactggcagcagatgattcaccgtctgtgaaatgcgacagcagcaacatctcagatgttcaccccacggggcaagatggcgagggttccatatcaaagtagagttcattttcgttcgccctacatcgtgttagtaacttgctggaatctgtgagctccatatttggccctgtttagcttaaagcaaacttagagttgttaaaatgtttgtgaattgcgggaaccatcttctcttaagttgtactagtagcgtgaactggtgataagtttatcaagcgagacagttgttggtgtctgatgcatgtaaggcgatttgtgcttttccaaatgcgtgtttctacctatgtgatcttatttttttagtgattgctctctgtcataatctcttgtgccgcaattgagcaaggctatcttggcacatttcactggtt

SEQ ID NO: 19026 - DNA, 1490 bp, Triticum aestivum
  Clone ID: PAT_TA_19026
acctcgcctcgtcgtccgcccacggtctaatccgattcaaacgcaccgcttcctcgtgtccgaactaagccccaatcccgtcaccaccgccgctggtgctcggcgcgatggcgcagaaggacgccgccaatggcaacggcgccaccacgcgcccgccgcccactccctcccccatccgcttctccaagttcttccaggccaacatgcggatcctggtcaccggcggagctggcttcatcggctcgcacctcgtcgacaagctcatggagaacgagaagaacgaggtcattgttgctgacaactttttcactgggtcaaaagacaacctgaagaagtggatcggacacccaagatttgaactcatccgtcacgatgtcaccgaaccactgctcgtggaggttgaccaaatctaccaccttgcttgccctgcctcaccaatcttctacaagcacaaccctgtcaagaccatcaagacgaatgtcattggaaccttgaacatgcttggacttgcaaagagagttggagctagaatattgttgacttcgacctctgaagtttatggtgatccccttgagcatcctcagacggaggcgtactggggcaatgttaacccaattggagtcaggagctgctacgatgagggtaagcgtgtagctgagacactgatgttcgactaccacaggcagcacggcattgagatccgtattgccaggattttcaacacctatggacctaggatgaacattgatgatggccgtgttgttagtaacttcattgctcaggccattcgtggtgaagcactgactgtccagaagcctggaacacagactaggagcttctgctacgtcgctgatatggtcaatggtcttatgaagctgatgaatggagacaacaccggacccattaacattgggaacccaggtgaattcaccatgctggaacttgccgagaatgtgaaggagttgatcaacccagaagtgacagtgacgatgactggagaacactcctgatgaccctcgccagaggaagcctgacatcaccaaggccaaggaggttctcgactgggagcccaaggtcgtcctgcgcgacggcttggtgctcatggaggacgatttcagggagcgtttggcagtgcccaagaagaccaaggcctaattcccctccccgcgtttggcgtacaacatcaccaatttgccagagcatactcatagttgggtgggttcgtcaatattcgttgctgcgtttcgttacggaatttgagttccaataaaccaattacaccttcgtcgttcacttgaaagattgtattattagaaacttcaaacaaggcctggctgtttgtattaccgtcgctttttgcggaacttgtgctccttacgttttagcatatgcacttccctaaatcaattatagcaatgttcgtgccattttgggtttgttattaatttttttttgctgcaaagatatttctctgatgcttaaaaaaaaaa

SEQ ID NO: 19027 - DNA, 571 bp, Triticum aestivum
  unsure (1)..(571): unsure at all n locations
  Clone ID: PAT_TA_19027
tccggnnaattcccggcgtcgacnccacgcccgtccgacaacattctccccagtggtcagcagctcagaacaccccagaccaagttagcaatggcgaagcgcctcgccgtcgccctcctgctgctggtcctgctcgcgtccagcgacgccggtgctgctgcccgtgctgctattggcgtcggcgagaagaaggctctggtgcccgggctgccggtggacctccctctccctggcctccccgggctgcctgggctccctgggctccctgggctgccggggctccctgggctccctcccgttcccaaattgacggccaccaacaagtctccatgatcgtctgtggtgtacgtgctggctaacatgcaagctgaagctgaactacttgtgggtttagacttgcagctgtagcacgtaccggccggaagaaaatcaccggcgcttcgctcaagcgtctgtaccaactactatctttgtcgtgtgtatttccgttcagttaaaccatcgtgtgtatttcctttcagttaaactatcgtatgtatttcctttcagtccacgtaagtatggttggtac

SEQ ID NO: 19028 - DNA, 649 bp, Triticum aestivum
  Clone ID: PAT_TA_19028
cggccgctcgagccggcgggcgggactcgctgcgcaaacacaactaggagtacacaacaacatctccccagtggcccgcaactcggaacctcccagaccaagttagcaatggcaaagcgcctcgccgtcgcgctcctgctgctggtcctgctcgcgtccagcgacgccggtgctgctgcccgtgctgctagtggcgtcggcgagaagaaggctctggtgcccgggctgccggtggacctccctctccctgggctccctgggctgcctgggctccctgggctccctggcctgccggggctccctgggctccctcccgttcccaaatccaccgccaccaacaagtctccatgatcgtctatggtgtacgtacgtgctggcttacatgcaagctgaagctgctagcacgtaccggccggaagaaaatcaccggcgtttcgctcaagcgtctgtaccaactatcctgtcgtctgtacttcctttcagttaaaactatcgtatgtatttccttacagtccacgtaagtatgttttccctacttaacgacttccttgatgtgctgctacatgcatcatcaacggaataaataaaggatttgtcgatgtgatcgccttcttttggatagacaatgaacagatggcatcattggtat

SEQ ID NO: 19029 - DNA, 682 bp, Triticum aestivum
  Clone ID: PAT_TA_19029
gccggggccgcttccgaactaagctcacgcaaacacaactactccccagtggccagcaactctgaacctcccggaccaagttagcaatggcaaagcgcctcgccgtcgcgctcctgctgctggtcctgctcgcgtccagcgacgccggtgctgctgcccgtgctgctagtggcgtcggcgagaagaaggctctggtgcccggggtggacctccctctccctgggctccctgggctgcctgggctccctgggctccctggcctgccggggctccctgggctccctcccgttcccaaatccaccgccaccaataagtctccatgatcgtctatggtgtactacgtgctggctaacatgcatggctgaagctcaactacttgtgggtttagacttgcagctagcacgcaccggccggaagaaaatcaccggcgtttcgctcaagcgtctgtaccaactatcctggcgtgtgtacttcctttcagttaaaactatcgtatgtatttcctttcggtccacgtaagtatgttctccctacttaatgacctccttgatgtgctacatgcatcatcaacggaataaataaaggatttgtcgacgtgatcgccttcttttggatagaaaaaaaaaaaaaggcccctataccaaaaaaaaaaaaaaaaaaggcccctagggccgcggccgct

SEQ ID NO: 19030 - DNA, 1051 bp, Triticum aestivum
  Clone ID: PAT_TA_19030
gacccacgcgtccgcccacgcaaacacaacgacacaacatctcctgggtagtgattttataagaactcccagttagcaatggcgaagcgcctcgccgtcgcgctcctgctgctggtcctgctcgcgtccagcgacgcgggagagctgaatgggaagcacggtgctggtagtgccgtcggcgagatgaaggctccgttgcccgaccccgggttgccggcaccggttgtcgcgggggtactgccaccggttgtcgggacagcatcatcggttatcggggggggagtgcctggggtcactccccttcccgttcgcaaatccagcgccaacaagtctccatgatcatctatggttcatgtgctagcttacatacgaactgaagctcaactagttgtggctttagatctgcagctatagcacgtaccggccagaagaaaatcaccggcgtttcgctcaagcgtctgtgccaactacttactatctttgtcgtgtgtatttcctttcagtccaggtaagtatgtcttccctacttcacgacttccttgatgtgctacatgcatcaacggaataaataaataaaggatttgtcggtgtgatcgccttcttggatagaccttgaaaaaactcaacaagaacaagaagctcatcaaagaagctcgctcgcaagtacgaatgctttcgtcgcttccgaggctctgatcaagcagatcccccgtctcttggatcctggtctgtcagaaagttccctacccccgtttatactcccatgatcttaacgtacgtatcaacgagtcttgattgccgtcaagttacagctcaagatctgcatgagtgtggcggcaacgtcgatcaccagcttgttggtacatcggcccatctagtatcttgactcccttcagggagacggaagacttaccatcaaaacttccggggggggggccagcttctgttgctcctgctgcagctgctagatcgatcatcgaccatatgcatgcaccgtgccgtgcgtgcatcatcgatcatatagatctactactaccataccatgttaccg

SEQ ID NO: 19031 - DNA, 688 bp, Triticum aestivum
  Clone ID: PAT_TA_19031
acctcgcgcccgccgcggcgccaggcgccgcaaacacaactaagctcacgcaaacacaactactccccagtggccaacaactcggaacctcccggaccaagttagcaatggcaaagcgcctcgccgtcgcgctcctgctgctggtcctgctcgcgtccagcgacgccggtgctgctgcccgtcctgctaatggcgtcggcgagaagaaggctgtggtgcccgggctgccggtggacctccctgggctccctgggctgcctgggctccctgggctccctggcctgccggggctccctgggctccctccccttcccaaatccaccgccaccaacaagtctccatgatcgtctgtggtgtacgtgctggcatacatgcaagctgaatctgaactacttgtgggtttagacttgcagctagcacgtaccggccggaagaaaatcaccggcgtttcgctcaagcgtctgcatgtatcaactatcctgtcgtgtgtactgtcgtcagtatttcctttctgttaagctgtcgtatgtatttcctttcagtccacgtaagtattttccctacttcacagcttgcttgatgtgctgcatgcatcatcaacggaataaataaaggatttgtcggtgtgatcgccttcttttggatagacaaaaaaaaaaaaaaaaaaaaaaaaaaacccccctaggat

SEQ ID NO: 19032 - DNA, 714 bp, Triticum aestivum
  unsure (1)..(714): unsure at all n locations
  Clone ID: PAT_TA_19032
ccccagtccgcagcctgccccaaatcacaacctcatccaaatcgacctaccctacttccaccccggccacctccgccgccgagcaccttccgctgtggccgaccaccattcgccaccccaagcatcccaccgcagtgcctccccgactattgtcgccagccacccttcgcctcttcgtcccaaactatctgcacaaggacgggaagggagggagacccgatgggcggaggaggtcgaagccgttgcccacaccgcggatctgccgcggggatgcgggaagaaaggacgcggttgcgcggcccccggatccggcgaaggacgtgcgcaagaggcggccaacggggcgcggggcacaactccagatccgggcggcccgagcagagcgtgaagctaggaagcgggcatatgctttgggtggcccccttccgggccacccgccggcaccgatgggctgttttggcggcgggtgggggggccccccctctccctcccctgccagtgacgaggactaggccacaaaggccggaatctgccgcatctttgaggggttcgctcgggtgtcggctcagacgtcgggcaaccactacgccagccgcataggcaaggcgggaataagtanaacttaagataccnaggaagtgactcaaantattancacaaaaattccttgtnaaagaantaatnnttaccctnagttttgtttntaaaaatttt

SEQ ID NO: 19033 - DNA, 1262 bp, Triticum aestivum
  Clone ID: PAT_TA_19033
ctcattttcattcttggacatgtctggttgttctttaagcaacttatggcctgcaaaagatgaaaagtctagagcatttggaccttatcttgagcagagtaactgatggtgcaatcgagtatgttgcaaatattggaacgaagctgagatatctaagcctcaagaatactggaataacctctcaggcaccatgtattttggcaggaaccgttccaaacctggcttcactgtctttagcttatacaaaagttgatgattctgctctagtatatatcagcatgatgccttcattgaaagtgatagatctaagtcatacaagtatcaaaggtttcactcgtgttgaagcaaactccgagaaaatactgtctctgcctctacttgagcatctcatttatcttgaaagtctaagtctggaggatgcaccactgtcagatgaagttatacctcccatggcatcctttagagcactaaaatatttgtacctgaaaagtgatttcttgtctgatcccgcattgcaggccctgtcttctgcctcaaatttgatacatcttggattttgtgggagtgtattatcaaactctgggcttctgcaatttgtgccccctgcccaactacatgtgttggatttgagtggctgctgggtcttaacagagtatgccatctcatcatttcgtagccatcacccggtgatagaggtgagacatgaactaattcaggaacttcaaccaagccacattggtacttcacaagttcgcaagtctaggcatcttccacggggaaaaacaaatttttttaatagctcggctgattctagcaggcattctggtatcttctttgtagatcaaaggataaaatacagcagggagaaaatgctggagatccaagatcttacccaatcgaattcagtgttacatgatgtgcagcttccaccagagctgcgaaggatggaatgagacaagttctggtttacttttctcgcgcacttcagtctcatcatttgattaaatagtgcatctattttcttgggggacatcgcaattttgaattagctaaagacagcccgtcatttgattaaatagtgcttctctcactgtatactgccaactgtctgagttgtaacatgaagaatttgcttgtatgatttatatgcctttgtgatcctgaagtatgtattcagtcagttcatctgttttaacagagggcatttgtgttatattgtcaaatgtgaccatgggttcaaatggttgatgcattcaaaaaaa

SEQ ID NO: 19034 - DNA, 918 bp, Triticum aestivum
  unsure (1)..(918): unsure at all n locations
  Clone ID: PAT_TA_19034
cgataacagtgcaacgaaaaaatctctgctctgtgtcaagnaatcaagaacagagaaaggcgaatccatggctacgttcgcgacgtcgtcgccggcggtgatggtgtcggcccgccctgggcgggtggcaagggctcggcggtgcgtggtggcgcgagcgtccgcaacgatggcggcaccggcgacggtggccgcagggaggacgcactacgaggtgctcgggctaggcgccggggccggcaggggcgagatcaaggccgcgtaccgacgccttgccagggaagtgcaccctgacgccgtcggaggtggcggcgacgaggggttcatccggctgcacgaggcctacgccacgctcaccgatcctgaggagcgcgctcgctacgaccgagatgtgacctgccgcgccgcggggatgatgatgcggcgggcggctgcggccgggcatacgttcaagcggaggacgtgggagactgaccagtgctggtaggatgggcggactcacgcggctgccctccgggaccatcggccggtccgatcagggcacggcgcgtcatggaggcggcgcccgctggagagaagatcccgccgactgccttggaccgcctggtcagaattggacggctcagatcgggtgtgcggacgcaggagctctgtacacggcaagagtcgttttttaaagatctcttgtgcgtccggtcagcaaaatggaaatatgtaaatgaattagttatatatatactgtaaattaaaggccaatgaatatactagttttttaacaataactagtagagtgcccgtgcgttgctacgggcgacaatgtagataatcagcattcttatactcacaatgttttttttttctgcatgggtagttctgaaattttggtaagagtcaatagatcatgtatatgtttgaggc

SEQ ID NO: 19035 - DNA, 763 bp, Triticum aestivum
  Clone ID: PAT_TA_19035
caacagtgcaacgaaaaaatctctgctttgtgtcaaggaatcaagaacagagaaaggcgaatccatggctacgttcgcgacgtcgtctccggcggtgatgtggtcggctcgccccgggcgggtggccggggctcggcggtgcgtggtggcgcgtgcgtccgcgacgatggcggcaccggcggcgctggccacgggaaggacccactacgatgtgctcggcgtgggcgccggggcgagcaggggcgagatcaaggcggcgtaccggcgtcttgccagggaggtgcacccggacgctgctggcggcggcggcgacgaggggttcatccggctgcacgcggcctacgccacgctcgctgaccccgacgagcgcgctcgctacgacagggacgtggcctgccgcgccgccgggagatgatgatgcggcgggcggccgcggccgggccggcgttccggcggaggacgtgggagactgaccagtgctggtaggacgtacggctggcaaacgcggcggccctccggggccccagccggcggctgcccggttcgctcaggcacggcgctgcagagaacatcgtcaaggctattgtgcatcgtacgttcaggattggacgtcccagatcgggtgacgcggacgctggagctctgtacacggcaagaggcgttttttaaagatctcttgtgcgtcctgtcagcaaaatgcaaatatgtaaactaattacttacctactgtaaattaacggccaaagactatatagtacgtagc

SEQ ID NO: 19036 - DNA, 1113 bp, Triticum aestivum
  unsure (1)..(1113): unsure at all n locations
  Clone ID: PAT_TA_19036
gcagtgcgaagcaggaaaacaccatccttgcaaccaaaaatcaagaaaccatataaagcaaaaggaggctacgctcgttcgtcaacgaggacggaccacggggtaaggtcgacacgctctgcgtggtggggaggagtgcatggctgcggtcgcgacgtcgtcgtcggcggtgatgtggtcggctcgccctgggcgggtggcaggggctcggcggtgcgtggtggcgcgtcgcgtccgcggcgatggcggcaccggcggcggtggccacaggcaggacgcaggggggctacgaggtgctcggcgctggcgcgccggggccagcaagggggccgacatcaagggccgccgctacccggcgccttggccacggggaagtgcaccctgaccgccgtgcggagggtggcggcgacgaggggttcatcccggctgcagcgctgcctacgccacgctcgccgatcccgacgagcgcgctcgctacgaccgggacgtcacctgccgcgccgcggggagtgatgatgcagccgggcggccgcggccgcgccggcgttccggcggaggacgtgggagaccgaccagtgctggtaggtgaggcggactcacgcggctgtacccccgggaccatcggcaggttcgatcagggacggcgcatcatggaggctgcgctcgttggagagaagatcccgccgactgccttggaccgccagcgcccggtcagaaatggacgtctcagatcgggtgttcggacgcgggagctcagtacacggcgacaagagtcgttttttcaaagatctcttgtgcgtccgaatagccaaatgcaaatatgtaaatgaattagttactactgtaaattaaaggccatcgaatatactatatgtactacctctttgttcaattccataaggatgccttggaatagttgtctcgagtgcgtagagccctgttatagttttggataggaagaacaaagtttgggaacacatatagccactggtgcaaagtgaggacaaatagtcacttgtgtcaatattactactctcatgtgtttttatgtcttcaatttaaaatccgggcccttggtgtcctgacacattgcaaaaaaaangtccggacatt

SEQ ID NO: 19037 - DNA, 976 bp, Triticum aestivum
  Clone ID: PAT_TA_19037
ccacgcgtccccgggccccagcgtcccaccgccgtgaattgcaggagtggcggacgcgcggggagaagagaagagaagagaagagaagagagattcacgcgcggcggagcccggccacctccttccgacgtctccgcccacggagccatgggtttgacttcggcgaaggggatcgccctcaccgtctccttgtttggcctcctcgcgtttctgctcggcgtcatcgcagaaaacaaaaagcctccttatggaactcctatcaagggaaaggatgttgtcatctgcaagttcccgagtgacccaacgattgcaatgggaagcctgtctattgtggcacttgttttagctgctttcattgggcacgttgccatcttttacccgtacaagggcaagtcggttcctcgtggagcgttatttcagagcaccagcttgtctgtgttctttgttattgctgaactggtatcagctctggcttttgcaatgctgctctgggcaacgatcacggagggtcaccatcgcaccagtaacgttcaccacgacatggataccctgtgccccaccgcaaagaccggcctctttggaggtgccgctttcctggcccttgacgctgctctgttctggcttgtttgccagatgctggcccttaatgcgagggccgactatctggatgaggatgaggatgaggatgacaagggcgaatatggccaggtttatgctgctgatgccgatggcacgaaggtctgagtcagttaactgcaggatttcaaaaatagcaccgtttagatatattttagattcattatgcgtctttgaaaaggtcggtttagttctccaaaaaattgtagatatgccgtgccattcccgtagtcgtacataagatcatttcctcattccagtttcagacttcagattgaacgataagttgtgttctggtttgctacttccctttctgaattaaagtatcatgttatctgtg

SEQ ID NO: 19038 - DNA, 571 bp, Triticum aestivum
  Clone ID: PAT_TA_19038
gctcgtctcagccgccacccccacgaaccctagccgcgccctcctgcatctgtcctcctgcccctggtctgccccaagcccctcctcatctccttgtcgcacccacctcatcaccagcgacggccgccctggacgcatgagctagccgaggaaaagcggggtggcgcgacggcgtcggccggcggggagcctgcgtaccgcgagccgcccgacctccttccgtggatctgctcctcccatttccttttcgttgatttgctttttttgttcgcggcaaatctgccatggtaaggagggccaagttctggacagggcgcctcaacctcgccttcctcttccacctgctcgctgatagagagacagcggcagcggtgggaggagcctgggcgtagaggggagaagtgacgagggggtgcagagccaggagaatgggggttcctggatgagcacagcggcacagggcctggtcccgccgctgcgagagcagagtggaggaccacacggggccgcgatggggtggcatccggcgagacaagcagctcccaagcagggaatgcagcggtgctggcct

SEQ ID NO: 19039 - DNA, 1629 bp, Triticum aestivum
  Clone ID: PAT_TA_19039
cccacgcgtccgaacaaaacatggctccgctgactcccagacttgtggtgcccatagatgtgaagaagaagccatgggagcagaaggtttgtctccataaccgctggcatccggatatccctcctgttgctgatgtaactgaaggggaattattccgtgttgagatggtcgattggactggaggacgggttagagatgatgactctgcagatgatatcaaatttctggacctcacaattactcattatctcagtggcccccttagaatagtcgatgctgaaggggttccagcttcacctggtgatcttcttgccgtagagatctgcaacctcggtccgctccctggtgacgagtggggttatactggaatattcgaaaaggataatggaggcgggttcttaaccgaccacttaccaagtgcaagaaaagccatttggtattttgaaggaatttatgcatactcccctcagataccaggtgtcctttttccgggattaactcatcctggtatagtgagaactgcaccatcagttgaacttcttaatatatggaacgagagggaaagaaagattatcgaaacaggtgacgcgttgctgaaacgcgacgttgttctacatcagccccttgctaccttaccaacctccgctaactgcttacttggaaggaagactcaggaagggactgctgaatggaaaaaaattgcaaatgaagcagcaagaactattcctggaagagagaatgggggaaactgtgacataaagaatctaggcagaggttccaaggtttatctaccggtatttgttgaaggagcaaatttgagtactggtgatatgcactttttcccaaggagacggtgaagtttcattttgcggagcaatagaaatgagtggattccttgagctaaagtgtgagatcataagaggtgggatgaaggaatacctgactcctgttggtccaacagcacttcatgtgaatcctatctttgagataggtccggtggagccacgtttctcagaatggttagtctttgagggcatcagtgtagatgagtcggggaaacaacatttccttgatgcatcagttgcatacaagcgtgcagttctcaatgccattgagtatctttccagatttgggtactccaaggagcaggtctatcttttactgtcatgctgtccatgtgagggtaggatatctggaatagtagacgcccctaatgcagtggcgacacttgcgatccctacagcaatattcgaccaggatataaagccaaaacgcctggggcatggaccgaaattgagaagacttccggatgttctgagatgaaggtgcagtagacaccttcctgtaacacagggccaatatcatgtttagaatatctaacaataaatctaaataatcatctttagtattccacaaccatctatgttttgtgcaacacgcaatgtggacgcgtcgttgtaatatggggtttcttgtttctcgatgcttgataatttatacgacacacataaaaatatgtaaaacagtcctgcatggtgtttctttgttgcccttggggtcatcttgctgcttagttctatcgtaattgaaattgtcacacgcttctcaataaaaaaaaaaaaaaaaaaa

SEQ ID NO: 19040 - DNA, 650 bp, Triticum aestivum
  Clone ID: PAT_TA_19040
tcttccacgcgtccgcccacgcgtccggaggtccaagattcccgctggaccttggttcccttcttttttcttggctcattggaaggtcctgcctgccatctgggttcctggcgactggcgcaagagagcgtggggttttgggaactctagcatcaaccccatcatttctttggtgcactgccttttggggcgaaattgtatcaggtgctctgttcatggcccaggggtattgattggttgggatcccagcgcttgcaacggttttgtgcaaggcagccctgcttcccgtcaatcagagaaggcaagtcttggatttttcccgatcacaatctcaggtccctagcaattgcaaatcagggggcttgttttttcctaatctaatcaagagaagcaaccgtaatcgccggagttggtgaggcaaggggttacctggattttcgcaagaacaggggcgttacaaattgaggaatccctccggtcacgtccagttgattcttgggctttgacatggagaggcagaccagtttccgcctgggcgcgctggagaagctcaagaacttccgggggatggagaacttccggcggagcaaggacagcccccgcatgcgcggtgacacgccgctccacctcgcggcgagggccggcaacgt

SEQ ID NO: 19041 - DNA, 1264 bp, Triticum aestivum
  unsure (1)..(1264): unsure at all n locations
  Clone ID: PAT_TA_19041
agcagcgccatccctccctctgtccatcccgaccgctgcctccatcgaggaggtaggagtctaggagatcagcgagctgctaggccgacagcttgcggcgggccatcacagaagctacgccgtacgcggcggcggctagccccagcttaatagattagttctgccatggcgaggcttcccggtctgcgttgctgtgaccttgccgcgcgcggctccctccctcctctcggccttgcctgccgccctcgcaggtcgccccgcgcctcggctctacgctactcgtctctccaagctggtgacagtctcgggaaggatgtcttgcgcatgttccttgaggataggcagacgaatggggacctggtctccaaagtcgctgacatggttttgaggagaaacgacacaggtcttgatgtgttagaggctaccacagatcaagaaaatgctgcagatgttgggcaacctgaagatttcagggatgatgttatgagtgagggagtcgtgggatttgaggcaattggagattttgtgtccgctgagggcagccttactgcgagaaggaggctttctgctctggctgggcagaaagagagtgataaaaggaaggaattcaaccttctgagatatgaagcaattaaggacgaactgttgctcctgaccataggaattgggagccgcttgcactatatattgtgtcctagtcctctctgtggaggctgggtatcagttatgcttttggagttgctttcagctggttgtatcttcaacttctgtatcgacacccagataacctgtcaaaggaagatgttcctgaagtttttctaaagaagaaagtgaagaaaccccgccctccaagcgtggatgggcaggatgcaatagggtggaccctgggggcccccccatgggttctcccctccccttggctgctatttccgcctgtgattcttgggctgtctacctggtctaggccttctcagcctagcttttttaactttgagcttgttccagggatgatggggttctttgcgtacaaggccgcagctttggtacaagtctacagagataacgatgatcttagattgatactccccgaggacgatcctgactacacctgaaaagttttgaggatgagagttttttcacctagttttcctttataaagcaaagggcacattgatgtatagtttatgttatagtttgaaataaatcccgctgatcttttgtgtgcanataaaaaataatgcaagacagaagggaggtaaagagc

SEQ ID NO: 19042 - DNA, 823 bp, Triticum aestivum
  unsure (1)..(823): unsure at all n locations
  Clone ID: PAT_TA_19042
atgataaataagaaacccgcggggcacttccggggttcatctctnctcctaccggtaccgaattcccgctgcgtcccacgactccgccttgcctcggcgcctgctgatccgacttgccgaagcggcggcgcagctcccctcgaccccgaagcgcagcccctcgatggccgccgacgaggccccaaccacggaggcggcgtgccaggacctggtcgagatccttgacgagggatcgggccgcctggacatgggccggtacgtggaccacgtccgcgacctttcggcgggcgccatcgctaccttcgagggcaccacgcgggaccacttggacgggaggcgcgtggtggagctccgctacgaggcgtacggggccatggcgcgtgatgactggcagccgccggatcgcgatcaccgcgccgcgcacgcgctttgccggctggccgtggcgcaccgttagaggaagagaaccgccggcgaggcatacatgtaatatcctcacattgtgttgcaccgcgccgacgccatggacgcgtgccgctacgtgatcgacgagatcaaggcctccgtgcccatctggaagaaggaggtgtacgacgacggcgaggtctggaaggagaaccgcgagttcctcgaccgcaccgacgccgagaagaagggcaagccggccgctgccgccggccgcggcggcggcgggtgctacggcagcaaggtgagggtcagctgatgagtggcggccgccggatcgcgatcacgtggacgtgccttttttttccccttgtgttacgagagattttagtgaagagaaaggtcagacccggccggc

SEQ ID NO: 19043 - DNA, 908 bp, Triticum aestivum
  Clone ID: PAT_TA_19043
ttgacgccggccgttggcactagcagccggagctcttccagtggcatagctacaaagcggagccggagctcctccagcggcatagctgcaaagcagcgtccatggaggggagccatggcaagcactaccacagcagcgggggaactggggaggtgctataggagatttgaaacggagctcgtcgacaaacgctggtgctgcaacgcagcaacgtgtccacggcagccgggatgtgacgcacaactttctccacggccgtggcgctgcgtgcaaccacaactacgctgcaatgcaacctcgtgctccggcggcacaactgtaatggaccgcttgtcgccgacgtcgaagctgccatggagcgcccatcacccgcggcggagctgcaatggagcgcccgtcacctgcggcggagctgcaatggagcgctcatcgtcgggtcccggccccgtgctcctatgcagcactcgcgcgatgggtcccggtgctgcatcgcaatgcttgccggcggctcgatgcagcgtcgcggttggctcttgggagagctcggcgctgctgccacgcttggagtcgatgcccttgccacgaccggcgacgatgctatgttgcagcaggttggtctactgccgaagggagctgccatggccaggaggctgttgtaaggggaaggcaccgggggtgctgcagggggcagccacctgcaggggcgtgctgccgagcctggtgttgcgagcgagcttccacatggcggctgtggctgcgtgtgagtctcaggcccgcttgtcggacctgtgtggggaaattttgcgttcgctgcgaggcgaggaagacgaggccactgcaggcgttgtattgcttgagaacaacgtggttaagttggctaatccaacgtttgtgggggctttgatcgg

SEQ ID NO: 19044 - DNA, 912 bp, Triticum aestivum
  unsure (1)..(912): unsure at all n locations
  Clone ID: PAT_TA_19044
gggggagagacggatagagatgggagaggcatcgccggagtccagcggcgcggcggccggagggccgtctatcccggggccgccaaggaaggggaagtcgtgcaagggctgcctctactactcgtcggtgctcaaatcccggggatacaaccccatctgcgtggggatccctcgctccatcccccaagtcccgggcttcgtggtggaagagcctagggaggaggccgcggcgcaggggcatgatctgagacagttcaaatacgcctgtgccggttactccatgttcgtcgacgacagagacgccaaaagcggcgagaatgacgccaaggcgctattgccgtattgccagggcctcgagctattggtggacagcagaatggttgagagaaaatcacccgctgtagagcatgcttcaacacgtaatccgaaaccgaaggaagctgctgctgctgctgccaccacccagcctcaggagcaaggacagcgaccacagctggcgacgcgtgggcggacgcgtgggttcaggaggagcgccgggctggtggcctcaggtgtcgccaagaacctcaacaaaacgggcagctacatcaagcagaacgtcgaggacatattttcccctgaccgacggcctccacccaagcagtagtagccggctgccacgcgaggtcgcccatttccgagctgggaagctggagaaaactgccatgcaggtcaagggaaaaaggctacccggcatgcaccggacgctttcctggggcgtgctactgatttaattccttctgctgtatacttgtttgcttggtttttgctatttattatgtggaaacaattggggtctggtttnnnnnnnnnnnnnnnnnnnnnnnnnnnnnnnnnnnnnnnnnnnnnnnnnnnnnnnnnnnnnnnnnnnnn

SEQ ID NO: 19045 - DNA, 1007 bp, Triticum aestivum
  Clone ID: PAT_TA_19045
caagacggggcgatcggtcggtcccccctttgacaaggaaatttctccgtcggagagggagcacggggaagagacggatagagatgggagaggcatcgccggagtccagcggcgcggcggccggagggccgtctatgccggggccgccgaggaaggggaagtcgtgcaagggctgcctctactactcgtcggtgctcaaatcccggggatacaaccccatctgcgtggggatccctcgctccatcccccaagtcccgggcttcgtggtggaagagcctagggaggaggccgcggcgcagggccatgatctgagacagttcaaatacgcctgcgccggttactccatgttcgtcgacgacagagacgccaaaagcggcgagaatgacgccaaggcgctgttgccgtattgccagggcctcgagctactggtcgacagcagaatggtagagaggaaatcacaagccgtagagcatgcttcagcacgtaatccgaagccgaaggaagctgctgctgctgccacccagcctcaggagcaaggacagcgaccacagctggcgagacaggaattcatggcgaggttcaggaggagcgccgggctggtggcctcaggggtcgccaagaacctcaacaaaacgggcacctacatcaagcaaaacgtcgaggacatattttcccctgaccgacggccaccacccaagcagtagccggctgccactcaaggaggtcgtccatttccgagctgggaaactggcatgcaccggacgctttcctggggcgtggtactgaatgaattccttttgctgtatacttgtttgatttttgctatttatatggaaacaactggggcctggttatgtacatgagaaacgggatagggtgtttctgctccgttgggtggttgctgaataataatatgtccaaggtgtttgtttcaactcagaaggtccttctgagaaggaggaattcatgctactactgttcatctatcaagcaccctacaaaaaaca

SEQ ID NO: 19046 - DNA, 834 bp, Triticum aestivum
  unsure (1)..(834): unsure at all n locations
  Clone ID: PAT_TA_19046
ngagctaggctaacaagccaaagcacaacgcgggggagcaggcagagggaggtatacctcgctgcttggcctcgatcttccatggaggagcaaggggagagggggctccagctgctgctccccgcagccgctgctcgggtgctccgggaagcgccggtcagcgccgccaccgaccaccagcagctggacctggacctgtccatgagcattgggccgaggcagcagcagctgctgcagctgcagctgccacggccggcgcccccgactccaccggcgaacgagagcaggagagcggcggcgactgtggccgccagcgctgcgacggcgaggcagctgcagcagcagcaggtgacggtggacgtccgctccgtgaagcagcagacggcggagcaagcgcggatggcgtcggcggagcgcgcctacgcggagcgcgtccgggagctggcgaagcgggagctggagctcgccgagagggagttcgcgcgcgccaggatgatctgggagcgcgcccgcgaggaggtggagcgggtggagcggatgaagcagatcgccgccaggcggctcggctccgccgcgtccgccgccgcgctcgagatcacctgccacgcctgcatgcagcgcttccatccttaattaggtcgacatggtcggtcggagatcgatgcttcctgctcgccattgctagctgtaactctctctctctctctctctatctatctttctatctctcgtatctcctgtcttgtgagtgccagtcaccttctgtttgagacgataatcatctggttgatgcatgcagcaaggaagcggttattcctccttactctaaaaaaa

SEQ ID NO: 19047 - DNA, 559 bp, Triticum aestivum
  Clone ID: PAT_TA_19047
cacgcgtccggccgccgaaatcaggcgcgagatcggcgccgaggtcgccgtgctctcgtccgcccacagcatcgtgccggggctggcggtggtgatcgtggggagcaggaaggactcgcagacgtacgtgcacatgaagcgcaaggcctgcgccgaggtcggcatccgctccttcgacgtcgacctccccgaggacatctccgaggccgcgctcgtcgccgaggtccaccgcctcaacgccgaccccgccgtccacggaatacttgttcagcttccattgcccaagcatatcaacgaagaaaatatattaaaccagatctccattgagaaagatgtcgacggctttcatcctttgaacattggcaagctcgcaatgaaaggcagagatccactgttcgtaccttgcacgccaaagggatgcatggagctcctgtcacgaagtggcgtcactgtaaaaggaaaacacgcagttgtggttgggcgtagcacatcgtgggtttaccagtatcccttctcctgctgaaagcggacgcgaccgtgtcgatcgtgcattcacgga

SEQ ID NO: 19048 - DNA, 1118 bp, Triticum aestivum
  unsure (1)..(1118): unsure at all n locations
  Clone ID: PAT_TA_19048
gtcgtcgtcgctgcgaggaaggaagtcgagcaggagcgagaggggagaggatcatctgcgacgccaaggccgccgccgatcaacggcggcgcgagcgccgccgcgaggaggccgtgcgccggtccgcgcacagccccgcgcgcgctcgtccgcaccctcgtgcggggcggggctgggggtggcgatcgtaggggaaaggaaggactcacagacgtgcggacggaggaagcggcaggcccgcggcgaggccgccatccgctccttcgacgtcgacccccgcgaggccatcgccccgcccgcgctcctcgccgacgtcccccgcatcaccgccgccccctccatcgacggaatttttgttcagcttccattgcccaaaccaatcaacgaagaaaatatgatcaagatctcatttgcattgagaaacgatgtcgacggcctttataatttggacattcgcaagctggaaatgaaaggccgagagcctgtattcggcccttgcaaggcaaagggaggcactgagctcctgaaacgaagtggcgtcactgggaaaggacaacacgctgtggttgggcgtacctagcatcatggtgggtttggacactatcccttctccttctgaaagcggaaccgaccgtgtcgatcgtgcattcacgcaacccaaatcccgaaacaattgtcccgtcaagcagacatttgtcatagcaggaccggggccaagcaatgatggtgaacggaagactcgatcaaaccaggcgcggcgggtcatccgacgtcgggacaaactccattcgacgacgccaaccaggaagcctgggtacagactcgttggcgatgtggatttctcggaggcgagcaaggtcgcgggtcacctgactccggtccccggaggcgtcgggccgatgaccgtggcgatgttgctgaagaacacggtggacggcgccaagaggggtatagtcagctgatttgctgcgtgatttggtaatgtggggatgatgttgtaactgggtgcttagactaaaatcggttccccattttgtcatgtcttgcgctatttcgagatcaataaacgacgctctgtcgctcaccaaaaaaaaaaaaaaaaaaaaaaaaancccccc

SEQ ID NO: 19049 - DNA, 1322 bp, Triticum aestivum
  Clone ID: PAT_TA_19049
cggacgcgtggccggacgtgggggcaggggtgctcgctcgctgccatcatcacgagctagctcgattaagcacagatagtgcatcaatggcctccaccgcacagcttcttggccacctcgccggctccacggccacagccagccttagcttcacgcctgtcagcggcggcggcagcagcagcaaggtcaggttcctgccggcaacggcgcagaggcgccgcgtggtggcgcggccgcgggcggcggtgtccggtgcggagaaggagaaggccaagccggccgagtccggcggcaaggaggacgagcgcgtggtccaggtgcacagcgccgagggagttcgacagcgcgctccagaacggccaagaaccggctcgtggtggtggagttcgcggcgaggccacagcgtgaacagcaagcgcatctacccgtgcatggtggacctcagccgcacctgcggcgacgtcgacttcctcctcgtcatgggcgacgagtcggaggccacgcgggagctctgccagcgggagggcatcacccaggtgccgcacttctccttctacaagggcaccgagaaggtgcacgaggaggagggcatcggccccgaccagctcgccggcgacgtcctctactacggcgacaaccacgccggcgtcgtgcagctgcacagccggacggacgtggaggcgctcatggcggagcacagcggcgagggcggcaagctgctggtgctggacgtcgggctcaagcactgcgggccatgcgtcaaggtctaccccaccgtcgtcaagctctcccgctccatggccgacaccgccgtcttcgcgcgcatgaacggcgacgagaacgacgcatgcatgcagttcctcaaggacatggaggtcgtcgaggtgcccaccttcctcttcatcagggacgccaagatcgtcggccgctacgtcggctccggcaagggcgagctcatcggcgagatcctccgctaccagggcgtcagggttacatactaattaaaccaccaagccaccagcaatgctttatgtacgtacgtagtacaacgatcgatacttgtgaattcggccaaacgaaattaaggagtgcagatagaattactcctgcagtttactgcatgcatgcggcatcgatcgatgctatatataggttcatatttagacatttttatgctcttaattatctggtattgggcgccaatacatacggttatagcagtaatagaattttcgagtgcaaattgtaataagtttataatggttttattgtgatattatcagagctttgccatcctattttttttgataaaaaaaaaaaaa

SEQ ID NO: 19050 - DNA, 674 bp, Triticum aestivum
  Clone ID: PAT_TA_19050
gaattcggcacgagtccaagctctcccaccgcaagacctcgcgctcgcatccatggccgcggcagccatctccctctgcggctcgcgctgcgtcggcccgagccggaagcccgaacctcgcctcgcctcccaagcggccgccgcgccgtgcgcgcggccgtcgtcgtcgcgccgaaagctggtggtcgcggccgccaagtcgtcgggcaagaaggcggacgagaaggtcccctcctgggcccggccgggctccgacgagcctcctccgtgggcgcgcgacgaaggcggggcctcggggcaggaaggcgacgccgtccaggttcctttctacgcgtacctgctcgcgtccgccgtgacggccatcgccgccatcgggtcgatattcgagtacacgaacgggcgggcggtgttcggcgtggtgggcacggacagccccctctacgcgcccatcctgggcttcttcgccgtcaccggcatcccgacctccgggtatctgtggtacaaggccgtgcagacggcgaacaaggacgccgaggagcaggaccgcagggacggcttcctctgatttggttttctttaacatgtaatcggctttggtctagagtaccagcctttttgctggttgtgcttaatgttaacacaattgagcataaaacatcacgaggctatggggg

SEQ ID NO: 19051 - DNA, 445 bp, Triticum aestivum
  Clone ID: PAT_TA_19051
cccacgcgtccgcccacgcgtccgcggacgcgtgggggcggcggctcttctccgagcagctcgtgcctcgcggcacctcgcgctcccccgctctatagcatctagccctagccaactatcctcctcctcctcctgcaccgcctccgcggcggagacgccgtcccctgccgccgctgcgccggccatcccggcagacgttgaagacgcggtcgtcgtcgtagccgaggaggacgacttgaggagccacatcttccggctgcggctggcgaagcggagcgcgacggaggcgctcgagaagtgggccggcaagggccgcgccgcccccgcgccggagctccgccgcatccatggacctagaggtcttcagaggaattcttgatgagatgtcaaaagatccgaactccaacgaaggatggacactgtaccgaaacctcgccagtatcta

SEQ ID NO: 19052 - DNA, 870 bp, Triticum aestivum
  Clone ID: PAT_TA_19052
cccacgcgtccgcccacgcgtcccccctcgcgtctccctcatattccacatagcaagcaacaagtacatcttgttcttcatttgtgttgaactttgctagctaggttcaagatgagcaagcccgtgaagattgggccatggggcggcgatggaggcgaacctcgcgacatcgaatacactcctttcgcactagttggtgtggcagttcgtagcggggacgcaatcaacggtgtcaggtttacttacgtggataccagtgggaatctgcatgaggaggaatggggaggctccgaggcggagaaatttgagcagttgctccttcaagaattagaatatgtgttggaaatttcaggaacgtatggatcaccccctgaatcatatgtaacatctcttgaattggttaccaacaagggtcggactatccgtggcggcactgccggctctgggggttctttcaacgtcccgctagtttccacccggatcatcggcttctttggagctgcggggacgacttacattgactcctttggcatgtatgcgggctttgctgcatgatcggttcatcatgtctccgtgctagtactactatactactagtactgttttagtgtgtggttgcaataaaagcagggagccctttgttagctggcaggagtgctagctatatgcctgtcacgccatgaatcccttctctgctcaagggaacatacatatgtatgtgtatatcgtctgagtgaaaaccttacagtgtgccttgtatccagtattatattaattaccatgggatataaataaatgtaaagctaccccttcagacgacaagcccttgttgaaaaaaaaaaaaaaaaaaaaaaaaaaaaaaaaaaaaaa

SEQ ID NO: 19053 - DNA, 542 bp, Triticum aestivum
  unsure (1)..(542): unsure at all n locations
  Clone ID: PAT_TA_19053
tcaaaaccanaacagcagcagcagtgcacaagaacaacaggcagagccgaatcacacagcctgcaggaggagcaggaagacttctagctaggaaagatgagcagcttggccctcttctcgccaagctcctcctcctcctctctgttcctcacaaagcaggcacaccctaccaaggcgagggctcctgcggttgtgaggtgcggcagtgggcccaccctgtcaggaccacatcaagaggaggagagagagggggtgatggtggccttggtagggaggagaaatgcactggcctctgcagcggcagcctgtggagtttcggtgcttggttttgcaggcgatggcctggcggcggccaagcagggcccgctggcagggaggatcccggggctgtctggccctgatcagaatggttggaaaacataccgcaggccggacgaaaagtctggcggccacggagtcggctggagcccgatcatcccgtatagcttcaaagttcctgatggcntggaagagacaccagtgtcgattgctgatcttggtgg

SEQ ID NO: 19054 - DNA, 1894 bp, Triticum aestivum
  Clone ID: PAT_TA_19054
gaattcggcacgcgcacaggcagagccgaatcacacacaccccgcaggaggggcacgtccacctcgcgctggcgggcagcttggccctcttcttgccatgcccctcctcctctctctcccctacgttcctcgttcacccggccaaccctaccaaggcgggggcgcctacggttggcgggggcacctacgggtccgccctgccagagtcggatgaagaagaggggagaaagggggtgatggtagcgaggggaggtgggagggccgctgcggccgctgctgcaggagcttgggtgcttggggtgcctggctttggcctcgctggccggccagcggggacccggggcccgcggggggggccgaggcccggtctggccgccgatcatgagtgtgttgggaaacaaaccgcacggccggacgaaagaccgggcggccgccgacgcggctggcggccgcccaatcagcccgtacaccatcatcctgcctgatggcaaggaacagaaacgagggtcgatgactgctgtggctggcacggagatcggccggcgggtcagcaacccgaaggacggacgattctctgtcattgtagcgcccatccgtaggtttgcagatgaccttgatgatgcaacaatcgagaagatcggcacaccggagaaggtgatcaacgcctttggaccggaggtcatcggcgagaatgtggaagggaaggttctgtccacagccacagctgagtactccggaagaacttactaccagttcgagctggaaccacctcacatcttcatcacagctacggctgctgggaataggctctacctgttcagcgtaactgcaaacgggctgcaatggaagaggcattacaaggatctgaagcaaatagcagaatcattccgcgtagtctagggtggttccactgggttcgttcatcacataatctgtttcattactagagaaaatgagggatgccgttatgtaaagggagggtaagtacacatcatttgtaacgatgattttgtagctgaagaaattgaacattgtatgtaagcttcctcttctagttacagtaagaattcagacctaaaggtgccttcaggggcgcatataacaacttccaggccaaaacgcataaatgcgcgtttgaagcttccttggctatagcctactacaggtcaaatctatatgactggcaatgaactgatagactgatacatgtagagttgtttcactgcacttgccggcctccatatagggttcttacatctagatcagggaaagaattatgcccttgcctgacttgtgtgaacgcgtcatggagtataagtgtgatttaaactttcaaggcatcactagagctccagtatatgtgatatgtagctttacaccatcatcacatcaatgcttcccagtcaggcagatgcactccgggaatgggttttcataaaaggattcctctgtcctaagacgtgctctgcccttgctcccgggcaaggacgcatatctcttccttggggtgccttgcctgtatttgtgcattttagtaacaagtgaggacagcttaggaccttccataagttctcctttttcaagtaagccaaagagttccaccaatcctctcctatcaggagttaaagtcttgcgatgacccagaaatctacgatggccctcaacagctcttgccatattgccggagtgtgatggaataaacacatcactttccactgaaattatgtagtcaagtgctgcaacttgagaagcatgattcttaaacttctcaagctcttcttttgttgccagcacttccttgctaaccaagtttggaaagtacgatctcaattttgatatatacttatcaccaccataaatttcaccagctgcaatgtagatcccggacgcgtgg

SEQ ID NO: 19055 - DNA, 1590 bp, Triticum aestivum
  Clone ID: PAT_TA_19055
cgcttccacacaactgagctcacagagctaagctgcatagctaatcacacaccctcacctcccgcttcctcggcgagctccgaagctcgtatgtagtgcgagcctgccactgctagctgacacaacagcttgcttatcgatcatatctcatagtccgggatcgagagatctcttaggatcaaccgcaagggtagtcgaccggaggagatcaagcaacccaaccgaacgatgtcggtgacctccaacaccccgacgggggccaactcgcgagtgaactactccgaacgggatcccacgacctgacgcacggcgcaggacggcgcccccacgcctaccccccacgcatgtactaccaggacgaagtcctcccccgacttcttccccccgcaggtggggtaaggaatgctggcgccggtgctgcgtggggccgtgccctgctgggcggccttcatgtgcggggccgggcgtcaatcgacacccgcggctgggccacgcctccctcggctgcgtcatccccacccccagcatctatataaccgccgaattggcctcgcctgcccgcctccgttcctgccccccccttcaagcccgccgggacgctcgcctccggccggtgccgggacgttccctggattcacgtgccggtccggggggccgctctattagcgagggctgatctacgcggacgtacgtggtgcgggatgtaccgaactccgtctctgtgcgaggccatgaggacgtagatagcgtgagtacatgtctggtgtaacgcatttgtattttttgtgattttctccatgtgcctacatgcatgtgtactttacgcgaacgcggtcgctgagttcgccggctgagctgttggttccgtggtttgcattacctccatcttcgcagggcctgtgtcaggaggatcgatgaacccggcgaggactctggcgccggcggtggccagcggcgtctacaccggcctctggatctactttctcggccccgtcatcggcaccctctccggtgcctgggtctacacctacatccgcttcgaggaggagccctccgtcaaggacggcccgcagaagctctcctcctttaagctccgccgcctgcagagccagcggtccatggccgtcgacgagtttgaccatgtctgatcggccggccggccggtgcaactacaccccaccccaactatatatatgctctgtattggatttgcatgcgtacgtacgtaagtgcgcacgtatacgagcgcgggacgccatttgtaaccagtcaaagtatgtacgatccatgcatctacgtgtttgtacgggtgtaccgcgtacgagcgagctctgtgccaaaggaactgaagtagtactggacgcagctagcttcgtgtgtgtgtatgccatgggtacgtagatagcctgagtacatgtctggtgtaacgcatttgtattttttgtgattttctccatgtgcctacgcgcatgtgtatccctcgctttctctttcgctttgtactgcgtcagaggttgcataaatttataatatgatgatgaagctaacggagcttgctttgcctgaaaaaaaaaaaaaaaaaaactcgag

SEQ ID NO: 19056 - DNA, 432 bp, Triticum aestivum
  Clone ID: PAT_TA_19056
ggtcgacgggacactagagaaccaacgtgctcattgggacgatttcgtgaaattcaaggattcggaattagctaaggaatggtcgagaataaacaagaagaatgccgaaaaaaaggataagttccataagctggggccaggtggctacgcggtggcagtgcctaagtgggataagtctgacaaagagatggaggatgcaggtgccactccggttactaagagctggccccccaggggcaggacttggttctatgcgcatggggggagttggacccgaagacaggcaatgtttcgacgaaggcatgtctgaacggagccgacgatgcgctacttgttgcaatagaagaggctcgatcgggggtgttccagcccaacagagagaacgacgagcttacgcgtgccctgggaaatcctgaacacccgggaagaaca

SEQ ID NO: 19057 - DNA, 1022 bp, Triticum aestivum
  unsure (1)..(1022): unsure at all n locations
  Clone ID: PAT_TA_19057
ggccggcaggtcgttccgagcgccatcggaagcgtaggacaggggcgagaaaggcggcggcgagttgaaaaatggagccggggaggaaggccaccatcatgatggtcccgcgttccgcctccgcccttcttgctgtggtggcgccgctcctccccgcgccggcgccggccggcggcccccactacctccagcacgtctgctgcgtcgcccaccacaaatcagacctcaaggtgaacgggttcccgtgcaaggcgaacgcgacggccgacgacttcttcaccggggtcctcgccaagcccggcgccaccaacaccacgggcggctccgtccgccaccggcagccagcgtgggagaagcgtgcctgggcctcatagcaccctcggcgtctccctctccctgcatcgactacgcccccctggcgggctcaacacgccccacaccgacccgcgcgcgaccgaggtcgtttttgccctctagggcgagctcgacggccttcatatccaccgcacacacacgctcctcccagacactatcccccggggcgatgtttgccttttcgcgcgccccctcgcgcacttccagaagaaatactcagacacccccgccgcccatatctcccccctccaccccgctcccccccggcacgccgtccgtcgccatgacgctcttcggggccccccaggtacccgacgacgtgctcgccaaggccttccagatcggcactgtgggaggttgacaagatcaaggccaagtttgcgccaaagaagtgatggaccggagcacgaataagatgcagacttttgtaaaatacgttctcaatggctcgtttagtgatttgttggttatccaataactgcgttaagcaagtcatactaatgcagtcgtgtcgtgcattcttggccgacccgactggccgacctgtgtaagtggcctgaagaaccacaaatttgtactactactaagtgggactgttggagtttcgaaaaaaaaatcttttgaaaaaaaaaaaagnagnaatataa

SEQ ID NO: 19058 - DNA, 942 bp, Triticum aestivum
  unsure (1)..(942): unsure at all n locations
  Clone ID: PAT_TA_19058
gtgtttcttgttgtgntttttgcttgtcgtcntgtggcttgcttgtttttttttctgctctgttgccnatcnggaatgacccacgtggccgacgcgncagtcccatgcttctctggcctcctgaatacgctgcccccctggctcaccccggcccctcgggccccccggcggcccgccgggttcgcccccggcgccccctcccgggccatgatgtccatagtatccaccgctgctgatctcttgcaggacttcaggactggttacgttaccctctcttcaccagagtccatgtttgtgtcacaattgattgggactgctcttggctgtgtcattgctcctctcacctttgggctttactggtcggcctttgatgttggcaatcctgatggcatgttcaaagctccatacgctgtcatcttccgtgagatggcaattttgggagtcgaaggattctcggccctcccccaacactgcctagcaatctgctctttcttcttctttgcagccatagcgatcaacctcctgagggacgtcactccagacagcgtgtccaaattcatcccactcccaatggccatggctgttcccttctacattggagcgtattttgcgattgacatgtttgttgggacggtcatcctgtttgtctgggagaagattaaccgcaaggagtcggaggactttgcaggcgcggttgcttcgggtttgatctgtggtgacggcatctggagcgtcccttctgcaatactctctatcatgaggattgacccgccgatgtgcatgtacttcaagccatctcttgcctagggcgtaaataggctgtagctagaatgtttgttttattgggatgccacaatagaagagaaccacatcgtgtacatatttatttcacacacgtgtaaatcatactgcggcaaaaatagcagcagctccgttcattca

SEQ ID NO: 19059 - DNA, 552 bp, Triticum aestivum
  Clone ID: PAT_TA_19059
gcactacaagcaggagcacggcaaggccatcgacgaggttctcgagggcaatcgcaacgacaagctctccgcgatgctgaaaaccgcggtctggtgcctgacatcgcccgagaagcatttcgcagaggtgatccggagctcgatcatcgggctcggcaccgacgaggagtccctgaccagagcgatcgtctcgcgcgccgaggtcgacatgaagaaagtcaaggaggaatacaaggtgaggtacaagacgacggtgaccaaggacgtcgtcggcgacacttccgggtactaccagggcatcctgctcaccctcatcggggccgagtagccattgctaggatcatccaagctcggaggatgcagttcaatggcgtattgtttgctacttagaccgttcgatccaacagagtgacattgtcgtgtgtacaagtacaatctagagagtgaagtgttgatgttgtgaaataagacccttggcagttcatttattggtgtattcagcactagcttgagacaatggtacttccatcacgatttgacttatccgaagat

SEQ ID NO: 19060 - DNA, 1404 bp, Triticum aestivum
  unsure (1)..(1404): unsure at all n locations
  Clone ID: PAT_TA_19060
ggcgccggagaaggagcacgaaccctcagccccatggcctccatctcggtcccggaccctgccccttccccaaccgaggatgcagagaacataaggaaagcagtacatgggtgggggacggacgagaacgcgctgatcgagatcctgggccaccggacggcggcgcagcgcgcggagatcgccgtggcctacgagggcctctcccaccagcccctccgccgcacgctccgggacgggcgctccagaaggagcgcgaacgctcagccccatggcctccatctcggtcccggaccccgccccttccccgaccgaggatgcagagagcatcagaaaagcagtgcaagggtgggggacggacgagaacgcgctgatcgagatcctgggccaccggacggcggcgcagcgcgcggagatcgccgtcgcctacgagggcctctacgacaagcccctcctccgcacgctccaggacgagctctccagccacttcaagggcgcgatgacgctgtgggcgatggacccggcggcgcgggacgccaagctggcctacaaggccctcaggaagaagggcggcgaccggcacgcctgggtgctcatcgaggtcgcctgcgcgtcgtcgccggaccacctcgtcgccgtcaggaaggcctactgctccgcctacgactcgtcgctcgaggaggacgtcgccgcctgcccgctctacaaggaccccctcaagcagttcttggtgcgcctggtgagctcgtaccgccacggcggcgagcacgtcgacggcgagctggcgagggccgaggcggccgagctgcacggcgcggtggcggccaagaagcagccgctgcacggggacgtggtccgcatcgtcagctccaggagcaagccgcagctcaaggcgacgttccagcactacaagcgagagcacggcaaggccatcgacgaggttctcgagggcaatcgcaacgacaagctgtcggcgatgctgaaaactgcggtctggtgcctgacatcgccggagaagcacttcgcagaggtgatccggagctcgatcatcgggctcggcaccgacgaggaatccctgaccagagcgatcgtctcgcgcgccgaggtcgacatgaagaaagtcaaaggaggaatacaaggtgaggtacaaagacgacggtgaccaaagactcntccggcgacactttcccgggtactaccaaggcatcctgctcaacctcnaccggggccgagttaccattgctaggtnancccaantcccggaggatgcattcnatggcgtattgtttgctacttaaaccntccatccaacagatgaattgtcctgtgtaaanacatcctaagangaatgttgatgtttgtgaaataaaccttgggattcattatggggtatcacatactttngac

SEQ ID NO: 19061 - DNA, 447 bp, Triticum aestivum
  Clone ID: PAT_TA_19061
cccacgcgtccgatttgccttttcacgctccttttcctcgaacgcccgcccactgctgttctcctctcccgagcagagccaccaactccggcggctcggcctcaggttcctctcgccgcggctgctctgctaccaccgggaccccggacccgaccgatggagttctcccgccgcggccgagccaccgatgacgccggcgacggccaacgcttccctgaccctccgccgcatggagacccgatgctggtgatgagggacgcgctgctgtcacagctccagaaggaccgccttcgccaggagatcatcgtggccgagctggctaagatagagcgtgccatggccctgcgcgccgccactggcggccagcaagccacaccggcaccagccggcgaatgcttgaagacgtacgatggtaacgcggctcgacagaatgcagcgtctgatgag

SEQ ID NO: 19062 - DNA, 443 bp, Triticum aestivum
  Clone ID: PAT_TA_19062
cggacgcgtgggctccattctcaccatcccctctgctccatgctcaccggcgccacctatccactccatcgggatctcgcccgccttcttcactccccgcgacgtgtctgggtgagcagccggatccggccgccatcaagccatccattgttctggccatccctggccgacttccgctgccaacggcaacttgcaggacgatttgtacatcaggcgagcggcaccgtcgatctgccatcctaggccaatttctggtgccgagggcgtcgtgttctcctccaacttgcacggcaacagggctcttccgatgtccactgattgaagctcgccgctccgagcagtaggcgctaacactgggagagagtccggctgggcctccactccaaaagacagtttggagggaacaagcgctgctgatgggagccgcagctgccggagctgtg

SEQ ID NO: 19063 - DNA, 1880 bp, Triticum aestivum
  Clone ID: PAT_TA_19063
gcatggagctggaaaggtgtttgcggagatgttcaaagatagctccgacaggacatggaagttcacgtttcttctcgtcgagattacgtcaccgcgacccgcacaaatcatgttagaatcttacctaccagcatgaggatgcaagagacaacatcagccggcagtggcacatccatgcgacacttcattttacatcccatctccaatggcctgaatctcatgttaaatacccatcctcggattaaagaagttgtgaattttgaacttccccgaaagcataagtaggaggaagatgaaccatcagagttgctgaccatctctagtatcttagatatggggtaccctgcaaggaccttgatgttgttgctttgtttaggtgaaaagtgcgcagctcgatgcggcacagccggaaaataataacgcccggtcgcctttccacggcgaaaggtatcccggcggcgatggcggcggctgcggcaaggtccggatcccggcgcttgttctccatatccgccctggtgccaccgaagccaccgagccctcccccgaaggcagatcccttcgccagcctctttgttcccgggttaagcaagcgaacagtagctgatggacttaggggagcttttgcaaagtctggtgaagtcgtgcatggttctcttttgacaaaccttccagcatcatctgtaaaaaaatcaaggtggtatatgatcaatgcaaaccgttcaggtcctttgacagtgcgtaaagaataccgcaaagtacttccttctttcataaggccatctgcatcttactccacacaagcttcagaaaaaagaccaaaacaggagagaacagacttgacgactgttgaagatccctttaatgcgcctacctacaatatacctgagaagccagtgacatttgtcgagggcgcctcttacagtgttgtaatacttgctgggcttggagttgctgcattggctggatacgctgttttcaaagagcttatatttgaaccaaaagagtacaagatttttgggaaagctctagcaagagttcagagtgatagccaggttacagccaaaattggttaccctataactggttatggtacggaatccagaaaccgcgcagctcggcagcgcatccaaaacagggtttggacagatgaggatggtgttgaacatgtggaggtaggctttcacatccgagggccgcatggagctggaaaggtgtttgcggagatgttcaaagacagctccgacaggacatggaagttcacgtttcttctcgtcgagattacgtcaccgcgacctgcacaaatcatgttagaatcttacctaccagcatagggatgcaagagaccagatcagccagcagtggcacatccatgcgacacttcattttacatcccatctccaatggcctgcatctgatgttaaatacccgtcctcggattaaagaagttgtgaattttgaactttcccgaaagcataagtaggaggaagatgaaccatcagagctgctgaccatctctagtatcttagacatggtgtaccgtgcaaggaccttgatgttgttgctttgtttagctgaaaggcgcgcaggcacatgtatacaagccatctttcctgatgctcctcaaacaacatggaacggagcgagtgatccttcatctatcgagttgtggtcccgtttcaggcagttttaatgatgcctatggatttcatgcaaacctccgtcctgtccgcattgctatctggttacattacgactttcaagcctgggtttccaggcatgtatgaagtgatcttcaatacaagggtgcatgtttctttagcattgctaaaattcagttaaaacctagagacggtaaaagtaccgcacttgcggacccc

SEQ ID NO: 19064 - DNA, 2007 bp, Triticum aestivum
  Clone ID: PAT_TA_19064
ggctttgggggaggacccagtcaccggggggcggcggcgcctgatccgcacacggcacatctcgggccgcgcggcgcacatccacccccctccactctccacgagtttgctcccccacttcattcagtagccgctgctaccacgcgggcgggggggacaccctctgccgccgccatgggagcgctggaggaggcgcacctcggcagcgtcgccgcgtgggggtgcgacgagggggaggattcaagagctccttgtggaggtgcacggcggtgaggggccgggtgacgctattgataatgcggtgcgctcgctggtggcggggctcggcgaggatgaccgccgggaggggctgcgccagtcacccaagcgcgccgccatgaatttccgcagcggcacccggcgttacagatagagggtaaaagatattatgcagggtgctctgtttcctgattttggtgttgacgaagggactggttctgctggaggaactggagagcaagttgttgttcgtgatatcgatctttattcatactgtaaatcttgcttgcttccgttcagcatacaatgccatgttggatatgtgccctccggtggaagggtcgttgggttaagcaagctttcaagggtagctgacgtctttgccaagagatttcaaaaccctcagagattagctaatgaagtttgtggtgcattgcatgctagcatacaacctgctggtgttgctgttgctatgcagtgctggcacataccgttgccggagaactttaaatgcaaaaattcgggagctttgattagaacttcacattcatctcgctcgggagtttttgagggtgagaacagctctttttggaatgattttgtggctcttcttaagcttagaggcatagacatggagatggacagccgttctgcttctttaacttggtgccccttaaggcctcatgaggttccgctttgcaatgggcacgcaaagaagattacaactaatggtgctagctcagcaaaatctgcatccattccatctaatatggtttctgctgtcagctcaatgctcttgtctcttggtgaggaccccctcaggaaagaacttctaggcagtcctcagcgttacgtgcaatggctgatgaggttcagagcatgcaatcttgatgtgaagctgaatggttttacacttaacagtgcaagtgtatatgagagaccaggcgaagatgctactgatcatcgagcaattagttctgagctgcatttgccattttgcgcccagtgtgagcaccacctcctgccgttctacggagtagtgcacattggttactttggcagtggagatggtgaagggatcaatcgctcacattttcaggctctggttcatttctatgggtgcaagcttcaggtccaggaaaggatgacaagacagatagctgaagcagtttattcagtctcacatcgtggagccatagttgttgtagaagcaaaccatatctgcatgatatcaagggggatagagaaaatcagaagtagtacagcaacagttgcagttttgggtcagttttcgaccgatttttctgccaaggcatcctttttacagaacatcttagatactgctaatcaggaagtatgagtggcttcagatcatatactgatagaatctcagccaaaagatacaatgagtctaatcctcagtcatcttttcagcaaggcaggcactgcgacgactatatatatggtttgaagttgtcatgcagctatggcatggttgccattttaccagccattgcaggcgggagcgaccaggacctcgtcacgtggaatgttgtgtctgaagaagattaaccagaagcaccaaaaagttttggttctcctgtgttgtaccattttcgtttgaacggcatgtcaaagttatcctagcgttgtaggtgcggcggctgtgccgagcaatacagtataaatgttttaagtggttgtctcatgtactagcaattttggtatcattccagcttctgttcgtcc

SEQ ID NO: 19065 - DNA, 725 bp, Triticum aestivum
  Clone ID: PAT_TA_19065
cctaagcccagaccgagagaccccgcacccaaatctagggtttcgctcccccgccgcaggatggctgcccccgccgccgccggctccggcgccgtcgtgcccgctggtgacggcgagggttggacccccagtttcggcgacatggtctggggcaaggtgaagtcgcatccgtggtggccgggccacgtctacagcctcaccctctccgacgatccggaggtgcatcgcggccaccgccatggcctcgtcctcgtcgccttcttcggcgacggcagctacggctggttcgagccgcacgagctcgtccgcttcgaggaccacttcgtcgagaagacctcgcaggggggcagccgcaccttccccgccgccgtcgccgagtccctcgacgagatctcgcgccgcagcgcgctcgcgctcctctgcccctgccgtggacccgacaccttccgcccccacaacgaggatcgcaggttcctcctggtgaacgtgcccgggttcgacagcaacgccgagtacctccccgaacaggtgacggccgcgcgggagcggttcgtcccgcagaagatgtatgacttcctgcagaacgctgccgtgcagcagcgggacgcggcggagacggccgcacggaccttgcctgggatcgagatggcagcgatgctcatggcgtaccgccggtctaggtacgagaggtacgacctcacctacgccgaatcatttggtgtgga

SEQ ID NO: 19066 - DNA, 1623 bp, Triticum aestivum
  Clone ID: PAT_TA_19066
cccacgcgtccgcccagttctcttctcccacgcgtcaaaccccgccacggcggagcgcctcgcggcatcggcctccctgctccctagtgcggcctcgccttcctcgtcgacccgccgcgccaccgtcgcctccgggctccggctccgcccgtcgccctcgcgcttctcacaggctgcaagcagagggcgcggtggcgctggcgccgccggggtggtgccgcggctgcgggtggtccgatgcatggcggcgtcggaggccgcgcagctcaagagcgcgcgggaggacatcaaggagatcctcaaaaccacctactgccaccctatcctggtccgtttgggatggcatgattcgggtacatatgacaaaaatattgaggagtggccacagagaggtggagccgacggaagcttaagatttgatcctgagttgagtcatggagccaatgctggtcttactagtgctttaaagcttattcaaccaatcaaggacaaatacccaggtatccaaatagccaggtattacctatgcggatttgttacagttaggcgagagctacatcaattgaaacttccgatgaaatatgggcgggtagatatcacagcacctgagcagtgtccgcctgaggggaggcttcctgatgctggcccacgtttacctgctgaacaccttagggaggtattctataggatgggccttgatgacaaggaaattgtcgcattgtccggagcacatacacttggaaggtcacgccctgacaggagtggctggggaaagccagaaacaaaatatacaaaggatgggcctggtgaacctggagggcaatcatggacggctgaatggttgaagtttgataacagctacttcaaggacataaaagagcaaagggatcaagagcttctagtattgcctacagatgctgcactatttgatgacccatcattcaaggtatatgcagagaagtacgcagaggaccaggaggcattcttcaaagactacgccgaagcccatgctaaactgagcaaccttggtgcaaagtttgatcctcctgagggattctcgttggacgatgacaagggtgccgtggcaactgaagagaaggcggttgctgatccagcaccaacgagtgatactaatggcacaggaccacagccagagcccttcgttgccgccaaatactcttacaagaagagagagctatccgacacgatgaagcagaagatcagagccgagtacgagggccttggaggcagcccaaataagcctatgaagtccaactacttcctcaacattatgatcgtgatcgcaggattggcattcttgacgtctctggccgggaactaagatcagtgatctgatgttctttttcacctgttgtaattaaccattttccagggactggtcgacatgcaagatgaccagtgcaaatacttttggtcatcttacgttgtcttaagttttcatcattcaaagtaaagtggggcaaacctattaaattgctggaaacccatgggatgtttctggctgcaaaaccagtaaattgctggaaacactgaactggtagatcaacaaatcaatttgatacctggttacagggggcttaaaaaaaaaaaaaaaaaaaaaaa

SEQ ID NO: 19067 - DNA, 706 bp, Triticum aestivum
  Clone ID: PAT_TA_19067
acggggcttgcttggcatctgaaccacctaacccttcttcctggcctgtatttttgccgctggcttagtggtgtgttctctcctcatctttgttctgggtggaagggcggattgagtgcagctccatttcgcctcggagtcaagatgggggacgtggccaaggacctggccgccggcacggtgggcggcgcggcgcagctggtcgtcggccacccgttcgacaccatcaaggtgaagctgcagagccagcccacgccgccgcccggccagccgcccaagttcgccggcgccatggacgccgtcaagcagaccatctcggccgagggcccccggggcctctacaagggcatgggcgccccgctcgccaccgtcgccgccttcaacgccgtgctcttcaccgtccggggccagatggaggccctgctgcgctccgagcccggcgccgcgctcaccgtcggccagcaggtcgtcgccggcgctggggccggcgtcgccgtctccttcctcgcctgccccaccgagctcatcaagtgcaggctgcaggcgcagagcgcgctggccacagccgctcctgccgccgccgccgcagccgctcccgcgggcggcgcggctgccaccgtcaccgccacggccaatgctgccgcggtcaagtacggcgggccgctggacgtggcgaggcacgtgctgcggtcggagggcggcgtgc

SEQ ID NO: 19068 - DNA, 1149 bp, Triticum aestivum
  Clone ID: PAT_TA_19068
accacgcgcattgccccgcgtacgcccaccccgcccccgatcgcgatcgccaccaccaccagtagagcgcgccgcgcgccaataataggggcgcgcgcatggcgtcccagcgctgaaacacactgctcgctggtcagtggccactggccggccaccgcacgcacgcacccacgcttcgatcgagcacgagcacggcgcgcagcgggccgatgtccatgcgcgaccgcggcgcctccaccgtgtccccgtcgctgcgcttcctcggcttcattaagcagccggatgacgccggcgctgccgaccaggagctcgagctcgacgagcgcgacgtagtctggtcgtcgtccccctccttctcctcggcctccaccgcctcgtcgccctcgcccacgccgtccccgtccgggggaagccaccgctggcccctctcctcccgcgcgttcccgtccggcggcgccggcctgtcgtcgctcatcgccgacgaggacaaccactcgcccagcgcggccatcccggccgcggcccgacgggagaagcagccgcgctcgcagccgtaccaccagtctgcgccggtggccgtgcccgcctggtccaaggcgacggcggacaggcgacgccgggaggcggagcaagaggccgctgacgaggaggaagagttggaggacgacgaactcatggtgccgccgcatgagatggccgcgcgccgggccgcggcggcggcgtcggtgatggagggcgctgggcggacgctgaaggggcgcgacctccggcgcatgcgcaacgccgtgtggcgcaccaccggcttcctcgacctgtgaaaaaggacgctcctttggaggtttctttcgctgcccacgtcactccaattgatggtgtagtatttgttacagaaaatgtggatcttctgttggtacgtttgggattctaggtgaaatattttgatgtactactactagtaaattattaacaagtggttatgtttttcctagaagaaaagaatgctgatcccggagcaactaaataaggtctaaatggctggtttgaacttgcaactaaccacaatagccactgggatacaattgctttatgatctgtacctttttttttgcaaaatgatacttccttcgtcccaaagtgaagggagtactt

SEQ ID NO: 19069 - DNA, 588 bp, Triticum aestivum
  Clone ID: PAT_TA_19069
aagagagcgaggaggatagcgactgcgaagaggaggaggtgggccttgcggcgcccggcggcacgcagtactacgcggcgtacgagcgccaccagcagctcggcggcggcggctatggcggcgggtgcgcacagcccaagaagcacagctactactgagctcctgcgtcgtgcggtcgtgcccacatgtgactgccagcgtgatacaatcctacctacggtgacacctatctgctcacatgctcctgcatgcgatgccagtatttggtggacctttgcattgcaaaagtgtctaaataagatgtacatgtaacacatattctgaatccaccataagtggcatcggtacaataatttaccgcacatctggcccgggagcttcagctatactagtaggcagctgctattttcatcatgaacgatactgagcaggtaagggccaggtttcctcaacagaaacctaatatggttcctgtgcaccgtgtgatttcgtctagactgaagtcgaattcggcggcgtgatcccttgatccaagtaatacttcttctcgggattgggccagcttgcctggaatatcccccacttttt

SEQ ID NO: 19070 - DNA, 2793 bp, Triticum aestivum
  Clone ID: PAT_TA_19070
gcgggtacgagggcgacgaggccgagacgggaggattccgcgtagcggagccgcccccggcgcggcggggcgaggcatgccgagacggccagccggagccccaccacccaggggtgctccggcggcggctgcggcggcgggtgggcgccgcctaggaggcggaggcactcctgagctcctgggtcgcgcccccgcgcgacggctacccgggcgcgacaatcgcagctgtcgtgcacggccccgcgaacaaggcgatgcatgggtacgtcggcgggcagatgggggaccagcacgctgcagaagtctctaaatacaatgttcatctcactcgcatcctgcagccgccgtagggggccaacggcacgatcaggtagtccttggtctggccgaggtgcctaaataagatggggtacgagctgatattctgcatcccaccataagtcgcatcggtacaataatttactagtacacaagtctgattattagcatgcgtctctctctgcaacatgctcttgatggtcgtcgtggtaagtgggtaacccatgtacagatctggccccggagcttcagctatactagtaggcagctgctattttcatgaacgatactgagcacgtaagggccaggtttcctgaacagaaacctaatatggttcctgtgcaccgtgtgatttagtctagactgaagtcgaatttggtggcgtgatcccttgatccaagtaatacttcttctcggcatcggccagccttgcctggaatatcccccactcttttctacaccgtcctcttaccccttcccatggtgctcttccattctccgacttgccctggttgccaagtgatggaacaccctgatgaacaatccattgagcatcaacaactccaattttttcatgagccggctccacacatttcctaagagcaaaatcaagaccccatccatggatcaagtcgaaaagtgtctaaataagatgtacttctaactcatattctgcatccaccataagtggcatcggtacaataatttactagtgcacaagtctgattattagcatgcgtctctctctgcaacatgctcttgatggtcgtcgtggtaagtgggtaacccatgtacagatctggcccgggagcttcagctatactagtaggcagctgctattttcatgaacaatactgagcacgtaagggccaggtttcctcaacagaaacctaatatggttcctgtgcaccgtgtgatttcgtctagactgaagtcgaatttggcggcgtgatgccttgatccaagtaatacttcttctcggcatcggccagccttgcctggaatatcccccactcttttctacaccgtcctcttaccccttcccatggtgctcttccattctccgacttgccctggttgccaagtgatggaacaccctgatgaacaatccactgagcatcaacaactccaattttctcatgagccggctccacacatttcctaagagcaaaatcgagaccccatccatggatcaagtcgttctgaatcatatgccatacacagcgccatgcatccctagagaacacagttgccataatttctacaaatgctgcacacggtggcagatgggggtcggaacaccagcctggcctctcctcagttactttgtgaacttctcgatcaccacgccgcttagtcatttgccatgtcagacctctatcaggttccaaaccaggttgagagatctccagcccatgcttcgtaccaagcgtgatgtactcctctgcattgaaatgttgaacacctagatcctcatcccagataaatatgtagtcataccgggcaacgacatcaggatgtaaaaatctcttggcataccaccacttagtttgcttgctaacactcacatggatggccctttttgaccactcaaattcatcccattcagtagtccgaccatcatagtggaacaacataattgtgaagttctccgagaactttttgactgctgcatcaatatttgccttttgcgcgattccaactgtaaatgtaacaaggtactttggctggatagtaagatcctcactaggttcaccccacaatcttcgcagatagaggtctgtttcagatacgacaatacctggtgggagcctttcagcacctttagggtttgaggtaacataaatcttaggaatttcatcagacttggaatcagaattgttcttcttgtgactgtttgcagatgtccatgcatggttcaacaatgtttgggttgtgattccggagtttctatcttcaatataggaaacaatactggaagggaaatgaagcttggttatattgactgtagggaaggatatcccaaacaagtaacctagcataataccgataactgctgagaatacaagcctcatgccttcatttgatcttggcatgctgctccggcctagaatgccgggctttgccatgggggctgtcagtatcttctggccgcgatggaacttgttagcagaacggtttccgcaccgctgaagaacttgtagcaaatccgccgacggcggctcgtgtcctcgcggatcggggcggccgtgccagcgatccggcggcggcggcggcggcggcagcagccctgcaggcagggctcacgagcccgggagtccgcctccctcgggggtccggcgagggcgtcgccgacctgcacgttacccgcgggcggttggcggcggcggggagggagtccccggcgtgaagtcggcgcggtggcgggggtaggggaggtggcaccgaaggccgacaggacctcgtgccgaattc

SEQ ID NO: 19071 - DNA, 380 bp, Triticum aestivum
  Clone ID: PAT_TA_19071
cacgagtccacagccatatcctcccactcactcgttttctggtgtgtctaaggctagagcaagcgagcgagcgagactgagagaattgtccgaagaagatggcttgccctgcccaatccatgctctctgctagcagctgcgtgctcctgaggagcagcaagccccagcaggccacgattccgcgaggaggaggaggaatcaacggcggcaacaggttcttgacactgtcctgcaatgcttcttcgtctccggacgactccgagtgcaacgacgtggagtgcgcgccggagaaggaggtcgggagcctgagcgtggagtggctggcggaggataggaccaaagtcgtgggaacattccctcccaagaagaaaggatggacc

SEQ ID NO: 19072 - DNA, 1125 bp, Triticum aestivum
  Clone ID: PAT_TA_19072
gccggccggtcccgggtggtgttcctgaatgtccacagccatatcctcccactcactcatcctcccactcacccgttttctggtgtgtgggggggggtaaggcgagagaattgagagaagaagatggcttgcccagcacaatccgaagatgctgctagctgccccttcccactgcatggcatccacgcgcaggcgcgtcatgatcaggagcagcaagccgcagaaggccccgcgtccacgagtaggaggcggcatcacgggctggcaactggtcttcgacgctgtcctgaatgcctcctcctgctccggacgcctccgagtgcgacgacgtggagtgcgccccggaggcggaggtcgggagcctgagcgtggagtggctgccggaggagaggacaaaggtcgtgggaaccttccctcccaagaagaaaggatggaccggcctcgtcgagaaggacaccgaccggccagaccaacatctactccatcgagccggcggtgtacgtggcggagagcgccatcagctccggcacggcgggcgacgtcgtccgatgggtccgagaacaccgcggcgctcggggcgggcgctggccctcatcttcgtcgccggggcggcctccatcctcatccaggtgagcaagaaccagccgcccgtgcagaccccaatactccggacccgcctctcaggcttactacgtcgcccaggtccccagccgggcctgccgcggccattgctcggtcccagtcgaggccccccccgttgtggaagcggacggcgccccaggaggcgaccttctgattcagccgccatctaggctgaaccttcggcaaccgcggggcagccgtagtcggtgagctgataatgatatacgaggtgagcgagagacggaaatattcgaagcataaatttgatgtggggcgacgggcacgagcttgtgtgttagcaattcgatacaacgctagagtttggagagtttgaggtgccgttcttcactcatgagtgaagcctactctttattttgtatacgcggtctatgccgggtggttggcttggcgttcagttacttatcatacataccagttgcaatcatgttacaacatctccacgaaaatataataaagtttttt

SEQ ID NO: 19073 - DNA, 975 bp, Triticum aestivum
  Clone ID: PAT_TA_19073
ccatcgcttcatctttgccacagccgaagccggcagtgtgctggattacaggccatctactgtggctgcagctgcaatcttggctgcatcctatggagctctactgaccaaagaagcactggagtccaagatggacaatctatctccaccatgccccattgagaaagagcatgtacatgcctgctacagcatgatggttggcgacttgagaaacagaaagagcaatggcaagagatcattgccatgttcagactccaatgaagttgccaccagtacatatgattctgttcttgttgacgatgttgccgacactgctgccttcatggcagcggtgtcggagatgaacaagcggatcagactggagccgccgggaatccattgagaagctagcaccgccggggacacgcaattttttgtcagatgtctaagggggcttggtttggatcttcattttgttttttccttgttcaaatttgtttaggttctttcggccattgccatggttggcattggcaatgctgttggattggtttggattggtttgtgagaggggcaagcgatgagcaaagataagggctgggctgagctttcctaaggagaggagagcttcactggagcccaattccggtgcccaaatggagcacatttcctgtgagaaattcaccccaaatctgcactgtttttggtacgccatagtggtggatgccatcttacgttgcatatggtgagatgctagctgttggatgcagtagtagcactgaaaggctgggggtttggccattgtttatagagccaagaagaaaaaggttgcaagtggatgtgtgatcagtgaggagtggtgttccactaagatgcactgcactgtacttgcatggatgcatgggttacattggtttgtgacaagctccttggggagtaggttgtaacttctgtaacatctgcttctgttcttgagaaatgggatcagattggtgc

SEQ ID NO: 19074 - DNA, 534 bp, Triticum aestivum
  Clone ID: PAT_TA_19074
ccggaccaacgcacagcaccacaacgccaccaaccagcaagtaaaatcgtcaatcttgtaccgaccgatcgatcgagagggatgaacgcagactacggcgcgcctacggagctggcggggcccctgcagcagaggcgggccctgtaccagccccgcctcccgccctgtctccagggagcgacggtgagggtggagtacggcgacgcgaccaccaccatcgaccccaccggcgcgcacgccgtcgcccaggccttcccgcgcacctacggccagcggctcgtcacctttctcgcgccggacgacaccgccggggctggcaaggctgtcgacgagcgcccgcccatcagggtgggcgtggtcttctccgggaggcagtcacctggagggcacaatgtggtctggggcctccatgatgctctcaaggcttacaatccccagagtattctctacggatttattggtgggactgaggggctgtttgcaaacaaagacattggggatcaacagatgatgttcttgcctccttcaagaacc

SEQ ID NO: 19075 - DNA, 1125 bp, Triticum aestivum
  unsure (1)..(1125): unsure at all n locations
  Clone ID: PAT_TA_19075
gaggatcgcctccgccgggtgcccgccgcccccggccgtccgctcctgtccggtcttcttccggcgcgcccggccgccccgcccgccgcccccgtcccctctcccgccgccggcggtccccgctaccccctcgaacagtatttccgagtgagatgcaaaggaagcaaagagatatataatcagcactatggacgatacaatattgcataaaatatggagggatggatatcttaccctgtccgtccacacgcgtcggcccaggcgtcctccttacgctcaaagtttcggggtccctgacgtcagagcggagcgcgaggagcacgttcccggagctggaggggttccgtgtggcggcgctgcgagggttccggcgcgtcttctcccacgccgcccccatcttcttcgagcgcggcatcgccattgaggccactaaggagttctcaagcttaagcgtggagcattgtgagggagaaatgatagttgtcactgtgtttgaaatcaaggaggaggaggtgccagccttcatcgagagggaactcgagttcagatttcttgctgtggtccctgaaggactggatggagtgccttttccaaatccagctgttgtctgtgcacgctatagcgatgaagagtatttccaagtgagatgcaaaggaagcaaagagatatataatcagcactatggacgatacaacattgataaaatatggagggatgatatcttaccctgtcgtctatatctcaggcactgtgttcttgctgccaagaatctgggagaaccagcatatagcaacttcttagaccacacctatctgggtgaccggagaaccacaataagggaatacttggccacgaccggagctggcatcatggaagaggagccaccggagacgctaagaagccgctacggcggctaacccgacgatgactctcacggccacagccaccacagattgaaattctcacttgtgtgactgcttcctaccgaatcggcagtcgatatgaacagggatgcaccaaataatgcatgatgcttcagtgcagaatatctacgattgcgattgttttgggcgcaaattatcggcgccaaacgcggtgnatgtatgaccctgttgtgattgatgt

SEQ ID NO: 19076 - DNA, 539 bp, Triticum aestivum
  Clone ID: PAT_TA_19076
tttttcaccatgaattacagaagcttgtaccctctaaagtaccaatactgacgactacatgcctgcatattcagtgatacaaaactaaattctaacgtactaaaactgatgattctaatccacactggaagtgttgcccatggaaattcagaaccttggtagttaaggccttttattcttgccatgttatctgctatgaacttgcatgaagctcttctctcactcactctttggattttgtccagcatgatatttagttacctaattttgttattaatgctgatatgatcggctacataaatttatgtctagcttaattgtccatgcattgccatgtaaatattcaaattcagaagaaaaaaaggtcacaaagaaacaactatgcacggtgaaaaataaagctagagataagttttccatgcatgtaaatatttcaacacacaactttgctgctgtagacattcccagtggactgttgctattagtgaaccaccctattgtctacgggtgcttgagactaacattctaacttgcaatcc

SEQ ID NO: 19077 - DNA, 890 bp, Triticum aestivum
  unsure (1)..(890): unsure at all n locations
  Clone ID: PAT_TA_19077
ttgatgccgtgcaagnaggtgcagaatgagaatgaggctaataaaatggaggaggatgctaaggtgtctgattcggaggtcgttgagaaagggatcaacagtgagagtattcatactaatgcttcttctggtgttggtcacggagggggagataaatcattcgccagtgccctcagnatgacaagcctgatgatggtagtattatggacgagaaggctgaacatgacaagagtttagatgacaaggctgaagatgagaagggatcaagcgttgaaaataatttgcatggtggttgtcagaatttgttgagcaattgtaattttgcaagagccccaacaagaccacgatcaatacctgctcataggaatggagcatcagcccatagagatactgcattggccaaacaggtagatctggctcctctgatggtgattgatgaagcagcaaatgacagctccttgactaatgtccagggagacaataaagatgaccttgtctgcctagaacatactgacccaagtcttgcttgcaatcaaatggtggaacacatgagactccaagaagaagcagcacaaactgagatacgagatgtgcaagaacagaacagtactgcacaacattacacagttcaggaaaattaaggagtgtgatggactgaatcctacacttgcttctcagtacgattgttcgaagcttcaagtgagggaagaagtgcaaatttacaatattgacacaccaccacaagatgtagacttgattgattcagctgataaagggaaaacaacagatagtgtggaattattacctaatatcaaagatgaagctgttgtcacgataaaagaggaagaacttggccaatctagctcatttaaaatatgtgatctcaacct

SEQ ID NO: 19078 - DNA, 853 bp, Triticum aestivum
  unsure (1)..(853): unsure at all n locations
  Clone ID: PAT_TA_19078
attcctgactacaaaaactgggaaaggaacaccacagtggatggctccagaagtgctacgtaatgaaccttcaaatgaaaagtctgacgtgtacagctacggagtggtcctatgggagcttgttactcagaagattccttgggatactctcaatacaatgcaggttatcggagctgtgggtttcatggaccacagattggaaattccgagtgacatagatcctcagtgggtatcaatgattgagagttgttgggacagtgacccacagcgccgcccttcattccaagaactcctggagaggctccgtgagctgcaaaagaaatacgccctgcaggtgcagatgcagcggagcgcggctgggaaaggcgctgaaaagatgagcgttgatgatggctagctaaggctcaggccccgacttggatggattgtgtatttgccattatgaaaatgggccattgggctggatccggaaggttcgaggaagtcctccaccacaggagaatcgagacaaggtgcctgaaaggtggttttaagcttgatgaatcacgaggctgaagccctgagacgcggtttcttttcggagagaaaggccatagaacgaacactcgtcacatagcagtcgttcgaggcactgtaggagggacgccttgatcagttcttgatggattttttgtattaccaaaacttgtattcatacatcctttctggtgtgactagttagggaagctcaatggcttgggagtttgaacgatcttattcgtttgcagcatgcaccacgatcaaaatcgaaagggcagttactgtacgcactttccctatttcaaattataaggtgttttttttgtaaaaaaan

SEQ ID NO: 19079 - DNA, 1209 bp, Triticum aestivum
  Clone ID: PAT_TA_19079
tttacaggcctgctgccattgatcaactcactgtactgggtgaacaggtgggtgtgccagtttactcagaaggaaccgcggccaaacctgcagaaataaccaagaatgccgtggaagaggcgaaaagaaataatattgatgcgatcgtagtggatactgctggcagactgcagattgataaaacaatgatggttgaattgaaagaagtaaagaaggcagttaatcctacagagattttgcttgttgttgatgccatgactggccaggaagctgcagcattggtcacaaccttcaatattgaaattggtatatccggtgctatattgactaaattggatggtgattccagggtggagcagcacttagtgttaaagagtgtctggaaagcccatcaaatttgtagggcgaggggagcgaatggaggaccttgagcttttctatcccgaccgcatggcacaacgtgttttgggaatgggagatgtcctttcatttgttgaaaaagcacaagaagtcgttcgccaagaggataccatggaactgcagaagaagatcatgagtgcgaaatttgacttcaatgactttttaaagcagacacaaaatgttgccaaaatgggatccatgagccgtgtaatcggaatgattccaggcatgaacaaggttactcctgcacaaatccgggaagctgagaaaagacttgcattcgtagagtcgatgatcaatgcaatgacagccgaggaaagggaaaaacccgagttactggccgaatcacgcgagaggaggattagggtagcagaggagtctgataagacagaacaagaggcgagccaactggtcgcgcagctcttccaaatgcgcgcgcagatgaagaaattgatgggtatgatgcaagggcaagaagcaattgcaggaatgggagatctcatggactcgcttaatgctgacgagaaggcacctcctggcactgcacggcggaggagacggcggagcgagccgccacggcagagggagctggatgcagtgggtggcgccagtaggccttgagttgatgtgcactggagctggaatttttcactgaaagagttgtggattggcatgtagatacgggtcctgctgcatgatgtaatatttcctgtacattttggcataccgactttacaattcgtgggaaatgtgtttagtggacggaacatggagtttgagggtggaggc

SEQ ID NO: 19080 - DNA, 1327 bp, Triticum aestivum
  Clone ID: PAT_TA_19080
aatcgatcaagccgcatcatatgcaaaaacagttgcatgtgttcaggccattttgtctaataaaggcccacgcacagcagctgaaattgaatgggttgctttaatagggcaatctgttgcaattgcgtcagctcaatcagggtcagttgggtctgagaattcactggaaacagcctggcgagctgaggcggaaagccttaaatcaatcttaaccactgctcctcagaataagctgggaagaattgctcttgttgataccattgctaagcagatacgtaagcggatgaaagtgcggctacctaacttattgactgggcttcagggcaagtctcaggtagtgaaagatgaacttgcaaggcttggagaatcgatggtacaaagtccggaaggaaccagggctgttgctttggagctgtgccgagaatttgaagataagtttctcgctcatgttacttctggtgaggggtctggttggaaaattgttgcaagtttcgagggcaagtttccagataggatcaaacagcttccgttggacaggcattttgatctgaacaatgtcaaaaggattgtcttggaagctgatggttatcaaccatatttgatatccccggagaaaggtttaaaatctttgattaaaggagtgcttgaaatggcaaaggagccatcacgactatgtgttgaagaggtacaccgtgtattgttagacatagtaaatgccactgcaaatggcacgccagggcctcggaagatatcctccgttcaaacgcgagatcattacaattgcatctaatgcgttggatacattcaaaagtgacgcgaaaaagatggtggttgcgctcgttgatatggagcgtgcctttgtccccccacaacatttcatccgtttagtacaaagaagaatggaaaggcagcgccgtgaggatgaggtgaaaactaaatcatctaagaaagcacaagatgctgagcaagccatgatgaacaagggttctgagcaagctaagtcgtcaaaagacaaatccaatcagcaagataaagataccaaagagggacctaatctgcaggttgctggtcctggcggcgaaataactgcaggttacctattgaaaaagagtgcaaaaaacaatgaatggagcaaaaggtggtttgtcctaaatgagaagagtggaaagcttggctacaccaagaaacaagaggagagacattttcgaggcgtcattgtcttagaggaatgtaaccctggaagagatagaggaggaagagctttctaaaacttctaaagattcaaagaaggcgaatgggccagagaaaggcccaagtctcgtattta

SEQ ID NO: 19081 - DNA, 1611 bp, Triticum aestivum
  Clone ID: PAT_TA_19081
gtgcagaattgttgtctgctgcttagtttgtcccatacacaggtggaagctcttatctacctgtgtattaagacttatcaggtcgacgaccaaggttactgcaccgagaccatggcaggcagctcaccgaaggttagtgagatccggtgtgggcagcgtgcggaaggctccgcggcaatgctggctatcggaacagcaaatccggcgaacaaggtgtcccaagaagagtaccctgactattatttccgcgttaccaagagcgagcaccttactgaccataaagacacattcaagataatatgtggtctaacgggcacggagaatcgtttcttctaccacacggatgaactgctcaactcccaccctgtcttgctggacaacacgtcaccgtcccgtgaggctcggcatgatatcgtggccaaggctgctccagagcttgcggcagcagcagcaaagaaggccatcgcaaagtggggccgtccggccagtgacatcacccaccttatcgtcagcaccaactctgacgctggcgccccaagcgctgacgtacgcttggtttcactccttggccttcgcgccgatgtgtgtcgtaccatgctccatcttaacggctgcttctgctccgccttgcgcctagccaataaccttgctgcgtacaaccgtggggcacgcgtcctcgtagcttgcgtggagctcgccatttctggcttctgcagccccggcgaaggggactgcttagacaccctcatcactcatgcgttgtttggtgatggggcaggcgcggtaatcgtcagcgccgaccccatgcaccccatcgagaatcctctgtttgagatggtgtccgtctctcagaccctcgtgccgagcactgagaatgcgctcaccttgaacttggggagcaatggcactcatgggaaagtttacaccaaactgcccacactggtagcagacaccatggaaccttgtcttctggaagcgtttggtccacttgagatggacttccaatggaatgacctcttctgggcagtgcaccctggcagccgtgggatcttggaccaacttgacaagacactccagttggagcccacgaagctagcggcgagcagaactgtcgtacagaagtttgggaacatgtttagcgccaccgtgatcttcgtgcttgatgagctacagcgtcgaatggaggaggaaggagagcaagctgagtggggggccatggtgggatttggaccaggcttcactatcgagaccatggtgctccatgcaaccggcgctctcaagaaaaaatagcgcttcgtggttaagctatgtacgcagcagcggagaataagattaaagtctgtgtgcccaactattttaattgttctcatccaaaagttattttgattggatctgtaacctatatggttaccaaatcaaatatcaactacctccaataatgtacgatgttatggtttgtcctgattttgacagccattaatgaatccatattgcaagacagtctaaaagtattgctcacaagatttatttttccactgcactatgcatgctacttcctccatccgggtttgtgaagtgggcacagatttttggtttttcaatttgactagc

SEQ ID NO: 19082 - DNA, 1828 bp, Triticum aestivum
  Clone ID: PAT_TA_19082
cccgcgcccgcatcctccaggacgcggaaacgcagaggccgcgtcgcctttctagctaagctaagctaccttgaggaaatggccgcggcgacggcaatggccatgctggcggcgctggcgatcctcgcgccgtcggcgcgggggctcgaccgcgccgagttcccgcccgggttcctcttcggcgccgccacgtcttcttaccagatcgagggcgcgtacctggaggacggcaagggcctcagcaactgggatgtcttcacccacacgcagtctagggaaatcaacgatggacggaacggggacgtggcggatgaccactaccaccgttacatggaagacgtggagatcatgcatgatctgggtgtcaactcctacaggttctcgatctcatgggcgagagtcctaccaagaggccggcttggaggcgttaattcggctgcaatagctttctacgaccgcctgatcgccgcgctccttgagaaagggatagagccgttcgtgacgctgcatcactttgatctgccgcacgagctggagacccggtacggcggttggctgggcgccggaatcagggaggagtttgactactacgcggacgtgtgcttcaaggcgttcggcgaccgggtcaagttctggaccacgctcaacgagcccaacctcttcaccaagttcgcctacatgctgggcatgtacccgcccacgcactggtccccgccgttcgggaactggcacagcggcaactctcgccgggagccctacgtcgcggcgcataacatgctcttgtcgcacgccgccgccgtcgacaactacaagaagaattagcaggcaacgcaaggcggatcgatcgggattgtgatcgccatgaaatggtatgagccgctgaccaactccacggaggatatcttggcagcaagacgggcgttgtccttcgaggtggattggtttctggatccgatattctttggtgactatcccagagaaatgtgtgagatgttatcatcaaacttaccaaagtttacctcagaggagaagaggctgctacggaagaacaacgcagattttatcgggctaaatcattacacatcgatttacgccaaggattgcatctcttctccatgcgaccttgaagactcatgacggaaatgcgctggatgcaagctgtaggtgaaagagacgccgtgacaattggtaaaccaactgcaattcatggttactatgatgttccggaaggtatggagctaatcgtcaagtatgtcaatcaggagatacaagaacacgcctgtctatgttaccgaaaatggctactcgcagtttagtgacaatagtatggaggacttgatcaatgacattggaagagtaaactacctccagggctatctcacaagcatccctgcagcagtcaggagaggatcaaacctgagtggctactgcgcgtggagtcgcagggcaactaccagtggctttggtccacctacggttggatggacaggtaatttgaacccgtgaggtgcaaaatgtgaggcaagtcgctattggcactcccggtttgctacacatcgttccaacacttccctaatagcgtctttgcctagtatagaaatgtaaattttgagtgctgtaaaggtatatactacatactctggaggttgtcatcactttggagtaatggaggggctaggggtgcactggagcaatgcctgttccatgtggtggaccgggtttgtggattccatctcatgcgtgatctgtcttcaaatcatgtacgggtgtacgcactattgacggctatagcattgcccaatcagatagagagtaattgttttcgtcc

SEQ ID NO: 19083 - DNA, 1630 bp, Triticum aestivum
  Clone ID: PAT_TA_19083
gatttcggaacgtgctttcgcacgcgcccgcgtgcgcccccaagcgtgctcgcccgcgtcctcctctaagagtggtgaggggttcgtcgctgctagccaggcaatcatggcggagacggtcaccaatgtatcggagtaccaggccatcgcgaagcagaagcttcccaagatggcctacgactactacgcatccggggcggaggacgagtggaccctcaaggagaacagggaggcattctccaggatcctgtttcgccctcgcatactgatcgacgtgtcgaccatcgacatgaccacatctgtcctgggaatgaagatatccatgcccatcatgatttcccccaccgcctttcaggaagatggctcaccccggaaaggagagtacgcaactggcacgggccacgcgtcagcagcaggaactgtggatgacgctgtcatccgtgggctacctcgaggcgtcgggagggaggtcggcctcgaactgggcccggggattcgcttcttccagctctacgtgtacaaggacaggaaggtggtggagcagctggtgaggagggcggagaaggccgggttcaaggccatcgcgctcaccgtcgacaccccgcgcctcggccgccgcgaggccgacatcaagaacaggttcgtgctgccgccgggcctcacgctcaagaacttcgagggcctcaacctcggcaccatggaccaggccaatgactccgggctggcgtcgtacgtcgccggccaaatcgaccgcaccctgagctggaaggacgtcaagtggctgcagagcatcaccaccatgcccatcctcgtcaagggagtcatcaccgcggaagacgctcggctggccgtccactccggcgcggcgggcatcatcgtgtccaaccacggcgcccgccagctcgactacgtgccggccaccatcagcgccctcgaggaggtcgtcacggccgcccaggggcgcatcccggtgtacctcgacggaggcgtccgccgcggcaccgacgtcttcaaggcgctcgctctcggcgcctccggcgtcttcatcgggcggccggtggtgttcgcgctggcggcggagggcgaggccggagtgcggaacgtgctgcgcatgatgcgggaggagttcgagctcaccatggcgctcggcgggtgcaccaagctcagcgacatcacccgcaaccacatcttcaccgagggcgaccgcctcgggcgccccctgccgaggatgtgagcaagagccaacggcatacgaacgcgcccatcgccgatcatcgccgtctctgacgcacggccgggcatgctagccaagtatccactgcaacgcacgcaataattaccgcgaactctatacctacgacatcgtcagcgccaagatggatgctagccgtgtgtgtccggccggggacggtgagccgtagtagataaattttgcgtactgtcgaccggcacgtttcgccatttgaccatatttcacaccgactacaccatattgtattccatatcctattgggtccgcacatatacactcatcgattctgtatttatcataatacattgtcatcgagtaaagcttatctggatacgggtgtgaactggaaagggtacgtcgagacaatgtgcaagctct

SEQ ID NO: 19084 - DNA, 1101 bp, Triticum aestivum
  Clone ID: PAT_TA_19084
gcggcacgcctcatccccgggttccgcctcccctcatcccccgcgccccctcccgtcccggcgagccaccctcctcctctatgccccagaccacgcgcgcacgccacagccgacgccgtgctaagcttcggcgcggaggcctcgtggccgtggatcgtgatggaggctgcgacaggagaggcggccccgccgcgacccttggcgtcggcggcggcggagcaggacgcgccccgcccctccgccacctgcccaggctcgggtggccggcgggcctcttcgcgggtcgctggacggttgacggggggggtcacgggggcattggctgggagggcggcggacaagcggcgtgctctggggagctgggttgggggcatttgctggcgctgtcctgtccattgaggtcctggatgcggcccgcgcctattggcgcgcctacaggtcaacaccccagagtacatcacccgtgggggatttcctggatgagctccttcatgctcggttcgtgggagagcagtatgagccatcagtgtatatgtcatatcgttggcaggttggtattgcagagtttggcaatgatgatccgtatgatatcactggagaagtttcatccgatgggctctcacaggataacttgaagaagttgccataccatgtggtgattgatcagaaacaagagccagctggtgaaaacttgtcttgccctatttgcctacaggatatcgtgacgggagagatggcgaggaggctgccgaagtgttgtcacaccttccatcagccctgtgtggacaaatggctcattggccatggttcgtgccctgtttgtaggcaagatgtgtaatatatgatgtcttgtttgtgctatcttcttagaatgtaggtaacacagctgtgtaaaatgcttgttctcatggtacatagaaaggtaaatagcagtgtaaatcaagccatgcatgtgtttctacactgaaaataaaacggcgatgtacataagatattccgaggatcattcttttcccactcaattgagatgtgtaagtaacctaagtttgacctgcttctgatgcataaataaccagtactatctctgccccaaaaaaaaaa

SEQ ID NO: 19085 - DNA, 1034 bp, Triticum aestivum
  Clone ID: PAT_TA_19085
ccgcaccccgccccccgccgcctccgtaccgggcatgcaagtcgttcgccgtgatcaggagctccaaggccgaggggcccaggagacccacggcgcctccactgtcgccgcccccgcctatgcctcccgtgtcgccccccccctcctccccgccgtccctccttccctctcactctcttcccctccgtctctctgttccttcctgccttccaagagacaatcaagaacgccaggcagctcaaaccaagcaatgtctttggcaccttccatcccttccatcaaggtgaaggtgggacgcatcgccccgccgcctccgtaccgggcatgcaggtcgttcgccgtgatcaggagctccaaggccgaggggcccaggagacccgcggcgcctccactgtcgccgcccccgcctatgcctcccaagacgccagctctgtccacccctccgagcctgtcccagccaccgaccccagtgaagccagcacagccatcacctcctcctcccgagaccaaaccggcagtggccactgccgctgcgaccccaccggtgggaggggttgtgacgttcgagtaccagaggaaggtggccaaggaactacaggaatacttcaagaagaagaagctggaggagaccaaccagggacccttctttgggtggttggccaagaatgagattgccaatggaagatgggctatgtttgggtttgcagtggggatgctaacagagtacgcaacaggctcggatttcgttgagcaaatgaagatccttctctccaattttgggattgtggatttggattgatggctcatgtttggcggtgttgttctgtataagtctgaagtataatctatcttctttcatccaacgtatagaaagatcaatcttgcacactattatatccttgagtttcatttgtgctgtcccgtcagtattgatgaatgtaaaatccaatttccagctttcttgtttgttaatactacatgaattactcaagagtaataaaatggatattgactaaaaaaaaaaaaaaaaaaaa

SEQ ID NO: 19086 - DNA, 3542 bp, Triticum aestivum
  Clone ID: PAT_TA_19086
gtccgcgacttaaccaccttgcggaacaacaagaaaaacctgctccttgcgggcgatatgaccaaacggcacgccggcgcgcccccgctgtccgcacgccccacgccgcccctctccggcgatctacaggtgtagatcccccccggaaaaaccccgcgcccggcgacgatgacgacgttcgcggaacctgagaacgcgctcaagagagccgagaagttgatccaggttggacagaagcaggcggcgctgcaggcgctgcatgagctcatgacggagaagcgacacagagcaggagagccgctgcgcgaaaatgatgcactagaggctgttgctgtctcagcaccagtccgtgaaccaacatctgcaaccccaggtgtcgcagcttacgcaactggtgctgctcatggcaagtaggtctcgaagggggaactcgtgaatgatagtagcaggcaggacgccgactgcggcggcggaaccagaccgctgggatccgcgatggtcggtcctcgcccttgcgcagcgccaggatgctactcctgtgcgcgatgctcgatgccatccgccgagagccgccaacaaagccaatgatgcgcgtaccttccgccagtgacgctccacggtgccggattgcgaagaagcgccccaggacagcccgccagctggacgcagatgatccaactccatctgctcaacgctggcgtcctgggcctaggacctctcaaaattcctcatcgaactagtgcaccggctggaggcgctggaggtgcctggcattaaatgcgccgctcgcaactttgatcctaagttgtgacccgtgcgccttccaagtcttgaaggtccatacacgattgctggtctactgcggttatctggaagcacgggtactcgcccttccctccggcgcgccgctcctcctatgctcgatgcttgtccagtctgccaataacttgatccggttcgtgatgcgcattccttccgccaggatgctcccccttgtcttgtgccaagatgcgccccatgctgtccataacccagacgctgctgctccagctgcatctactgaacgcgggcgtcctggatctaggacatctgcaaaaagctcttccacctcctcgtctctcggctggaggcgctgtagctgcctggcctgaaatgcgctgtgctctgcctgctgtatgagatttttgccgtccatcttccaagtctgggagcttcatgcacaatggaagcctgccactgatatctggaagcacggttacttgaatttgcttgttgcgcacctaaattttcgaattgcaactttgcactatttctcagtcatgtttgatgttttgagagtcacggtactcacttcataataaggtaaaagatctgtacaaccttatggagcatgagttccttcctctggatctagcatcaaaagtacagcctctgctttccaagatttctacgattggaggaaagctttcagctgcatcttcagttccggaaattcgtttatcacagtaccaatctgcattggagaagcttactgcactgagggtgctgcagcaggcatctcgtattttccagtccatgaaaattgatatgctatctagaatgatcccattctttgaattcaatgtcgtggagaagatcgctgttgatgctgtcaagcacaattttgttgctatgaaagttaaccatttggcaggagctgttcattttggcaacatggacatagaatctgatgtgcttagtagtcaccttagtgtcctcgctgattccctgaacaaagcattgagtcttattcatccacctgtgcaaaagccatccaaacctagtgaaaacttgaccagtcttgctggagtggtggagaaagaacatagaagactccttgcgaggaaatcaattattgaaaaacgtaaagaagaccatgagcgtcaaatattggaaaaggaaaaaatagaggagacaaagagattgactattcagaagaaatctgcagatgaagaaagggagaggcttttgaaggaacagagacttagggagcagcagaggatccgtaaagaaatagaggaaaaagaggcgagggaagcagcaaaaatgatagaagatttaacaggaagggggaagaataagaaaaaaattcacattgagggggatatgacaaaacaacacgccatggaggtggtgttgaatcaacaggtgaaggagcgtcaggagatggaaaaaaaactggcgaaacttgcaaagacaatggatcacttggagagggcaaaacggcaggaggaagcaccactaatcgaggaggccttccagaaacgcctcgaagaagaaaagatccttcatgagcaagagcagctgagagagattgagctcagcaagcaacaccatgcgggtgacttgcaggagaaaaataggctttctagattgttggagcataagaatgctttccaggaaagaattgtccaacgccgtgaatctgagtttagtagcctaaggaaagagagggaagaaaggattaatcagttgctatcttcaagaaagcgtgaaagggagactgtacgcaaattgatgtattttctgaacatggaggaacagcggatccaaagggagcgtgaggaacaggaggctagaaagcgtgaagaggaagagaggagaaagaaggaggaagccgtgaggaagctcaaacttgacgcaatcgctgctaagcagctgcagagggagagggagttagaagagagggagaaacagagaagggaggctctcctaagaggagcagagcccgtgcgcgcagctgatgcaccagctgctgctgctgtcgcaccgccagcccgtgaaccagcagcggcagccccagctgcagcagctgcagcaactggtgctgctcctagcaagtatgtcccaaagtggaaacgtgagggtgatagtagcagtcagaggccgactgcggcagctgaaccagaccggtgggtccgggatgatcgtcctcgccctgccctccgccaggatgctcctcctgtgcgcgatgctcgtcccatccgccaagaagctcctcctgcacgtgatgcgcgtcccttccgccaggaggctcctcccgccgcacgccaagaggcgccccctgctgcccgccagccggacggtgctgctccagctgcatctactgaacgctggcgtcctggatctaggacctctgcaaattcctcatccacctcctcgtccaccggctggaggcgctgaagctgcctggcctgaaatgcgctgtgctctgcccgctgtctgagatttttgccgtcctacttccatgtcttggagcttcatgcacaatggaagtctgccactgatatctgggagcacggttacttgaatttgcttgttgcgcacctaaattttcgaattgaaaccttgcactgtttctcagtcatgtttgatgttttgagagtcacagtactccatgcataatgtgttgctctttgttggcgtatatgttccagactatgctgttgttttgtcgagtatgcataatgaaagctaccgctgaatttttgagaaaaaaaaaa

SEQ ID NO: 19087 - DNA, 645 bp, Triticum aestivum
  unsure (1)..(645): unsure at all n locations
  Clone ID: PAT_TA_19087
ttttggatgatttttttttttattaccacaactgacagagtaaacatattgaatttccactgagaattggaacacctcggcaacttttaatgttctagacctggaaactaagacggacactgtccctgatcacaaccataagaaacccatacgaaattactaggactataactgatcctgtacaatactaaccaccaagtgtgaagtcgacgaattgttgtgctcactttatgcgagctattgttacgacgatgaagacgaacaccgagagcatgaaggacattctcactacatcgtcagacaaatcgtagtccatgctctgggcctggaagagcgtgtgcacgagctgaagtatcttctcaaggaactccttgatcttcgcctgggtgttctccaggacccattgcatcattccaggaggagcactagagctccccttgttatcagtttccttagcatcctggaaggacttcttaaattcttgcaccacctcattgttcatgacagcgtcccatacagccttatcagttgacaaggccataaccattttctgaacagaggcatcttctttcaacagctggaatgcgtccagtacattttgatgttcccttnncatannnnnnntcgagttaagtgcaagtgtgc

SEQ ID NO: 19088 - DNA, 1402 bp, Triticum aestivum
  Clone ID: PAT_TA_19088
aattcacacacacccacacacacacccaaagaaagacacgcaaacatgccggccaccgcctcgccgccaccgctgctcctcgccgccgcgctcctcctctccgccgcgttgctctgctcggcctgccccgtgccgctgccgaagcagacggccgacaacagcccgcggctgcagcgcgcgtacgtggcgctgcaggccctcaagcgcgccatcaccgacgaccccaagaacctgacgggcaactggtgcggcccggacgtgtgcgcctacttcggcgtcttctgcgcgccgtcccttgacgacccgtgcgcgcgcgccgtggccggcgtcgacctcaatcacggcgacctcgccggcacgctgccgttcgagctcggccacctcactgacctcgccgtcctccacctcaactccaaccgcttcgcaggggggctcccggactccctccccaagctctccctcctccacgagctggacgtcagcaacaacctcctctccggcggcttcccgcagcacatcctctgcctccccaacgtcaagtacgtggacatcaggttcaacaacctgtgcggccccgtgcccccggccatcttcgacaagaagatcgacgcgctcttcatcaacgacaaccacttcgacttcgagctgccggagaactttggcaactcccccgcctcggtcatcgtgctcgccaacctccgcctccgtggctgcatccccgccagcgtggggcgcatgggggccacgctcaacgagctcgtcatgctcaactccggcatccggtcctgcatcccgccggagatcgggtggctgcgcgagctcaccgtgctggacgtgagcttcaaccagctccagggcacactgccggagtccatggcggggatgcacgcgctggagcagctcgacgtcgcgcacaacgagctcgccgggcacatcccggagggcatctgcgcgctgccgcggctggccaacttcacctactcgtacaactacttctgcggcgagccggagcggtgcatggcgctccggcgcaacgacgaccggcagaactgcatcgccggccgcccggaccagcggccggcggaccagtgcctcgcgttcctacaccgcccgccggtgcactgcgacgggcacggctgcctggcgcagcactagtggagatcattcgtttggtggtgtaaaacggggcgagatttcaatcatcgtatatacatacatatatgaacacacactgtaatttttattttttttacagagaggatggtaataatggaatttgtagacatacatgatctcatacattattgattattttgcgggtgcgtacatacataaaaataggtcgataatttaactatctaaatatgtattatatgtgacaaaaaatatatatttagaaact

SEQ ID NO: 19089 - DNA, 2077 bp, Triticum aestivum
  Clone ID: PAT_TA_19089
cttctccgctggtctcgctccactgtctccgccccgttccttgcacgcctcttcgtcctcccgacgtgttaggccgagagagaccgagcttgagcgatgatgaaggcgggggagaggagcaactccaagcggcgcccaggccgctgtgcgactgagccaacttgcgggcggacgtgtgcgagatgcgcggcgacgtgagtctgcacccgcaggttccctctctgctcttcgcccgacgcgaggggtcgcagcgggacggggtgtggaagatcaagccctacgcccggaaggatactgatctctgcctcaggcaacacgccggaccagacggtctccaccgacgccatcatcggcggagaccccaaagtggtcgacgatgaaacctatgtaaagccaaaagagatcacgaggcggcgaacctcctccaccgactgcgccgaccgggccgggccccgcctgccggcggccgccgccggccgccgccaagggcggcgccgcccgtaggtcgtggggcgcggcgttaggtggggagaggaaagacgtggtggaggagggggagcgggacgaggagaagcacgccaaggtcacgctcccgaccgtctccaattacaccattcatgacgccgaggacgccgacaatgccaagcaagaaggctcgagcttgtcccccaacggcctcgccctgctcggcagcaagccgctgtgcgacttctccaacttccgggcgaacgtgtgcgagatgcgcggcgacgtgagggctgcacccgaaggcggcctcggtgctagttcatggagcccgaggggtcgcggagggaccaggtgtgggaacgatcaagccctacccgcggaagggtcgacgagttctgcctcaggccacaatcacggcagcctgacggtcaagtccaccaaggttgccgcctcggtgcacccagggatcggcgtgcacgccgccgggctctcctcccgcgcctccctgccgcggggagcctatctcacgacttccccgacgtgatcgtgccgctcttcaccaccgcccgccagttcgacggcccggtccagttcctcagcccgcccatgcagcccgtacgccctatcagtcgacgagagcagcctcaccggccgttccccgaagcccttatcgacttcagcaaggaccaccaggtgcactgctacaagcacgccatcgtcggcacgcacgcctacatggagttcaccatcgacgccaccaagtcgccgaacggggtcaccatggtcgacttcaaccggttcatgcggtcggcctactcgctgcccaaggccgccgcggcggcgctcggggagagccccagggtgaagccgaggctgctcatcatcaagcgggaccgcaccaaggatgttccttaacctggaggagattatcggcatggccgaggagctcgggttcgaggtggtgatcgacgaggccaacgtgagctccgacatcaacggcttcgccaagctggtgaactcggtggacgtgatgatgggcgtgcacggcgccgggctcaccaactgcgtcttcctgccgcagaacgccacgctcatccagatcgtgcccttcggcggcctcgactggatctcccgcaccgacttcgggaacccgtcggagatgatgggcctccggtacaagcagtacgccattaccgtcgacgagagcagcctcaccgaccactacccgagggaccacaagatcttcaaggaccccatctccttccacaagcgtgggttcgagttcatcaggcgcaccttcatggacaagcagaacgtgaggctcgactgcaagaggttcagacctgtgctgctggaggcactggacaacctcaaccagtaaatttaaggcaacttgccacccatttttaccattcgtttcgtgaaatttgatgttcattctctcatggcgtgtatgtatggtctaaactatagagattttgtctaggaattactcgtgtaaactgtataaattaaattgcccgccgctgcaaagatggaacgaaattcattgaaatgatataggcccctcacattgtcaataaaaaaaaaaaaaaaaaaaaaaaaaaac

SEQ ID NO: 19090 - DNA, 1386 bp, Triticum aestivum
  Clone ID: PAT_TA_19090
cccacctccccgcttcgcttctcccggcccaccgcgcccccccggaagccctcgcccagaccgccgcacgccccatctccagcgcacaaccaacgccaacgccgccgccgccgccgccaccgccatggcggccgcctcgagaggccttctcgcgcgcctccgccacctctccctcgccgggccccgcctccccccttgccgcctcttctccgcggagcctctcgtctcccatcccgacgacgacgatgcctgcgccggcggcgagggcggaggccggatcatagaggcgcgtcctggtgtcatgggcccggactcccggcggaccggcgtgatcggcgtgaagtgcggcatgtcggcgatgtgggacaagtggggggccaaggttcccatcaccgtcctctgggtggacgacaatgtcgtctgccaggtcaagaccgccgagaaggaggggttctacgcgctgcagctcggagcaggccaaaagaaggaaaagcatctaacaaagcctgaagtgggccactttagatcacaaggagtccttcttaagagaaaattaaaggagtttcctgttactgaggatgcacttcttcctgttggggacaaccatcatcggttcgtcattttgtacccgggcaatttgtggatggcattggaatcacaaagggaaaaggttttgcgggtggcatgaaaagacatggttttagtgggatgcctgcatcacatggtgcttctttatcacatcgcagcatcggttctacaggtcaaagggatgctcctggcagggttttcaaaaacaggaaaatgcctgggcgcatgggtggtgttcaacgcacagtgaaaaatgtatgggtttaccaaattgaccctgccaggaacttactgtatctgaaaggccaggttcctggtcctcaaggcagctttcttttcgtcaaggactctatttacaagaaacctgacagagctttgctgccgttccctacgtatttctcacaagaaggcgagttggaagacatggagccgctcattgccgatcttggtgatgtcgacccgttcatggcagcagattaagactatgacaaatttcgaagaatcccttttgctttcagtgcattgttgacaatcccaagtgattgtctgttaaattttgcattggatatatgagtagctcctgggttacaagagtcaccccgttacttgacctgcccagatcaatgttgttccatgtacattacctggcagatatgccagggccctgactcagttagggttttgagctgattgtttggtcgaccgagtggatcttattttgtttaataagttgtgtaagctatgattcagatagatatataaaatcgaaatctctattcaaaaaaaaaaaaaaaaaaa

SEQ ID NO: 19091 - DNA, 241 bp, Triticum aestivum
  unsure (1)..(241): unsure at all n locations
  Clone ID: PAT_TA_19091
ccccccaacaaaacgtgttcctcctcgcctcctcctcattctcctcatccggccccgaagccaagggaaaccagagatgcagcgatagacgctgtaaagaggtggctatatagacttcggtgctgcgagtcttgccgaggagtgagggaggggttgcttgattgcttgcttcggggtcggtgtgcggggtgaggtgtggagatgatggggggaggggcggggtcggtgagcggtggnaaat

SEQ ID NO: 19092 - DNA, 1700 bp, Triticum aestivum
  Clone ID: PAT_TA_19092
cgtctctctgtcgcccccacccacgcgccccgaagaagcaaccgcccttctccccccctccatcaggcagctcgccgtcgtcgccaactcagccaagcctcgagggaaggaacgacacacagatccggaccttgctgatgaggcttgtcattcgttcacctgagattaataaactccgttagtcaatcatggaacaacaacaagtcaagccatctctccccccgtctgatactcctatggataaccaggattcatctccacttcctgccgttactactgctgatcctgttccacgtgctctttcaaatgattcggctacacagggtgccaggacaaatcataaaatgtggtcatctccttctgcaaagctgggaaagcaaacacaaggttgatgatgacgcgactcccaatcatccatgtgttcctacatcaggcttatcttcctattgagaaaaacaagcaaaaaagatgtgcttatggaaaaggacttattcttccaagccagattagatatgtgaagtactttgagcgtattttaatttacttcaatggtgaaaatcagccgcctcgcaggtgcatgcttaggggatttcgccttcataggtgcccctattggatcaggccatcaattactgtgtccaatcacaatggtgttcttttttctacgaagaagcatccaagaacgaaagaactaatgccagaagatttctggtttagtgcaccaaagaagggaattatggttttcgcgttgcccggggagcctggattagcagaggtagctggtgatttcaagattcagtttcatgatcggcaaggagatttctactgctggctaaatacaacaatgatggagaacagagtgacactgaatccaactgattttgatgattttgacaagagaaaattgccgtcaccaggattccaggttgagatcgttctggtagattatagtggttcacaaccaccaaaacaaaaaccagctgatggatctgctgataagaagtctgatgctgattcctctacgagcagcagtgccaaagacagcaatgctgcacctgtagagtccaagaaagaaactggaagtgatgataaggatgatgttttttctgacaatgaagcagaagatgggtcatccaagggcaggaaggaggtctccagcagtggtcaaggtggagcaaatggagccaaagcttctgaaacaagtgttgcacaacaggagccatcagctgttgccagcggaatcgagaaaataaccatttcgggcgatcaaggaattgcaagggcagctgacgctatctctctcaaaactgaagctagcagcaagagcggctccaccaaagcacacccccctgctgtggaatcatccagcttgagcgagttcaaggccatcgccgcagacgcttcggtcttctcatttggagatgaagatgactacgaaagcgaatagggccctctgcttttgcaggtgtttggtttgtcatgtgtacattttcactcttctaagacccatgatggaatgtcactataaagcaaagctggaaagaattgatttatttttgtgttttgcgtttattatagccctttaatcaaggtgcaatgttgtaccttggaccagatctgaacttggacagtagcgactgagaatgttatagtcatttgattctccaagctagacggttgtttctttcaaaaaaaaaaaa

SEQ ID NO: 19093 - DNA, 1535 bp, Triticum aestivum
  Clone ID: PAT_TA_19093
gccgccgcgaagatccacccaatccgaacgctgcaattccttccctcagagggaaaaaaaaaaaagaagagggaagcatccggcgacgccgcgatcctcatccacacccgcgcccgcgagggcaccaaccgcctcccgctgccggacgcggccgccgccaccgtcggcgacctgcagcgcctcatcgaggcgcgcgccaccgtgcccgtcgccgcccagcgcctctccctcgacccggccctgctcctccccgccccgcagccgccgctcctcgccgacccggccgcgccgctcgcctccctgcccctcgccaacggctccttcgtctacctctcgtacccgcccggcgcgcgccccgcccagcccccgccgcccagggccctcaccgccgccggctccttcggcaagaagatgaccatggacgacctcatcgcgcgccagatccgggtcacccgccaggaggcgcccttctgctccgcggcctccttcgaccgcgactcggccaacgccttccagctccacgtctccgagtcgctcgccttcgccgtcaagcgggcggggttcctctacggccgcgtcgacgccgagaccaaggaggtgctggtcgacttcatctacgagccgccgcagcaggggtcctcggacgtggtccacctgatgcgggacgccgacgaggaggcccgcgtggacgccatcgccgacgggctcggcatgcgccgggtagggttcgtcttcacacaggcggtcgggaggaaggccagcgagacgggcgagtacaccctgtccaacagcgaggtggtccaggccgcccagctgcaggcggagggcgggatcccggagtgggtcaccgccgtggtgaagctggaggtgggggaggacggctcggcggacgtgcacttcgaggcgttccagatgagcgaggtctgcgtcaagctgttcaaggacggcgtgctggagacggagatccaggactccgacgacccccgcctctccaagatgcgcaaggaggtgattgcaggagggaaggacaccatggaggtggacaacgacttcttcctggtgccggtgaagatctccgatcaccagggcccgctctcaatgggatttccgattgaaaaccgtggaattcctctgccggcgaacgctctcaggagccacatggatcgtgcaaagcatctcccgttcgtcaagcggatctctgatttccacctgcttctccagatcgctgctttcctggatgtcaaggccgacgttcctactctggctgcgtgcgtgggacaccaggcagaggtgccagagggctaccggctcctgatcgacgccttggcaggtcaaacataaccagagagggtttcctgaaacaaagacacggtgtcatttagcagcttgctctcagtatcatctcatgtgtgatttatatgaatgtctcaggtgtgtaagtcttgtttaaaactcgtatatgcgattaccattgcacaaagggcaacatgtttcattttgaaaaaaaaaaacctacgcgtctgcccacgcgtccg

SEQ ID NO: 19094 - DNA, 699 bp, Triticum aestivum
  unsure (1)..(699): unsure at all n locations
  Clone ID: PAT_TA_19094
cccgttcccgcctccgccgccacgccgcccccgagcctagggctcggcccactgtcgcgccggcgggacccggacgtcttgcggatgggttgcctgcggcgccggccggagccggcggccatcgacatcacctgggtgtcgtgccggggcgtcaggtcgtcgctcccgttccacacgccgtgcctctacgcctccgtctgcgtcacgccgtcgtccgccggcaagaacgtccgccgccaccgcgtcaagacccccaccgaccgcgccggcggcgagaaccccgagtgggacgagcgcctgcgcctccgccttcccgacgacgcctcgctggcgtcagagcaggaagccgcggggaaaaagaaggacgggcacgttgaccacgacgacggcgccttctccccgccgcggcgagctcaaggcccaggtggccgtcctcggggacctgcccgccgcgccggtcgtcgtcccgccctccgacctcgtagccgacggctggacgcgccgcggcttctcccagcttgccgcgtccgcggaccgcaggcagcccaacggcgtcatctccttctcgtacgccttccaaaaagacggaaacgacgacgtaancgggcctccccgcgcgcgctaacaagnnctccncggattccgtangntgggcangacaccngntacacgtaacaaagtagtnnacancgggcatgg

SEQ ID NO: 19095 - DNA, 1559 bp, Triticum aestivum
  Clone ID: PAT_TA_19095
cggcaggacgacggctccggctcctcctcccgggcccagggtggtgacgaggggccctccgctgacgggttcgaccccggggcgccgccgccgttcgggctggcggacatccgggccgccatccccaagcactgctgggtcaaggacccctggcgctccatggggtacgtggtgcgcgacgtcgtcgtcgtgctcgcgctcgccgccaccgccgcccgcctcgacagctggctcgcctggcccgtctactgggccgcccagggcaccatgttctgggcgctcttcgtcctcgggcacgactgcggccatgggagcttctccaacaacgccaagctcaacagcgtcgtcggccacatcctccactcctccatcctcgtgccttacaatggctggaggattagccacaggacgcaccaccagaaccacggccacgtcgagaatgacgagtcctggcatccgctccccgagaagctgtacaggagcctggacagttccacccggaagcttcgattcgcgctaccattcccgatgctcgcgtacccattctacttgtggtcaaggagtccagggaaatcaggctcacatttccacccgagcagcgatttgttccagccgaatgagaagaaggacattctgacgtcgacgacatgctggcttgccatggctggcctgctcgctgggctcaccgtcgtgatggggcctcttcagatactcaagctctatgctgtaccctactggatttttgttatgtggctggactttgtcacctacctgcaccaccacggccacaacgacaagcttccctggtatcgcggaaaggcatggagctatctgcgcggggggctgacgacgcttgacagggactacgggtggctcaacaacatccaccatgacattgggactcacgtgatccaccatcttttcccgcaaatcccgcattaccatctagtggaggcgactgaggcggcgaagccagtgctggggaagtactacagggagccggacaagtctggcccgttcccattccacctgtttggcgcactggcacggagcatgaagagcgaccactacgtcagcgacaccggagacataatctactaccaaactgacccaaaactcgccgctggtgcacacacatccgattaacaacatcaagcatactctttgagcggatgctgctcaccatcacctgaccgagtagccctctgctgcctcaccttgccaagttcctcagcatccggcaaatcaagcaggtggatggcgtggatgctagcccggcatattggatttttggttgtacaataggcttgaagccacgatagaatagattatgtgcttgtaagaaacaagtgattctttggaccagagccacggtagctctaaaaagattggaaaaacttgcctgatcaaggggcattcattgttcgatactacagcacctgttatacaattatagagcagtatttatgtcagctggtccatatgcatatactactgctgtgaagatctcagcttaactccagatctttgcacggacatgtaaatagaatttacgcgtg

SEQ ID NO: 19096 - DNA, 463 bp, Triticum aestivum
  Clone ID: PAT_TA_19096
gccgctcgcctcctcctctcccgggtcgctgcgccgccggctcagccgcttctcctgcgccttctcctcctcgctcctctcctcatagatgagtcctcgaccagatcggcgtccagcgcaggaggatccggatggtcgtggtggtggcatattcagcggcgtcgccggacgagctccaggtgcgggggagatatctctacgggcccgcgcaaccacgtcccctcgctgacgtcggcatgtagtccgcccatgccgtcgaggagagggagcagccgcgcccggaggaggtcgtccccaacgtctgcataatccagtccggatttgtggagagcccggtgcagcaccgtctacagggccggagcttcaatgacgaatccactattcgcagacagcccaactcgacaggcacgagccatgtcgacagtcgaggtggcactcgggggcatgctcgcctcggcagtca

SEQ ID NO: 19097 - DNA, 1200 bp, Triticum aestivum
  Clone ID: PAT_TA_19097
cgaccgcccccgccccaagttttccgcaattcatttggctccaatccatccccgaacaaggcaagaacacggacaagccaagaagaacaactccccagcgtctccggcgagcagcgtttaattccatccaggctttcgaggtacaagaagaaaggcttctgttcggccatggctttcccagctccagctgctgtattccttgatgagaacctgccaatccatagaggcaagaggactgatgggctgaacgcgaggccactgaaaccatcagcaaagccatcagcaaagccatcagcaaggaaggccctgcgggatgtgtccaacaccagcaagccccaagcgcctagcattcaaaaaggccaccccttgaaggacaggtccgtcctgaaagacaagtctgctcttcgcagccaagaagccattaagaagaacccactgagcaagactacaatctatgctgatgaagccaccaaaaaatgtcatgaatgggccaagggtggggtggagggcacccacttcactgggaatgatgctcagaggttggacagtgacaagatagacaaacgtgtcaagaagaaagtggagaaaataacgtcagcattgcatgactggtcagatgtgatatttgatcctctgctgtttccagctaaggcagttgcaccgttttatgaagaagtaaatgtgctggaactggagcctgagattcttccagacatcagtgggcgtctctcgatttcaggcgataaggcaaagctgactgaagattcttttgatgaagttgagcttgacagctactcattcctggaggacaagcctgttgagtttcagctgagagacgagatgagtctttatccatggagcctggagtcagtgaactgaagagtccctctgcccacctgaaaaaacttcaaactccactgctgtcactgcccttgcaacactgcttgctcaggagcagtcgactgtagaactagaacgctagatgctgctgttcttttctcccgtctgttgtgatggatgaacctaacgtactatcgggtttcagtgttgcagtggaagcagcttagcttcctgtttgttttggctgagatgctttttcagtcagtgatgtgtaaatggtcgcataagatcgctcctctattgtgaactgtgcgggtttgatctctgatttttcagcttggtcatcagttaaaaaaaaaa

SEQ ID NO: 19098 - DNA, 1712 bp, Triticum aestivum
  unsure (1)..(1712): unsure at all n locations
  Clone ID: PAT_TA_19098
gtccggtgctccctacacgctcgcgccgtcagcttatccgcgttccatatcctaaacgcatccctcgcacacatgcatgcgcctgagtagaggacctgtcgactccgactcgctcgtccgcttcgctcgcgggtgcagcaaatcgcatcacaatatcatatactcgttcatcactcatcactcatacacatacatgggctgagtacatactcgatcagttagcttgctggcgatcgatatggggaaggtggtcgtcgcggaggccacggcgcggcaggtggcgtccttcgtcctcggcgccgccgccgcgctcaccgtcgtcatgctcgtccagtaccgggcgccggccgccgggctcagccgcgccaggacgccggcccacttctccggcttgagattatcatccgacgaccagcaccaccgccgcaacgccacaacaacagcgcgtcccgttgttcatcatcaggcgccaccggtcgccggcagtgctgcccgagacgacgatcgtcgccgtccggcgaacgccacaacaatcacaaagcccaattctaccaccacaagtcatcttcccagcacgcgtcggcatgaagaaaagggagggaaggaggagtcggcggagttccgggggctggcggcggcggtggcacgcgcggcaacggacgaccggacggtgatcatcacgtgcgtgaaccaggcctgggcggcacaaggctccttactggacctgttcctggagagcttccgcatcggcgacggcacggcgcgcctcctcccacacgtgctggtcgtggccatggatcccggcgcccatgcacggtgcctcgccgtgcaccagcactgctaccactacaccatcccgggcctcaacatcgacttcgccgcgcacaagtacttcctctccaaggactacctggagctggtgtggagcaagctgaagctgcagcgccgcatcctggagctcggctacggcttcctcttcaccgacgtcgacatcgtgtggctgcgcgacccgttcaagcacgtgacggcgtacgccgacatgacggtgtccagcgacgtgtacttcggcgaccccgacaacctgggcaacttccccaacacgggcttcttccacgtgaagcccaacgcgcggaccatcgccatgacgaagctgtggcacggtggtaggggcaagtacccgggcgccaacgagcagcccgtgttcaacatgatgaagaagcagatggtggcggagctcgggctccgggtgcagtacctgaacccggcctacgtcggcgggttctgcagctacgggaaggatttggggaagatcgtcaccatgcacgcgaattgctgcgtggggattggaaacaagattagggatttgaagggcgtgctgggtgattggaggaactataccaggatgccgccgtgggagaggcaccgggccaagtggaccgtgcccggcgcctgcattcgagcggaaaaacaagtttgatccatcaattggttgatggattttgcaatcgtctgttacttatagagtagtttaattcttcatatatactccctgtggggatggagagatagaccatagagtatttgttgctatacctctaaaatgctctataatgaaaacatatactgtatctacttattccatgctttttcctgttttaccactttcattcctatgtttacatgtaaatatatcnaaccaatacaccaaattt

SEQ ID NO: 19099 - DNA, 970 bp, Triticum aestivum
  Clone ID: PAT_TA_19099
ggtgatgttaaataagttaattcaatctcatgaatttaacagatatgacctcgtggatttaactcgccaggctctagccaaatatgcgaaccaaatctttctgaagatcatccaaggctacaaatcaaacaacataaaccaagtgaccaccctgtgtgaccacttcctaaaccttgttaatgatcttgacatgctgctagcctctcatgagggatttctgcttgggccttggttagaaagtgcgaagggccttgcacgagaccacgaacaagagatacagtatgaatggaatgctagaacccagattacaatgtggtttgacaacaccgaaacaaaagcaagcttgctacgcgactacgcaaacaagtactggagcggcctgctgcgggactactacgggccaagggccgccatctacttcaagcacctgatatcaagcttgaagaagaacgaaccttttgcgctggaagaatggaggagggagtggattggcctcaccaacaactggcagagcgacaggaaggtcttcgcgaccacagccaccggagacgccctaaacatctcccggtcgctgtacataaagtacctgcgcaacgccgattcacttgggctagatggtatggactcgttcggaaagcctgcaagcttgtaaatttcaagctcctgggtatgtatctcttaagaaatttatagaagatcagatgggatgttttagctagaggtcatcaaacggttgggtgtttgggtcaatgatttttcactccatgatctgattgcacggtgaaacatgcctttagctttgtgttcggtttggctggtatgtaatcatgaaactaggaaccaaatgccatccctgttgtgacttcaggtgtgtttgcaacaaaatgtaccattccctccgttccgaaataagtgtacatgtagactcatttttttgaatgtaaaaaaaaaaaaaaaaaaccgagactag

SEQ ID NO: 19100 - DNA, 671 bp, Triticum aestivum
  unsure (1)..(671): unsure at all n locations
  Clone ID: PAT_TA_19100
cacgaacgcacacgtacggcgcacaccatggtgaaggaaaccaccgaagcgcacggcggcgaggtgaccatcatgtctgcgacgacggtggagccggcgctgccgctgcagcagcaccgtctgccgctgtctaacctggacctcctcctgccgcccatcgacgtcggcgtcttcttctgctacctccacccggcgcccaccgcggccgccctcaaggaggcgctcgccaaggtgctggtggcgtactacccgctcgcgggagaggttgtggccaacggtgacggcgagccggagctgctgtgcaactgccgcggcgtcgacttcaccgaggctagcgccggcgacaccgagctgcgggagcttcggctgggcattgtggacgagggcgtcgacaagcttgttccctccaagaaggccggcgtcatatctgttcaggtcacaaagtttaagtgcggcggcgccgtcgtcggctgcactttcgaccaccgggtctgcgacgcctactccttcaacatgttcctcgtcgcatgggcggccacgtcccgtggtggctccgtaccaccggcaccgaccttncgccgctccctagtgtccccgcgcgacccatcgccgcgtacgtatgccaccaacgccctgatcgaccgncttttctcccctcttagctcagcgtc

SEQ ID NO: 19101 - DNA, 1043 bp, Triticum aestivum
  unsure (1)..(1043): unsure at all n locations
  Clone ID: PAT_TA_19101
ggaatgttagtgacattgaaatacttcaatnctgaaaggatgaacgcacaaaaaatgttgaaggcatggaggaagccttaaaagagctccagaaagatcagagaaaattagaagatgaagaggcagaattccgcaagaaaaaggaagcgattactgacagggtgaggattgaaaagaagaagcgagaagacctacaaaggcgtgttgatttgagaagaagaactctggaggacatatcaaaagaggaggatgtggaatccagcacaagaaagcttactgatcggctagctaagttaaatgatgatcgatttcgagcattgctaaaactcaagaatttacttgttgaagctgttgctctcaaatggagttatacagaaaagaacatggcttctattgagcttgatacaaagatatgggagatggaaaaggatgtgaagaaacacgaaaaggatgttcttagtgcttccagagactatgaaaactgtaaaagaatcactcaagagcataagcagctggtgcttaaggcaaaacagcatgcggagtcagtatctatgatcacggacaaccttgcaaaagagtttgagaagatgccgaccaccatagaggaattggaacttgcaatacaagatactgaatcagaagcaaattctatgctattcctcaaccaaaatgttttgcaggagtatcaaaaccggcaacgtgagattgaatcaatatcaacaaaactggaagatgataaagcagaatgtgagaggtgctgctctgaaatagaaactacaaagggtaaatggcttccaactctccaaagtcttgttttaaaaataaatgatacctttagtcgcaacttccaagaaatggctgtggctggagaagtttcacttgatgagcatggtcttgattttagtcaatacggtattcttataaagggtgaagtttaggcaaactggtgagctgcaggtgctaagtgctcatcaccaatctggaaggggagcggtcagtttccacgatcctgtatcttgtatcgctccaagacctgaccaact

SEQ ID NO: 19102 - DNA, 1218 bp, Triticum aestivum
  Clone ID: PAT_TA_19102
tcgccggcttctccacctcctccacccccgcacgccacccccatccccatcccccccggcgatccgactggggcggaacggagcgcacgggagatattccgtccttccttatcgtttcctttctgtggccaaggatgacagcgacaaggaggtggcactggaagaggacggcggcgccacccgcagcgccgactgcgatgctgtcaccctcaccgggtgcacctccaaggccgcgaggagcggcccagaaggagaagcaaagggcactaggcttcgcgggggcgacgcgggccgcgccgcgtccgctgggctccttcagtcggtccacctcatgtaccccgcccagcgggcccgagaaccggcccataggcaccgcccttctggagccgcctcaggcgagcgccggcgtgctcgacggcggcttcaagaagatcgatgctggctacgatgatgggtccgagacggtcaagtactaagactgacggggaaagagcctgtcgggtgcatgatgccgagatgatgatgggtgacgtggctgagttccacgcccaagatgacggacgcggttacgttgtccatgatgatgatgatgactcccaggacaagtctgatgcgcctctggacagcagcagcagcaagggccgtggctctggtgccccctgccagtgctggttgaagaagcacatgtcatgcctgtatgaccaggccaaggagaccaatcatctctggggtgcggttgtcgtggctgccctggttggccttgtcatcttgtggcgcaaagacaagttgcacatgagctgccttaaatggcgctctcgctcggcagtcagttaatgatccaatccgaattcctggactggtgggtctgtttgtggtcttcttcgtcgatacaatctctgacgagtcttcgcagatcgccctggaagtcattataaccaagaagaagatggccatgccaatatgattcgtgacaatgacgaaaggggtctctagttgtaataatatcaagtttgacagggtattttcttgttgccaggcttgtgagatgccaaagtttcttattgctcttgtacccatagtcgtcgtacctttgcactgtttaatacgaacggcgcgccctttcaagtaattttgaaaaaaaaaaaaaaaaaaaaaccaggcccctacgcccctccagaggccgccctacatgaaccctccccctcatccacccctctg

SEQ ID NO: 19103 - DNA, 746 bp, Triticum aestivum
  Clone ID: PAT_TA_19103
agcccaccagcacgagcaagaaaccactgaacactagcgaggcgccatgctcggcctctgcgtcctctgcggcgcgccaccggccaccgtctcggcaccgccgccgagagcccgctgcagcgcgccggagaagagcggccgggcgttcctcctgggcgtccctgcggccgtctcgctctcgctcgccctctggtccaccccagtgagcgccggcatcctgtcagggtccaccgggctggagtcggttccagcgcccccgatgccccggctcgagttcctggacaaatggaatgcggagaaccagaggaagtacgcggagaatgactcgaggttcaagtcctccaaggtgctcaaggagctgctggagaagtccaagcagaacaaacagaagaacgagagggagatccaggacaagtactgcctgcggggcgccgagtggggcgtcggcgactgctccacggtggggatgacggaccaggagaaggaggacttcatcacagagctcaggaaaagagttggggaatgaacggaccacgctgcagcatccgactcaattgctcgccagaaacagagttctggcactgcagagctgcttcttgccacagcggcaggatgtagtggtagcatagttattactagagaaagagagatttgatctgaggggcggatgaacagttggcaaatacacaatctagttcagaacagctgatggtttaaaaaggtcaaaaaaaaaaaaaaaaaaaaaa

SEQ ID NO: 19104 - DNA, 903 bp, Triticum aestivum
  unsure (1)..(903): unsure at all n locations
  Clone ID: PAT_TA_19104
ttgtggtgcagcggacaccgacatcagcgggtgggtgacagaccgcggcctcagcgggtgggcgactacacctgcagctggtgctatacccatggattccggcacaactcgaaacattcaggtgattgaaggttagctgtactaatcaaggaaataacatatatctgcatggttgttattcttgttgttcatcgacggttgctgtggttgaggtacgagcatacatataacatgggttgccatgaaagatgtcttcccatctcaggtgatgaagatggcgtacctttattttttgacacaagtactgatcggtgttggaattgggctttataaacttggctttccagcagttggttttcctccatcgcctgcttattttccctcttcgaagagtgaataaaagatacatgatgaaatacaggtagacaagtgtgtggaaattggacttccagaactcatcctaatggtcgcattttctcaggtacacattacaaatttttatgaatttctgctggaccaaaccattgtttaaatggttttgaatgaggtgatgttgtactaatcatgtttgtttcctagatgataatttcctcatctgttgcattctggaaagtgtctttggtcggttttttgntcttttcactgtttcaatcgtgtgactatacacatgtatcctcacaattagtggcgcttacaagaatggcaggcctacttgtagcttttcttatgtagntaaataaaacaacctaggggtctcacacttttacttctttcttaatataaataagggcttgctattggcctgttaatacttcncacttggnggatgangctttacnccanntttagnntcatnnnnnaatcttnggcctttntaannaacntaanntntnnnnttaatnn

SEQ ID NO: 19105 - DNA, 1065 bp, Triticum aestivum
  Clone ID: PAT_TA_19105
cactcgtggccggacctgacctgacctcgcgtcgtcactgtcgctcgcgagacttcgccggattggaatcagatacggcacgacggcgacgatttcagccgccggctccgtcgagctccgctaatccgtggctcagcccagcatcaggtggctccggtggcctgattcgacgcccgatcaggatggcgttgaagaaggccaagtcgtagtcacgcctggaatggatgctagggaatcgagccgtggccaggaagaacacgcacctctgagtctatccatggtccgtgacactgtacatcgatccatagacttgaggcagtgatcaggttttgttcaatgcaagaactcgccatgggccagtgcctgctcaaggaacagaggcgaggtggatccatgaggatcaactgtacagcgtcaagttctccaagagcggcagctgcaagtggctgctccacacgctgtcacgcagcagctctgatgtgctccggaaggagcagggcccgggcccaggtcgccgcccgtcgctggttgaactttgcggggccggagtccgagaagacataagtaggttttcagatttctccatggtgcctatggatcttagctagcagatatacaacgaatgggtgcggtgtagctacatcaatgacgagttgctgggagcttttcgcgactgtgctttgcaggatatttgtctggatgagtaccctggagtgaaggatgcttggatggaagtaatcgcttctcaagggcagtccttgctatctgttgacatctcttgctctgatgtgactgatagtggattgaatcttctcaaagattgctcaaatatgcaaagtctggcatgcaattactgtgatcgaatttctgaacatggacttaaaacagggccaggccccccaaacttgacaccgctcagccttaagaaatgtgctgctgttacagctgaaggagcaaaagcctttgcaaagttagttaacttggtaaatttggaccttgagcgatgcccaaaaattcatggtggccttgttcatttaaaaggcttgagaaaactggaaacactga

SEQ ID NO: 19106 - DNA, 976 bp, Triticum aestivum
  Clone ID: PAT_TA_19106
gccggcccggtcgagaatctttcgcccactccgcggacccctagccatctaccaccgcccgcctcctcgcgcgaaccctaaccctaggccgcccggccgctccggggtcctccctgcagccccaccgcgccctctcagacaaggtggagctgatcgagatcgacctctccgaggaatccgcctcctccacctcatccggcgactccgcggaggagccgatggggatggggcgcctgaacgacgccatccgcggtgtcctagtgcggcgggccgctccggagtggctccccttcgtgcctgggggatcgtactgggtgccgccgatgcggcggccgctcggggtggccgatctcgtcggcacggtcgtctacagcgcgaggggcgccgtcgatacggcggagatggcgagagccaccatggttaaggagccgcgatgactaacggaggagggccatgtgcttcaccacgcagcggggctggccgtcagaggcctatttcgtccaagggaaagtttggcatccagtgaagaagtcaaggaaaaatgctaaaactgatgatgaggaaagctaatttgtccttgcaagtttacctgggatccccaggtggacacaggaagactcagctcggagaagtaaaaccctgctgatggctgtacatatagacgatataggtgtcttaacagaccctagcgacaataatgagccgcctcatcgcccgtctcttcttggtaggtcatgcgtgcttaagatgaaatatgatgaatttgtattacaacacagcctagtgtcatgtgccctttgactgctctctgagctgaagttgtatgatgtaccaactattctttgtggattatttctgcttgtacgggcacccgtcagctccacgggttgtcggcgtcagtgggtaatgttaatacagatttcttaccgaaaaaaaaaaaacctcggccgcgaccacgctaatcactagtgaattc

SEQ ID NO: 19107 - DNA, 472 bp, Triticum aestivum
  unsure (1)..(472): unsure at all n locations
  Clone ID: PAT_TA_19107
cccacgcgtccgcccacgcgtccggtaaaagaaaaagagaaccaccaggttgcttgcagcagcgcgccaagcctccaacaaccagagagcactgagcaagccaggcggtgcgatggaacccccgggcgcagcgcggaggaggcctcccgccatggccgcgcccgcgctcctcaccctcctgctcctcctcctcacgctcgccctgtcctccgcctccggggctccggtcggggaggattacgtccggccgccggcccggccccgcgcgggccagcggaaggccctcctcggcctcttcccctggagcaagaagaaggcctccgcttccgcctccgatccccagcaggtgcacatttcactatctggagagaagcacatgagaattacatgggtcacagatgataactctgtcccctcagttgtggactatggaactaagtccaacgcatacacatnctcatctaatggagaa

SEQ ID NO: 19108 - DNA, 1457 bp, Triticum aestivum
  Clone ID: PAT_TA_19108
cccacgcgtccgcccacgcgtcggggagttgcaaagccttaggcaagaaagcaagccagcagcatatacatatttgaatcacatagaagcaagacctagttcttagaggttccgcaacaatgcggcaaatgacaaccatttcggttggcattgttgtgctcgccgcacttgttttggcatccgagggtcgcattgcccggaaggacttaggtctggaccttgatctgggcctagggaccggtacagaggttgacattggcataggtggtgctattggtggtgccggctccggctctgcatcggggtctggttctgcggctggatcagggtcgggatcagcctctggttccgggtctggctcggggtctggttcgggcgctgcatcatcggcaggttcgggtgcagtttctggtggaggatcctatgctgggtccggtgcaggctcgggctcaggtggagcctctggctctggtgctggttcaggctcaggtggagcctctggctctggtgctggttcaggctcaggtggagcctctggcggagcttctggctctggcgctggttcaggtgcaggctcaggctcaggtggagcctctggcgctggtgctggttcaggctcaggtggagcctctggtggagcatctggctccggtgccggttcaagcctcccgtggaggctatggctcggctgcgggctctggggccgggccgggctcgggtggaggctctggctcaggtgctggttcggggtccggttatggtcaggggcagggaaaaggcgaaggcgagggccaaggatctggatatggccagggttccggctcgggccatggacaaggttcgggctctggttcgggttatggtgagggacatggtgaaggttatggccaaggacgtggtgcgggatcaggatacggtgagggccatggcgaaggttatggtcaaggaagtggtgtcgggcaaggatccggatacggtgagggccatggcgaaggttatggacaaggaagtggtgtcgggcaaggatctggatatggcgaaggtcatggccaaggatctggttcaggctctggctatggtgaaggctctggtagtggttatggaaatggggctggctcgggctacggtgaaggtcacggatatgggtatggatctggacatggcaaatgatttcagacgcagactacttaataatgtatgattgtctcaagcttcatatttacacttggacatcatctatgtgtgtgtgcctgcgattctaaggaaccgagtctaactaaattggtggggggtcaaatgtgtaatcctatcatctaggttcaagtctttgactcaaactttagagtatatgttccacccgttgtattaatagtacatgtaggttctcctacatgtgctttaatatgcacttatttataaataaattccatgttgagtgaataaaaaaaaaaaaaaaa

SEQ ID NO: 19109 - DNA, 1703 bp, Triticum aestivum
  Clone ID: PAT_TA_19109
ggcgccacctcttcctcatctcacggcgcccatgcccaccacctgttcgacctcctgacgccagcctgtcagcccgccatgccgcccgcgctcacctccaaccccccttccttccggcccttatcctcccctctccgccgccgcgccccatccttcctctgccgcgtcggcgccggcaagcctggggcggatgaggaggccaagaagaaccccttctttgtcgacttcagcggcaagtttgaggacgccaagtcactgataccggccttcccatcgccgggaacagggtccctgtttgccggagggaggggaaagaaggaccaacagacggtgttcgtggcgggcgccacggggcagacgggtgtccgcattgcacagacgctgctgcggcaaggtttcgccgtgcgcgccggggttccggacctcgtgtcggcacaggagttggctcggctcgccgccgcgtacagactcatatcccccgcggaggcacgccggctcaacgcggtggagtcggattttgatgacactgaggcgatcgccaagtccatcggcccagcggccaaggtggtgatcacggtcggcccggtcgagaagggattagagggcgggccggtcactaccgaggatgcgctccgggtagtgcaggctgcggacctcgccggcgtggcacatgttgtggtggtctacgacgagggcgccggtggcgtcaatggggcttccacgaacagtgtgcttaatgggttcacgtcttttttctcgaacctcttctcccgcgtgcagactctgccgctaagtgaatttttggccaaggtggtagagaccgatgtcaattacacgctagtcaaggcgtcactcactgaagactacgaccctgagagctcgtatgggctggtcctggccaaagagggttcgtccagcactacgacttcctccactgacactggcaaggtgtccaagttgcagattgcttcccttgtggctgatgttttctccaacattgagatcgcagagaacaaggttgtggaagtttcaactagctccttgggaacatccaagcccacagtggaggcactaacagctattcctgaggacattagaagaaaagagtaccaagaagctgctgcaaatgcgagggcacaggaggaagccctggcctcccagcgagctgctgatgcagaagaacccaccagtaagctcaaaaccgaagggaaggatacgacctcagaagaggcaggcgcaagcacggtgaacgaggcgcaggcctcgctggagaaccttctaaccagagccaaggggctcaagcttaacactgacttctcctgggacaagttcagcacacagcttgcagccgtaggagcgaccgcgcggagctcggacgaggaggaaccaagggcccagatcgccacggtgagaggccaggccaaggccaagaagctggcaccgcagagggccgtcgtgaagccggtggcgcagaaggtgaagcaggcaacaatgcagccggctcccaagaaggaggtgaggcccgtgtttgggggactcttcaagcaagagactatctttgtggacgaggactgagcatcgcagcagcttttcttcttcttctttttgtgaaggccctgatgtatccttgaaatatatatataaatataaattaaagattaacggtcgaatccaaaaaaaaaactcgagggggggccgtacca

SEQ ID NO: 19110 - DNA, 1106 bp, Triticum aestivum
  unsure (1)..(1106): unsure at all n locations
  Clone ID: PAT_TA_19110
cngaacgatcgccgagtgttcgacgagtgcctgcgcggagcggcgtcaatgggttcatcgccgcaagcgtaaagctacccgcctcgcggtgttcgttccccggcgcatcgacgctgaaagcactgaagattggtccatcgactcatcttgacactaatggaccgggaacactcggctttgaagaaaatgagattggaggacgcagaggattctgcgatcagtcaagtgcctgccacggcgtcgagcatgcatcagcaattgttctggagccagtggcagctactggactccattctccccacgggcggtttcgcacactcttacggcctggaagctgctatgcaatcgcgcatagtgaacaaccaggaagacctgaggctgttcctcatccaggtcttggacaacattggaagcctgctgcttccattcgtctactgcgccagtaggtctcctgaggctgcagcgtgggttaagctagatcagctgctggacgctacactgacaaatgaggtcggcaggaaggcgtccacgtcgcaaggctcggctctgttgagggtggccgcgtctgtcttcactgagatccagccgctgcaggatctccgacggacatttctcggttccatgagtgtgtcgttacaccatgcaccggtattcgggttgatatgtgggctggttggatttgacagcgagacaacgcagcgtgcttacatgtttgtggcaatgagggatgtgatctccgccgcgacgaggctcaatttgatcggaccgcttgctgcttcggttctgcagcaccaggttgcgccagatgccgagaagatgctgcaaaagtggaaggaccgtgatgtctctgaagcatcacagactgcgccgctgcttgacgcgttgcaaggctgccatgcttacatgttctctaggctgttttgctcctaacaggcgaggttcacttccatatctttccatctctctcgttgtacaatgtctccaagcatacacaacagaggctcaacttcatgatacatgtaccatttgtgcttttgtattattctgatgtattgaaacatatctccttatttcctgagaaaataaattaactggttcatagaaaa

SEQ ID NO: 19111 - DNA, 2025 bp, Triticum aestivum
  unsure (1)..(2025): unsure at all n locations
  Clone ID: PAT_TA_19111
aggaattcggccgaggntgaagtggtcgggatgtgagacttactgtccntttcgaagctcttatgacagcaaatgttgctgaggttgaatctcccgaagataagatgctcatagatgagactgatgaatttggtaatgagatccctctagggaaaattgtccaaattcttaaatcccgaggagcaaaaaacacaggggggaaacagaaggcagcatctgttccagtaaatactggaaaagatgatgatgtcttgggtttgttaagagaaataaacttagataaccaggacaatttgggggagtcggtgaagagcaaaccaaagaagccgcagatggatatgaaagagagcaacgagaagccagtagatttttcggcaccaaaacgcaaaagatcagtttctaagagtagaccacactcaggaaaaggcagtaaagacggtgacgagcttttagtgcattctgccagcaaaggaaaacccagtgactccttagaaaacaagttgaaggagaaaagaagagctgactcaaatgataaagacttggtagcatcacctaccagtaccaaaacccctgtatccaaagggaaaaaggatgctaagtcccatactgaagtctcgcgtagcagtgcaaagaagtctgctgatgaggacagtactatgagagctgctgaactggctagtctaaatgggtccttcaaaagacagaagccaagactggtttctggtttagcgaagtgttcaacgcatgactcgagcagtaaagacttggtaggacgtagaataaaagtttggtggcctttggataaggaattttatccaggtgttgtggaatcttatgattcagcaaagaagctacatacagtcttatatgatgacggagatatggagcagcttaacatggctaaagaaaagtggaaaatgattgaaagtaatgggttcaccaatggaagcagcaaaagaaggatcatgtaggttcaaatcaaggacgagcacaagagacgaaatctaccagcagcacgaaagttccagctaaccaacataagtcaataaagacagcacaggagatgaaatctaccagcagcacgaaagttccagctaaccaacataagtcagtaaagacagcacaggagacgaaatctaccagcagcacgaaagttccagctaaccaacataagtcaataaagacgccctcacctctaaagaggaaaggaaaaccaaaaacgcctccggaaaacaagcgtagaaagacatcaggaggtagcaagtccatcgaagctaccagcgaagctggcgttaatgattcagattcagccagttctctcgctcattcagattccgacaaagatgtaaaatcagatggggagaaggataaagaagtagcagttggctcagctgagaaagaaaaaacaggaaaaacagagaaagagtctgcagaagatatggagctggaagagaaaaaacctgacggcgacagtttgagctgcaaggaggaatctgacgacgaaactcttagtgtctggaaaaagcgtgcatcgcaagcgacataggctttgctttctctcagttgacatatgtcgtcctaggatgcagatatcagaggcagtcgtctgtggaatgtggatatctcattaatttgacccttcgcagctgacagttgtgatgtagaaaaatgttctttgcaatagcaacaggttagtatagaagagccagctggataggaaggatttgctttgtaacgttatttaggtgctagaacttgttgctgacttcgccatggcattgttcaatgggcgtacgaatcctcgagggtcagatgttgtgtaacatatcttgtttaccattcttttgcaggagatagcaaccgtgtcttttaaactcatgtagagatgttgtacaacaataaatcagtgtcttgggattgttttgctaccagtgtgatggtcctccctttgggaccctattcgaagaaacagattttgaatatgtggcggaaaaaaaaaaaaaaaaaaaaaaaaaaaaaaaaaaa

SEQ ID NO: 19112 - DNA, 1351 bp, Triticum aestivum
  Clone ID: PAT_TA_19112
cttgcctccagacaaagaacattagcttccatctagccgccattattcctgactgcagctctcacaatgctgagcaccacggcgcaccacagcagcaggcagacgcatgctttcgagaagagcccgagccgcagccgccacggctcggccaggaagaacggcagcatagacaggaagctgcagctgcaagcgatgagccacgcgagcaagtacctgcagcggatgcttgtatgcccgccggggctgggcggcggcgtccggcggagcggctccggcctctccctgtcgtcgctgtcgctgtcgcagaactcgagcgactcgtcgctgagcagctccaactccagcagctgggagcccaaagtgccgctgatctacggcggcactttcagcccgtggggtgacgtgctcgtgtccctggagaatagggggggagacgactgcgacgacgacgacaaggtgagcgcccgtgatgcggcggaagaggaggattataaataaagagagcccgtacgcttgcacagatgcagctggatcaccaagaacagtgatgaggcgtatgtccagttccacgacgaatcctggggcgttcccgtttacagcgacgaccgcctgttcgagctgctcaccctgtcagggatgctcatagaccacaactggacagagatactcaagaggagggacatgtacatggaagcatttgcgggcttcgatcccaatgtggtggcgaagatgaacgaggatgacatcgctgtgatcagcgccaataaggagctcaagctagcagagtgcagggtgcagtgcatcgtggagaacgctaagtgcataagaaaggtggcgaaggagtttgggtctttcagtgggtacatctgggggcacatgaaccaccggcctatggtgggtaaatacaagcaccacaaatacatcccgctccgaacacccaaatcggaggggatgagcaaggacctaatccgacggggttttcggcttgttggtcctgtcattgtctactccttcatgcaagcctctggcatggtcatcgatcacctcgtcggttgctttcggttctctgagtgtgtccaccttgctgagcggtcttggggtatcacaaatgtcgccacgtagacgcccaagcactccagtctcgaactttgacattccggtgtttgcttcataattacttttttcaccaaaatatgcaagagttgggtaccctttatttatttattttttgattagagtaatgcatgggttgtaaattatttgtgctagactactaagttatgttttccttttacttgtggtagtgtgactggtatgtaagttgcgatgattaattttttttgaacaagtt

SEQ ID NO: 19113 - DNA, 455 bp, Triticum aestivum
  Clone ID: PAT_TA_19113
cctcaacaattcaaccacacaatgctgaacggagccgacgagtggtgcgccttcgtctgacggactgctggcccagctgaggccaccaacgctcagcgcacaagacgcggtcttggatctctgcttctctgccctgttttgaagtttcgccataaagaaaagcctctttgcttcgagagacagccaccatagtctctctccgctccggtggcataattgcttgatcctgggctgccagcaccagcacggttcctgacccgagaagatgttctccttcaagtccagcgtcaagtcgtcttccagtgggaaccaagtttccacgccgcgcttcactgaggaatcagatatgcacgagcagttgaacaagttgcaggaggagctggtaagggagaaagaggagaaggtacgtgcactggatcagatagaggagctcaagaagaaaagcagtagaagaa

SEQ ID NO: 19114 - DNA, 851 bp, Triticum aestivum
  unsure (1)..(851): unsure at all n locations
  Clone ID: PAT_TA_19114
cgattcggacgaggcaggggcgggtggaacaatggagcaaagttgcatatgaaacttggaccaaccttcagcctgattatgtaatggataatggaaaaccaagaccaatcaaccagagtatttcccaagggtcgatcatgctggaacctaaatttatgcaaggacatcaacagaattgtgcagagcgaaatgttcatgaagctgatggtcatcaaggtacttcaggcagtcatcccaagcagtgcacattaaaaaggcttggatccatacgagtgacgccaaatgaagaagatgcgtcttttgacatcagtgtttaccttggttctggctccgaacaataccatggaagcaccgctgcaaatgacantacccggttcagtcacgctccattgcccggctaccgctgcagacgaattttcaggatccgtgttattaaagcaagcatccttgacaatggtcgatgaggactatgacataccttttgtacccagtgatgcttcactccatctgtttgatgcgtctgctttagccgctttcacagatgagcctatttactctaggcatgtcagcttcagagagagcgactgtcacgagacgctagccttcagagcagaatcagctgtttgaacaacgcgactggcaaggcaacaacattgatcagatcttaatggattccctgagtataactgtagttgacacttatatagtcatgctattttgacgtttctgttaaatttgccagtggtgatggacagcattgtttgttttgtgatgtactacttatgtattgtgctgttaatgtcttgtaaattcataaaagaaactttaagtattgcacgcgaatgcgatct

SEQ ID NO: 19115 - DNA, 708 bp, Triticum aestivum
  unsure (1)..(708): unsure at all n locations
  Clone ID: PAT_TA_19115
cggctcctgctcaggccgccggtcgctttttgctctctcgcttcgccgccggtcgtcgagacgagagtggccgccgcctgaattcttcctagccgctcaaccaaccatcgatgggccaagaacagagccagcccgacccggcggtgggggagccttctccgccggccgccgaccccgcgccggcgcagtctcctgcccccgcgccctcctccctcgaggagctcgccgcagaggctatgtcgtttagtgaggatgatgagtcaattgacgttaaggtacagaaagctctggattgtccgtgcgtggctgatttgaaaactggaccttgtggcagtggatttgttgatgcattttcctgcttcctgaggagcacagaagtagagaagggatcagactgtgtgcagcccttcatcgcgctgcagaactgcatcaaggagaatccagcggcattttctaaggagatattggaagaggaggagaaggacgaggaggctnagaagtccaacctgcaagttagagctccagcatggtctanagaatccaaatccaaaccaaagctttgagatcctgtggtattaagctgacagcctganacagagattaccctgattcgcnctcttcaccntgtttctcctataaattcntccgttataggcaagaagattaagcatccaggattcttcggcagaaataagcncagtttgtgtg

SEQ ID NO: 19116 - DNA, 918 bp, Triticum aestivum
  Clone ID: PAT_TA_19116
ccaccaccaccaggcactctcaaacctcgggacagaaaggccgccgtaccgaatcagagattgacagcggcggggcggggcgccgccagccagcgagcgcggcgcgaatccggccccggcgagatgctcggcaagcgggcagcggagcatgctgatgcgccggacgaccagcctggcgtccatgccgtcggtgcccaagcaggtgcgccagggcagcggcggcggcggcggcgacgacgacgacaaggacaggcaggcgcgcgcgcggccgtcctcctccgtatcggccggcgcggtggggacgggcggcggcgccggcggtggctacccctctcccgggcgggacgccttcgccgggctgatgatcaccgcggcgttcctgtccgcctgcggcttctgcgccaagcccctcggccccggcgaggacacctacatctacagggggcgaggtggcattctgcagccaggagtgcagggagcatcagatcgcgaaggacgagctcatggaacagaactgcaccatcacatccatccgggaggccccgtcggaccagtctggcagcggcggcggctccggcggcgccggggacgccgtcgcctccgcatagtcgggcggccattagcttattacatatactagctagtgatgtgccacatatatatggcacagttgttgcatgtttaccccgcgcggccgtgtatacaggttgccctgggtaccgaggaattgatggttttcgcgatgtgcccgcggtggccggtgaatgaggagtacatggcacacaaggaatgtgtcggtttcctaaccagccccagtggagaaccgaacctggactgcaatgcaacatcttttttgggtgggccttcaaactatctcttttagttgcgtgtaaaattatagattattctttaatctcg

SEQ ID NO: 19117 - DNA, 595 bp, Triticum aestivum
  Clone ID: PAT_TA_19117
acacaagaaatctgcttatcttgtttcttgacgaattccataataacaatggcagctccaaactgcgtgggaatgagctgaattttacatatacatatgcaaaagcaaatgtggtggttctgtgaacaaccgaactcgattttaggattatgtacagtagcatctattataaagaagatacttgaagagcatagctatcgccatgctgcgcctttgatcgtgggtcaccaggtgatcatttgcagaagttaatcaccatggccgttggctgtatgaatgtcgtgatgcaaatgtttacgcgctgctcttcttgccgtcagttgcaatgccagagaaagcaccgataggcttggccagggtacgcctctgagccttcactgacagtgggctgtccttggcctgttcatgaagcaacaaaaccagttagaatcagatacctaagactcttggtcaacttgctagtgatttacatgacatcataaccacattaattgaaaacattatgaaatggtctgagctattaccgcgaggcaggttccctgctgggtgttgcagatgggatagttatgagggcagcagctgtagtgatcatcgc

SEQ ID NO: 19118 - DNA, 1401 bp, Triticum aestivum
  Clone ID: PAT_TA_19118
gggggttttttttttttttttttttttgcacacaagaaatctgcttatcttgtttcttgatgaattccataataacaatggcagctccaaactgcgtgagggaatgagctgaatttacatatacatatgcaaaagcaaatgtggcggttctgtgaacaaccgaacccgattttaggattatgtacaggagcatctattataaagaagatacttgagagcatagctatcgccatgctgcgccttcatcgtgggtcaccaggtgatcatttgcagaagttaatcaccatggccgttggctgtacgaatgtcgtgatgcaaatgtttacgcgctgctcttcttgccgtcagttgcaatgccagagaaagcaccgataggcttggccagggtacgcctctgagccttcactgacagtgggctgtccttggccgcaaggcaggttccctgctgggtgttgcagatgggatagttatgagggcagcagctgtagtgatcatcgcagcaggtagcaccctcgagtgggcaacagccccaggcgaagcactccttgccgtactcgtagatgcagcagcaggtcgtgctcgcggggcactcgttgtagctgtcacagacggaagacggtggggcgggagatgtggagttgggccggggttaggggggttctcgcccgtcttcgtcgggtaggaaggctctacggcaataccacatttgccactggatgccttgatgtagtcatgcagcgtccaagttaatcatagttaaggagtagtagttgcagattgcaactgaggtgaggacaacaacaaaattattttagtgaaggagacgataatagaagttaggtgtgtgggcctaacagagtaacatattcataccattaagacaaaatgtccccaagctctctcaatcagaatgatacctatctattttggaaataaggaggtaccataaccttttggcgcttactcattcatcaaacctactgcagaacagtataatgttaaagaagctcaccgatttgtagagctggaatgccctgcccccagcctcgatcgcaacactgatgggctggtttgcaactgccttctgcagactcttctcactgttaacaggcacatcctcgtacccatcaatggtaaccaccttggcatttttcttgttagcatcgcaacggttgtccctctccttgtaggggtagtcctcctcagagtcaataccgccattgttaatgatgaactcaaacgcatagtccatcagacctccattgcatccctcgttgtaaagtgtcacagtcaacaagctcttgctcggacagagggatcatgtcgcctgtaacaatctggttgatgccttccacagctgctattgctgagaaagcagcagctccctgcccggcccggccg

SEQ ID NO: 19119 - DNA, 1919 bp, Triticum aestivum
  Clone ID: PAT_TA_19119
cccttcttgccatttttgttccccgccccctttcttttttctttggcccgcttttcccccgccgtctttcttttttttttttttttttcacaaacaacactgtttttacttgtttcttgatgaattccctataacaatagcagcccctaactagcctggggaatttacttaatttacatatacatatgcaaaatttcatttggtggtttttccaaacaatcgaacccggttttgggcttataactggggacggaatcgagcagagtatgatccatataacatctgcaaaagcaatgcttggtcgttcttggaaagtcaaccggaactcagattttaggattaagcacaacgatggacgtattctaatgaggtatattgaggtagaacatagttctcgccaatgctcgcgccgtcaggattccatggaatcaccaagggccgatacatttggccgaagttaatcactgatcgtccattggctgttgatgaacgtcgtggtgaaaactgtttacgcggtgctgttcttgcggtgcgattttcaaggccgcagcagaggtcctgatcggcttggcctagcgcgctacgcctcgtgagcctccaactcaacagaggcctttccttgcccgcgaatgcaggattccgtggctcgggtgggggaagacgttgtaggttgtgacagcaccgaagactggtggggcgggagatggtggagttgggccggggttaggggggttctcgcccgtcttcgtcgggtaggaaggctcgacggcaataccacatttgccactggatgccttgatgttacgctccatccggatgtaaccatcctctccccagacggtaccccaggagttcctgacgagccagtagtccttgccgttctctgtaccataaccaacggcggcgacaccatggtcaagtgctgttccacaggttccggtgaagatacccgatttgtagagctggaatgccctgccaccagcctcaatcgcaacactgatgggctggtttgcaactgccttctgcagactcttctcactgttcacgggcacatcctcgtacccatcaatggtaacaaccttcgcatttttcttgttagcatcgcaacggttgtccctctccttgtaggggtagtcctcctcagagtcgataccaccattgttaatgatgaactcaaacgcatagtccatcagacctccattgcatccctcgttgtatgaagtgtcacagtcaacaagctcttgctcggacagagggatcatgtcgcctgtaacaatctggttgatgccttcaacagctgctattgctgagaaagcccagcagcttccacagccgccctggtccttgatggcagcaacggcccccttcttcctccagtcgacggtctccggcagctcctcgttgtcgtcggcctggtacctggcgctgagcttccgctcccggtccggcttggtccgggcgccgaggtacgtgctgcggtactcctcgttggtgaggtcggcgaagcggttgaggccgaggcggaaggagtggagcccggcgtcggcggcggcgttgtgctggtcgatgtagcggaggttgtccctgaagacctcgaagcggcgctcctcctcgccgatggcgttgtacgtcctgcggtgctcggacatccactcggcgtacatccgccgcacctcctcctcgctccgctccccgtacgacacgatcgacatgtccgccgccgccgccagcgacaccagcagcagcagcgccgccgccaagagagccatggagctcctcatcctcgagaccacaagtacaccacggagcaggaagagagatgggggagcagtagatgggattgggttggagacctcttgcgtcgacctgcaggcgcgcgagctccagcttttgttgcctttagtgagggttaatttcga

SEQ ID NO: 19120 - DNA, 1307 bp, Triticum aestivum
  Clone ID: PAT_TA_19120
tcggagagaatggccggcgacgtcgcgcgcaagcagctccaggcgcgcgtgggggcgttgccgtgggcggtgcggctccagctgcgcgcgctcgaggccgccgtcgacgccacgcagcgccgggacggcaccgtcaaccgcttcctcttctcgctgctcgtggaccgccaggcgcccgccaaccccgcgcgcccggacgccgggggcgtccgctccgtggacgtcaccgtcgacgcgtccaccggcgtgcgggcccgcgtctactttacgacaggcgaggcgggggcggaggcagacgcgtcgccgcgccccgtgatcgtctacttccacgccggcgtccgcacggtgttctccgcggccacccgcccctacgacgcgctctgccgcaccatgtgccgcgaggcgggcgccgtcgtcgtgtccgtgacctaccgcctggcgcccgagcaccgctaccccgcggcctacgacgacggggaggccgccctccggtacctcgccgccaccggcctgcccgccgaggtccccgtccgcgtcgacctctcccgctgcttcctcgccggcgacagcgccggcgccaacatcgcgcaccacgtggcccagcgctggactgcggcaccagcgacaacgcctccagccgtccacctcgccggcctcctgctcctgtccgcctacttcggcggagaggaccggaccgagtcggagcaggcactggagggcgtggccccgatcgtcaacctccgccggtccgacttctggtggaaggcgttcttgccggagggcgccgaccggaaccacccggccgcgcacgtgacgggcgaggccggcacggagccggagctgcccgaggcgttcccgcgggcgatggtggtcgtcggcgggctcgacccgctccaggactgggggaggcggtacgccgccatgctgcgccggaagggcaaggaggtgcgcgtggtggagttcacggaggctgtgcacgccttctacttcttcccggcgctgcccgagaccggcaagctcgtcgcggagatcagggcgttcgtggagagcgtggcgccgaatcagaccacgtagagaagtagagacgatgatcacgaccactcgtcgactcgtcgtggatgtcgtgcatgtgtcactgtcaaagtcgctgcgagcagccgcgtccgtctaaattattactctgtgttgtataagttcgagttgccatctcgatattttctttgtgcaacatgtgccatgggtgatgggggcatggcagtgatggcacccccaaagttaaatgtttgagaatagttcatatctcaaaa

SEQ ID NO: 19121 - DNA, 476 bp, Triticum aestivum
  unsure (1)..(476): unsure at all n locations
  Clone ID: PAT_TA_19121
aagttgaaagtacccgctgacgggtcgcaatggagaaaaatcgagagaaagtacaggaatgactttgcaggtgatgcaaggaacgtatggtttggcctaagcgcagatggtattaatccttttggggagcagagcagcaaccatagcacctggcctgtgactctatgtatgtataaccttcctccttggttgtgcatgaagcgcaagttcattatgctgccagtgctcatacaaggctctaagcaacccggcaacgacattgatgtgtacctaaggccattagttgaagaactcttacagctgtggaatggaacaggtgtacgtgcgtaggatgagcacagacaggaagaatttgacctaaaggcgtttttgttcatgactatcaatgattggcctgctctcagtaacctttcangatagacaaataagggaatacgcggatgcacgcactgtttggatgataccgacagtatata

SEQ ID NO: 19122 - DNA, 1441 bp, Triticum aestivum
  Clone ID: PAT_TA_19122
gatgaattgcttgcgaggattttttttaaccaaaaaaattcagcatataccatgacaaaaatctggaggtacggctttttcggtgcagaatcatgctgaggccaataggtacaaactcaaattacatcgtcaatcaagatacaggagggattcagctctcctaggcacaagcctctgacgttggtatttgtaaacacacaagcataaaaatggttctccggagaggggatgtatttcggagaaacgccgaacggggggaaccgaaccatgtcttctaagtgctgcacttccacctggacgagggcacgcagttcaggtaccggcaccagtggcagccgtcgttgccgttctttcccttgaagagcatcgccaggccgaccacatacccaaccagcagcaagagcagcgccgcgccccacagagcatactggtacgtcttgtactttgggggttgatcggtctggggcaactcatgccgctccatccaaccaaattgaggccttgccagcagcacaaacccaaaaaggaacccggatacgaacccaccaatatgcgcaaaattatcggcatgcggtagtatcccgatcgccagattgattgcaattatgaacagaagagttgtgatggctgctgccttgttggaataaatggtccagttcataataagctcagagagcatagagccaagcaggccaaacaaagctccagaggcaccgacagagatgtagtgattacgtaagaacagtgcagacagcacacttccaccaaagccagatagcaggtagatgatcccaatgcggacaaagccaaattgctgttcaaggcggattcctatgaatagcaagctcatcatgttgacaatcaagtgaattaggccagcatggagccagatacagctgaataggcgccaccattggtgttgatgaacaactttggcccagtcaagagctcccatcttctccaaagtggccgaagaggggccgaggagcgggttctcgcgcagcggctggaaggagaactggcggaggaatccggcgacgcagcgcgcgtcgccagccgagggggctcccgtggcgggggcagtcgttgaggtacatctcgacggcgaagaccgagacgcaggcgccgagcacggtgggcacgagccacggccaccactggcgctcgtcgtagccggtgccggtgccgtacgaagcgtactgctggtaccccgcgccggcccggcccgccttcccctcgccgctgccgctgccgctcgccatggcccctaacgcgcgcgcgaagtctggtctagctagctagggctgcccccctcgctggcgctccgtggcctgtagttatagcagcggccgcgggcgggggaggggaagcggcgacgtacgagctgtagtgtgtgggagtgtaggagtagtggaaggtggttggcgtcgccctcgtgccg

SEQ ID NO: 19123 - DNA, 1149 bp, Triticum aestivum
  Clone ID: PAT_TA_19123
attttgatagcacaaagccgagtgctgagccctcagcggccacaggacacaaagccgaaacgaatatagcagcagaacaggataagactcaaaaaccttgacgactgcgcagctcgcaggctgcggcaatggcggcgacactgcagttcatcagcctgctcggcacctcctccgcccatcatccagctccttcctgcagcagcagcaacgagaagcagcaccgctctgtccacctgccgcagcagcagcaggggaggaggaagagcgggaggagcctccgcgccgtccgtgccgtcgagacgggcgccgagcctgccaccgccgactctgagacgacggtggagccgccgtccgtcgactttgcgttcgtcagccctcggctgctgccggacgggacgccggacgtgcactaccggacggcgtgcggcgggcagaagctcagggacatcatgctccaaggttacatcgacctctacgggccttacgataaattgctgctcaactgctcggggggcggcgagtgcgggacttgcatcgtggaggtagttgaaggcggcgaaatgctttctccgaaaaacgaagtagaaaaggaaaagctcaaaaggaaacccaagtcatggaggctggcgtgccaggccacggttggcaacccagattcaacaggacagatggtcatacagcagctaccagagtggaaggtacacaagtgggagaagtgactggagtataacattatgatgattatgcagtagacctcatgagtcatgaccctggaagaattagacaggagcaacacttggtcaagagaagaagaactagaggctgtctgcttgaaacctcaacgaggactatatgtaaaggccgacacagagacatgtgaaggcgtcccgtagaactagaagcaaaggcgcacttccttgcgctcgtaaacaaatacgtagtacaaaataatccaaagtgctccaatgctcaaatataaaacaatcggttcatttttctcaacctaagcgatcacctattgtataatactgtgcatcacctcggcaccctctctcaccgagtccacgtccaaggttgttctggacgttgccaaacatgattgtattccctgattgagtaatacaagaattatttcgcaaaacataaaaa

SEQ ID NO: 19124 - DNA, 997 bp, Triticum aestivum
  unsure (1)..(997): unsure at all n locations
  Clone ID: PAT_TA_19124
tgcggcgccccacgcgtccgcatacaggtccaagcccgcccgcccgcccatagagctcgccgcctccctccctgtctccttccccgcctctctctcgtcgtcgtcccccgcagcgccggccgaagcaaagcacggggacttaaccgccgccatgagctactacggccagcagcagccgcccgtcggcgcgcctccaccgcaagggtatccaggaaaagaggagtacccgccggcaggctaccctccggccgggtacccaccgccggggcagggacaaggctaccctccccagggatacccgccgcagcaggggggttatccgcccgcagcagggggtatcccgccacagcagggtaggggtacccgccgcagcaagggtacccgcagcaggggtacccgcctcagtacgcgcagcagccgccgcggcagcagcagagcagtggcccgtccttcatggagggatgcctggccgccctttgttgctgctgtctgttggatgcttgcttctaagttgatttctaagcggcagggaacagacttggtgcagctgctatgtgttccatattggaaattgggattggcttgttgattaatagtagtacttcgtagaggagattacaagaactccttaccgtcatgtttgtatgttcagatgattggatgtaccttttcgcattaaaaaagatgtttgttgtaaaaaaaaaaataccaagtcgcctagatgagacgccgctcttaaacacagggaaaccccggttncaactaatccctgnagaaaccccttccaantgctatacnaangccnacgttcctccaaatnccncctaangaatgaccccttcggcataaccgggttnggtcccataaaaaaaaaaaaaaaaaaaaaaagaaaaaaaaaaaaaaaaaaggcaaaaaaaaaaggaaacaaataaaataaaataaacacaaaaaaaaaaaaaaaataaaagggggggggcctttttaggggtcccaagtt

SEQ ID NO: 19125 - DNA, 982 bp, Triticum aestivum
  unsure (1)..(982): unsure at all n locations
  Clone ID: PAT_TA_19125
gccggccgggttccgggggagatatcgaaccctcccgaaccttcggagcgcgcacggggcgagcgagggagagagatggcgtacggcggcggcaggaggggctcgtccaggtggggccttccgatggtgaggtcggacgcgctcggcaagctgggcccctccttcggcatcggcgccggctgcggcgtcggcgtcggggtcggcctcatcggcggcgcaggaattggagctggattccctggtttacagctgggattcggagccggtgctggatgtggaataggaataggtttcggctatggttttggaaaaggaattgcatatgacgagaacgggaaatattcgaacatcaggagatcatttcagaacaccaggagccttccttatgatcaggagtttgatatcctgtttgacgaggtgatggagagcaccaggaagctcatcaaagcgacgacaaaggagctcgacaagtggaggcgcatgtagagcgaacatcacatgaacaaacagggattcagcgagatacgccgtcagtattctaccctggtgaaggatcaatttcgtcaaggcatgtgcgaggatgcgagcatcatgtgacggagacgccgtccccgcaccaccggaatatcctgcgcggcgtcgctgtcggtagcatatattgttcgtctgtagaatcgctgtttcgcattgaaatactcgggcctcgcgcagcatcgcctcgaatcaaatctttctctgtctcgttaaacatggcgtctgtatttaatttcctgattagtagtcaacgtcacctcgcaaaaaaaaaaaaaagcccctagagcaggtgatgttcatgcttctttcttgggcatcattgttaaacaagattttgtgttcctccacagcagtactacatacaccaacaccaaacgcttcctacgtcaggcgaaaatgaaatgcttgtattaattgatttcanaanananaaannnnnnnnnnnnaa

SEQ ID NO: 19126 - DNA, 774 bp, Triticum aestivum
  Clone ID: PAT_TA_19126
cccacgcgtacggcgcaccctcctgaaggactacaagaacgagttcgatgagatactggtggcggacaagcagctgcagaaggagctcctctacgacatgcagaagttcgaggccggcaagggcaagtcgtccagggacggagaggccgccggccccagcaggagctctccggctgctcctgacccgggtgacgcggctgcaaaggccacggcgcggtcggtgctcaaggagatgaaccggaacgtgccgacgccgccgctgcacaccatgagcgtgcccaaggtgaagtcggtgctgggcactggggcgctgagtggctcgcgccgaccggctatcctagagtcagtgaggcggctcgagccatttggatcagacgatgagaattagcatgctaacaacttgcaatccaaggaaatggagttaacattgtttaccattcaaggtgtgtgcatgcgaagccgctttacacgtcatgatgtttacaagacagagcaagagcaaatttgtgttcatttcatggggcattatgtactgagatgtcatatgcacctgcaagagctttgatattattagggatagcactttcagaaatatgtaactgtatcatgatgctaagagggacaacttatactactaggctcatcttctcaatgagtttcttttctttttctctttactgattgattctgtagatgtgtaactgtaatcgaatggtgtcgagaaagctgaaatgattgcaagtgctgtcttaaaaaaaaaaaaaaaaaaaaaaa

SEQ ID NO: 19127 - DNA, 975 bp, Triticum aestivum
  Clone ID: PAT_TA_19127
actcggcaatgacggtccacgacacactcacgcatcttctccatcgacggcgcgccggcggcgatggcggcgcggaagctcatcctcggcttcacagcagcaaggcgagccagttctcaggcctctgtactcctccgggcctcacccctcctggaagcctccacttctgcctcccacgccaccgccgccgcgacgaagggatcgccgtgggcactgctcttctcctccagggtcttctcgtcgacccctccggctcaacagtccgccggagatgtgcccgccccatccgcggtggaccacaagttgatattccctgaggttaagttccttatactatccgtcgatttagcacatgatttccttgaggaacttggggattctgcagcagatcggatgatttaggcattcgacatagattacgggaatcaagttctaacactgaggctagccgatttggggacctatggttgtaaacaagcaaaacccccaaccgggcaaatccggccttcctcgcccgtgtgtgggcccgcgagggttgtcgggggggctgcagcagccggctgggggttttggcggccggctgggagtctctcgcggcttcctgagaaggagaatcggtgagtctctgtggaactccagccgacctgtcctttcgggatgggatagggccacgccgcttagctaagtccaatggggcatactacatttcgagggagtcgacgtgacgtcgtctttcggttggtggttccggccaggtgacccaacggggtggtggtccgcccctttttgcccccattggcccgttggcgtgccctattaggcggccggctttccgccgttgccgggccttagcccggtattcctcctgttatataatcaacccgttgccggccgtggtcgctgtgttttataagcgtggtgtccaaattgtggggtggtgtttcaatagcatgatcagccaggctaaaaaaaaaa

SEQ ID NO: 19128 - DNA, 1698 bp, Triticum aestivum
  Clone ID: PAT_TA_19128
cccacgcgtccgtctcggtgtccaaataagcgcactagcgagcaaagtttgttagacagaaatcaagcatggctttcggtatggctttcaggacagcactgctgtgccttcttggcatgctgatagcttcccctgccattgccgtttctgattctggtatctactaccagattggtttgatgtggccgggagcatactgcgcgcagaccaccggcggatgctgcatgcccaagagccctgtcgtgccggcggccgacttctacgtatcgggctttaccgtcttcaacgcgacgaccgacgcccccgagaccagctgcagcggcactcctttcaactccggcgagatcctggaaatcagcggtctgaggcagttctggagcaacatcaagtgccccagcaacaacggccagagcagctggaagagcgcctggaagacgtccggcgtctgctccggcctcgacgacaaggcctacttccaagccgcgactcgccctccgtagcaagatcaacccccttctctcgcctcgtctccaaagggatcaagccggactttggcctgtacagcttggagaagatcaagaaggtcatccaggcgggcaccggcgtgacgccaggtgatccagtgcagcaaagggccgttcgataagttccagctgtaccaaatcttcatctgcgtggccggggacgccaaaacgctcatcgagtgcccgaaaccgcagaagttcacgtgctccgacgagatcctcttccaccccttcaagaagtggatgctaaagcaggccgcgtcctcggtgtcctacgccgaagcattcgaatataataattgcagcatgggatactgaccttaaaatgcagttctgccaacgatcaggaaattcagcggtgtattcatggaagatgcggtgacagaaacaccattcattatatagaggctcactaaatcgtgaaagcggaaacataggtgacagatacaaatataaccccatgcatattccagcctgaactagagcacgcagagtaggtaataatggtgaaggagttgagctggcccatattcctttcctttcagtccattcaagataatctttcatctcatatactggtccagcaaagtggctgccacagcagaggcagtaaccaaaatattcgactagagaaggcaacttagccaagcgatacttcttctgagcatcacgtagaccctcttcttccttcaagagaccatcactgtagttcattgagcatgaaatgactttcaacgttaaaaccatcaaagcaccagttgcgtcgatgcctccctccttccacgcgtccccactcatgtagtagacatgacatgcgatgaggaagccgaatgcgccgaggaaggtgacgaggccagctcggcgacggcagaggagcatggcgaggtaaccgagcgccatgggcccgacgaagaggaggttggaggtggccccgaaggacaggtaggagagcgcggcgccgctgagccccgcgtagaggtgccgccccgtggcgctcggcaccgcgcgccagaggaggcccgtcggtatggtggccgcgaagcagagcaggaagcggagcacgggcaccgagacgccgatcgccgccgccatcggctccatctcgagccccatcgtcgccaccgccaccgccgccgcagaggggggacgaacagatgcgggcgcggacgcgtgg

SEQ ID NO: 19129 - DNA, 710 bp, Triticum aestivum
  unsure (1)..(710): unsure at all n locations
  Clone ID: PAT_TA_19129
agagggagtatatccatggaggcgaccctggtagaaatggtacacacccttgccgccatccttattctctggctgatctcgaggtccctgtggcatctggtatggaggccgtacgccgtcgccggctggtttgaacggcaggggatacgagggccaccttacagattcgtccttgggtccttgtgggagatgaaacagatgttggttgccgagaggacaaaggcgcctctggatatcggcagccacgactacacctcccgcgtcaatcctttctttcacaaatgggccgccgattatgggaaaacatttctgtattggttgggaccaacaccgacaatatattctaccgacttggagctagtcaagcaagtactggaagacaagacagagttgttccagaaggactacctgaatccaatcttggaacgcatcttcggcaaaggacttgtgaccacaaacggcgatgactggaaacggcatcgcagagtcgtatacccgtcttcaaccacgagagctcaagtctgtgtcagcatgacaagggaaggacacaaaagatgttgcgcaatggtgaacaaatagaaaagggtgacggcaccaagccgagatgacatgaggtgnacgtgaagagttacttnagagtnttgacagtgtttcggcaaacagcaagaatccgggagtgttgtcgcggcaagaggcagagctccggntat

SEQ ID NO: 19130 - DNA, 1045 bp, Triticum aestivum
  Clone ID: PAT_TA_19130
ttcttgatgcaaagcgcatccacaacctgacaaattatctagaaaagttacatgatagaggattagcatccaaagaccacacaacccttctgttgaactgctataccaaattgaaagatgttgagaagctgaaccatttcatcaaagatgaagatggggtaggtgaaattaagtttgatgtggaaactgccataagagtatgtcgtgcagctggatatcatgaacatgctatgtttgtggccaaaaaggctgggagacatgagctgtatttgaagattttacttgaggatcttgctagatatgatgaggcgctgcagtatatatctggccttgaggcaaatcaagctggtcttactgtaaaagaatatggaaaaattcttgtggaccatagacctgctgaaactgttaaaatactgttgaggctttgtactgatgggggagatcctacggcaaggagaggttcaaatagcatgcgcttgcttatgataccttcaccaatggactttgtaaatatatttgtgcacagcccacaatatctcatggaatttctagaaaactatatcaaagcagtcaaggactcacctgctcagacagaaatccataacacccttctggagctgtatatatcaaaagatttaagcttcccatctatgtcacaagaaaatggctttgatcatcacaatagtaaagaaagaaaagggaagggaattacaaacggctataaatcaggcacaagggagaaagcgaaacttggaaaagaagaaaataaaacagcaaaggatattgttgacagacaaaggaaaggacttgctttgctgaagtctgcctggacacctgagatggaagaacctttgtattctgttgatcttgctcttatcatttgtaatgcaaatgcatttaaagatggcttgttatttctgtatgagatattaaaactctacaaagaggttatcaggtgctacaagcaagctcatgaccatgaaggtttaattgcatgctgcaagaagctaggggactcaactcaaggaggggatccatctctctg

SEQ ID NO: 19131 - DNA, 767 bp, Triticum aestivum
  unsure (1)..(767): unsure at all n locations
  Clone ID: PAT_TA_19131
cccacgcgtccggaaggctgagaaacagaggagaaaggaggcaaaatacatggccaagaaactgcaggaggaggaagctgcaagggctgcagaagaggaaaggaagaggaaagaagaggaggcgaagatagccgcagcagctgctgacattcgaaagaagttgaaggaaaaggagaagaagttgctacgcaaagagaaaaatcgcctgcgcgcacttgtgggccaggtagttggtgagtcccacttcagtctgtcaaaggaggatgttgaaacagtatgcacatcacatgattttgaacagttgaagaaactctgtgatattatggaggacaaggatacagctgaaagggccaggttgctgagagctgcactgagcaaagaagaaaactcctcgaatacctcacaagaagagaaaattcatgccaatggtgtggcggattctactccaaaatccactgtcccacaaggcactccaaaatccacagccccacaagtcattacactaggcaactatgagaaaaaagagaaagaatggggaaaggaagaggttgaattgcttaggaaagctatacataagtatccgaagggaactaacaagaggtgggaggttatttcaagagtttaatggtactgggtaaatntgctnacgaaattttgaanggcacgaaaancaatcctctgcaaaaancaaactcctgctaaagctttggaccctttccttgagaaacccaaaagcaactccatcctatggtancgcctcctttcaa

SEQ ID NO: 19132 - DNA, 730 bp, Triticum aestivum
  Clone ID: PAT_TA_19132
cccacgcgtccgagcaggcgcgtgcagtagcaggttccgatgtacgggcctcgtcggccaccactagcgctcgtgtccaaggcaagctgctcctgcagagctccgtggactcgcccgacggccggctcaggctgtccgtccagctcgtcagcgccaccgtcgccgggagtgatgggcgtggcatgagaggggaggcggcggcgctggacgccgtcatagcgagcggagagacagagctcgacgtggagctgccgtgggacgacgaagccctgggcgcgcccggcgcggtgctcgtgacaaaccactccgacctccccgtgtacctgaagctgctgagcctgacctcgccggccgtccacttcgtctgcgacggatgggtctatcccgtcgggaagcacccgtaccgcctcttcttcaccaacgacgcgtacgtgaaggaaaacacaccggcggcgttgctcaaggacagagaagacgagctccgtcagctccggggagagggcgtgccggccgacgagccgctccagaaatgggaccgcgtctacgactacgcgctctacaacgacctggggaaccctgacctacgaaaggacctggcacgcccggtgctgggagggtcggaagagtacccgtaccctcgccgtaccaggaccagccgacctccgaccaagacagatcctgagagcgaggctagagtgccagtggagcaagaggtgtacatcccctgcga

SEQ ID NO: 19133 - DNA, 1609 bp, Triticum aestivum
  Clone ID: PAT_TA_19133
gaattcggcacgagcacacgggtcccggcgggcggcgcccgctggccggacccgcacatcggccaccgcgcacgcccacgcgccccccccccgcctgcgccgcccggaccttccccaggacctggggcgtggggcgctgggatggtccggaacggtgcccctacccgcggcggagctggaacccgccggccgcccagcacggcagccccccccgagcgagacgagggcgtcgctcgaggaaggggtccacatcccgtgccccgagcggaccggcgccgtggccacggcgcccaccctccccacactcgagcggcccttcgcgtccgtggcggaggcccgcggcctctgcggcacccacgcccagcccaccgccttccccgtcccacaggtcatctcagcgaatcgaacagcttggcggaccgatgaagagttcgccaggcaaacactcgcggggacaaaccccctgtccatcgagctcgtcaccggcctcccactcacgagcaagcttgaccgggccctgtacggtgaccaagacagcaagataaccaaagagcacattgagaagaacttgggaaacatgaccgtggcgcaggctatagaaaaggacaggttgtacgttgtggatcaccacgactgggtgatgccgtacctgaagcgcatcaacgagctgccaggcgacgtggagaagggcgagatctccgagaggaagtcgtacgccacaaggaccctcttcttcttgcaagacgactccacactcaagccgctggcgatcgagctcagctcgccgcacccagaggatgagcgcctcggcgccaccagcaccgtgtacactcctcccgaccaactcaaagccggcgacgccgcctccgacaccttcacggcgtgggacctcgccaaggcccacgccgcctccaacgacgcctgcaagaacaactacgtccttcactggctgaggacgcacgcgaccatggagcccgtggtgatcgcggcgaaccggcagctgagcgtgctccacccaatccacaagctcctcaagccgcacttccggaacaccttggacacaaattccacggcacgacacatcgtcatcggctccggcgacgagcgacagggtggtgccttttacgcttggcggacggatgaagagttcgccaggcaaacactcgcaggggcaaaccccctctccatcgagctcgtcaccgctctcacactcacgagcaagcttgaccgggccgtgtatggtgaccaagacagcaagataaccaaagagcacattgagaagaacttgggaaacatgactgtggcgcaggctatagaaaaggacaggttgtacgttgtggatcaccatgactgggtgatgccgtacctgaagcgcatcaacgagctgccaggcgccgaggagaagggcgagatctcccagaggaagtcgtacgccacgaggacgcttttcttcttgcaagacgactccacactcaagccgctggcgatcgagcttagctcgccgcaccccaaggatgagcgcctcggcgccaccagcacggtgtgcactccgcccgacgaactcaaagccggcgacgccgcctccgacaccttcacggcgtgggacctc

SEQ ID NO: 19134 - DNA, 850 bp, Triticum aestivum
  Clone ID: PAT_TA_19134
gacaggattgtggaagattgacatggatgggaaagtgaatggagcagtagaaacatgctttggatcgtttcatcggtattggcagtatatgaacttctcgcacccccttatcaaagcaaagttcaatcctaatgcatgtggctgggcttatggcatgaacttctttgatcttaattcttggaggagggagaaatctaccgagcagtaccattactggcagactcagaatgagaaccggctactatggaagttgggaacattgcccccgggtttaatcacattctactcgaccacaaagcctcttgacaaatcttggcatgtccttgggctcgggtataatccaagcatcagcatggaggagattagaaacgctgctgttgtgcatttcaatgggaacatgaagccttggctggacattggtatgaaccagttcaggcagctctggacaaaatacgtggattacgacgactcgttcattcgtcaatgcaattttgcaccgccatagaagaaggaagccttgacatttattctgcagaaatggaaaaggtttggagattggaactggggaacatttcagctggaacagcgccgaacatcttttactgtcagatgactgccgtcctgaaaccggttttcatttctaattcgaaaacaatcacttgcgattctacttgcctgagattagtcttgtgaatgtgtaaaattgtgatacgaattctatgtctcatgctatacttagtactgagtgctgtatagcttttgtgttggtactggcacgtatgagtacacaagtacgctttatttgttggcctctatatatataccatgtagtcccaccgtctagttcttg

SEQ ID NO: 19135 - DNA, 1795 bp, Triticum aestivum
  Clone ID: PAT_TA_19135
gctcggggcccgcggctcccctaccggctcctgcctcttctggcccgcccctccccctctcttctctcccgcctctcccgtgcccgccctggggctcccgcctcccctctccaggcgggtggcccggcgcgccgagagggatcctattcctccttcccaccactccgacgactacgagccggagccctctcgatcggaacgaggagcgggaggaggaggagaggatcctcgtcgcccgctgcccctgcgccagccgctcgtggggccctgccgcgccggcgaccgcctcaggcctcgcctcaccctccacgtctcttgctccgccgccgagaaccgcttcatttctcaccgctctcagcacttcgaggtctcggaggtgggcgtgctggcaaggtgtctctgcgtgctcctagtgttcccaacccttcgacaacgttgaccgccaccctcccctcaaccggccaactatcttctaggggagtgctcagccttcggcttctccccccatcctgcattcgccttgccttcttcggtgcccttgctggccccctctatttggcccccctgagggatggccttcagagttcccatgttggccttgctattgctgctgcccgccatgcccatcgtcactgcagtacagtgtaacccctctgcatatgccagttacatctgtagaaccatttccccagtcacctttgggcccgctggtatcaaatgaagtatcatctgtctcgtcattttctgcaaagttggatacaactaattcaccttcacttaatcttccatcgatactgcacgatccttcacttcacctccagcttcctacttcaattgttcccctgcatggttctatggtttcaacatatccgttacttcatctgccgtttcccacttcacctcttgttcctgtacatggttcgcaggttccaacattttccgttgcttcacctgccacttcctacttcaccatttgtttcattgcatagctcacaggttccaacatttacaccattgatgtctgatcctattgtgcatgtcccagtcattgatatgtgttcctccggtcaggcttatttggtgagttgtggtccttctataacttcacctgttcccctgctccctagcttgaagcctctgattccagaaaccgaatcgttggttgagaggagtgctagggaaacactaatgaggcttttagcttcgacaccaccatcaagcaacccccagctggtcaacattctccctgcagtccttactgatgtgcctgaaaatatttctcgatctcctaatgtgaacatgcatgttggtgtccatcgcaacgacctacttcttagctcatcttggggtgctaatgtgattggaagtgggatggcagccatggagctgcactcggaggatgaggtttccagtgggcatgatgctcatgcaatggttgcgtttacggaatttgatgatatcaacggagaccgtgatcagccccatttccggaggatgtagtttgcacatggggttttcttgagctctttgttggtatgaaatgtctgaatattttgaacggcacttgtatctacatggtaataggctatctggttttggcaatacgatgatatatgcagcctggttcccatggcttccctgcccagctaaacggctgatgtggttgttaaatgtaattagttgtttgtacccgcccgggcggccgcgcgtcctagatcgtgctctccatcctccatgccatctttcgctcaacacctccgatgttctccatcgtacctcggccgcgaccacgcta

SEQ ID NO: 19136 - DNA, 1255 bp, Triticum aestivum
  unsure (1)..(1255): unsure at all n locations
  Clone ID: PAT_TA_19136
cccgaatctcgagcgccactcatggcctcctccgccttgtccggcacccaccatcgcctcctcccctgtttcctgcgccgcctcccccggccccgcacgcgctcgtgctcccgcctccgcctcgccgcctgccatgccgacaccctcctttcctcctccgggacccagaggcctcccgcccccgcggcgtgctcgtccgcatcctccgctggcgggttctctgactggctactcacgaatgggctgccgccgggcaaggtggccatcctggagcgccccgtcccgtgctctcgcgggggcaaagaccggccattacacttcgtcgctgctgggcaggacctcgaggcgggggatgtggcgttcgaggtgcccatgtcgctcgttgtcacgctggagcgggttctcggcgacgagtcggttgctgaattgttaacaacaaacaaattgtctgagctggcatgcttggcattgtatctcatgtatgagaagaagcaaggaagagattcactttggtacccgtatattaaagaacttgatcgtcagcgaggcagggggcagctagctgttgaatcacctcttttatggactgaaagtgaactggattacctgaatggcagccccatgagggatgaagttgttgttagagatgagggaataagaagagagtataatgagcttgacacattgtggttcatggcaggttcattgtttaagcaatacccttttgatgtacctactgaggcgttcccgtttgagatcttcaagcaagcatttgttgcagtacatcctgtgtggtcacttgcagaaggttagttagctcgaagatttgcactagtcccttgggccacactgttgacgtacaagacaactgcaaacatgctgacgcgttgatggttctgttcggtcgctggccgatcggccgtacaaagcaggggaaccaataattgtttggtgtggccaacaaatcaagttgctccaaatcatttttattagaaccattgatcaacacaagcaatcagcgcgtacagcaagccaggcccccaaaaaccccccaaatcctcattgccaagagcagagcctggacgctcaatctaagagaaaccttgctgcctcacaaggcccagtttccagaggcgaagagaaggaaactatttctgaaatgctgccatacttgagactaggatacatttcagatccagatgaaatgcaatgtatactttcgtcaganngtgatacatgtccagttagtccatnn

SEQ ID NO: 19137 - DNA, 619 bp, Triticum aestivum
  Clone ID: PAT_TA_19137
cggtactcacttcacggacgcgtggggtcgccgctcgatgcagtccaccagcgacgagaggccaacaagggttgtgaagcagttctttaggcacgcgcgtgcagcccagaaaatccaggaatcctgattgctttcagttcactcagtaaaaaagaaaaagtggcgtgtgtagctcacttttatcaatttttggtttgttgtaagcgaccccgattcgttccatgtgtcttctttgcagatcacttctttgctttttttgcaggcgaccccgattcattcgatgctagcttcctggtcggagctcctccaccgttcacctcctcctctgcatcccatgcagttggctccggtggttaacgatgatgcattggcagggggcggatgcagtatggcagggcagcgcatgtagtgcggtagcgccgcacatgcagtgcggtgctcacggccgtgcgtggccgctacggttggccgcgcgagccactccctgggacttgattgctttctttcttttttggttgagggaagttccacaaaatttagtttgcggcagcatggttcggctgtaaccccccaagaccgacgctccagaagtcttccagctaaaaaaaaaaaaaaaaaa

SEQ ID NO: 19138 - DNA, 1474 bp, Triticum aestivum
  unsure (1)..(1474): unsure at all n locations
  Clone ID: PAT_TA_19138
atgagatgcccttaaagttatccccttcctttccttccccggccggccctcctactcacggcggagcggagaacccaaccaaccgccgccgccgccatgccgccgtccctcctactccccgcctccgccgccgcctcctcctcctcctctggtattagtatggggaggctgtcacctaggcccctgctcgtctgcttccccgcgcgccgcagccgtctccatgcggatgtggggctccgcctcgccgccgccggacccaacggcgtcaacggtgcggcctctcccggtccagattccggttccggttcagggggcgccaaccacctgcccaaaaaccggagggatattctcctggaatacgtaaaaggcgtccagccagagtttatggagcttttcgtcaaaagagccccaacacaggttgttgatgccatgcgccatacagtgacaaatatgattgggactctgccgcctcaattttttgctgtaaccgtcacaacggttgctgaaaatctggcacagcttatgtacagcgttttgatgactggatacatgttcaggaatgcacagtatcgtctggaactgcaacagagcctggagcagattgctcttcctgaacccaaaggagaaaagggctcagaagattatgctcctggaacccagaaaaaggtaagtggggaagtgatccgatggaacaagaccactggaccagaaaagattgacgctgtgaaatatatagaattgcttgaagcagaaatcgatgagctgagccgtcaagttgctaggaaatcatctcaaggaagcaatgagctcctggaatacctaaaaaccctagaacctcaaaatctaaaggaactggcgagtagtgcgggtgaggacgttgtatttgcaatgaacgcattcataaagcgtctcttggctgtctcggaccctgcgcagatgaagacggcggtttcggagacgagcggtgcccagctggcgaacctgctgttctggctgatgatcgtcgggtacagcatgcgcaacattgaggtgcgtttcgacatggagagagtgctgggcgccgcccccaagatgggcggagagctgccgcctggtcctggagacaacacacagacacaactatagctgctagataacaagcacagcgcgtgcggttgcagttgcagacgatttgttagtttggtctgctgagaagtgtgtgtttttgtacggatatatgtatgttgttctgtcttagctggtatttagatagcaaaaagaaaatttacaaccgcatgtatttttgggggaagaatgtacatttgaaagtagaaagcgttctaatgatttataagggcaagttgtctccactcctacctgtaggagagatcttgttatttcctttggtttttgcctttttctgagttgactactttgtgtctgagcggcgatcgactagcctaggtggaaccncaangccnctcancgaacnggc

SEQ ID NO: 19139 - DNA, 1273 bp, Triticum aestivum
  Clone ID: PAT_TA_19139
gttttcaatgtgactgataaggaagggctgaaattgaaagacaaggctgctattgcggagattgagggctacatccggaagtccttgggcgcagattcaagatacatgcctgctaaacggagatcggtgggtgtcgccgcttcaaccgaccacaatgtcattgagctgacagggagcgatcgtccaggcctgctctctgaagtcagcgcggtgcttgcgagcctcaaatgcaatgtggtcagtgctgaaatttggacccataacaccagagttgcagccgtgatgcgagtcactgatgaggacaccatgctagccgtcaccgataccgtgaggcttgaaatgatcaaggagcgactatcctaccttctccgaggaaacaatctctcgcgaggagctgccatggcagaagcatcggggacttctgccacacataccgacagaaggctgcaccagatgatgcttagtgacggggactgctgaagagtttcatgggcatgtcccagctcaacctcagaggcctaaggtcactgttcggaattggaaagacaaggactactcggtggtgaccatcaggtgcaaggacaggccgaaacttctgttcgatactgtttgcaccttgacagacctgcgctatgttgtctaccatgcaaacattgacgccagcaataatcaggcgtaccaggaattctatgtaagacatgtgaatggatctccaatgaacactgaagctgaaagattgagagtcatccagtgccttgaaagtgcaattgagcgcagggtatctgagggtgtgaaacttgagctgtgttcaaatgacaaggtcggcctcctgtctgaggtcacccgcatcttccgggagaacagcctgactgtcacaagagcagaggttagcaccaaaggcaggacagccgtcaacacattctacgtccgcagctctgcgggggaggcagttgaccagaagaccattgattccatcagggaagccataggacacaacattcaggtgaaaggccaccctgaggcggcgcctcagaagaaagagtccccgacatggttcctcttcgcaaacttattccgaccaaggtctctccctagtcttggattgttcgtgcggtaatgctcgcatcgaactcggagaacatctctgtcaatcaagccttaactgctgaagcggtccgtgagaattggagcctacatttggctccactagtgcagagttagtttacatacattatattgtgttgatcatagaccatcatcacctgtaaatatg

SEQ ID NO: 19140 - DNA, 702 bp, Triticum aestivum
  Clone ID: PAT_TA_19140
tcggcacgagggttaacaaggacgccccggccgcaaacaaatcgctccaaaatcgatactctcgcctcgccgcgccgctcccgtctcgcgccgccgctctgtcgccttgccccgcagtgctctctccttgccacgctgcactcatctggagccgccgctcacctacgccgggaactcgccgacagccaccgcccgaaagtcgccgactccgccggcggcccgatctccagccgcactccgccggaagctctcctctagctgcccgtcaccgctccaagccatccacctcgacgagtcctcaggtacacgagctattcgccaacgactgctcggaatttgtcaggcctctcatctgctactgctgctccgattcaactttctgttctgaactttgtggatagatggcttccaatagcgtgtttgctgagttgctcaggaactacaagttagatggcacaaacttcactgtttggaaaaggaagatgatgtttctgcttacagctgagaatattgagtatgtgatttcgaccgctgagcctaacaaacctgctgatgacgcttcagatgaggaaaaggataattatgcagaagaactcaaggagtggaataaggacaataagaaggctaggatttttattcttggttccatgtctgattcgttggcaggtgaatatgaaacagaggttgctgcatacagaatta

SEQ ID NO: 19141 - DNA, 799 bp, Triticum aestivum
  Clone ID: PAT_TA_19141
ctgctatctctactccgtctacaatctttggcgattggttttgggggaaggaaggtgattggattgaaatttatgattcataggatttatatattgatgaccgcacatcctgatatgtttgcaacccagtgaattccgtttgagtactatacatgttgactgtgattgggcaaattctgcattagattttgctgataaaattggacatcaattgtctgcaaattatggagcacctcccggttgaagttattggcaacattcttgcacatcttagtgctgcacgagatgtcatggtttcctctgcggtttgccggaagtggcgggaggcctgcaggaagcatctccattcactgtccttcaattcagacgactttcctcgggacatgaccacacgtcaactggagatcatcatcacacagactatatttcagacgatgggactgcaatgcctctctattcacatagataacacacatgagttctctgcagcacctgtgattgcatggctaatgtataccagggagacgctccggtgcctgtattacaacatccaaaccaaccctaatgtaaacatcctggagaagtgtgggagacagaagctggaggtgttggatttggaccataacacaatcaccggtgttgaaccaagctaccagaggttcacttgtcttaaatccctttatttgaggcatgtgagcatttctgccctggatttgagccttctagttgctgcttgccccaagatcgagtcactagcacttgatgtccttgagattgtcacttctgattggcagtctac

SEQ ID NO: 19142 - DNA, 657 bp, Triticum aestivum
  Clone ID: PAT_TA_19142
cgcgtgttggagatcgagagaaggaaaccctagccgccgtcgtccagatctgcttgggttggtggagggtatggctatggcgctgcgcaccatggccgccaagctgaagcagaagatccccgccgctgtccagcgggttcgcgtctcttctcgtgctccggcacctgctgatgctgacttcgaccgcttcggcttcggcccagagtttcgccgggcactggacaagattgtagagaaacacaggaagaggcgcagggacgaggccttagcctgtggtgctggcttcagtcttggagcactcacctttttgcttggggtccataggctcggttgaagggagatggctcaatggtgaatgactggaatatctatcctgcaccgcatgttctactatctactactgcacctgcaagttctactatctactagtactctatatatcatgcatgttttaactagccggtgtactctgtaattcctggcttgtgtgttatgtaagatcactactgtatgtacaatggggatccaggttctgtgggatctaatttcggtggttgcatgtgggatgtaagggcattctatcgccactcttatctgttgttatcagagatctatattcagccgtgttgttaatctgttgtggtgttctcatggtct

SEQ ID NO: 19143 - DNA, 667 bp, Triticum aestivum
  Clone ID: PAT_TA_19143
cgtccgcccacgcgtccgccccggcgcccacgctggagatcgagagaaggaaaccctagccgccgccgtccagatctgcttgggttggtggaggtatggctacggcgctgcgcaccatggccgcgaagctgatgcagaagatccccgccgctgtccagcgggttcgcgtctcttctcgtgctccggcaccggcttttgccgacctcgaccccttcggcccagagtttcgccgggcactggagaagattgtagagaaacacaggaagaggcgcaggaacgaggccttggcctgtggtgctggcttcagtcttggagcactcacctttttgcttggggtccatcggcttcgttgaagggagatggctcaatggtgaatgactggaatatctatcctgcaccgcatgttctactatctactactgtgcccgcaagttctactatctactagtgctatatcctgcaccccatatgttctgctatctaccagtactatatcctgtatgtttaactagccggtgtactctataattcctggcttgtgtctacctatctagtagccactgtggggatctaatttcggtggttgcatgtgggatgtaagagcactctatcgccactcttatctgttgttatcagagatctatattcagccgtgttgttaaccaaa

SEQ ID NO: 19144 - DNA, 903 bp, Triticum aestivum
  Clone ID: PAT_TA_19144
cggccgctgggggcatccgggcgggagcggagcgctcgcgggtggagatcgaggagaaggaaacccaacccgccgccgtccagtatctgcttgggttggtggaggggagggtatggcgctgcgcgcgcgaaccacggccgccaagcgcagagcagcccgaccgctgtccatctcgtgcgcgttcgcttctcttctcgtgctccggcacctgctgatgctgacctcgaccgcttcggcccagagtttcgccgggcactggacaagattgtagagaaacaaaggaagaggcgcaaggacgaggccttggcctgtggtgctggcttcagtcttgtgagcgctcaccttttttcgtggggtccatcggcttggttgagggagatggctcagatggtgaatgactggaatatctatcctgcaccctacatgttctactatctactactgcacacgcaagttctactaatccactagtgctatatcctgcaccgcaagttctactatttacttgtactatatatattatgcatgttttaacttagccgtgtgtacttctgtaattgcctgtggcttcgtgtgttatgtaagatcactactgtatgtacaatggggatcccaggtttctttgggatctaatttcggtgggttgcgatgggggatgtaagggcactctatcgccacttcttatccgtgttgttatcagagatctatattcagccgtgttgttaatcaaaagaagtgttctcaccttcgagtaattaattgtatgcgtgttgtccaacgatatatccttacatattctggtgaaccatgcatgagtcatgcctcgctgttctgctgtccatagaaatctttctttctcttcatcacgtgtgacttttattagctccagccttcgtaagagga

SEQ ID NO: 19145 - DNA, 862 bp, Triticum aestivum
  Clone ID: PAT_TA_19145
tttccttttcggttgcgcgcaagcaaacacagccgccgccgatgctcctaaaaccccaggcaatctgggcggcttccctccctctcttcctcggccgccgcctcctccccaaatcctctccccctccctccggccgccgcctccccttccgcccgatttgcaagcggcggatgagcgcgcaggcggagcccagattcgcccctctccccacagcgcagtccgagcctgatgccggggcagacgggtaccagttccggctggtttcctacaacatactcgcccaggtttatgtgaagagcgcattttttccccattctccatccgcgtctcttaagtggaaagctcgttcaaaagccgttctaacagaactcaagagttttaatgctgacctcatgtgcatacaggagttggatgaatatgagacattctataggaaaaacatggaaagtactggatattcaagtatttatgtccagcgatctggggacaaacgggatggatgtggtatattttataaaccaaaaagtgtggaactgttacagaaggaagtaatacattacaatgacttggtggaaacatgtcatcttaatgataatgtaattagtgccccctcgaataattcttcaccatcagaagaatctagtggaaaggaagataataagaaacgtggagatccaaatgatccacgtgtgagattgaagcgtgactgcgttggtttacttgctgctttcaagcttggcgatccttgtgagcatatcctgattgtggcgaacacacatatttattgggatccagaatggattgatgtgaagttggctcaagcaaagtatcttctttcaaaagtctctgagtttgagaaaat

SEQ ID NO: 19146 - DNA, 836 bp, Triticum aestivum
  unsure (1)..(836): unsure at all n locations
  Clone ID: PAT_TA_19146
gcacgaggctcccatcccttctccccaccgtcagcaacgcttccggctgccctcccgcgccgctcgccggatccgccgtttctcaggaaatggccgcgctgcaaccatcgttctcttcactaatggctatgaacaatagctgcaacaccatgaaattccccaagactgcacttttgcctggtttcggtggcatttcgcgccctcaagatgtgcaggacaggaatgctagcctcacctgttcaaggcccaaggcagtttcagtgactgatcagtcagtagcagagccagcaaaacccaggcaaacgaaacacacagttgatcctgctgctcccgaatttctgccgctcccagcatttgaagactgcttcccacggagcaccaaagaatgcagtgaagtcgttcatgaggaaacaggtcatgccctgaaggttccatttcggagagtccatttgaccggagatagcgggcatttcgacacatatgacaccagtggtccacaaaacataagcccaaggctcggactcccaaagataagaaaggaatggattgacaggagagagaagttgggtagtcctcgttacacgcaaatgtactatgctaagcagggaatcataacagaggagatactgtactgtgccaaacgcgagaaccttgctcctgaatttgtccggtcagaagtcgcccgtggacgagccattatcccttccaacaaagaggcacctggaattggaacccatgattgttggaagaaacttccttgtaaaggtgaatgctaacattggggaaccccggctgttgtgagctccatttgaggggggaagncanaagctccantg

SEQ ID NO: 19147 - DNA, 1748 bp, Triticum aestivum
  unsure (1)..(1748): unsure at all n locations
  Clone ID: PAT_TA_19147
acgcaacgcaggtggacgtcatttcgtcatccccaacccccacccctacacacgactcgccacaagccgagcagagagaggccgcgccatggcccgcatctagggaccgaggaggaggaggagcagcccagtagacgcaggcaggatggggcgcgcgttcgtgtacgtcgtcctgggcggcggcgtggccgcgggctacgcggcgctcgagttcgcccgccgcggcggctactcccgcggcgagctctgcatcatctccgaagaggccgttgctccttatgaacgccctgcattaagcaaaggctatttactcccagaagatccttctcgtcttccaaaattccatacttgtgttggagctaatgatgagttactgacgacaaaatggtacaaggaacaaggtattgaacttgttcttggaacaagagtgatatctgctgatgtgagacggaagacattgcttacagccactggagaaactatcagctataagacacttataattgcaacaggtgctcgggctttgaagctggaagagtttggaataagcggttcagatgctgcaaacatatgttatttgcgcaatcttgaagacgcggataaattagtgaatgcgatgagctcatgttctggtggaaatgctgttgtcatcggtggtggctacataggaatggaatgtgcagcagcattggttactaacaagataaaagtaaccatggtcttccctgaaaaacactgcatgggtcggctatttacagaaaaaattgcagactattatgaaagctactacactttgaaaggagttacttttaccaaaggaactgtgcttacatcctttgaaaaagactcaacangggaaggggactttcggtaatccttaanaagatgggcaaccacccttcctgctgatatgggagtagttggtattgggatccgtgcaaataccagcctttttgaaggccagctgctgatggagaagggcggcattaaggtaaatgggcaaatgcaaactagcgacagctccgtgtatgctgttggtgatgttgccgcgttccccatcaagctctttgacggtgatatccgacggcttgagcatgttgactcggctcgtagaaccgccagacatgccgtcgcagccatcctggagccttccaaaagcagggacgtcgattacctgccattcttctactccagagtcttcacactgtcctggcagttctatggagacaatgtcggagaagtaattcactacggcgacttcacgagcaacagccctcggttcggcgcatactgggtcagcaagggccagatcacgggcgcgttcctggaaggcggggaccgggacgactacgaggcgttatcggtggttgtctggcgtaaaaccaaggtctcggacatgcctgaacttgaaagacaaggcctggcgtttgccatccaggaaagcaagaaagacgtgcctgacagcggggtcaccctcggcgagaagcccaccttcgtgtggtacgcgacggcgggggttgttgcggccgtctcgatctccgcgttcggttattggtacggcaggaagcgccgcaggtggtgagctgatggaaggccggaggaagatctgtgatgtgcactcggagggaatcctgtataaaaacctgtacgaaagtgtaattttgtctcatactgtaaacaagtatagaaacaccatcatatattgttaaacgaacgaaacgatgtctcgaaatcccgagagcgatcct

SEQ ID NO: 19148 - DNA, 1403 bp, Triticum aestivum
  Clone ID: PAT_TA_19148
cctcctcaccgcttccaaccccttaccgcaaagattcaattcgcagaggaaccaagagcccaaagctcccagctagctagctgaaatggctctcgcccaccagatcaccaaccagccgctcctctcctccccgccgtgcctcgcaagaaccaacggtagcaatgcgcggacggcgaggacggcgtttcttggccacagctgctgcctgaagcttcgggatacggcgaggagatgcgtcgtcgtccgcgcgtcttcgtcagcgcaggcggagcccaagtccggaggtggggacggggatggaggccaggagccgtacgaggagtacgaagtggagatcctgaagccgtacgggctcaagttcgccaagggccgcgacggcggcacctacatcgaggccatcttccccggctcctccgccgagcagatcggcaagttcaccgtcggcgacaaggttattgccaccagcgccgtctttggagaggaaatctggccggcggcagggtacggccagaccatgtactgcatccgccagagagttggccctctctacatgaagatgcagaagaaatttgggaaatgggatggtgctgctgagctctctgacaaggaggtcatcagggctgaaaggaacaccggaaatgtcagcactaaactgagagagattcagatgcaaaattaccagaagaagatggaggagaagatccaaagagaacgatgacctgcggatggggctaaagcttcacaaggatggaagacccaagcaggcgttggagaagtgcgagtcggtgctggggtcaaaaccagagattgatgaagcttccgtagccagctacaatgtcgcgtggccaaattcaaagctcgaccggatacaagctgggctttctgcacttgaagctccgatgagcggaccggctggttcaccgtcggcgacacggttattgccacctttaccgtctttggagaggaaatctggccggcggccccttctaaacaagtacgatgaatcatttatcaacgagatcgccatctatgctatcaaatccatatttggattcggtaagaagtgatgacctcctatcgattgcacacatctacttggtcttgcactttgcacacttggccataccgcccagcctcccccccctgctttttaccctccgagaattccccacagtagtttttggccttcctttggacttcagccattctatggacatacactttttcagcaccactggccatctaccccgtccgaaagccacagccataggacataacattccctcgcccccgttcggtgtgccgtgcctgctggcgtgcttgaagtaccaatcgggatgtggatatattatctggtgaacacaagagccagcgtttgacggccgacactcgattgtcattct

SEQ ID NO: 19149 - DNA, 1731 bp, Triticum aestivum
  unsure (1)..(1731): unsure at all n locations
  Clone ID: PAT_TA_19149
gtaccgtccaaatcagaggggcggataaaatcccaccaatgctcctcctcgctcccaccccgccgccgtcgccggccaccgctcaccggcgaccgggtggcagcgctgcctcgtgcatccgctgctcgagcgtgcgagagcttgataggtccccgagccgcccgccgctgccggcgctggcggaggcaaagcgggtggtgctggtgcggcacgggcagagcacctggaacgcggacggacgcatccaggggagctccgacttctccgtgctcacgcccaagggggagtcccaggccgagacatcccgcctcatgctcctcgccgactccttcgacgcctgcttcaccagcccgctcgcccggtcccgccgcaccgcggagatcatctgggacagccgcgataaggacctcatcccggactacgacctccgcgagatcgacctctattccttccaggggctcttgaagcatgaagggaaggagaagtacggggctctgttccagcagtggcagaagagtccatcagactgcagcatcgatgggcactacccagtgcgggagctctgggaccgagcccagggctgctgggagaggatcctgacacacgagggcaagtcagttcttgtggttgcgcacaatgcagttaaccaagcgctcgtcgccacatccctgggacttggcacggagtactttcggactctgctccagagcaactgtggcgctagtgtgctggatttcaccccacagcccggcgggcgccctccaagtgtgtgccttaaccgcttaaatcagaccccgaactctcctatttctgccgaaagttctgcaggtagaaagtcgagcaagcggatcattctagtttgtcaaggggctacacagagcagttctgagggtagtttaggcggagtgggttatgcaccgctgaacatgctgggtgttatacaggctcagaagaccgcggaactgcttctagatctgaaggtgaacagtattatctgtagcccacaagtcgcagctgttgataccgcaactgccatatgtgaggtccaagaggctgctgattgcttaggtgctgactgtgtgcctcgttacgttgaaatgaagaatttgttcggactcgaaattgatgatgcctttctaacaaagcaaaagagccttgaacagatagttcagtctggttggatgggcggcatggaacaccaaaagcttaagacattgtgggctcagtcagaggatgcatggcaagctttggtaaacgaattgccagaggatgatggcgctgagtcagaccgagtcgttgtcgccatcggccatcctgccatccacctaggactgctctgcaggtgtctgaacctaacaatggattacatgccgtcttttcatctggacgacggcagcatcagcgtgatcgatttcccggatgggccgaaaggaggaggtatcgtcagatgcacgaattacacggcccatttgggcagatggtcggtacccatcacaaaatcaacagaaaacaatgatgaattctgaattaatttttgtacagaggtaattaacatctcccgtttctttcgctgtaaaaagaaacatcttccatttcttggtgggagtaccatccttaaggaaaatgaattgagcttgtagatatcatacactgatgtaaatggctcttcctgtttttatttggtgaagattatttcattcactaaaaaaaataaggggccaaaaatnccaa

SEQ ID NO: 19150 - DNA, 1211 bp, Triticum aestivum
  Clone ID: PAT_TA_19150
ggttccccgaacgaacccgatcgctcgcaccagacgaaggaggcgaggagctccttgtgtttgggtggatttgccctttgcgttgcccccaccctcaccgggccacaggacgaaaccaacgccacaacaactcacacccccttcgcccgcgacttgctcagtcgcagcgagccgggccacaagacgcgagcgttccggttcaggttggggttggggttgcgctccctcgtttcatcgtcgatccgcccgccccgccacaccggcccgggggcagacagagatctctccctcgcgcgcgcgtgccggcggtgacaaatgcggcttgattcgccggcggacaagcggcggtgagcgatgcagccggaccagaaccagcagcggaggaagggttcatcggagatggacttcttcagtgaatatggcgatgctaatagatacaaaattcaggaagtcatcggtaaagggagttacggtgtcgtttgttcagctattgaccaacatactggcgacaaggtggcaatcaagaaaatacacaatatctttgagcatttatctgatgctgctcggatcctccgtgagatcaaattactccgcctattgagacatcctgatatagttgagatcaggcatataatgttgcctccgtcaaggagggatttcaaggatatttatgtcgtctttgagctgatggatacagacctccaccaagtcatcaaggccaacgatgacttgaccaaagagcaccaccagttctttctctatcagatgcttcgtgcactgaaatatattcataccgctaatgtttatcatcgtgatttgaagccaaagaatatattggcaaatgcaaactgtaaactcaaaatatgtgattttgggctagcacgagtggcattcaatgacactcccacgactgtattttggacggattatgttgctactagatggtatagggctcctgagctttgtggatctttctttactaagtattcaccagctattgacatatggagtattggttgcatttttgcggagattttaactgggaaacctttgtttcctggtaaaaatgtagttcaccagttggatttaatgactgatctcttgggtacgccatcactggatactgtttccaggatccggaatgagaaggcaaggaggtacttgagtagtatgaggaaaaaacaaccggtatgtttttctgagaggttccc

SEQ ID NO: 19151 - DNA, 1057 bp, Triticum aestivum
  Clone ID: PAT_TA_19151
caaaaagcgaagcaaggagagcgagcaaccaccacccaaacccaaaccctaaccaacgccaccaccaccgtccctacgcttctcctgtctgtgggacgcgcagcagatcggcgcccggatccaatggcgcgcttattgctgctgctgtagcgtagggcggcgaggagaccggtgctcggatgccgccgatctgaggcatcggcgaggaggaggacgaggggatgtcgtccccgccggcgccaggtggggcgttcgaccgctacgtccagcgcggcggcgcggtggcggtgccggcctcaagcggcaacacggttttcaagagtggacatctcttcatatcatccaaaggacttggatggaaatcatggaaaaaacgctggttcatcctcacacgaacatcattagttttcttcaagagtgatcctaataccttgccccagagaagtggtgaagtgagtgctactctgggtgggattgatttaaacaattctggcagtgtggtagtcagagaagacaaaaaattgttgactgtccttttcccagatggtcgtgatggtcgtgccttcacccttaaggcagaaacttctgaagatttatttgagtggaaagcagcattagaagaagctcttgcacaggctccaaatgcagctcttgtgatggggcacaatgggatatttcgcaatgacacttgtgatgcatatgaaacaacggctccaaattggcgagagaaaaggccagtcaagtcactagttgttggcaggccaattctgcttgcgctcgaagatatcgatggccgcccttcttttctagaaaaagctctgcgttatcttgagaaacatgggaataagggtggaaggaattttgcgccaggctgccgatgtggaggaggttgataggaggctatgtgaatatgaacaaggaagaaccgagtttgcaccaggcgaggatgcacatattgttggtgactgtgtgaagcatgttcttcgtgagctaccatcttcgccagtacctgcttcttgttgtacagctttattggaagcttttcgcttggagacta

SEQ ID NO: 19152 - DNA, 947 bp, Triticum aestivum
  Clone ID: PAT_TA_19152
ggggtgcttattcgtgctggcggccacggcacacctcaggaatacggtaatgttctgtactgttttctatgaaaagaccatgggaagaggctacctgcttgccgaagtaaaggctcccgttgggatcaggtagaactcttcaagacaaaactgcatcgatgagaagaatgcgagaatagggaagagtgtgacgatggctaacggggaggggatgcagcagaaaagaagccatacataacttcaataggtgtatacatatttaagaaagagatagtagtaaatctttagagatggcgttttcccactacaaacgattttggatcggaaataaatccagctaagacaagagagataaatgtaaaggcatatcttttcaacgattactaggaagatattggaactatcaaatccttcttcgaagcaaatcttgcccttgctgaacagccttcaaagttcagcttctatgatgctagcaaaccgatgtacacatcgcgaagaaacctaccaccatctatgatcagcggtagtaagatcactgattcgatcatttcccatggatgtttcttggataaatgcagggtagagcacagtgtcgttggaatccgttctcgaataggctccaacgtacacctcaaggatacggtaatgctcggtgctgatttctatgaaactgacatggaaagaggcgaccagctggccgaaggaaaggttccgattgggatcggggagaacacttcgattcaaaactgcatcattgacaagaatgcgaggatagggaagaatgtgaccattgctaacgccgagggtgtacaggaagcggacagggcgtcagaaggcttccacatccggtccggtatcacggttgtgctgaagaactcggtgattgcggatggattagtcatatgagctgaaaaaaggcggttctccagtccagcaagagaaataaa

SEQ ID NO: 19153 - DNA, 499 bp, Triticum aestivum
  unsure (1)..(499): unsure at all n locations
  Clone ID: PAT_TA_19153
tgcaggnaattcggcacgaggcccactcgcccacgcgtccgcggacgcgtgggttctcacgctcggtcgcggccgtggctagggtttcgggctgggcagggcagcgtcttcgccgccggcgcggctccggtggactccgacggctcctctccatctcctccctcgcccccacgtgcggttccgcttcccgctggccacgaggggcagccggggcgcatcgggctgggcctcctctgtttccggtctgttatggacgaggaaccattaggaaggaaaggtgtgtatcaaccaagaagcggagctaggtgtgcctggtctgcggcgacgacctttgggccaacaacacatggacatttcagagataagctattgcatcagaactttgcttggcgaacatccgggacactcgggtacataagatccaggagggtaattgattattttgcaaatgataatgatacagaggctaggagaaccatctctttttcattatatacat

SEQ ID NO: 19154 - DNA, 2340 bp, Triticum aestivum
  Clone ID: PAT_TA_19154
tgtcttttcggtccagctttgtgtacctggagttgctaggtgggtcctcgtgctgggtacgggtccctgtggtggactgggttctcgccatgttggcctctttgttctgtgctgtgagctcttcgtgccagctctctagcctttcctgcccaaagcgtgtctttgaaacattagcgtcgcctacaaagacaataaagaacatgttgactgtccctagttcgccttcatcacctgccaatggtggctcagttaaggtagtgcacatgacaccagtgacttctgccatgacaactgctaagtggcttcgtggggtgatatctttgttgccagagaagccttcgtctaaacttgagaaatttctttcgtcttgtgatacagatttgacaagtgatgtaacaaaaagggtcagcataattttggaagcaatttttccaactaagccttctggccattggggtggttccatgggcctgaattgtacaaatgcctttgatattccatgggccgaagcaagaaaaatggaggcctccaagttgtactatagggtgttggaggcaatttgcagagcataatcactcaatactaatgttaataatctcacacgagtcctgtcaaatgagcgttttcaccgatgcttgattgcatgttcagccgaactggttttggcaacacataagacagttatcatgatgttccctgctgtcttggagagtactggtctaactgcatttgatttgagcaagataattgagaacttcgtgagacatgaagaaagccttccaagagaattgaaaagacatttaaattcattagaagaacagcttttggaaagcatggcgtgggagaaaggttcatcactgtataattcattggttgttgccaggccatcacttgcttcggaaataaatcgccttggtcttttggctgaatcaatgccatctcttgatgacatagtagcaaggcagaatttccatgctgaagacttgccagctacaccatctaaaaaacgggctgcctattcagatgagaatggtgacagtaggtcaccaaagagattatgcattgaaccgaggagcacactggtagaccaaatttcacagacaccaccagcaaaacaaagctatactttgaaagcgaaatggcgtcctctccagtcaacatttgcaagtcccactgtcagcaatccggttggcgggaatgaaaaatgtgctgaagtaggggttcacatcttcttctccaaaatcttgaagttggctgctattagaataaggaacctgtgtgaaaggcttcggcatgtggaacagacagagcgtgtctataatatcttcaagcagattcttgatcaacagacaactttattttttaaccgacacattgatcagcttatcctttgttctctctatggtgttgcaaaggtttctcagttaacactgacgttcaaggagattgtcaacaattacagaagggaacagcaatgtataccagaagtttttagaagtgtctttgttgtgaatacaaatcacaatgcgaggacttggatcacgccatgttgacatcattgttttttataacgaggtgtttgttccagcggtcaagcctttcctggtggcattaatcccttctggtggtgctcatccggacaacaagaagaatcctaatagccaaattcctggatcaccaaagccaccccccttctcaaatctaccagatatgtccccaaagaaagtctcatcttcccataatgtttatatttctcctctgcggcaaaccaagaaggatgcattgctttcaccaagttcgaggagtttttatgcttgcatcggcgaaagcacacatgcttatcagagcccatctgaagatttggccgctataaataattgtctaaattacaccagcgggagaatcaacactcggataaactttgacatggttagtgattcagtggtagctggcagtctggcccaaccacatggtgtccctgcctcttccgatcctgcaggttcattcagtttcttgtcaaggaaggacaacccaggaccagattcttgagcaaataaatgagcatctccctctgtatatagctcacgaccccacagaaggccttctgttcctcctgaataagtgggtgaactcagaatgcttcaactgtactacatctgtgtgttagggagtagcagcagtataaaagtgggtgattacttagcattagcgttcctggtgtatcattttattttccagctgatgaaaaacagtagggtgtaagctgtgttaaataataactggcgttatgtttcagtgtataatctgttggcgtttactgtagaaaaaaaaaaaaaaaaa

SEQ ID NO: 19155 - DNA, 623 bp, Triticum aestivum
  Clone ID: PAT_TA_19155
gtaaaggcaatgcacgccctaggcatacaattagcaatctgcaggcggactctcctgtgcaatcagaagatgatcatgaggaactgcttgcttcagcaaattctgctctaaggtctgcttatggaagtgcattttggcggcaggtggatcctttctttggttttgtgaccacagaagacatagcgtacctaagtgaacagatacatttgctagatgactctgctgcgagcaggtcagttgaaggagacgaaagtcggaaatacaagggtagccttgaatacatttcagagccatcaactccggctggtagcaacaaagatgaccatagtgctcttccaaatgggtatgccctgaatgggatggtgaatgattcaggcgcctgggggacaagctgcattgaacctatcctggatcaacttgtccaaggaattgatgtgcgagaagttggttcggttggccaaagacttattcaagcttggatagatgaagataaggttgatgatattgccaacgacgtttacagaagcgaaggatatccattcgatacacatgaaatacattttgatgaaggaggatggaaatctcattcagaaagttataagttggagcctttgctgaatttt

SEQ ID NO: 19156 - DNA, 543 bp, Triticum aestivum
  Clone ID: PAT_TA_19156
gcattgcatccctaaccctaagcgagcagcagccaggtagcagacaccggcagccatggagagcactcgcgtgctaccgagtgccaaccatcgcatgccatgcagcctccaaacctttccgcgacgcaacgttctccgtgcccttcaccgccgcaaggacgcaaggcagccacgtcgtatctcaatctcatgcgaggcgaccggcggcggtcgcgtcgaccgccgtgaggtgctcctcggcctcggcggcgccgcagctgcggggctggccacggaccaaggtcgaggcgcgatcgccgcgcccatccaggccccggacctccgcaactgccaaacgcccgacctcccgaacacgccgtcggacaccaactgctggccgacgcccggcaccggcatcacctactttgagctttcgccccgcttctcgccgctccgcgtgcgtacggcagcgcacctggtggacgcggagtacctggccaagtactagagggccgtggcgcttattgagcagctgcctgccgatgacccgctcaactttgagca

SEQ ID NO: 19157 - DNA, 992 bp, Triticum aestivum
  unsure (1)..(992): unsure at all n locations
  Clone ID: PAT_TA_19157
gaattcggcacgagctccgccacgccacgccaaagcctacgcgcgcgaaatggcgacgtcgaccagcctcgccgccgcgctgccctcgcggctcacctccccgggccgccgcgccgccctctcctgggccacctcctgcgcgcgccctcacccagcccgtgccgtctcatcgggctgcaggctggtcgtgacctgcaacgcgcaggcggcggcccccatcagcattgggcaggggacgcccgtcaggccgacgagcgtgctggtggtcggcgccacggggaccctgggacggcaggtggtcaggagggcgctggacgagggctacgacgtcaggtgcctcgtcaggccccgcccggcgcccgccgacttcctccgggactggggcgccaccgtggtcaatgccgacctcagcaagccagagacgatacccgctacccttgttggcgttcatacggtcattgattgcgccacggggcggccggaagagcccattcgaacggtagactgggaaggaaaggttgctctaatccactggtgctaaggccatggggattcagcaatatgtctcctaccccattctccagccccgtcatcgcctggtgcccttcatggggtgaggcaatgacggttcccagaccttggtcatgacacatgtccggattacacatcatcaaattgtgcgtttcnatgcaagggcctaattnggnaatatccgngcctatactaagaagagatccatttggggaacggatctcccacccggttgcatacatggataccaagactccncgcctganttgttgcttgccaacaaaaagcaacaaaaaatccaacantgctggacantgcttgnaactcagaggtnttcattagtaaaactgctggcaaatncaattaatacggncctgttatcctgaatttaccnaataaaggttttcaaggaacattgntnaagngganttttaaggccccagaacntttcaccaaaagaa

SEQ ID NO: 19158 - DNA, 713 bp, Triticum aestivum
  unsure (1)..(713): unsure at all n locations
  Clone ID: PAT_TA_19158
taccggtccggaattctgggtcgacccacgcgtccgaactcctcccactggctcctcgtcggagctcaccgcaccaccatgctctcctcctccctcatgctgacctgcggccacgctcccctccccgcattccgcaaaccacggcgccgaatccccgccgtcccccaaaccaacgcctctctctccaccttcctgcccgggcggggaggaggagcagcagcgccgcgccggggctgggcccaaatctgccgggattcctcccggccgggcgccgatgccgcggagcaggacagagagatcaagaacgacctagcaacggcgaccgtccccaagattggcggtggcggcggcggcggcgggcagctcagcgactggataacatcggtgctgctgttcgggatatgggcggggctcatgtactatgtcctccagctcgcgccaaaccagacgccatacagggacacatatttcttgcagaagcttttaaatcttaaagtcgacgatggctttcgaatgaacaatgttcttgtgtctctgtggtacataatgggaatctggccactggtgtacagcatgttgcttcttcctactggaagaagttcaaaaagcaagattccagtctggccattcctggtgctttcatgcattggaggagcatatgcgttgattccttactttgttctgtggaaacctcctncacctgccattgatga

SEQ ID NO: 19159 - DNA, 1704 bp, Triticum aestivum
  unsure (1)..(1704): unsure at all n locations
  Clone ID: PAT_TA_19159
ggtcggcaaccccctccccggcgcttccgccggcggctccgccccgtccccgccgcgcccgctcgccccgcccgcaaaaccgtcggtggcgtcgcccttccaccgcgccgccactccactacccctccgccgccgccctcgtcctcctttccgtcacacaccacaagtcgttcaaagagcggggagcgagcgagcgagtgcccgcacacgcgtcacttctccgatctggtccggctgttccgccatagagcaagcccgggatcccgcctttgttctagctgccgctgcgtgctgccaattccgaaggtcgactcacaggactgaagaggcgcctccttccttctcggttctcgattcatcaggctcccgacacgcgcccgtgccacaatgtcagaggacaagggccgcagtcgcagcggtgcacgggtgaaagtccgggaggcggtctgcaacgccgtcgccggcggttcggctggggccatctcggcgacggtgctgtgcccgctggacgtgctcaagacgcgtcttgcaggtgtacggtctcccttcaaacctttcccctggcactcgcgccgcctggtaaggataattctttcagggattgcaaccacatactgcaaaactgaaggccttcctgggttgtatcgtggcctttctccaacaatagtagcactatatccaacttgggctgttacattttcagtttataattacgtgaggggtcttcttcgatctcaagatactaaaaatggcgaactgtccatacaggaaaatattttagctgcttcctgtgcagggattgcaacagctgttgcaactaatccattatgggttgtgaagactagactacaaacacaagggatgaggcctggcgtggtgccttacacgagcgtcttatctgcgttacgtaggattgcagcagaagaaggtctccgtggattgtacagtggtcttcttccttctttagctggggttactcatgtagccatccagttcccagtatacgagaaggcgaagctgtaccttgccaaaagagacaatactacagttgacaagcttggccctggtcaagtagcaatttgttcttcaggatccaaaatagcagcctcgctcataacataccctcatgaggttgtacgatctaagttgcaagaacaaggccgtgttccccatggtgctatacggtatataggtgtaacggactgtataaagcaagtgttacagaaggaggggattgctggattctaccgaggttgtgctacaaatttgttgcgaacaacgccgaacgctgtcattacttttactagttatgagatgatcaatcgactcatgcaccagctcctgtcctcctaattgaaagatggaaaccaacaaatcttcaatgtgcttgcaatgctgaatccgtaagttctggctgtaatggtccgttatccgtggttgcattgccatttgtccattattggaagaaaagatagctgttggacgacagatttgggtaaaagtagacggatccagaggtttgtgtttgcccgtgnagggagaaaccctggtggtttaaatccatcctgcatagtggttaggagcacctcgtcctccacagaacggtgccttccccctcttgcccctccaagaacgaggcagnnaatgnccatccacgttgatttaantttttaagaagatattgggcaactatgnactgatcat

SEQ ID NO: 19160 - DNA, 2587 bp, Triticum aestivum
  Clone ID: PAT_TA_19160
gcccacttttggctatgaaggtgatccaatgcggcttctgttctcaaagtctgccagccctcaccatgggtttgcggcatactacacttttgttgagaagatcttcaaggcagatgctgttctgcacttcggcacacacgggtcccttgagttcatgcccgggaaacaagttggaatgagtgatgcatgcttccctgatagtctgattggtaacatccccaacatctactactatgcagcaaacaacccttcagaggcaacagtggccaagcgtcgaagctatgcaaacaccataagctacctgacaccaccagctgagaatgccggtctgtacaaggggctgaagcagctgtcagagctcatcgcctcttaccagtcactcaaggacacgggccgtggcaaccagattgtgagctcaatcatcagcactgcaaaacagtgtaacctggacaaggatgttgacttgcccgatgaaggcgaggagctcccagccaatgagcgtgacctcgtcgtcgggaaggtgtatggaaagctcatggagatagagtcacggctactgccatgtggtctgcatgtgataggtgagccaccaactgctgtcgaagctgtggccacattggtgaacatagctgcccttgaccgcccagaggagaacatattctcgctgcccggcattcttgctgcgacggtgggcaggaccattgaagatgtgtacaggggtagcgacaagggcatactggctgatgttgaactcctgaagcagatcactgaagcttcacgaggtgccgtacgtgcctttgttgagaagaccacaaacagcaaagggcaagttgttgatgttacaaacaaactcagttccatccttggctttagtctctcagagccatgggtggagtacctgtcccaaaccaagttcatcagggcggacagagataagctgaggaccttgtttggattcttgggagagtgcctgaagctgattgtggcagacaatgagctgggagccttgaagactgcccttgagggaagctatgttgagccaggccctggtggtgatcccatccgtaacccgaaggttctcccaacagggaagaacatccatgctctcgacccgcagtctatcccgactgcagctgccatgaagagtgccaagattgttgtggaacgtctgctggagcggcaaaaggctgacaatggtggcaagtatcctgagacaattgcacttgtcttgtggggcaccgacaacatcaagacctacggcgagtcgctggcccaggtgatgtggatgcttggtgtggagccggttactgatgggcttggccgtgtcaaccgtgtggagcccgtcagcattgaggagcttggacgccctaggattgatgtcgtcgtcaactgctcgggtgtgttcagagatcttttcatcaaccagatgaatctgctggaccgggcagtaaagatggttgctgaactagatgagccaattgagatgaactatgtgcgcaagcatgcccaggagcaggcagaggagctcggtgtctcggtaagagaggcggcaacaaggatcttctcaaatgcatcaggctcttactcgtcgaatgtgaacttggcagtggagaatgcatcatggacagatgagaagcagctccaggacatgtacctgagccgcaagtcttttgcattcgacagtgatgctccaggggtaggcatgctagagaaacgcaagacgtttgagcttgctctagcaacagcagatgccacattccaaaacctggactcctcggagatctcactgacagatgtcagccactacttcgactcagacccgacgaagctggtgcaagggctgcggaaggatgggcgggcaccttcatcgtacatagcagacacaaccacagcaaatgcacaggtgcggacattgtcggagacggtgcgtcttgatgcaaggacaaagctactgaaccctaggtggtacgaggggatgatgaagagtggctatgagggagttagagagatcgagaagcggctgacaaatactgttggatggagtgcaacatccgggcaggtggacaactgggtttacgaggaagcaaataccacattcatcgaagatgaagagatgaggaagaggctgatggacactaatcccaattcgttcaggaagctgcttcaaaccttcctagaagcaaatggcagaggctactgggagacatcagaggataacttggaaaggctcagggagctctactcggaggttgaagacaagatcgaaggaattgaccggtgaactcatttcactgatcaaccagttccagcatttgaccaagaagaaattcttctgccttgctgagttgaaacttgtataatttgtgatttataaaagttgtaacatgcaatacagacctttaacaaagagggtggttcgttgtgaatgtaaaaaggaagcatgagtagttcttttttggggaatattgatactttgctgtcacatgttcatctacggatatagtaacagagaatggagtgtcatttttaactgttttaacaaaataacatttgaagtttaaaaaaaaaaaaaaaaaactcacctcgg

SEQ ID NO: 19161 - DNA, 502 bp, Triticum aestivum
  Clone ID: PAT_TA_19161
cgggtgtgttctaactgctcccatttcttcaactgaggagaatatggagaatgtgcaactaagtgacccgcagttccatttggggcctggggagagctcgagtggcgacctcagccgcggtggcgaggtgtgggaatctggcattttggatggtttatacatatcacaggaaaaggttaagtttgattctgaacatccatcagaggctttggaggagcttcgggaggtgtcaattttgaaggatgggtcacatgacatcccagttaatgaacatgaaagcctccatgtctctgttaatgaaggccagacctgtgttgcattgaccaatgctcttgatgtgtcggtgaacaatgatgatgcttatcaaccattgaccaatgaagacaagacttgtgacattccactggttcagagcaactgtgctgcattgaccaatgaagacgaggttcagagtgtgccaccacggtcagagaacaatggactggattatcaacctttggtc

SEQ ID NO: 19162 - DNA, 978 bp, Triticum aestivum
  unsure (1)..(978): unsure at all n locations
  Clone ID: PAT_TA_19162
gtttgtttgagaagctagaaccacacaaacaaccatgactggtggtggccaacgcgaccaacgttttcatgacgctgctcaagcacggatcccccaccatgcaaatcaggccgacacgcttaagctggtggtggcggatgcgaggctccagcgcgacgttccagtgcgacggccgcagaggaaggacctctacgaggtgcttgaggtcggccgctccgccaccgacgaggagatcaagaaggccttccatcgcatggcgctcaagtaccatccggacaagaatggcgatgacccagtggcctttgacatcttcctggaaatccaattcgcccacaccattctgtcagatcccagtaaaaggcggcagtatgacaaatcaggattcgaggctattgaatctgatagacagaaatccgacctggacctatcgaatcttagtccagccaggaccatgtgtgtggccctgttcaagtaaacttggtgtaccgattaagacaactgttccaagtagccgttttgaaggaggctttggataagccgttaaggttttcaactccagctaggacaatcctgaacgcaggaaggtggaaaagctatcaaccaatattagcccggcgacataaccggaccggaggcggtggcggcccggctgcccccgtgcactcaacccatgggaacaaatttaagtgcttaattcacatgcgaagaaatgggaggacccaacntncactgcaaggaggacatnttgacacccggaacgtactnaaaccnggatgtacttcctggggttccggtgtacnattnagcaaaattacccgcanctgtataaagaatccatacgggtantgctaaaangttgntantccaatcagtgagttatgaatgaactgaaccacantcccttcaagggaaantttccaccgnacaacaccatttattnggaacttccccctaagaacgaaatncacaananccaaa

SEQ ID NO: 19163 - DNA, 765 bp, Triticum aestivum
  unsure (1)..(765): unsure at all n locations
  Clone ID: PAT_TA_19163
cccacgcgtccggcgcagagcaatggacgcggggggcggcgagcagctgaggctggccgaggtgcgcgaccagctgatccgcgaggaggactccatcgtcttcgcgctcatcgagcgggccaaacgcccgcgcaacacgccggcctactcggccgccgccgccgccgccggctcccttgccgagttcttcgttcgggaagccgaggtcctgcacgccaaggctggacactatcaaaagccagaagatgttccattcttctctcaagatcttccaccacctgtctttcctaccaaaggtcgcccaaaggttttgcacccttttgcttcattggtctgtgtgaatgatgcaatatggaagatgtatttcaatgaattgctaccattattcactgcggatggcgatgatggcaactatgcagaaacagttgcattagattttgcatgtctgcaggctctctcaagaagaattcattgtggcaaatatgttgctgaggtgaaattcaaagacgcgcctcaagattatagcccaccaatacgtgctaaggacactaatgctctgatgaacttactaacgttcacggctgttgaagaaaaggtcaagaagagagtagagaagaagccaaggatatttggacagaatgtcactctggaggacagtgtaggcaagcaagatggtgatgcctgtgacagtcactgtaaagttgatcccaatgcgccttccaagctttgtgggttgtccggactgcccgttaaccaagactcncg

SEQ ID NO: 19164 - DNA, 862 bp, Triticum aestivum
  unsure (1)..(862): unsure at all n locations
  Clone ID: PAT_TA_19164
cggggnagtagtagtataacgcgtcgactcgancggccggcgttccgttgttttttttcttttccttcttcctctggcacaaatgtatgtattgcacagtgctccatccaaacgatatttcaggtcaagattattccatggacacaattacctcagacaccactcactacctacataggatccacaaagccagacacagagcctttaaaaattagtattgattcaaatctcgatcagcagcacagaatcgatgccatctctggaccctaggtatgctcatctggttgcgcatagacaaatggcggccattaatccgagagcatcatagaggtacggacctcgataaattgcggcccatgtgagacctgtaccgcaggcacggacgcttcacgatcctgccagactgtcaccaactcaaccaaatgcctctgcagatcatgtctactcagcgcgtgcacatgaactgtacagatcatgatgaattgctttatctgtaaaataactgcagagatgtatgcattttctgacagtaaactcaatgaaaagatggctggattggtataatcactcgtcaacaaagnggtgttgcctaccatcaggtcttctcttgcttcatcaccaccctgaatgaagggcctgcggcgtgagancgggcgcatttcctggaaggtttggcaatacgacggtgaggttgagctggtgaagtcgccgacaaangaacggctgacnctggtgggcttgtgcnccgtcacgacggaattccacgcncaaactaaataaaatgggggtntgtgcctttgcgaatgcattggtaatgaataaaaangaagttccctgttgatcgaaaaaaaaaaaaaaaaaa

SEQ ID NO: 19165 - DNA, 917 bp, Triticum aestivum
  unsure (1)..(917): unsure at all n locations
  Clone ID: PAT_TA_19165
ggacatgggtgtcaaagatattcctgttaatgctggtattaaggattttgatgttattgaacaaggtgatgttgttgtcttgcctgcatttggagctgctgtggatgagatgtacacactaaatgagaagaatgtgcaaattgttgatacgacatgcccttgggtttcaaaggtgtggaacatggttgagaagcataagaagggtgactatacttctattattcacggaaaatatgcccatgaagagactgttgccactgcttcttttgcagggaagtacattattgtgaagaatatggccgaggcaacatacgtatgtgattatatacttggcggccaacttgatgggtctagctcaactagagaggagttccttgagaaattcaaaaaggctgtttctccaggattcgatcctgatgttgacttgngaaaggtgggcattgcaaatcaaacaacaatgcttaaaggagaaactgaacaaattggaaaacttgttgagaagactatgatgcgtaagtatggagtcgagaatgccaatgaacactttgttgcattcaacactatttgtgatgccacacaggaaagacaggatgcgatgtatcacctagtgaaggaaaaggttgaccttattctggttattggagggtggaactccagtaatacctctcatttgcaagaaattggagaactcagtggaattccgtcctactggattgacagtgaacaaaggattggaccaggaaacaggattagctacaagctaaatcacggtgagcttattgaggcagaaaactggctaccagaagggcctatcacaattggagttacttctggtgcctcaaccccggacaaggttgttgaggatacgctacacaaggtgtttgacattaagcgtcaagaagttttgcaggttgcat

SEQ ID NO: 19166 - DNA, 626 bp, Triticum aestivum
  unsure (1)..(626): unsure at all n locations
  Clone ID: PAT_TA_19166
accaggaaacaagattagctacaagctaaatcacggtgagcttattgaggcagaaaactggctaccagaagggcctatcacaattggagttacttctggtgcctcaaccccggacaaggttgttgaggatacgctacacaaggtgtttgacattaagcgtcaagaagttttgcaggttgcatagattttcagcaaaattggccaggggataataatagttgatggcctggcaaaggttagtagaacaattgtgcgacctatcgttgtacagtagctaagaatgtaatgctttaggcacatacttttacgaggatatctgtgctgggatacatatatatgttgtaatcacttgtaccacgaacagtagtacacttgtatcagctgctataacccctggccccttgaaaaatcgttttcataggctggttacatagatatcaaccactgggtttgttgctggatagggctcaaatgcaggactccctgtatgtagcaagtgcaagaaatgcagggtttcctttgtatattagggcgcaagtccaattcccattctgatatgttcatgtgtcatctgttgtaattgaatttaactttttctcccgtaaaanaaaaaanaaaaanaaaaa

SEQ ID NO: 19167 - DNA, 1918 bp, Triticum aestivum
  Clone ID: PAT_TA_19167
cctaaatttgccacaggacaaaacatgaggtccggggataagatgatcacaagcggaggatccccattccaaacccagcgcacctatccccattccgttccccgccgcggcactcggcgtcgtccgccccgcagctcagctccacacgcccgcccactccctccgccacaagcgatggcgaccatcaccacgcagctccgctccgcgctcctctccccggccgcctcgtcctcgtcctcctcctcaccgcgccgcggcggccggcgcgcgccctcctccgtccgctgcgatgcctctcccccggcggcgtccgcgtcggcctccctcgacccggacttcgacaagaaggccttccgggcggcgtccacaacctcacccgcgacaactacaaccgcaagggcttcggccacaagaaggagaccctcgagctcatgagccaggagtacaccagcgatgtgataaagacgctcaaggacaacgggaacgagtacacctgggggccggtgaccgtgaagctggcggacgctacagctcaaagaacaatgctcaagggagagactgatcaaatcggcacactcgctgagaagcattgaacccgcggtatgactacgagcctgcaacagaacactgtgtcgccttcaacactatttgtgacgcaacacaggaaagacaggatgcgatgtatcacctagtgaaggaaaaggttgacttattctggttattggagggtggaacccagtaatacctctcatttgcaagaaattggagaactcagcggaattcctctactggattgacagtgaacaaaggattggacaaggaaacaagattagttacaagctaaatcacggtgagcttattgaggcagaaaactggctaccacaagggcctatcacaattggagttacttctggtgcctcaactccggacaaggtcgtcgaggatacgctacacaaggtgtttgagattaagcgtcaagaagttttgcaggttgcatagattttcagcaaaattggtcaggggataataatagatgatggcctggcaaaggttagtagaactattgtgctacctatcgctgtacagtagcttagaatgtaatgctttaggcaaaacttttacgaggatatctgtgctgggatacatatatatgttgtaatcacttgtaccacgaacagtagtacacttgtatcagctgctataacccttggccccttgaaaaatcgttttcataggctggttacatagatatcaaccactgggtttgctgcttgtggagggtcgaacgccggtaatacctctcatctgcaagaaatggagaactcagtggattccgtcctacgggattgacagtgaacaaaggattggaccaggaaacaggattagctacaagctaaatcacggtgaacttattgaggccgaaaactggctacaaaaggaggcctacggcttctgctggggcgtcgagcgcgccgtgcagatcgcctacgaggcgcgcaagcagttccccgaggagcgcatctggatcaccaacgagatcatccacaaccccacggtcaacaagaaattggaggacatgggtgtcaaagatattcctgttaatgctggtattaaggattttgatgttattgaacaaggtgatgttgtcgtcttgcctgcatttggagctgctgtggatgagatgtacacactaaatgagaagaacgtgcaaattgttgatacaacatgcccttgggtttcaaaggtgtggaacatggttgagaagcatacgactatacattcacgaaatgcccattgcacttttccatgactcgatcctgatgttgacttggaaaaggcgggcattgcaaatcaaacaacaatgcttaaaggaagaaactgaagaaatggaaaaacttgttgagaaactatgatgcgt

SEQ ID NO: 19168 - DNA, 738 bp, Triticum aestivum
  Clone ID: PAT_TA_19168
cccacgcgtccggagcagtcttttcttctgttctttcttttccctccctcctctgatctctctcgctccgttccaccgaaatagatggccgcactctgcctcacggctccggcgatcgcgaggtggtccccgccaccgtccccccggcggtggcagcaccccctgtgccaggactgcgccaggcgtcgcaggggccttgcgcggcggcgggccagtggagacgacgggccggaggaggcggaggcaccgccggtgaggaccctcctggttgacaactacgacagctacacctacaacctcttccaggagctctcggtcgtcaatggagtgccgcctgtggtggtgcgcaacgacgagtgggcatggggggacgtgtactactgggtgtacaagaagagggcctttgacaacatcgtgatctcgcctggccctggatctccggcgtgtcctggcgacataggtctgtgtctccggatagtttctgagtgcggagatatacccatcctgtgtgtctgccttggccaccaggcgtgggggttagtacatggcgctaaaattgttcacgctcctgaagctatacatggacgacttagtgaaattgaacataatggaagctacctctttaatcatatcccgtcgggtataaactctggattcaaggtagtgcgctaccattcacttgtaatagaagcaacctcactgcctgaggatcttgtgtcaatagcatggtgtgcctct

SEQ ID NO: 19169 - DNA, 1859 bp, Triticum aestivum
  unsure (1)..(1859): unsure at all n locations
  Clone ID: PAT_TA_19169
gtcgcgnccgagtaccaccccggagcactcagagcggagttcagtagagatgatcatcggtatggagtaatccctcacgccgagaacagttcagagccaacagaggataagcatgctagtgcagatgatcatccagccaaagcccctcgacatgtccacttttcagttaccgagaaggccaagtcgctggacgaggagcaggatcaggaaggcaagtggaaggacttgacagaggaagaagaggacgaattggagtcactgtgggagcaccaagacctgatcgagcagctgaagctagagctgaagaaggtgcggtcagccgggctgccgacgatcctggaggagtcggagtcaccaaaggcgccaatggaggacctcaaaccatggaggatcgacgccaagttcctgcgcgaggacccgatggatgagctgaacaagttcttcaagagttacagggagaggatgaggaagtttgacattctgtgctttcagaagatgtatgccatagattttctccagctcagagggccccaacagtcggcgaactctctgaaggccttgtcgccaacggcgctatccatcctgtcgcacaatttccgatcggctcggtggagatcacccgaggacccatcggaccggctcctcaaggatctccggtgcgacctggagacggtctacgttgggcagatgtgcctgtcctgggagttcctccggtggcagtacgagcaagcctgtgacctgccggaatccgacccttaccacagccaccactacaaccaggtggccggagagttccagcagtttcaggtgatggtgcagaggtttgtggaggacgagcccttcaagggccctcggctgccagactacgtcaaggaacgatgcccctttcgcaacttcttgcaagtgcctgtgataagagaggacagcctgaaggacagaatggaggaccagcgcaaggggaactacgtgataacgagcgaggagctggaggtcgtcatggaggagtcgatgcacatcctgtgggagttcatcaaggccgacaaagagccgcagacatcggtgctgaagggcttgtcgaccgcccacgtcgagctccaggaccccagggacgaggctcttgtgaaggccatccacgccacgttacagaagaaagagaagaggctgaaggatctgctgaggacggggaactgcatcgtgaagaagttcaagaagcccaaggaggaccggtcggaccagaacctcttcttctcgcaggtggacatgcggctggtggcgcgggtgctgaggatgccgaggatcaccggcgaccagctgcagtggtgcaaggcgaagctggacaagatcatgctggtagacaacaggaggatccacagggaggcttcgtttttgctcttcccctgcttggagtacaaaacataaaccgtctctgattttgttctcttctttttcttcaccctccacaccatgtaatccacggcttgtaggtatttttttttcctttcagcctcttagtaatccggttctccacagcttacacaggtcgggtacctatgactgtaacctgataaacatggcataggccacagagccatccatggtatataagtttacttattacttgcagcccctagcctagctagctaggaaacagtacagttgtaatgaagccatccatcaccatcagaacgtactgctatacttactacatccccaagcaaaaaggccccaactagcaacaatactagcacaagttgtaatgaagccatcctgcatccgtcagaatgtacagattgccgctcctggggccgcccggtccccgctccgcccttgcgtgcctcgtcgatcaaggcaggaaacag

SEQ ID NO: 19170 - DNA, 774 bp, Triticum aestivum
  Clone ID: PAT_TA_19170
ccctcccccgttccatcctgcgtctcctcccgccttctgaacgacagatgtgctggatggcttcatggagctgctgaaggcaataaacggcaatttaaatgatttgaagaagctgcagcaaaaactggaacaacaaaagaagaagcaacagcagcaaaagaagcagcagcagaagcaacagcggccacagaagcagccggaagatcacattcaagctctgaatgcactgggagcagaaattaaacacaagctatccatccttggtctgatgccaccctctcctttggcagaggtactgaagcagctgaaggacaaggcactgaagcgggcagggctgaccgaggaatcgctgcaggagcagattgagcagaggatcgccgcgaggaacaacaagcagttcgacgtgtcggaccagatcaggaaggagctcgcgggcaaaggcatcgccctgatggacgagcctaccgggacggtgtggagaccatgcgaacgggagtagtcggtgattaatatgtgcctggtttaacagatgacagtgtacaacggacggatcttattgcgctggtgcagattttactcatgcaatatcgccagttttggacgtggtgtttctgtaggggttccaagttgactcaagagacgaggcccgtgttgtgtcggtggttgtgtaggaggacaaattgaagggtcctccgtatattggtatacttcattagtctgccgtgttgaatttgaacaaaaaaaaaaaaaaaaaaaaaaaaaagcggccgctct

SEQ ID NO: 19171 - DNA, 826 bp, Triticum aestivum
  unsure (1)..(826): unsure at all n locations
  Clone ID: PAT_TA_19171
ggcggtgatcttcatcaggctgctccggtcgtcgcgggcggcggagatggacaagtccggcaacctcgccaggtccgggaacctgcaggggagcttcaggatcgacgcggcgctgaacgtggcggctggcgccgcaaaggagaaggacagggggcagcaggaccactacggcatcttcgggatacaggactccatggtcagagacatcggcccctacaagaatctcgtcaggttcacctccagcgccttcgacctccgagggttctccggctcccctctgctcaccaagctgagggagatgttggaggccttgcagcaggtggacttaagggttctgacgcaccagcagaagctagcattctggctcaacatatacaacacatgcatcatgcacgggattctgcagcacggtttgccctcgaactctgaaaagctgctggcactgaagaacaaggcaacgatcaatctttctgggcaaaagttcactcctctggtaatagagaatttcatcttgaggcagccatccagtgtgaaagaagaattctggaaatgcgacgtcgatgccgaagagcaacaagcgaggggtctctacggattgaacattcaagacccaacatctgttcgcgatgtgctgtggcaacagnctctccagcacccggatatacaagcggtcgcgtgatggcggtctggagaagcgaactggactactgcagctcctgtggtgactcgacnaggagntgctgatccaanctgatacactcaacatcacgacttgcaaggcatgatcctgccagtgatngtacaactccaatcttgcnccaaaanc

SEQ ID NO: 19172 - DNA, 795 bp, Triticum aestivum
  Clone ID: PAT_TA_19172
cccacgcgtccgacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccaaaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgaaattctctccaagaacggtgttaaattcggagaagccgtgtggttcaaggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctgtcttacgctactaactttgccccgg

SEQ ID NO: 19173 - DNA, 1054 bp, Triticum aestivum
  Clone ID: PAT_TA_19173
ggacgctcccgagtccctcgtgcccccccgtgtgaagcctccaaagtcgctgccgcccccacgttccaccggagcgaggcgccgccgccggttctcgtctcctccccctccccctttgtgtgtctctcgctcttattttctcatctcggtctaatctaattctattatatgcatgcaggccgatgtgaagccaagtcgctggagcagagatctggagcgcctcgccagatctctcctctgcacccctgccagccgcgtcaggctccgcctcgctactggcggtctctccccggcaagcccatcggccggtgagagtagctcactctcgatccccttgtgctcgcgcgccaccaggggaggatgaaccccttgcacccgcgccgacgacctctccgatcggcaccgtgcctcgtcccgagccatcggggccgagcggctgtagcgggccagaggcagcgcgtctggcagcgacgacctcccctcacactcaaaccccgcctcgctcgttgccgcgaccccatacgcgccccgttcctgccgccacaggcaacggcccatcgtccacgagagggtgcgggccccacgtctcccctcgcctggaggcgatagcgtgcgggacgtcacgctccagcccgcgtcaggctgcttcgtcggcctagccgttattttgggcttattgacatatccgagaggggcttgcaatcagctgaggggcccgatggtcccctggtatattccatctttctactgtatatcggtgttgtgggtcgttagcatgaaggcaactaatgtttaatactttatgcttcagccttgcatgtttgatcagtggccgtgaaccgggacggcattgtgcttggttgtcttgactgtcactgtctatataaaacagctgttagttgtttaagtggaaatatgagtatgtttatgaggcttgtcatgacctgataagttgtgaaacatatgcccgttttagcttgaaccttgactatatgtactccctgtgtttgaacagtgaaatctttaaaaggctttcgaaaaaaaaaaaaaaaaa

SEQ ID NO: 19174 - DNA, 827 bp, Triticum aestivum
  Clone ID: PAT_TA_19174
gattccgacctgcaggaagaaatctgaaagcacatttgacagttgaagaatcgtgctcttgcagtaaggatgaaactaactccctcggtagcccatcaaaagggtcaccttatcagtctagcaagaataatgacatattttcagcaagcagaaaagacgatgaaattgttgaacctttgttggaacataagttaggaacatctgaaagatgccaaaaacaacaggatttggaggaagtagtattttatgagccagcattagatagagaataccagatgaaatcagttgatgcttcttccattggcaagggcattgatatggacattaatggcctcggtgtgacatttcctaatttgttacagggtgaacaacaatatcgcaaagtggattctgctgtgaatttcacagagatctccaagttactggataaaattgaaaaggcaccagtaatgaagagcaaaggtgaagcactggcttgtagaaaaccaccaaggcaaaaattgacaaatagcaagcaaaaagggtcctgcttatttgaaatgttgacagtaccatccaaatcacatctcacatgctccaaagatccaacatattcggtgaattctcgcagtaacacaagcagatgttcattggaaacacagaaacagttctcgacaaaaacagatacattgtacagcgatactcatgatgcatcaaaatccatagcagggttagcttcaacgtcaacacaaaaggactctggttacccagactcagaaaaaactgaacgggtagtctcctcctcaactaaaagagtatcaagctgctgtgaaggaaatgaaacaatc

SEQ ID NO: 19175 - DNA, 1126 bp, Triticum aestivum
  Clone ID: PAT_TA_19175
gaattcggcacgaggctctctctgccctccagcgcgcttcgctcccgccgggccgcacatggcgacggccaccgcctccacgtcgctccgcccgccgccgtccccgttcccgccccggcttgcggggtcgctgcgccaatggtgctgggggatgcctacgcattcctctcggaggagagccttccacgcgcatccgcggaagaggaacactttgttatgcgcagccgttaaaggccctgaagaatccttcaagaagaccattgaaatggataggctgattgatatgcttagagatgcaaatcccagagagcgttcagtgagggtttctgggttcggctggctgctcggattgatctatgcaaatcggatgatgatcaaaaagattatgaagaactggcagagaatgtcatgaacatagttgaccgtgtcgtccacaagactgatgagaagattgaacagtcaactgatgttctgaaggcaattattagtcctgttatgaatgaaggagaagatgggatgtggccaccgagaaatccggaggctctcaaattgatggaaaaagaaatatcaaacagagaaaaagaaggacagctagatgagagttttctgtcagaagttaatgctcagctgaggcaagctaaagacgaagtagataagccagggcttcaagtaatgcttcaaaaggtgttgcaactatatgcttccaactttctccgaaagcgcagttacgcttataaagggggagaggttgtagtgcctgaaaagtttcttgaatcgataatagaggctcccgaaaatgactggaataggctgttgcttgatggacttacagttggaaagggagatgtttcacctgaagaattttacgctgttaccaagaagagaattgagagaatcttgattcgcacggaaggaggttcttatcagcaacgggtacttgtcgaatatataaaagagatacaagctagagcagaggaaatagtgaaccggcttcaaggcccagctgtgtaacgtttatggtacatttgtagttactgaaaaaggctttcgccctgctttatatataaagcacaatccacaacaacacggtacaaacgcacgccaccaaaaaaaaaaaaaaaaaaaa

SEQ ID NO: 19176 - DNA, 758 bp, Triticum aestivum
  Clone ID: PAT_TA_19176
gtcggctcccccgtcccgcccccccccctccccccctctccccccctcgtctccgcccgccgctcgccgccgcacaacctcctactattgggtcggctctcctacccccacggcatccagctcgcgctgcgctgggatttaccgggccggcggagactcgcccggctggccgcgaagatggacgcgcgtcagactgcgcaggtgaatcaggcgtccggcgccgtcggggatgccgccgccgcaaagccagacgcaggacgcgtgggtccgatccccattcattcccagttcgtgatgatgcgcggcaacgcccgagaaaagatattcgagtatataggaaggaagccaagctcggctgattggcggaggaggttaccgcacctcgcgaggaggcttgaggaaatcttgttcagaaaatacccaagcaagcagtagtactacaatatgatgaaccgacaaattgagccgcaccaacagtttgctatcaaggagttgagtgctcagaaccaacaacgacaacggaacaaacaattgtcaagacagatagcatcttcccctgactatgtgacgatgatgtcgacacctggtatcacgcccagtgcaagtgaaacttctagaatgtcttatgtgacaggcaatattggcccttcgtcgtctggtgcagacatggttcctctgaacgccaacatgggggcagctcctaatcagcatgtaaacacactgctttttctggggatgaactctacacaccatgatcg

SEQ ID NO: 19177 - DNA, 987 bp, Triticum aestivum
  unsure (1)..(987): unsure at all n locations
  Clone ID: PAT_TA_19177
accattcaccaccttcccgccctccccattgatcaccttctcaccctccttctcgagagttagctgagaatcatcctgaggcagtggtaatggcgggcccagcggcgtcgttgaggttcacggttgaggaggaaggcggccgagctggtcacgccggccgggccgacgccacgggagctgaagcgtctctcggacatcgacgaccagggatggcctgcggtttcacatccccgtcatccagttctaccggcgcgacgcgtccatggggcggcagggaccccgcggcggtggtgccgggaccccctttggcaaggcggctcgtggagctactagcgctccgccgcccggctgaaggcacttgagggggcgtgctccccatcgaggccgccgccgacgcttctctggagcacggcggccccgccctgcccccgacattcccgggacccgaggaccgcctccccggcgtccacggctcgtctcaagtcctcggcactccgctcctcctctcccaggtgacacccctggcgtgtggaggcttcatcctggcggtgcggctgatgcacacgatggcggacgcgcaggggctggtgcagttcctggccgccgtggcggagctggcgcgtggcgcggcggcgccgtcggtgcgcccggtgtgggaccgggagctgctggaggcgcggaacccgccgcgccctggcttcgcgcaccgtgagtacgacgaggtgccggacaccaagggcaccatcgtgccgctggacgacatggcgcaccgctccttcttcttcggggcccgggaggtcgccgccatccggtccacctggcgccgggcctccggaagcgcgccacacttcaagtctcacgggagctgtggaatgccgcaccgtgcgctggccccacccacagtgatgcgatgattgatctcaanccgcggggaaacaagcgggcagcgcatccggcggtacacnggaagcttcgcttccgtggcgt

SEQ ID NO: 19178 - DNA, 713 bp, Triticum aestivum
  Clone ID: PAT_TA_19178
cgcggcagcatttcctatgcagtagccatccccgccccctcctcccccggcgtccccgcctgccaccgcgccccctggcacctccccccgcagccctcgcctgcccagaacgagtccgtcccctcctgcccgccagcccccgccttccccatgggcggccgccccgcccgccccgcccgccctcccggctgccgggccccccccaccgacgaggccctcctcgcccccccccccagccggcacgccgccgccatgcccgcccccgtccccttcggcgccgggccccccatcggcgtctgcaccccctgggtcctccccggctaccccctctccggcggcacggccgccgccgccgccggcccccgggaccgcagcttcccccgcggcgcgcgcccctcccgcgcccccggcgccggcgtccggtgcgccacccgcaccgacagcgccgtcctcccctcgccggcccacgagagcatcggggtcaagaaggcgctcgtgttctacaggggcaagccgcccaagggcgtcaagaccgactggatcatgcacgagtaccgcctcacagccgccgacaaccggaccaccaagcgccgtggatccgccgccaggccggatgactgggtgctgtgtaggatccacaagaagtgcggcaacttgcccaacttctcctcctctgaccaggaacaggagcatgagcaggagagctccaccgt

SEQ ID NO: 19179 - DNA, 613 bp, Triticum aestivum
  Clone ID: PAT_TA_19179
caacattcattggtgatcagaggggattgttgtccccgcggtcatcgccgctgttatggggaggacctgtaggtcttttcctctttcgggttctgttggtgctctggttgcttcgcgcctcttgcaggaaaggggtgagcttcttccacctgatgatgctttggatatagctcgtagggtgaaagaaacgtattgctatactccttcagacattgtcaaggagttcaagaagcatgacagcaagcctagtaaatatatcaaacaatggtctgcaatcaaaccgaagactggggttccatacacaattgacgttggatatgagcgttttcttggaccagagatcttcttccatcctgagatgtattctgctgacttctccactcctttacctgaactgattgacagctgcgttcaatctgcaccaattgacacaaggagagctttgtataagaacatagtattatctggtggaactaccatgtttaaagacttccacaagagactccaaaataatataaagaagatagtagacgaacgtgttgccgaaactaatgcacatcatcgtgtggaggtgaaacctgttgaggtcaacgtagtcacccatcctatacag

SEQ ID NO: 19180 - DNA, 1013 bp, Triticum aestivum
  Clone ID: PAT_TA_19180
cgatcggatattactgttaaggaggggcgaaaagagagcagcagagcggagtgacccagcccgatcctctgccgcttccgtcggcgccgccggctggagttggcatgggtgaggcgctcgggatcctcctgtatatactaatggtaggttttttgttgttgtggtggtattcggccttgtgctggtctggcgtgatgccgatggagtgttggccgccgtcgctcgcgcgcagcgttcggtggctgtcgacctcgtcttctgcttcgtctccttggtggaggcaaaagggaggcggcggatccgacgctagctcccccaataagcgcgtggctgcctcagttcgagccgctctggtgttctcccgtcttgcttctagccgtcatggtggcggcaagggaagaggtgggatggcgcggcggggctcgagtctctggtgggtgttctcgctggatctgagcttccagcgagattgtccggccctgatctgctggagggcctccagcgtgccgcctgctgctgcttccatcgcggtgatggagcgctggaggtggtcacaagggaagctggatgtcgctgatggagttcgtgagctcactcggcggtggatttggagaaactgtggcgcccttgctggtcgctgcccggttgattccgacaagccgccgtatcctcaggtcgaagggcgaccatttgcattcctcccggccatggagccaaaggggaggcaggactgcttcacggtggagtccatggcatggagtcatggaggtctcgctggcccaagtggtgccgtccccggcgccggcgaggcgggttccagcggggagcagaatcggactcgatcgcaatcttcttcctttgttcgaggtcttttttgcaatttgcagggtcttgtttgtaattgtccgtgtctttggggtcctgttgctaaatgtaccccatgcttatctaatgaataactgggtccttctggaccctacccttgttcaaaaaaaaaaaaaaaaaaaaaaaaa

SEQ ID NO: 19181 - DNA, 584 bp, Triticum aestivum
  unsure (1)..(584): unsure at all n locations
  Clone ID: PAT_TA_19181
caatcaccgcgactcactcactcgttcactgttgagatagagacaagagagggcagtgggcacaatggtctgcattaaggccattgcttttgtagctgtacttgtcgctggtgcatcgcttgccccggtgggcgagagccgctatgctcggaaggaccttggtctcaacctcggccttggcgggcttggaatcggtatcggcttgggtgctggtgtgggcgcaggtggttccggctacagttcaggctcgggctcgggatccggttccggatcagggtcgggttctggttctgggtctggttcggggtcgggctcaggatcggggtcaggtggtctaggtcttggacttggtgttggagttggtattggtggtggtggtggttctagttccggttctggatcgggttcggcatctgtctctcgttctggatcaattccaggcataggatctggttctggatcggcatcggcttctgggtcaggctcaacctcgngagggggtgggcttgggcttggggctggactcggagttggannnnntggtgcnnntnnnggctctaactnnnnnncnnngacnnnnnnnn

SEQ ID NO: 19182 - DNA, 838 bp, Triticum aestivum
  Clone ID: PAT_TA_19182
gcgcaacgtggtggcggacggcaccacggtgaatttgggcctttgggataccgccgggcaggaggattacaaccggctgaggcctctaagctaccgcggcgctgatgtttttgtgcttgccttctctcttgtgagccgagctagctatgagaatatcatgaagaagtggataccggagcttcagcattacgcgcccggcgtgcctgttgtgctggtaggcacaaaactggatcttcgtgaagataagcactatttgctggaccaccctggcatgatacccgttaccacagcacagggggaggaactttgtaagcaagtcggtgctttatattacatagagtgcagctcaaagacacaacagaatgtcaaagctgtgtttgatgctgctatcaaggtagtaatccagcccccaactaaacaaagagaaaagaagaaaaagaaacagcgtcggggatgctctatgatgaacttcggtggaaggaaaatgctgtgcttcaaatcctgaatgatcaaggaggtccctcagcccgaagcgacatcatgggtgcgcccgaagcgacatcatgggtgcgcggcaccaaattgacgaacactcgatatccactggatgtgctgattgcgcggtcaatgtgtatatttgcattgtcggtaattaattactagagttagatggttaaactagcccttgcttatgtgctgcagaatgcccgtgttttattagcattcatcgtgttaggaagttgtgtagaagcaaacgagatttgctgtgtcagtgacaaggtcgcaacttttgaagtctcggtgtattctcagttcagttagtctattttgtgattcc

SEQ ID NO: 19183 - DNA, 416 bp, Triticum aestivum
  Clone ID: PAT_TA_19183
ccctctctcttctgtagttggttgattataaatcgtaacccaacgtttttttttagaaaaggaggatgacccccggcttctgcatctgggcgatgcatacggccattttattaattattctcacaagaccttacaaagtaatacaacagtaagactaaagccgccgtctaagcaaactctatccagttgatgaaggggcgcagatagcctgggcctaataccaaacagacatcgcagccaagcctaacatctaagacctgagaccccatccaggacgcctgccgggcatgggtcacaccggtccggcgtgctctcagaggccgccgccgccaactgccaccgctccatcttcagaactgtactgatgcatcaaccttgctcggtctagctatcgtggacccgggagtttaggaccg

SEQ ID NO: 19184 - DNA, 1963 bp, Triticum aestivum
  unsure (1)..(1963): unsure at all n locations
  Clone ID: PAT_TA_19184
gggacactgcagggcaggaggattacaacagactgagaccgctgagctaccggggagccgacgtcttcgtgctcgccttctcgctcgtcagccgcgccagctacgagaacatcatgaagaagtggctaccggagcttcagcaccatgcgcccagcgtgccgatagtgttggttggtacaaaatatgatctccgtgaagacaaacaatacttgcttgaccatcctggcgttgtgcctgttactgcagctcaggtattatccccggtccccatacaccatggttacctgaaggctggaaaacgttcacagttggcctttgatttcttcatatctactccctctgttcctaaatacaagtctttttaaagatgccaatacggactacatacaaagcaaaataaataattctacactttaaaatgtgtctatatacatccgaatgtagtccttattgaaatctctaaaatgacttatatttagaaacggaggactacattttttctagaaatggaggatgacccccggcctctgcatctgagcgatgcatgcagccactttattaattattctcaaaagtccttacaaagaaatacaacagtaagcctgaagccaccgtctaggcaacatctatcgtactctatccagttgatgaagggatgctgatagtccgggcctaataacacagacatcgcagccaaacctaacatctaagacttcggcccgccgtaacgcttcgcgcacccaacacttacccccaacaccaccaccgcagcaagagctccgccgctccgctcccctcctctccccacccctcttctgtcccctcccctcgccccccttcctcgacctccgggggaaggactcggagaggcgcgcgcggccatggcgtccagcgcttcccggttcatcaagtgcgtcacggtgggcgacggcgccgtcggcaagacctgcatgctcatctgctacaccagcaacaagttccccaccgactacatacccacggtgttcgacaatttcagctcaaacgtggtggcggacggcaccaccgtgaatttgggcctttgggacaccgccgggcaggaggattacaaccggctgaggcctctgagctaccgcggcgctgatgtttttgtgcttgccttctctctcgtgagccgagctagctatgagaatatcatgaagaagtggataccggagcttcagcattacgcgcccggcgtgccggttgtgctggtaggcacaaaacctggatcttcgtgaagacaagcactatttgctggaccaccctggcatgatacccgttaccacagcacagggggaggaacttcgtaagcaagttggtgctttatattacatagagtgaagctcaacaacacaaaagaaggcgaaacctgtgtcttacgcatgtatctcgaaaagactcagcagaatgtcaaagctgtgtttgatgctgccatcaaagtagtgatgcaagcctccaaaagcaaagcagaggggaaaggaagaagaagaaagcacgacaaggatgtgcatcattgggtgtcctgtctataaggaaactggcatgcttctaagttgatcaaaggccttccatggtgattcggggatttatctcagaaagtctgtatcgtccgcgtgtgcattccctctgtaaacctgttaagacgttataagcccctaaagtagtgtcgtcaaactccttacgtaagtttacagaggtaggtgttttttatctcaggttttgcactttgcagtgtgcgtatatctcatgttttgtaatcggccaatcaactagtagagctagattactatggtcccattgggtgccttgtaacaaattagggcaatgttttggtacagcttggagcaatgccgcgatctcctttgcgctccagtcctcgccggtgccccgcctcgcngtagcaggcggagcaggagtcccatccaggacgcctgccgggtat

SEQ ID NO: 19185 - DNA, 1355 bp, Triticum aestivum
  Clone ID: PAT_TA_19185
accggtccggaatttccgggtcgatcacattgatcgaattgtaaccatgattaaacagatatcgataacggttgtgcatatgtagtaagtggggatgtctatttctctgttgacaattttcctgaatatgggaagttatcgggtcgaaaactagatgataatagagctggtgaaagggttgcagttgacgagagaaagaaaaacccagctgattttgctttatggaaggctgcaaaagatggggaaccatggtgggatagcccttggggcccgggtaggccaggatggcacatcgaatgcagtgccatgagtgcacaatacttgggcaattcttttgacattcatggtggtggggaggacctgatatttccacatcatgagaatgaaatcgctcaaagccgtgccgcatgttgtgacagcagcataaattactgggtgcacaatggttttgtcaatgtaaatggccagaaaatgtctaaatcccttggtaactttatcactatacgcaaggtcatagagctgtaccacccacttgcgttgaggatgttcttacttggtacccactacaggtccccaatcaactacacagtagagcagcttaatgttgcatcggatagattgtactacacttatcagacattgcgtgattgtgaagaaagcacccagcaggaccaaagcagtagcggaggttcactaccttttactaccacgcactgcatcgagaagctccccgcggtttgcgcgcccgcgggggccggtgatcttcacacttcggtggcgctggctgctatttccgacccgttgaaagttttgaatgatttgctgcatactcgtaagggaaagaagcaggagaaacggctggaatcgctcgcggtcttggaagagaaagtgagaatggtgctttctgtcctagggctgatgccctctagctaccatgaggcgctgcagcagctgccgggagaaggcgctgcggagggcgggcgtcaccgaggagcaggtgctgcagaagatctaggagcggacggcggcgaggaaggcgaagcagttcggtcggtcggacgagatccgggacgagctggcagccctcggcgttgccctcatggacgggcccgacggcaccgcctggaggccctccgtgccggcctcggagcagcccgtggctgccaagagcagtaaatgaacctccagcgaggcaccgtcttagacagttttgtgaaaccgcaatgtatgtaatcgaggatctgtgatttgggaattcaacaaaagaagttccgatggagacggaggaatgtactgcgtaggcctttgaaatgaaatgaagagagttttgatggatgccaaaaaaaaaaaaaaaa

SEQ ID NO: 19186 - DNA, 1278 bp, Triticum aestivum
  Clone ID: PAT_TA_19186
ctgctctccccgtctccctccgccactggcctccctctccggccccgccgccaccgtccgcgtgatcgacctctgcggcgaggagctgccaccagaacgctctccgcgacctctccaagtccgaaggaagaagatgaaaatataacagatgcggcacttatgtactgatgaagaatgtgctatagcatcttgaggaacattctcttggttctgttttgccgttgagattaacagaagaggggagttcgctgctgacccgcgcgtctccacaacggcgctgttacatccctaccgaccgggaggactgaatgttgtgagctggagctgagaggtgcagatggatcctgctgacactccgggaggggtcgatcccttttccaagacatcatgtatggatggcaagatgcagaggcattcccaattcccaccgccgttggaggcagcggactccgtatccagggtgctggacgacgacgacctcctcatcgagatcattgtccgactgggcctgcccaccagcctcatacgcgccatccttgtctgcaagcgctggttcttcattgtatccaacaaggcctttctccgccgcttccgcagcctccacccgccccgtctccttggcttctatgtctccaccaggtcaactgacgagctcttaccggtcctgctccgcccgtgctttgtctcgtggccgccgcgtcccccggtgcccgccccccctgtccccctggctccgctcgtcagtctgcgggcgggcgtcggacgacgtgcgggccttcttgattcccagaacgacaccatccttctccatggcttccaaggcaggaagatcttgtggggagtgcactggccgctctgcccagagagaggcgttgtttgacccgccgatggccccatattgcccaattcgatggcgcttcacctgcaggcacttgcgccccagttcctctttgaaggaagaaggtgacggtaaggagcttgaccttcatatggttgtcaatggcttatctccattaggagggaaaaaaatattctataaaatacaaggcgaacatatatacgctgcaagatggtctttggcactggcgttcctcagcagcggcagtgctcccttctccgcgatcggatctaaatcctttgctgtctggcaataagatctatatggagcactccacaagcattgctgcattgaatttgacaacctcaaacttcacctctattcctctcccggaaggaatggagcggtatatttgtgaagatatgctgttgtccccccta

SEQ ID NO: 19187 - DNA, 756 bp, Triticum aestivum
  unsure (1)..(756): unsure at all n locations
  Clone ID: PAT_TA_19187
ttttntttncttgntttgggtactataagtgatcacgaggcggtaactcatattacagggggtgtacacaccacgaaaaggtgtccaagaataaacagtgtcacttcttattcggattcaaaacggaattcaagtgcgtggaagcaaagtccaatgacttcccaggaaatcggcacatcagtatacaaattaaatagtccagatccaggagtggtagttggtacgtcgaacatgaagatagaaatgcggtcggcaggcaagaaatcattcgcagatcttcgcccctcgtaggagtcatcaacatttcggaagatcggacggcggaggcaacatcttttgattgggcagcgggccgtcgtccaccatccacgccatggacagtccccagctcaagtggacgtcgaagtggcagtgcataagccacacaccggggttgtcggcgaggaaccgcacggcgacccagccggcggtgggcacgctgacggtgttccgctcgacggggtcgacgaggttgtacttggccggatcgttgatggggtcgtagttgccgaacccttgcccgaccacgaagaagttgaagccgtgcatgtgcagggggtggctctcggcgccctggatggcggtgccctgcatcaccagttccaccgaggtgttgaacttgagcggcaccaccctcgtgccgtgggcgacgaacgtgttgttgggcggggtgccggtgtagttgaacgggtgcggcggcgtggtcgggaagttggc

SEQ ID NO: 19188 - DNA, 664 bp, Triticum aestivum
  unsure (1)..(664): unsure at all n locations
  Clone ID: PAT_TA_19188
cctagatgagcatgacagaagaaagtacgggatttctattaggacaaggctgctgccacttgaactattgcagatccaggcgctgcctccctatgcagcaggggccagactatgcgccgccctaggcatagtcggatctctaatcagatgagctgcctccaccattgtacgtatgttaagctgggacaattaaactgcatgtggtaagtgattgaccatctactgattgattttgcagatctgggcaatctgggatagctaaacatgttatatagtggcctctaagatttaggacgtcttctttttcggggaatgattcaaggcatttgaaacatgtgggaaaagcatatatagaattnagataattaatctcacagttggtcatattatgatgctcnggtaaggttaataagttataccgtaaaattttatgtctttgtcgtgcttctcaagaaaagataatggtaatagcaataatatgccactatttatgaagaaaaacatttgtatgtactgtattgccaccctagttncatggtcctgggtctttaaaaatataggtaactgagcanttatagcagtgttgacatantncaggatcaagcaggnaggtggatgacagacaattcanttgccnttttggngnaaggggggcngctacctg

SEQ ID NO: 19189 - DNA, 2974 bp, Triticum aestivum
  Clone ID: PAT_TA_19189
ctatgtaccatgcacggcagtgcggccgaattcactaggtgattagccgtggtctgcggcccgaggtgtccctttcgcggttgtcagtgtccaatgcccatcggcttgaagatcatccagaccgccatgccgatcatcatgaggttctcggtgagcgacacgaagccgagcggcacgttgctatctatccgcgaaccagtatccgaatgcgccatgcttccatggcagaccttttctattgacctgaaacaccatatcgccggtctttgtcgcattgatcgatttagcgagtggttcaaggagaggtatcgttacctccgcgcctgtttttgatgtcctgattgcgatgtagttattttttatatgttgaggccctaccgcgatagcatccgtgcgccggaggccggtatacagcatcaggtcaagcgccaatcgtgcttgggtgcccaaaggatgaatctcctgaaatctctgaacttcctcaatagtccacgtatgaaagccgtctgacttcgtcttctttggcttaacgtcatcagttggattggtctttatccacccgctgtcaattgcgaactccgaaaagagatcgcattatgctgagatatgcgttcgcctgaaacggtgtaccttcccggcggaacaagcccttggcggatatctgctgacgtaaggcgatccgaaattcaaatcgccacccgtccgacacacaccttcaggcattattcgcggacggagagtgcttgtagctgtcggccgcgcgcctggcgtccgccttttcaggtcgctcccgccagccgttgcccgccgcgggcgcccccgcccgcctgcggcgccgtgccgggcgtgcgctgctccctgcgtgatccctcctcccttcggccgcgctagtcacgccgcgggccggcggcccgtgcccgctggtgacgttcggccatcgtggacgttcccagccgccggtcatgcgtgggcggtggggggagcgcgcagattcccggggtgccggccgtccgcctcccaggcacccctcgcgctggccccgatgcggtaggccggcccccggcgctcccatgccatcgccctggggcccctacatccagtgtgtagctacctcgcacgcgggacccctctggcacgcccgccgggggcgagacctccccttgcgcctcccgcgacagcgtgcatcgcgacagtgccccccggcttggggtgccgcgtcggccggacaggccggcccgggggtgcttggcgccttcccgctcctccctcccggggggcgggcctccgtgccgcgccgctggccggtcgcctctccgggagccttcctcgcagggtcccacaacgggcgtgcccgggggcgtgtctcccacgggccccgtcggcgctttcgcctcccctgcgcctgccctgcgctcgccggggcgcccctccggccccgtcggtaccccccgcttgggttcaacctaaggtgaaatgttcgccggagaccgacaccgtaagcgatctgaaattcaaatcgccacccgtccgacacacaccttcaagcattatttttctgcttctctgtgtgaaaggcttcaaaagagaatatcgcccgctggcataatattgatctacgagccagcgaagggaggtgtgcgaagatttttgaaccttcggcacttcttgtccggccaacgctgcatcataagcttggttgaactcttttgatccaaactgtcccggaaggcgaatgcgcttctctttcccacggcggaagtaccagatggttttcccgtgtctggttacttcacgctggatatatggctttctaggtcttggcatggcagctactagagataccctttccctttgttgtcaatccgtgggttgtcttccacgtggtcttccggcaccaagcgtatttactcgttcttctcaccgcatatgcatgaccggtcgcttggaacctacatgatcctcgatcatatccagcgcgcacacgccgccggtctgccgcatgtctatctcggctattgggtcgagggatcacgcaagatgcaatacaagatcccgctttaccccgcagggagcatcttgggccccccggcggcttggcaaacggttttgagggtctaggacatataataagcgggaccctcgagccgcggacccatcgcctacatccgaaattccccagcgggcccgcccaatggccggaccaggggaagccattgccgaacggttcgggaggccccataatttctagtacggagagtaatattagctgtcgtcagcgggccagaagtccgcctttttatgtctaaccctcaaaccgttgccagccgcgggggcccagatgctcctgcggggtaaagcggatcttgtattgcatcttgcgtgatccctcgacccaatagccgagatagacatgcggcagaccggcggcgtgtgcgcgctggatatgatcgaggatcatgtaggttccaagcgaccggtcatgcatatgcggtgagaagaacgagtaaatacgcttggtgccggaagaccacgtggaagacaacccacggattgacaacaaagggaaagggtatctctagtagctgccatgccaagacctagaaagccatatatccagtgtgaagtaaccagacacgggaaaaccatctggtacttccgccgtgggaaagagaagcgcattcgccttccgggacagtttggatcaaaagagttcaaccaagcttatgatgcagcgttggccggacaagaagtgccgaaggttctaaaaatcttcgcacacctcccttcgttgggtcggagatcaatattatgccagtgggcgatattctcttttgaagcctttcacacagagaagcagaacaataatgcttgaaggcgtgtgtcggacgggcggcgacttgaatttcgcatcgcttacgtcagcagatatctcgccaaggagcttgtccgtccgagaaggtacaccgttttaggg

SEQ ID NO: 19190 - DNA, 555 bp, Triticum aestivum
  Clone ID: PAT_TA_19190
actccctatagggctgatttgaatttagccggccgcgaattcgcccttggaatgggcggggtgggtaagacgcaattggagacacgaagatttttggcgtggttccgataggtggtgctatcgtacatccacgttgatcgagacttcaacccacaaacggtaactgtcggcgttctgggaacgggggtccccagacttgcctgtctgcgacccacggcgtggctatgcgagcaggcctgtatggcccatcttcatcaacaagtcatacaagaccctcgcgagggaccatgcctcgcgaggcgggcgacacaggacctcctcaggagcggcctctccaggaaggctcgcaaggagcggaggtatcaaggcggggcaaacctcgcgaggctctcgtgacgtgagccatgatgatcaggatcaggcgggcgctaggcgggcgccagcgcgcgcagcgtccttgtttcctctttggttctaaggaagcaggcgcaggcgcggagtaccgaggcatcaggcaaaggtttccatatcagtgcaacgagaccaagaccagca

SEQ ID NO: 19191 - DNA, 868 bp, Triticum aestivum
  unsure (1)..(868): unsure at all n locations
  Clone ID: PAT_TA_19191
cgacgatggccggtcatcgacaatcgttggcagcggcttctctgaagctcccagctcttctgcttctgtggatcttcagcttgaactgggggcatgccgtcgcgcactttgatcctgcaaacatgaccgaactgcagaaacatgtctcctttttcgaccgcaacaaggatggcttcatcactcctgtggaaaccatccaagggtttgttgcaatcggttgcgagtatgcatttgctactgctgcctcagcctccattcacggtgcccttgctcctcaaacaaccccggctggtacaccactgcctcacttgacaatatacgtggagaatatccacaaagctatgcatggaagtgattcgggtgtatacgatcctaaaggaaggtttcttccccaaaagtttgaggaattattcaaaacatatgcaatactccgaccagatgcgttgacacttgcagagatgcatgcgatgctctttgctaaacgagatctagacccgatatcatgggcgccacccgagatagagtgggggctattattcacgcttgcaagcgattggcttggatttcttcacaaggacagtgttagaggtatatacgatggaagcgtgtttaccaagttggagaagaaatggcacccttctcaaagtgatatatgatgaacttgatgtaatgtgggacccacatacaagcgacggagaaggccaattcgtccacaccaggagtccatgccactgcaagcnaccaccaaatttgaaatacgtattgtatctctagttaccgtatttaataaccccctccatctcaaaataagttgtcttaactcttatactactttatattaaanttagtacctgcccgggcggncgct

SEQ ID NO: 19192 - DNA, 1114 bp, Triticum aestivum
  unsure (1)..(1114): unsure at all n locations
  Clone ID: PAT_TA_19192
actacttcgctatcggtcacccaggagtatttagccttgcaaggtggtccttgctgattcacacgggattccacgtgccccatgctactcgggtcagagcgtaagctagtgatgctttcggctactggactttagccatctagggtgcggcactcaaccgcttcgcctagcagcacatcgcttgtcttgctctcccacttccccggtttcccggcctgggctgctccctttccgctccccgctacgtcggggtccgctgttgcgttctttgcctctggcttctttcccgtggcagttcgcctcgttccctcttgcctgctctgcgatgcagccgccgcgttaaaaggttgacctatttgggaatctccggatctatgcttattttcaactccccgaagcatttcgtcgcttgctacgcccttcctcgtctctgggtgcctaggtatccaccgcaagcctttcctcttttgacctcgccattaacgttaaggntatgccatcctaaggtgctactaaatggaaggatcttatcaacgtccatgaatgtgaaatcatagatcgaactgccgaattggcaaaattcggtgctatcgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttgggaatcccattctaaggattcttgtggttccgggggaatccagttacaggagaaccaaggaacggggagctctcccctttttccgcccgactctttgatcttaagaatgctggttttaaagaacgagtgattgcccttctccgacccttactgcccaaccggagancggacgctaatgtgttcacntattgaacaggtctatggtcggtccgtgaccctgnacccgaaggcgtccttggggtatccgtattccnangggtggaganaaggggtcgtcatgatttcctcctttgcaa

SEQ ID NO: 19193 - DNA, 726 bp, Triticum aestivum
  unsure (1)..(726): unsure at all n locations
  Clone ID: PAT_TA_19193
actctaagaaatagacggggcgttgtcccctgccccgccgattatgcgtgggtatccgccgagggtctttccccggtcctcgggcgtttgtatcaccgacggcccagtgtgcgccgcccttctatcggcttcactcttttgggcgcgcgggaaccgggtcaccccggggcactaggcgcaacttttccctttttttctttatcttttatttctatagatcagacattttattttatggaagaaaaacaaatggaagaaaaacaaaaggatttagttcatattcatgaagccctagatttttggtttgggccgagctggatttgaaccagcgtagacattgtcaacgaatttacagtccgtccccattaaccactcgggcatcgacccaggaagaatttattctagggtttttgctaatctatgattaacctcctttcataatactccctacccccaggggaagtcgaatccccgctgcctccttgaaagagagatgtcctgaaccactagacgataggggcatcactagacgatagggncatatacaaccgctcgtgattatactataatcatagtatgagcaggttttttgggaattggcaatatactcnaaaaagtattaattagatccanagcaaagaagtttttccaacttttccggtatggtttcatctangatttttnnagttgatcgtatanatnaattcncnggcttcanttagtgtc

SEQ ID NO: 19194 - DNA, 1543 bp, Triticum aestivum
  unsure (1)..(1543): unsure at all n locations
  Clone ID: PAT_TA_19194
gttcgcttcgccgggtctcccatgccgccggcgaggagcccggcgccggcctgcggcggcgcaaagtcttcctccctctcgtgttgctcctcccccttattctactgaccctaatcctgatcttcccatctcgctccatccccgcgctccgcgacgcagctctcaggtcccaacagacctgcgactacgctgccggcggatgggtgcccgactcctccgctgagtcccacctccggtacgaccacacgtgcaaggagatcttcaaggggtggaactgcatcgctaatggcaagcgcaacggccacgccctcctccgctggcgatggaagcccgccgggtgcgagctactccccagactcgacccgctccggttcttagagcgtcacaggaacaccaacattggatttgtgggtgattctttgaaccgaaacatgtttgtctcattgactgcatgctcaggggagtgaacggagaggttcgcaagtggcgtccagcaggggcagaccgaggtttcacattcctacgctacaacctcaccctcgcataccaccgaactaatcttttggtacgctatggcagctggtcagccagtccaaacggaggtcccctagaatctcttggatacaagcaaggccacaggattgatgttgatattgccgaccaaacatgggcagaggcaccaagcttccatgatattcttattttcaatacaggacattggtggtggtcctcttcaaagtttgatccaatacagtcaccgatgctcttctttgagaaagggaagccgattatacctcctttactgccacctcaaggactggatttgactcttaaacacatgataacatttgcgaacaaagcaatgagacccaatggattgacattcttcagcactcaatctcctagacattttgaaggtggtgattggaatgaaggtgggtcttgtcaacgtgaccaacccttgtcctctgaagaggtcaaagaatttttctccttggacaacaacggcacaaacatagaagtacgcttggtaaaccagcacttgatgaaggctctggagctgtctactaccttcagagttttgaacgtcacccacatgagcgaattcagagctgatgctcatccggcgacaaccggaggaaagaagcacgacgattgcatgcattggtgtttaccaggaccaaccgatgcgtggaacgatttgctagctgcaagtcttgcggcaattcagtgctagccttgtgagaaaatttccccaatctttttcttggggtatgaatacgttggagcattatccgttgtcacagaagagatttcctccgaataccaaactgtagctttaacccagtattggagttttacgacgtgtactcctgaatcctagaatagcttaatcggatttgtttgttggacgatcaaacagagtggagttttctccaacaccgacggacatctctccnatgtgacaccgacactgaaaggcaggctgcattattttgtgcatatatatttgcaagatctaattggaaactatgttgttgtg

SEQ ID NO: 19195 - DNA, 383 bp, Triticum aestivum
  Clone ID: PAT_TA_19195
agcgtgccccccgcccaggtacacgaggtgcgtccagttttcgccgtgaccctctctactcttttgcacatgctgtgcgggcgaaatcatgataccatgccaagttccaacatcttcagagttcattttgcagtgattttcaatttcaccgtcatttagctccctaaacaaatcggtaaatgactgaaaaacagcaaatgatgtcagaacgtgttgcaaattgatgacgtcgcttggaatgatgcacactgaacgcaaatataggctggagttcaaataagttttaaaaacattgaagtgcccgtgtaacagatgagttctcgtccgagaccctgatactccgaaagagattgtccagtttgtacctcggccgcgaacacgct

SEQ ID NO: 19196 - DNA, 528 bp, Triticum aestivum
  unsure (1)..(528): unsure at all n locations
  Clone ID: PAT_TA_19196
cgnccantaactnaaantacggtgtatggtcgacctaactggcgggccccaggaatggttgnagcccatacncnatngaaaaaggatcttatcccaaaggcatnncaagtaantgtagtaaaacctggcctgttgacctttntgcttttccagcgatatgtacatatctaagtaattgtcgttctgtcagaccataatgaaaacgcaatttctgtttttcttgaagacgaatacgatattgctcctttttcccagaattgaatttttttttttaagattacttccggatttaggtgtttttctagtgagtcctggtaaagctcccagacggcgtattttttttaaacgaggtcctcgataacgggacatgaagactcctttttttattttattgaaatttcattttacacaattaatttcattgtatttacattacagaatacatcgaaattaaaactgaattcaactacaggataaacagagtaaaatcaactaaagtacccccccgggcggccccgcgcccanttc

SEQ ID NO: 19197 - DNA, 653 bp, Triticum aestivum
  unsure (1)..(653): unsure at all n locations
  Clone ID: PAT_TA_19197
cgacccacgcgtccgatcgcgccattgcccgccccccccctccctccccctcggccgcggccccggccgccccccctccccccccggcgggccgggccctgctccccccctgcccgccggcgctggtgcccgccgccctccgtgtggcggtgggggggggagggaccgaaacctggcccgcccccccctcctttttttggccccccaaaacggcctccggctccgcccggcggccctgcgtcgctgccatttggttgccccggggacccaattatggtgctctgtcaaccgcaacccggaacagtgaatcccggtcccgaatgtgcgggcggaagcgcaagagaggagggcgcatcagcttgagcttcagtccagtcacccggccgggcaggggcgagggccaagggcaatggaattcgccgacaaattgctcctggtgctccggagctactcactgcctgtttgggccaccatcatctcggggctcttcgtcgccgtctcgctctcgctgtccatctacttgctcctcaaccacctctcggcctacaagaacccagaggagcagaagttcctcgtcggtgtcgttctgatggtgccgatatacgcaatcgagtcgtatatatcattggtgaatccaaccattggtntannta

SEQ ID NO: 19198 - DNA, 705 bp, Triticum aestivum
  unsure (1)..(705): unsure at all n locations
  Clone ID: PAT_TA_19198
gctcgggtctcgtcccggnagaaagnatccagcaccgagcagctcgaggccgacgactcaccttttggaaggcggggttcttctgaggtgacggaccttgcatctccagtagatcgggcgcgtccactgttcccaggaccagagcatcgcacttggcaaagcagaggagaagatggacgctcgcggcggagacgcatcggccattgccctgctgctgtgcgcttgctttctcaccgcccttgcatgtgacagcacatggtgccaagtttgcgtacagcggtcctcttggccccgatcactgggggggattggaccccaacttcacgcgctgcgccatggggacgtaccagtctccggttgatatcaagaccagcgacgtggtttacaacccgatgctggggcctcttcacagggaatacaccgctgcgaatgctaccctcgtagacaacatcttcaacatcgcgctgcgatgcgaggatgctgctgggacggtgcagatcgacggggtgaagtacaagctggacaatatccattggcactctccttcagagcacaccatcaacggcgagaggtttgcggtggagcagcacatggttcacttcagtgacgacggcaacatatccgttgtgtcgatcctgtaccggctcggcaggccagaccctttcctcatgcagctgcaggataagctatcggagctctacgtgg

SEQ ID NO: 19199 - DNA, 455 bp, Triticum aestivum
  Clone ID: PAT_TA_19199
ccgagtgggatggagtcataggggtggaggacctcagcctttcatcaaagaccacgaagctggagaaatgccacaacgctgagaagagccacggcagcagcaaggcgctgaccggggagcgaagcagctcggactcgtcggacagcgccatcttgcggagccaggaccatcccaagaggaccccctccaggagcaccaagccgtcggctgctgcctagccctccctgcatctcatcaaaagagtggtgctggggttttagctgctgtctcttcttctttatgaatgttgcatagaagcaagaattaatgttttttacaagtctgtagggatgttataatgtcaggtctgcttttagggggatcttgttatttagcatgtaggctttgccatgaaacctgtgagacctttggtgctgctgtgaggttttatgccattcactcctggtagttataag

SEQ ID NO: 19200 - DNA, 2020 bp, Triticum aestivum
  Clone ID: PAT_TA_19200
ttggtgagtgatatcactgttcgtctagggaacacaaagttttaccttcacaagtttccacttctatccaagtgtgctcgctttcagaagttgatcccaactactggtgatgaaaatatcgatatccacatccatgacattcctggtggcccaaaggcttttgagatatgtgccaagttctgctatggcatggttgtcacactcaatgcgtataatgtcgttgctgcccgctgcgctgcggagtacttggagatgaatgaaactgtcgacaagggtaatctgatctacaagattgatgtcttcctcagctcaagcatattcaggagttggaaagattccattattgtccttgggacaacaaaagctcatttaccatggtcagaggatcttaagctggttcgccacggcattggttctattgcttcaaaagccaatgttgacacctccaaggttgaatggtcatacacgtacaatcgcaagaagctcccagctgagagcggccgcgtggggcaatggaatggggtcaagaagcagccgtctgtgccaaaggattggtgggtcgaggatctcacagatctcgacatcgattcctacaagcaagtcatatcagctatcaaaacaatgggtatggtgcccaaggatgctgttggtgaggcaatcaaagcctacacatacaagaagctcccctcactaagcaaggtttcaatgatccatggtgatggaaaggtccgagcgatgctagttaccatcacatgcttgttaccatcagagaaaggctcagtctcatgcagcttcctgctaaagctactgagggcaaccaatctgcttaaatgtggagagatgtgcaggaaagagctggtgaagagaattggacggcagctggatgaagcgtccgtgtctgatcttcttattcctacggtcgatggggagacaactggttatgacattgacatgatccttagtatcgtcgaagagtatgtgaggcaagatagcaaaaatgctcagaaacataatgctgaggtgaacggtcacgtgcaagcacctagtgcatctatgatcacagtagcaaaaatcgttgatggttatctcaccgaggttgcaaaggacccaaatacccctgttttgaagttcatcaatcttgctgaggcaatttcaggcaattcaaggcctttccatgatgggatatatcgcgccattgacatgtatatgaaggagcacccaagcctaagcaagagcgacaagaagaagctgtgctgcctcatggactgcaagaagttgtcgccagaagcatgcgctcacgccgtccagaacgagcgcctccctctgagaaccgtggttcaggtgctgtaccacgagcagacaagggcatccgcggcggcaaccgtccgagctgacagcatctgcatcggctcctacgagagctcaaggtcaggcgccacaaccaacactgaagacgagtgggatggagtcatagcggtggaggacctcagcctttcatcaaagaccacgaagctggagaaatgccacagcgccgagaagagccacggcagcagcaagagcaccaccaacggcaaggccaagggcggcgcgacgccgaagaaggtgctggggaagatgctgtcgagcaaggcgctgaccggggagcgaagcagctcggactcgtcggacagcgccatcttgcggagccaggaccatcccaagaggactccatccaggagcaccaagccgtcggctgctgcctagccctccctgcatctcatcaaaagagtggtgctggggttttagctgctgctgctgctgctgtctcttcttctttatgaatgttgcatagaagcaagaactaatgttttttacaagtctgtagggatgttataatgtcaggtctgcttttagggggatcttgttgtttagcatgtaggctttgccatggaacctgtgagacctttggtgctactgtgaggttttatgccgttcactcactcctggtagttataagaagcctgatgtgtttggcccttcc

SEQ ID NO: 19201 - DNA, 828 bp, Triticum aestivum
  unsure (1)..(828): unsure at all n locations
  Clone ID: PAT_TA_19201
tcagcaaatcagaaagccgccttcactgagattttggatgtctaagagctatttgccatgcacacatgcttccgttggcccttacatgggtcccttcatcaaatggtagtgatggtggttatgttggacatgatagtgtccttgattctcagtcagggaaagcgatactccgcatccatgaatcagcgtgttatgttaatgatgcaaagatgcaaggtttttttcatgcatgcactgaaactcatcttgagaaagggcaaggtattgcaggccgagcactcaagtccaatctgccgttcttctctcctaatataagagaatacggaattaaggattacccactcgcacaccatgctcgtaagtttggtctgcatgctgctgtagcaatccggctaaggagcacatacactggtgatgatgactacatactagaatctttctaccaatcaactgcacaggcagtgaaagaacaacagatgttattggaataacctgtccattactaagcaaaagaatatgcaaaagtttgcgaacatttcctgaagcaaaggttgataaattgacgcttgtactgcataatgtntnaagnaaccatggaattgcttcctacgggcatccngggattctcacatggggnnaacctgcacagaagaggattcangtnaactttaatngtaacaagggacattccaacaggacatctatnaatcactgcggagaaaaccatncacgggaanatatggaaggtgtccntaatactttcggagctaaggtgctcaaaaccncggnttgcanacttaacgttcccaaatgattttcatgaaccca

SEQ ID NO: 19202 - DNA, 765 bp, Triticum aestivum
  Clone ID: PAT_TA_19202
tagcgtggtcgcggccgaggtactccatcttgcacagataaagagggcgaagaggttccaaatgtatgactatggaagtgccgcggcaaacatggaagcgtatggaacaccaaaaccattggacctgggagctcactacagtcttattgacatccccatggacctggttgctgggcaaagagacagagtaatctcaccaaccatggtgaagaagcactacaagttgatgcggaaggctggtgttgaagtctcctataatgaattcgagtatgctcatttggatttcacattttcacacagggaagagcttttgtcctatgttatgtcccgcctggccttagcagctgacgcaggtaaaggccgcatcaagcagaccactgtgcgactaaggaagccgaagagagttcagtcagaaatggagaaggatcgtgccatggagtatagaggcgcagatgaagagatacctggtgaaccaaatgggcatagcaagtgatgcaaatttctgactagctgttgttgtacgtagttttgtgcataggtatatatatgacacgccgctctctgcatacttctacaatctacaccatgtagaagaatatttgaggatggatattgcacagttttaatagtttagttcgatggggactcttttatatccttgtcggaaaccagactggtacatgtatacatgatgtgttaatgttttcaaacaaataaagacaaaggacgcggggtctgggcggtttttttgggtgaaaacctcgg

SEQ ID NO: 19203 - DNA, 1045 bp, Triticum aestivum
  Clone ID: PAT_TA_19203
cggacgcgtgggccggggggttctcagggagaatttcgacccggtcgagatcgctcaagcatacgagaaaaatggagcagcatgcttgagtgttcttacagattcaaaattctttcagggaagttttgactacttggaggccatacgcaatgctggagtaaagtgtcctctgctgtgcaaagagttcatcattgatgcttggcagctttactatgcacggtctaagggagcagatgctgttcttctgattgctgccatcttacctgatcgcgatatcagttatatgctgaaaatatgcaaaatactcgggatggcagctttagttgaggtgcatgatgaaagggaaatcgaccgtgttatagggatagatggcattcagcttattggcatcaataaccgtaatcttgaaactttcgaagttgacatttcaaacacgaaaaatcttctggagggtgaacggggacaacttatagcccagaaggacataattgtcgtaggcgaatctggactgttcacgcctgaccatgtttcgttcgttcaggatgccggggtcaaagcgattcttgtcggggagtccctcatcaagcaggaggaccctgggaaagcaatcgccgggcttttcggcaaagacatctcacccgtgagtagtgcggtgtaaataggaaaaggggtaaggaatcgtgaaatgctgggcctctcatattttgtataggagaacagagcgatatgcgcttttggagagttttggtcagcaattttgtttacctggccagtatcggtgttcttcccttgctgccatttcctggaagttgtaaccggcctcactgttcaaaggatgcaatgcgaagagagatgatcgaataagttgggtgtagctgttatcagcttgagtttacttagcttgatagatcagctctttgctgttctatctaagttcgattttttgttgttgcaagttgcaacgcataatcttgaccatgctgacaagtgacagcctctgagctggtgataagataatgcagtagcaaacatgctaattggagct

SEQ ID NO: 19204 - DNA, 1407 bp, Triticum aestivum
  Clone ID: PAT_TA_19204
cccccccgcagccctacccaccccctcccgaccccgcgttatcgccgccgcccctcccgcgcccgggccatcacgtccaggcctcccacccccgacccgctgctcccatctccgccgccccaaagccctagccgcctccaagctccctcgccgcgtcatcgccgcccttcacatggacggcgcccgcgccgcacctcttcgctgcactcccgccgagacggatgcggcggcgacgacctcggaccagactgagacggcggtcgaagccaccgagcagggcaacaacggcgccccggcggcggacgcccccgcctccagcatcgaggggctggacgggataaagatccggaggcgcccggtcacgggcccgtccgtgcaccacgtgggccccttccagttccgcctcgagaacgtggggaacacaccgcgcaacatcctcgagaagattgtctggaacaaggacgttgagatttggcagatgaaggagaaaatgcccttgtacaggctgaaaggccctctggacaatgcacctccggccagggactttgttgctgcgctgaaagcgtcgtacgatcggactgctctgcccgctctgattgcgcaggcgaagagcgcctcgccaaggcggggggtcgcttaagggggggttttgacccaggctagagtgaactggcatatgagaaaaatggcatctcattgtttatgtgggtcatcctagctacgaacggtcttagagagggaatgctgttcttctggttgccgccggcttacctgatcgtcgtctcgggttacgtgctgaaaacatgtataatcggccgggatggcagcaagaagttgaggtgcatggatgaaagggaaaatcgaccgtgttaatagggatagccggcattcagcttattggcatcaagtaaccgtaatcttgaaactttcgaagttgacatttcaaatcacgaaaaagcttcctggagggtggaacggggacaacttataacccagaaggacataattgtccgtaggcgagtcctggactgttcacgcctgaccatgtttcgttcgttcacggatcctggggtcaaagcgattcttgtcggggagtccctcatcaagcaggaggaccctgggaaagcaatcgccgggcttttcggcaaagacatctcgcccgtgagtagtgctgtgtaggtccggaacggggccaccaatcgtgtagtgctggccctcccattggttgttggcgcgatcggtgcggcatgcgctctccgggcgttccggtctgccgcctggttgtcctcgccagtttcggtgtgcttcccttgctgccatttcccggaagttgtaaccggcctcattgttcaaaggatgcaatgcgaagagagagatcgaataagttgggtgtagctgttatcagct

SEQ ID NO: 19205 - DNA, 939 bp, Triticum aestivum
  Clone ID: PAT_TA_19205
cgccatcaaccccgccgggccggcgatttgtcccagctatctatggccgagccgctccccaattccgggagttcgggagtccggatccagcggccggctgacctataatagtacggggagaggagctgagaggggaaaaggcaggagtccgtcggcgatgggcgggtggggctgcttctgctgcggcgacctgttcggcgccgggggagaagccgcggtccggctgccggagccgttccagctgccggcgcccttgctcgcatggccgcaaggacgggacttcgcaaagggcgtgatttgcataggagaacttgatattgcaaatattacccaattccggaatatatggagctactctggagctacgttctatgagccagaagagttcctgatggtttccactgccttggccactatgcccaacaaaatgaccggcttttacagggttcccttgttgttgcaagggaagcggctagctgccagttaatcaatagcaggcccgctcttgagaaaccattagattacaccctcgtttggactaatgctggcgtgtatgaagatgacaatagtgaatgcggttgcttctggttgccatcaccccctgagggttatgaagcccttggctatgtggttactagaggaccaaagaagccctcactggaggcggtccggtgtgtgcgacaagacctcacggacccatgtgaaaactttaggtcagtcgttaatgtggaacgtacatgccaagtttggaagacgaggccttgccaccgagggacagcaggacgaggtatacctgttggtacattcttctgtgaaacaaattcagttaacagtcaggaatcaggcattccctgcttgaagactgtgacccgaatttgagagccatgcctgatctagagcagattcatgcactaatcaagcactatggcccaactgttt

SEQ ID NO: 19206 - DNA, 772 bp, Triticum aestivum
  Clone ID: PAT_TA_19206
cttcttcgtgccttgtgtcatcttatattcagtccaatagaccaacagctttcccatcctgtacacattgtgtgtttgatgtggatacagtgtctatagatgtttttatctcttctctgcccgcggccctagatttatgtgctctgtcatggaacaatcatgccaattcaaatgaagctattacaaggcacagttctcattcaggatcaagtggactggagatcaattgtggtgaatcttgcaatatctccaagcaagcaaattttactgaggataccaattatcctgcagagagagacctgtgctatttcactgagataatatctctgcttgagctgtttgggaactacatgagctgcgagtggacatacaaaaatgttgttgtccgtcttctgaagattttggaatcatgcacatgtgaggagtattcagctgctctcttggtacttgtcagccagcttggaaggtttttcattgatgatgttggttatgagacagaagcagtagttgagctgaggaacaagttagcagtgctaatagggacgagttttacaagatcgaggagcatacctgttcagttctctgccattggtgcgctgctcagtctctttccgttgacatttgataaaatagtttctagccagaccggaccattatcaggtccatgtgttctgcaagcgagtcagatttccgaatggtttggtcagttaagcaaggagaatcaatcttttgctcgttccttttttagctgagtcggtgggtattgcagcat

SEQ ID NO: 19207 - DNA, 1155 bp, Triticum aestivum
  Clone ID: PAT_TA_19207
cgctcgagggcgtgcgagccgggaataaaaggtccttcacttctccttcttcttctctccatcttccttctttcgtcttcctcatcctctcccccctccccttcttttattcgcggaggtatcttgctacgtccgcaagggaaataatgtcggcacagatcgcgccgccggagcatgtctgctacgtgcactgcaacttctgcaacacaattctcgcggtcagtgttccaagtaatagcatgctgaacatcgtcaccgtccgttgcgggcactgcactagcctgctgtcggtgaacttgaggggattaatccagtcgccacctgtgcaagatcattcccaggagaatttcaaggcccacaatatcagctttcgtggaaattacccggactatggcacatcttctaaataccggatgccaatgatgttctcaacaaaaagtgaccaagagcatatgctccacatgagaccagctcctgagaagaggcagcgggtaccttcagcgtataaccgatttattaaggaggagatacgaaggataaaaacaaacaatcctgacataagccacagagaagccttcagcaccgcagcaaagaattgggcgcattttccaaacattcatttcgggctaggctccaatgagagcagcaagaagctggacgaggccatcgcggcgcctatcccccagaaatttcaacgtgtctactgagacatatattcctatatgcatgatactttcatattgtaagtaactgaaggaaaaacctaagtaaattcttgaatcagttcgtaagtgagtacatagatcgtgagtgagtgatatgcagtgaattgggaaaaagccaaatagaagcattgagcaagtttgtgagtgtggacatagaacgtgaacgagtgataaacatgtcgtgagaaagccgcatatgggaagtgtatgcagctagattatctatcgtacatgcatatagaagacgtctgaataaatccccgtgctcgccagtttgttgtttaattgcttgaagataatcaccttgcttgaacatgtctgtattaggatttggtttggctagtgcaggtcacttcatccatcctcaatcacgttacctagaaaatgcaatacattttttacccagttgattgcattcggttatatacac

SEQ ID NO: 19208 - DNA, 992 bp, Triticum aestivum
  Clone ID: PAT_TA_19208
ccgcgccctcgccaacctccaggagctcgatatcagctacgccgaacccccgctgctgacatcggttctccgctctgcatccaacatccttgtcgccaagatcagccattgtgatttcgagccggccatgatcaatttccccttcctcaagaagctctccctgtttcgccttaccatctcagcggacctcttccccggactgttatcctgctgccatgccttggagagcttatccatgaccaaagttcgtgctgtgggctgtctccgtcttagctcgccgaccattaggaccatcatcttccgtcatagctatggtgaaaccgcagaactggtcatcgaggatgcccctcgccccgcgcggccgctagtgccttattgtgagagggatgatagtgtgactgtcagggtaattagggcgcctaatctggagatattgggccctttcttcgttgttgtctccaagctcctactcttccagggaataagcctggtcagctccacaaactcgatgcgcaccttgaaggttttggctctcaagtcttctgggcagaaattgaatgcagttcttaacatccttagggggttcccctgtttggaaaagctttgtgttatttttcatacaaaccgtgagaggaatgacgaaaatgagcctcagtatgatccactacatccagtcgaatgccttgagacccgtctaaaaaaagtggtgtttaagtcatttgagggctatggcaaacaggttgactttgcgaaattctttgtattgaatgcaaaggtgctagacaaaatagaattcgaagtaagaaatcagtacagcagtgagacagtggcttatgaacacaggctgctacaagtggaaaacagagcttcccgagaggctcgggttgaattcaggactacttcatactgacagagtaccatgtcaacaagcgtatccatgatttgtcagtgaccggccccttcagacagccatagacagcattgatgcctga

SEQ ID NO: 19209 - DNA, 737 bp, Triticum aestivum
  Clone ID: PAT_TA_19209
gcgcccagcaaagaaaactgaaagcttgctttctgcttctatcaaaccgaagcaaaaggatgctaaacctactgcaacgagtggaagtgccgtgttatgcccaagcaccaattcagcaaaggaagaggcagcagtcattgcaccagcaacagtagcagaagtcgtggaggtacaatcgtcacaatgcatggaaatcgatgctccatctacagatgagggatttgataaaacaagcaatgctttagatactgtgccatctgaagtaccgaaggtggtcccacgcggccgggcaatcggcgccccatctacagatgagggacttgataaaacaagcgatgctctggataccgcatcatctcaagtacagaaggtggtctcaagtggtatggaggaagaggaccattcgtcgtcaggtctggatgcggcgagttcgtgtaccatggacctgggcgaaacctgctctccaaacattcctgatgcctttgtcgagaagactccagtcaaaactcacttgagcaccccaaagatcagcgtcaagctgagagagatatcaaactcactgaagcttcttaatgctcgtccattgagcgtaatggcacaaaaggtagccatggaaaagacacaagaagagggcatggagaagacgcaaaaggtggccatggaaaagacacaagaagtggccatggaaacaacacaagaagagggcatggagatgatacaaggagtgggcatggaga

SEQ ID NO: 19210 - DNA, 695 bp, Triticum aestivum
  Clone ID: PAT_TA_19210
ccacgcgtccgcggacgcgtgggccccccaacaaccccgccgctgacgcgcgtcgccgccatcgccgtcgccgttcctacttcaccgcgtcgctgccgtctccgccccgtccgcaatcctggacactggtttttgagggcaactggggtcatcatgtgccatacacttcttaagctgtatcaaactccttacccgttccgatgctcttaaggtcctgcttaaaacaaagagatggacgcaactgatctagagaatccaacatccagaaactcatctcagaaatccagccgccgttccagtagccggcgttctcaaaagtcagctgggcaacaatcttcccccactgtatttccagagaaaagaggcaaatctagatctttgaggcaaaagcatgtggctgttgacaataaagatgccaaaaagggtaaaaaccatgagcgtagaactgatacggtggatgagaggtccaattttgtaggtttcgaagtctattctggcaaactgttttatgacaggaaaaataaaagtataggggcggatggtcatctgtcatcaaataagaaagctgatacaactgatgcaagactcacaagtaaagcccttatatggggttctactgtactcagccttgaggatgtcatctctgtatcttataattctggtctccaacattttactttacatgcatatcctgc

SEQ ID NO: 19211 - DNA, 765 bp, Triticum aestivum
  unsure (1)..(765): unsure at all n locations
  Clone ID: PAT_TA_19211
cccacgcgtccggtcggtggccctgtgtcttcttcatcagctattgcagtgccaaatgctccaagctttcacgcttcaaatcctacgtctcccttgtcagcaatgaacactattggatctcctactcaatctggtattgatcaacctgtaggggcaaatgtgtcacccatgaaggcggctgagttctctactcttgggcagcctggtacaacatcaagaggtgaccagtcccgcagaggagcacaagttagctacctgcatcatttatcctgtaggattattttagctggtctggagtccaatttgaagccagctactcatgctgcgatattccatcatatggtaaattggctagtcaattgggaccagagaccccatggcgtggatgaagctgatacagtgcaaacttctaggatcggaaggcccgtgcatgaatggatgcatctatgcttagacgtgatttggattttagttgatgaagagaaatgtcgcattccattctatgagcttgttcgcagcaacttgcagtttctggagaacattcctgatgatgatgcagtgatttgcatcattatggagatcataggaggagggacatggtgtgcatgcacatgcaaatgttggataacacttcactgccaacatttggactcatcggttctgtcacatctatcaagcatactggtgaatcgttgcaatttcgtantcccaatactatccatgtctggtagcactcatggagagatctgaaactcatccaagggg

SEQ ID NO: 19212 - DNA, 486 bp, Triticum aestivum
  Clone ID: PAT_TA_19212
cccgggtcgacccacgcgtccggcgcgcccccccgcgccccccgccccccccccccgccggcggagcgccccggcggcgacgcaggatgccagagcgactgcgcctcgtcggcctccgtcgtggacgacggcggcgacgaggccgcctcggccgccgtccggcctcgcgcgcccttcgtgttcgacctcaacctcccgccgccgtcggacgagctgtgcaccgagctacggctcttctaggatacaccggacccgggtcgccggacgagctgcgcaccaaagctagcgattttttatttttcttctattctttttcctcctgattattagattagacagatgatgctgtgtgcaagagcgattgtaccaccaccactactattctttacgcgataagaattgcggttgatttgattgacaaaaaattgcgcccaaattttgcgatctgattaagagttgatttttgcttgcccaaaaaaaaaaaaa

SEQ ID NO: 19213 - DNA, 988 bp, Triticum aestivum
  Clone ID: PAT_TA_19213
gcgcccacgcgtccgcacgcacgcacgcaggcaggccgcccggacacggcttcctgtctcctccggtccgctgcggctgcgagcgcgagggggtggatccccatctcccgctcatccatggcccccgcctcgctggaggagctccattgcgcgcccgcgccggagaagcccccgccctcggccccggagggcgagctccggtggctccggcggtgcgcgggggatggcgacgacctccgctggctccgccgctgcgtgggggccgccaccaagggcttcgccatcggcgccgggctcaagggcggcctcgcgctcttctccctcctcgtccgcctccgcagccgccgctcccccagatcgaggaaggcgggcgcgatgaccaacgacgaggcggcgctcctggcgctcaaagagacgctcaggtacggcatgttcctcggcaccttcgccggcgcctacgtctccgtcgacgagtgcatcgccgccctctggggccgcaaaagaacagcaaggtggaggtcattattatctgggttaattgctggtccttctatgctcttgacggggccaggcacgcagcataccagtttggcaatatacattctcatgcgtgctgcggtgcttgcatcccgttgtggaataaagagcaaaagatttggaaagatttgcaaacctttgacctggtcacatggtgatgtcttccttatgtgcctttcatctgcacaaattttatctgcatacattctacagcaggacagtttgccgtcatcatataaatcatttctgaagatgcatggtggaaaggatcagtctattctgcaaggcttgaaggaagtagttaaccacactgctttctctaacctagaggctattgagaagtactacaaatctgttggtgttgacataaagttggatccagacatgaaagtgccctgctcaattgtgcatggtaatcaatcatgtgcaggacattttatttcgttcttgt

SEQ ID NO: 19214 - DNA, 737 bp, Triticum aestivum
  Clone ID: PAT_TA_19214
ctgcggtggcgtctcctgcggctgctgtcgccgcgggagctcgcgggcgacgccgcggcggcgttgcggcgggccatccgtcgcgtgccgccgcccgcggtcgcgtcggtcgtcctgggggctctcctgctcgccgcgcggctcacgctgcctaaaaacccggcccaggaggtggcctacgcggacctcctggcggggctgcgcgcgggcgccgtgaccgccgtcgcgttcgaggaggactcccgccgcatctacttcagcaaggccgaggacgtcggcagcggcgaagacgagcacgagaccggtaggggcccgccgtgccgaagtggccgtactacgcgaggagggtgccgcacgacgaggggttcctgctggggctgatgcgggagggcggggtggactaccggtctgctccacggccggcggggaggctgctggtggacatgctgaccacgctgctcacgctgtggttctcactgctgccgatgatgtggttcttacagaggcagatgtcgtctgggggcagtgcggacaagcgccgccggcccaggaagcagcaggtaggatttgacgatgtccagggcgtggatgaagccaaggaggagcttgtcgagatagtgagctgcttgcgtggttcactgaactacaagaagcggggagcaagattacccacgggtgttctgcttgctggccctcctggaactgggaaaactttgctggcgaacgcagttgcagga

SEQ ID NO: 19215 - DNA, 722 bp, Triticum aestivum
  Clone ID: PAT_TA_19215
gaccggtccggaattctccggtcgaccccgcgtccggaattttcctccagggacaggcagggggcatacgggttgatagatctgaagagtcagaagaacaattgattttggcacctacactacacaaaaccctagccagtcccctcccctcccgcccctcccctccgcgcatgctcgcacccctcttctcccgaaaccccagcctcctcttcctccccgccgtcgtccgcatcgcccgcggagcaatgtcggcctcgccggccgccaaggcgaccgtctccgtcgagtacgccaagtccggccgctcctcctgcaagggctgcagcgccgccatcgccaagggcgcgctccgcctcggcgcctccgcccgcgaccctcggggctacgacagcaccaagtggtaccacgtcgcctgcttccccgcctcctcgctcccgcttggccccgtcgaggaggtccaggggttcgactccattaaggatgacgatcgcgaggagctgcgagagcttgagaagaataataagagcgaccagactgctgtcagtccattggaagtaccaagtccgaagaaagcaaaggtttcgcctaaagcagaggtggcagaaaaaggaagtgtctctgttgaatacgccaagtccgcccgttccacctgcaaggcctgcaatgcaagcatcgccaagggcgctcttcgcattggcgtctcagcccatgacccccgtggc

SEQ ID NO: 19216 - DNA, 582 bp, Triticum aestivum
  Clone ID: PAT_TA_19216
caatgatagatatgatcttaaaaattattagctaaatgtaagcagcagtctcttaatgctagagtgaaacctggccctgcttttgctacttcacctatctgtgttactgatcaggattatgaattctcgggtcgacccagagttaattactttggttgaatctgatcctttccatggttatgaaactgaaactgttgtggcacatcttactaagttgaatgatatagccaccctttttactcatgatgagaaaactcgctattactttattctcaaattatttcctttctcattaaagggtgatgctaaagcttggtacaatactcttgctcctggttgtgtgcgtagtccccaggatatgatttattacttctctgaaaaatattttcctgctcataagaaacaagctgccttacaggaaatatttaactttgtgcaaactaaagaagagagtctcccacaagcttgggggaggctttgccagttacttaatgctttgcctgatcatcctcttaagaaaaatgaaatacttgatatcttctataatggactaaccgatgcttctagggactttctagatag

SEQ ID NO: 19217 - DNA, 813 bp, Triticum aestivum
  Clone ID: PAT_TA_19217
tattttccaagctagcatttcgtacacacataggtacacatatttccaagctaaacgagaggatgtcgttggtgaggttcttcgacacgctggccctggactcgtggaaccccttcggcagcatcttctgcaccacggcgtccagcggcaccgacgcctggctggccagcgacaccacggccttcgccgacacctacatcgaaagccgggagacggcggaggcctacgtgttcagcgccaggctccccgccggggtcaccaaggaggaggtcaaggtggaggtggaggaggacggcaaggtgctggtcatcgccggcgagcggtgcctgcggagggaggccaagagcgagatgcgccaccacgtcgagcgcagcagcgccaccttcttcggcaggttctacctccccgacgacgccgcgttgggccaggtcagggcctccatggacgacggcggtgcgcagctcaccgtcaccgtgcccagggtcggcgcccccgtccccgtgagcatgcccgagccggcagtggccatcgaggtcgtcgaggcctgcccgtgctgatcgcgatcgatcgaccccggtgcccactcgggcagacgtacacgcagtaagctggtgctcgtaaaaaaaatgatctgctcgatcggtccgcagagtgtggtttagttttgatgccccaaatcgtggcgcttggtgtacgtaactacgtgcctccgtcggtctgttgctttgctgtattatgaatgtgagctgcatgcctgtaatatgcatgcatatttgcttgtactattacttgtcagttctggtgttcccgggc

SEQ ID NO: 19218 - DNA, 969 bp, Triticum aestivum
  Clone ID: PAT_TA_19218
gtgcggcgctcgacggggcgagaaactcccacgcgtccgaaggaaacgagctagctagccagcatttggtagtacacaagctacatacatatccccaagcagggctagctaaaccgatctagaggatgtcgttggtgaggttcttcgacacgctggccctggactcgtggaaccccttcggcagcatcttcggcaccacggcgtccagcggcaccgacgcctggctggccagcgacacgacggcgttcgccgacacctacatcgagagccgggagacggcggaggcctacgtgttcagcgccaggctccccgcgggcgtcaccaaggaggaggtcaaggtggaggtggaggaggagggcaaggtgctggtcatcgccggcgagcggaacctgcggagggaggccaagagcgagacgcgccaccacgtcgagcgcagcgtcgccaccttcttcggcaggttccacctccccgacgacgccgccctgggccaggtcagggccgccatggacgacggcggcgcgcagctcatcgtcaccgtgcccagggccggggtcgccgttgctgccgtgaccatgcccgagccggccgtggccatcgaggtcggcgaggccagcccgtgctgattgcgacgtacgccggtgcagacgtgcgtgcggtaagttgccttgccgcttgtatgatctgctcgatcggatcctctgggtgtgattccacaaattgtggtgttcgatctacgtaactacagtacgtacttgagtctgtctatggcttgctgttgtattggcttgtgagtgaggtgcttgcatgtttgcctgtactgttacttgttctcaaattaatgaagtgttcacaaagtactcgctaattaactgtactcgttgaaatatgagaccacctatacaccaagcctgcctaaaaaaacctatgcatcaagcgcataatttattttatttctgtcgattcgcccaa

SEQ ID NO: 19219 - DNA, 611 bp, Triticum aestivum
  Clone ID: PAT_TA_19219
gcacgagggagagagagagagagagagagaaagaatcaagcacacataggcatagggcatccacacattcgagaaagaaacagcaagatctcatcaaacaattgaagctgtagcaatggcggcagtgtccaagaaggctctggtaactatggctgttctggcgttggccgttctggccccgcctgtcgccgggctggtgccgtacggcgtcagcagcgggctgtgggacctgctcgacgacccgttccgggtgctggagcagacaccgctcgcggtgcagaggccggcgtccgcaggcggcccgggagcgtccatcccttcggcggtggcgctggcgaggtgcgactggaaggagacacccgacgcgcacgtcatctcgctcgacgtgcccggggtgaggcgggatgatgtgaaggtggaggtggaggagaaccgggtgctgcgggtctccggcgagcgcaaggcggacgaggagaaggagggcgagcggtggcaccgcgccgagcgcgcggcggggaggttctggcgacggttccgcatgcccgccggcgcccgcgtcgaccgcgttaccgcgcgcctcgaggacggcgtgctcaccgtcacagtgccca

SEQ ID NO: 19220 - DNA, 661 bp, Triticum aestivum
  Clone ID: PAT_TA_19220
gggtgatgctgcaggtttacagccgctcctgcgcgcatggcagcacgtggcgcgcgccgtgctcgtgcagccggacagccgccgaccggcattggcggctttgcgtgctgctggtgagtggtgactggtgagtgctactaatctcatatgggctaggcggctggccgtctcacggaaactcgaaagcacatcagggtctgcgattggcgcacggcagctgcttgtatcgatttacttttttgttgatgccttctgaagtctcaatctcccaatctggcaagtggcaaatccccatgagtccatggaatatcatacttcttcatctctatttcaattgcataaattgaaatcgacgattatatatttgtaccgaatttttatagacttgcacaaactgaattggttaaatgggatcatcatttaatcattcctaaatactactttagttgtcttttgtgaaaaatacatctctgatttcttgtaagtgtccaacttttgtgtgttaattcaagttcagtgactattctgatgaagatacaggaggcaaggacgaaccaaatcaccatcagttaggaacataccgtgtcctttttcaattttgactgcaaatgaacacctcatccaacagaagggtcaagagaaacaccctgcagcccatctc

SEQ ID NO: 19221 - DNA, 412 bp, Triticum aestivum
  unsure (1)..(412): unsure at all n locations
  Clone ID: PAT_TA_19221
gaggagaccagcagcactttgttcgccgggatgagctgagggccgcatgggagatcttcactcctttgcttcacgacatcgatggtggcaagctcaggtccgttccgtacaagccgggaacccgaggaccgcaggaagccgacgagttgagcaggaggatggggtatgtgcagacccatggctacgtatgggttccgccgaccctttctaaggtttagctgtttgattatcggctgccgcgtaaaaccacagaatgacagaacgcggggaagatccctctgtaatacgtgggtccgtgtaataagagaaacttctgcttgttgtgtgagtgaccgtttacgatatcgaaataagaaaaggatgtgatgttctatctcnaaaaaaaaaaaggaaaaaaaaaaaaaaaaaaaaa

SEQ ID NO: 19222 - DNA, 573 bp, Triticum aestivum
  Clone ID: PAT_TA_19222
gtcaagtactcaagttgtatcttgattccttattgtatgtatatacaactgtcatcacttattgcttaatatcttctgatataactattttgtagtttcactctttgaggcctattgacacttttatactatgttaattattcatgtatacagaaatcttggattcaacaatttcattttattgcgctctatggttatttagttcttttgtttgattttcagggtcttcacctttctgaaatcatagtggaatcagagaaacgtgggataacatttgacaagttactaactgttcctgagaatgatagttgggtctatgaagatggccagtcagcatcttgtatagctttcgtccttatgatgtacaaggaggctggactctttgaccctattaccagctctgttgaagttaccgaattcacagtgagtgctcctgaatccttgtgttcgaacctatgcccttatataggtatctttgtcggagcaaaagaatctggtggcgacatctgtttcgtgaatgcatgtatctcaattctcattatctaacacagtggaacgctggcctatcatttt

SEQ ID NO: 19223 - DNA, 423 bp, Triticum aestivum
  Clone ID: PAT_TA_19223
tcaaggcagttgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtaggtgaccaaggggcagaagttactgtcaaagcacctctgctaagtccaataatgtagatccatggccccatcaccgtctattgtactgtactgtactgtaccagaatgaacagtctcctgggacatgttttccaattgccatgacatgtcaaatgatcttctaccactcctgtaccagaatgctttaaaaaaaaaaaaaaaaaaaaaaaaaaaaa

SEQ ID NO: 19224 - DNA, 1127 bp, Triticum aestivum
  Clone ID: PAT_TA_19224
caaggagctgctcccctctgaaccagcaactgaagcagcttcctcgtctcatcatcgagaccagtagtacagtaagcacaatgggcgactaatctcaagtgggctcctgttctggcccttctcctcgttgctgccatggttggcagcaccagtgctggcaatatcgccgtgtactggggccagaacggcaacgaaggcaccctagcggacacctgcaactccgggctgtacgcctacgtcatcctggcgttcctcacgaccttcggcaacggacagaccccggtcctgaacctcgccgggcactgtgacccgggctccggcggctgcacgggcctgagcagcgacatccagacctgccagtcgcagggcatcaaggtgctcctctccatcggcggcgccaccggcagctacggcctgtcgtccaccgacgacgccaacagcgtggccgactacctgtggaacagctacctgggcggcagcgacggctcgacacgcccgctgggcgccgccgtgctcgacggcgtcgacttcgacatcgagaacgggcagtcggcgcactacgacgacctggcgaccgcgctcaagggcaaagggagcgtgctgctgtcggcggcgccgcagtgcccctacccggacgcgtcgctgggagccgcgctgcagacggggcagttcgacaacgtgtggatccagttctacaacaaccccgggtgcgcgtacgccaacggcgacgacaccaacctggtgaacgcctggagcacgtggaccagcagcgtcacggcggggagcttctacctcggcctgccggcgtcgacccaggccgccggcagcgggtacatcgaacccggcacgctgacgggcgcggtgctcccccctcccaagggcgttggcctgcgcggcggcatcggggtgggcccccgcttctacgtgctgcagacctaccaccgcgcccaggggccgctcagcgtctgcccagcctaccttgccagcatcgctaccctgccatacagtggcggggcttccctcttgttactatcggactagataaaataagagcgcgcgtatcatacagtttgtgttatatatacccaatgaataaaacttgaccttgcaaaaaaaaaaaaaaaaaa

SEQ ID NO: 19225 - DNA, 173 bp, Triticum aestivum
  Clone ID: PAT_TA_19225
ttattgcatgtaatccccaaaagactgtagtgtggtcttagctataacctcattaagcattcccagtgtctgtgggaggaagccgcaagaacttccccttagctgtcaactgaaaatttcactcctaggtgtatagtttgatttaaaaaaaaaaaaaaaaaaaaaaaaaaaaa

SEQ ID NO: 19226 - DNA, 677 bp, Triticum aestivum
  Clone ID: PAT_TA_19226
cacgaggccggatcgcgtctctcccatcctctcgcgcatcctcctccgactacctcggttgggttttgggggcggctggagatgtcggactccgaggagcaccacttcgagtcgaaggccgacgccggcgcgtccaagacctacccgcagcaggctggtactattcgcaagaacggtcatattgtcatcaagaaccgcccatgcaaggttgttgaggtctccacctccaagactggaaagcatggacatgcaaaatgccactttgtggccattgacatcttcaatgggaagaagcttgaagatattgtgccctcctcccacaactgtgacgtcccccacgtgaaccgtactgactatcagctgattgacatttctgaagatggatttgtcagcctcctgactgaaagtggaggcactaacgatgacctgaggctccctagtgatgaggctctgcttactcagatcaaggatggattcgccgaggggaaggatctgattgttaccgtgatgtctgccatgggtgaggagcagatctgcgctctgaaggatattggccccaagaactagaataccttgttaccgtgtttggctacctgtctggtcgctttaagtttggagctggtcttgagattatatataaacttttgatttgagcgtaagttaagaagacatatggg

SEQ ID NO: 19227 - DNA, 703 bp, Triticum aestivum
  Clone ID: PAT_TA_19227
tgagtagagcagcagtatggcgtactactcggagtccggctactgcgcggaggaggcgaggaggccgtacgccgagccggggttctgccacggtgagggcggcggcgagcgctacgccgtcgtccgcaaggagtacgaggaggtagctagacgagttggcgcgcgccggcagaggacatcactacggccacggccacagcggcagcggccaccagcaccgccacgtcgtccatgccgagcacgagggatcatgccatggtggctacctcgggctcggggaagaacaccgtgagcagcaccaggtgcacgggcatggccacggtgggcgccgcctgtacgacgcctgcgagagcaagcgctacgactcgtgcaccggccagtactacgcttgagcacgcatcatcacgtattgccatcatcgtcagggctctctctgcgcccctgcctgacacactgggcgctatatatacgtaaggctgaatgcatgcatcatctcacgtagtgtgtgtacgtgtgtgagtgtgtgcacgtacgactgcacggtcctactactatgtatgcattgtacacgtacgcatgtacttgtggtagcgtgtgcatgcatgccatgctgatgcaccccttattatgtagtaaagaataagaccgtgaagtaaataaaggaaagggcccgcatgtttattgttaaaaaaaaaaaaaaaaa

SEQ ID NO: 19228 - DNA, 819 bp, Triticum aestivum
  Clone ID: PAT_TA_19228
ctcccgtctctccgccgcttgcttggaagacgaagaaaccctccccccaccaacccaatccagccacatccgggcccggtgcactccgccgcctggagcagttcgccgccttcgttcgcatcccccaacgcggttcgatcccactggcaggaaggagcgtgatggccaagacgagctcgttcaagctggagcaccccctcgagaagaggcagtctgaggctaaccggatcagggagaagtaccctgacagaattccagtgattgttgagaaggctgagaggagtgacattcctgacatcgacaagaaaaagtacctccgtccctgctgatcttacggttgggacaattcgtgtatgtcgttaggaagagaatcaagctcagtgctgagaaggctatcttcatctttgtgaagaacacctcttccaccaacagctgctctgatgtcttcaatctatgaagagaataaggacgaggatgggttcctctacatgacttacagtggtgagaacaccttcggtctgctctagatggatggcgcaacaccacagctcaccgcaatcgggtcgccttgcccttgcttccctaccaatgccctgcccatgcggccatgcctcctgtaaataaggcctgccaagcaactgtgtatattctggtttcctcgttgcaagtgactgcactctactgctaaaacctacctatcagattgtcatcgatgtaatggacatcctttaaaccaaaatcaatggaccaaaaaaaaagaacaaaaaaaaaaaaaaaaaatgttgacatctcctatgtccgtttaaaaaaaaggggggg

SEQ ID NO: 19229 - DNA, 973 bp, Triticum aestivum
  unsure (1)..(973): unsure at all n locations
  Clone ID: PAT_TA_19229
gtgcatgaaatgatgctgaatggtgttttacaagttcataagccgcccattaattttgcagcctatggagagggcatcctccttacaccagcaaatcgttctgatgcctgtgtgaaatactctgatgttgatgaaaatggcattgtccatatgatgttgtgccgtgttataatggggaacgtagaaatagttcaccctggatctaatcagcaccgacctagtagtgaccattttgatagtggagtagatgaccttaaaaacccacaacattacattgtgtgggatatgaatatgaataggcacatctattctgagtttgtagtcatcgtcaaattgccttctaaaaccaaagattccttcgtgtctcaagaagagtgtcagaattcatctgatctgtcactggtgttgaattctagttcacctgactgtatttcagaggagatgaacctggaggcacctccagcattgggaggtggatgtgcagcccccatgctaggagattcgatggaaaaggctccaagctcaccttggatgcctttctccatgctgtttgcagcgatctctaccaaagtgtctcctgagaatatggacgtggttattggttgctatgaagagtttaagggctggtacacttgccgcggcgttcgacctgaggtcccctgccctggtctgggtgccagagtcccttgttgactgtatttgccagagcaagaaaataagccgaggtgaactagtgaagaagctgaggcatgtagttggtgatagagtgctaatatcgacgataatgcgtctccaagataaggtgtgaattgttctgcttgaaccttgctgatacagttatcttgggattccttttggaagactgaaatccttttagccgtaaggtgtgtcagctggtgggggttctggggatggaccgccaatccggcaccaccgaacttctgaanggctatanctttgctgtgaacaacta

SEQ ID NO: 19230 - DNA, 780 bp, Triticum aestivum
  unsure (1)..(780): unsure at all n locations
  Clone ID: PAT_TA_19230
tttggctttagccgccgcccctgctcctcccacatccctcaagcagacgcctgctcctcgccgatcgatacgatgtcctccttctccgacacccccaccgccgacggcctccactcgctccacgcccaccgcgcaagcaatatgtatgtggctggtgactccattactaaggatgacattaaggtcttcgccgcggtgccgtcgaagcctggcgctgagtttcctaatgccgcccgctggtacgagaccgtctctgcggctgtagcctcaagattccctggataaggctgttggtgtaaatctgcctgcgggatcacgctcctgcggcacctgctcctgcggatgaggctgaggatgatgatgaccttgatctttttgggtgatgaaactgaagaggacaaagaaggcagctgatgagcgtgctgccgctgccaaggcctcttctaaaaagaaagaaagtggtaaatcctccgtccttatggatgtaaaaccatgcgacgatgagactgatatgaagaagcgggaggaggctgtccacatggggtctctggtgggtagcataaaagcttgcccctggtgcgtaccggatggatacgattactataatggtctatcttgtcgacaatcgtcgaccatcctctgtcattctcacttaaatcaggacaaatgacccaatcccctcgagagttcccacattcgacggtgcctccccaactaaattcggttcnattggcaangaacgtacnncaatttcnngatcattacctcancataaaactt

SEQ ID NO: 19231 - DNA, 800 bp, Triticum aestivum
  Clone ID: PAT_TA_19231
cgtcgcctacgtcatcatcgccgcgtgctacttgcccgtcgcgctcgtcggctactgggccttcggcaacgacgtcgacgagaacatcctcatcaccctcaaccggccgcgctggctcatcgccgccgccaacatgatggtcgtcgtccacgtcgtcggcagctaccaggtgtacgccatgccggtgttcgacatgatcgagaccgtgctggtgaggaagtactggttcaggccgggactcaggctccgtctcatttcccggactgtctatgttgcgctcacaatgttcgtggccatcaccttccccttcttcagtgaactgctcagtttcttcggcggattcgcatacgcaccgacaagctatttccttccctgcatcatgtggctcatcatctacaagcccagaaggttcagcctctcatggttcaccaactggatatgcattgttattggggtgctgctgatggtgctgtcaccgattggaggactcaggcagataattctgaaaatcaagacctacaaattctaccaagactaccctagtttaagccaggcgccatcatcagctaaaactagtttctgaatctgatcgatgccatgaaattcctccttttttttcagggtaagatacatgtacagtcatgagtcatgatgatccgtgacctgctgtggttctgttaattctgtctcgaaccacgagatggtttgggattaaacatttctaggggaattgtttgtttgtgtaattgtgttcagtttggacttggaccttgagaaagatgtctgggccttatcacttg

SEQ ID NO: 19232 - DNA, 704 bp, Triticum aestivum
  Clone ID: PAT_TA_19232
acaagaagaggaagagcttggcgacgatggcgagcggcagcatcgtgaagaaggaggtcggcgagaaccacgacgtgctccgcttcggcgtcaacaacagcgtcaagggcgacctcgcgccgcagcacccgatccaggccaccgtccacaaggaggccaggttctgggcggataagaagaggttcggggcggaagccatctacggatctgctttcaacatccgcaaggatctcaatgcccaaatcctctccaagttccaaaggccccctggtgcattgccatcatctatgctaggatacgaggcgctgactggttccttggatgatttcgggtttgaagattatctcaacttgccccaagattctgacagcttccatgctccagacatgcaccacggaatggaggttcgccttggtttgtcaaagggaccgatttgccctagtttcaattgatttcacaaaatgtatttctcgtcttgcactgttctcctcattcaatatctatgtcgctctttagactgagatttcgatgcttgttttggttcataaccacacttgtgacgagattccttatccatcatgtagacctcacatgtcattgagataaaagagtgtgacaagagtgtctcatgctagctaaagtgtggctccaattttgttagccacacattaggcaagtttgtcaaaaaaaaaaaaaaaaaaaaa

SEQ ID NO: 19233 - DNA, 573 bp, Triticum aestivum
  Clone ID: PAT_TA_19233
ggcacgaggcaatgagttgcaatactgtaacgaggtggcctcagaactgaaatcaagagggttacgtgttgaagtctgtcatggagagcgcctaccaaagctaataaggaatgctgaaacacaaaaggtgccactcatggcagttgttggccctaaagaagttcaagccaggaccctgactatcaggtccaggcacaatggggagatcggcacaatgcccgtcgacgaattcatcacgagacttcaacttgctgtcgcaaacaaatcatcgttatagaccgttgttccactaaatttcagtccggtatgtagaacattagatcctttacacatagatctgttccatcaaagtaaaataacagctaaggtctgcagaagcaggtccaacactttttttgtgcatagcatagtccatagttgccatcagtcatcataggttacagaatatctctcttaccccccccccccccccccacacacacacacacacaaaagaaaaaaaactgctctctacgttttggctgaaagagatgcttttagttaaaacgcaaaaccagcaacaaaaaaaaaaaa

SEQ ID NO: 19234 - DNA, 452 bp, Triticum aestivum
  Clone ID: PAT_TA_19234
aatcttgaagttcacagatccaatggctgatgatatggcagcagcaggagtccatgcggccaaaatgttgacacctggagcagcgatgtctggctgcagaagaaggtgcagggttttttcagccaagtaggaaaggcactaatgtagaagtttgatcaactgttgaactggaggagattttttaccttcaggacagagggggacagagaacttggaccccgagatgagaaatatgcaacttctgggcctatcagttctccaagaattgtttttgctgagccaaactgaactgttgggtttctgtgtatgaaaaatagaaattattggaagttgctgataccaacagcatattgctagattgttgtaactgttgaaacatgtgcggcactgtttgcatacctcatgctagtagtgtatgcaagtatagctgttccaaaaaaaaaaaaaaaaaa

SEQ ID NO: 19235 - DNA, 517 bp, Triticum aestivum
  Clone ID: PAT_TA_19235
tgtttcaccactggatacaagcgagatctaccacattgtggagatccagttgaatcgggttaagaaccggctgaaacaacagaagattcatctccaatacactacagcagccgtcgagcttctggggtctcttggctttgacccgaactatggtgcgaggcctgtcaagagagtgattcagcagatggtggagaatgagattgcccttggtgtgctgaagggcgatttcaaagaagatgacactgtcctcgtggatgtaagttctgcggcgatcgcaaaaggacttgccccgcagaagaaacttgtccttcagagggtagaaaatagaaacgaagagttagttgccaatgactaggtcaggggttcaccttttagctagaaaatgctccagtgagaagatacgcagctgttagctctgcattttcgcgtctgacaaacttagcttggccttttaagttcgtaccttatgaagtgtcgtgtccagtctccggtggcaaaactcaacttgcaaatctct

SEQ ID NO: 19236 - DNA, 824 bp, Triticum aestivum
  Clone ID: PAT_TA_19236
gcctctcccccctctcgccaaggctgctaagctagtcactgtatggacggtggttcctgtggtctcgagggagtgccggtagtcacattctggcggcaactctccatccagcgctggtatcccgcttctgccagagaagcgctgtggctcgtttcctgaaacttgtggagccgcggggggcagtgctggccctgaaggtgtgccagtggtgacatctgctgataactctccagcccacgctagtattccgcttccctgtgattccgctgataaaccttgtgaagccgcagcgggcagcactgctccgttggaggctcagatatgtacgggtttctccaattcgatcagcttggaagtgaagaaaggcctccagaagtgcgcgacgttcccacctacatctggtcaggctaagcaggaggatggttcatgctgctatgcagatgatgggctcaaggctgctcctgcttacgagcgctctgtgtccttacctcagccaactttgaagctcatccctgctatgaaaggaggccgtgaaaagaatggaatagcatcaccaacagaaaatcgccatgtcaaatgggctcctgatgtgtatgaccccccggtgacatcggtatgccattcagtgactaacagctatcagcgccggtcaaaacaccgcaagaaggagaagaacaaacagaagaagaaacagaaggggaagtcaaagaagaaccaacagagttctacccagaatccatctgcacctcacgttcctgatcttgggttgaaaggtgttagcaccactggtggccagtcttcagtagacgatctgagcaaacatg

SEQ ID NO: 19237 - DNA, 705 bp, Triticum aestivum
  Clone ID: PAT_TA_19237
gaggcaaaagatgtccttgttctttacagtgtcggcatctacactgacgatgagctcggagcaatggtggatcgcatggaatctgccaaactgaggactgttaaccttactgacaatgatttggcaaaggaccaccttagatactttattggaggcagatcagaaataaaagatgaactggtttaccggttcattttcccggaaaggcctggagccctcatgaaatttttggacgcgttcagccctcgttggaacatcagccttttccattaccgtgcacagggtgaagctggagcaaatgtattagttggtatacaagtgccgccagcagagttcgatgaattcaagagccatgctgagaatctcgggtacgagtacatgtcagagcacaacaatgagatataccggttgctgttgcgtgacccaaaggtctaatgtcatatggctttgctcccataagttggtgacacttttcaaggaagattctgctacaaggtagaaggtgcaagtttcttctaaagttgaaatgaagccatcagcaaatgtagcttcagtgtgccatctgtttattcagatcatgtagtgtatcagttgtgtatcattattgttgttgtgcttcgtgatctcaatttatcgggttgtggcacctagggtttgtcaaataatgataaccaacatgttatctaaatatctgataataattat

SEQ ID NO: 19238 - DNA, 1033 bp, Triticum aestivum
  Clone ID: PAT_TA_19238
ttttttttttttttttgattatgaaaaatgctatttttctttggttaattatgaggggtttcctcgtactgtggcaatccctcgcgatagtttcacaatgcaataacccgatcataagatgaatacatgtatgtacagtaatctctatatttctgaacaaactagcagaacagctcatattcaatcgagtggtatcgctacgctgcttggagtgtgcatattgagcgcctcactggaatgccccttgtttacacaaagggagtgttcatcttgagctcctcctagcatatgccccctgaatcttccgggtattaaattgatgcctggttggagggtgttaaattcttcaggacccacgttaattacacaggtaaacgtataccagatcttgtcacttccagcctgagttcaggccgcagtacatgggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgggccgtggcatgctggaggtgtctctgtttaactagtagcgaagaaaatgccgaatactgttgactgcttttcttttgcgaacctccgcagcatgtgtaaactattttgcttattcactgatctgatgactagtccgcgattggctttctgttaatcgcgtctgctgtattcatattctgttgtgtaaaaaaaaaaaaaaaaaaaaaaaaa

SEQ ID NO: 19239 - DNA, 798 bp, Triticum aestivum
  Clone ID: PAT_TA_19239
atgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggcccggctcgatcaatccccatattctgagttaatgtcatccgcgcattgggagaagctagctgaggagctcacccatcaattctgcagccttctgggccagtctagggagagcccactgagtgttgcagtgtcagctggttttcaaggactaccaactctgctgaagctgacacaagtcatggctgcgaagaagcaggagtggcaagttatgaagcagctccctgtccccttagacctcgcgccagtctttcagccgccctctgtcccggggcgccccgtcctgcgcgagccccccaggggtgcgttcccccctacgccgctgccgtgtggacatgttgtctccaagcagtccatcatgaagctgtcgaaaagcagctcaaggcccttcaagtgcccctactgcccatcggaggctgtggcgtcgcattgcaagcagctgcatttctagatgtgctaatcttttctggctgcgcaaaacggcaaacctgttgttagcttcccctcctgttccctgttgcaccagtccaataacttatgtgcctctgtaatata

SEQ ID NO: 19240 - DNA, 638 bp, Triticum aestivum
  Clone ID: PAT_TA_19240
ccttgacgacctcacctcacaggtaaatcagctgaaggaccagaacaagcagctcagcatggcactgagcataaccagccaaaaccttgtggcagtgcaagcacaaaactctgtccttcagacccagaagatggagctggacagcaggctgggcgccctgacagagatcctctggtacatcaactcaagcaccagccccagcactgctcctgcagatccagccatggtgaacagcttcacaacatggagcagcgcctctgatattcttggcgccaacgcatggaaccagcagcagcccatagacctgtaccaatgcttctagctctagctctagaagatggaaggtggctgtggcatatgacatagtggtagggccagggggaaaggaggcaggcagcaggcatcaagtttctgttcaatcatgtagggcctttgtgtcactattgatgtgtgcttgatgcttctcccttgattgtttattttggaggcgacggcgatgttttggttttcttgctgctgttggtagagcctaaaggatggacaaatgacaaagtttgtcttggctttgtgtgacgtgaaggctgttgttctctggtacttgaggagtatatatatatataggggaaataatattgggc

SEQ ID NO: 19241 - DNA, 614 bp, Triticum aestivum
  Clone ID: PAT_TA_19241
cgaatacaggggagaaagagattctacgaatcataccaacatgccgccacaactttcaccttgcttgcttagatttatggttgcaaaagcagacgacttgcccaatatgccgggtctcactgaaagagctgcaggctgccatgccatcggcacgtagtggccctcaactcccggcggatccagagaattctgataacccagcacctcagtgtttcctacctgctcgtcaagatcgcagaggtcaaaatcatagccacgaggcacgcggatcagtagaagtggttattgaaattcgacggtgaatagacatttgacatgactatagaaagcgaagtgacagaggcaaatgtggaacatttcctgtatctagcatcggcattttctgcagggctgttgataatcaattaatcatgtcacccgcagcattgtcacggtatcatgatgtttgatctcccaaatcctttctagatgaaaaagtgtacgtacgtttcgcgtagtaggtcatcatgttatattattgaattgatcaatctgtggcctttgagttcattttgatgtgacgatgaatgttgtaacttgtaaatattattggtgtcaatactgaatcttctata

SEQ ID NO: 19242 - DNA, 1162 bp, Triticum aestivum
  Clone ID: PAT_TA_19242
atccccttgcatacgtgcggacgctccgctgccaccggcactgcccccctccgccagcctccaccaatgccgccgcccagcggactcaccgcctcgccctcgtcccccgccgcggcgttcgccccccggcgcggccccccccccgccaagccccgcgcccgcgccgccacctacgcgccgcgcgcgcgtgagccgcgggcgacgccgcgaagcggcgggggaggagcgccggcccggacctgcacgcgcgcgcgcgggaacggggaggtcgggggcggcgacgggtcgtgctcagggagcggcggcgatctcggcccccggcctcggcaaggagcagaacgaggtgggacgcccccccgaggactccgggggggagcgagtgaccaggacccggccgtactccgccctgaacggtggcagggggtgccacctagccggcggtgcacagccccggggagatgccactcgtccaaatgcagcaggaagaggaagagcatgacaagcgtgcacagcacctggaaggacggcatcgggaagaggagaacatggtccaggaagctcaagttgttgaaccacctatggataatcctcaaaactttcaacggcaaaggcaagtagtgcgccacttaggagagaaagtggagaagcaaccagacgttggagagaagttacatgatctcaatcccaaagtggcaaagctactcttggaaacaagcgaatatgggttacctcttgatcaggcgagcaacatgccgccttgggtgtcgctggatgcatcctttatgaatattaagtgagtggaggagaaatacaaaggtcttctaggtgatggagctggagtagcccaggacttccagtctctgggagaacaaatcactcaaatgaagggagtctctgatcctattaaatgctgttgcggactggagtacaatgtagaactaggcggggagtccatgggtgtaagataaactcagccgcagattgccacaggttcagtgcgtttaaagtatgtatatgcacagctggcgtaggctgcgcttgggcggtttatattttccacctgtattaatctacaagggcatttttctgtgcacacctgagatacgagtgtaacgaaaacacaattgtaaaattctggatttctgcttggatagcatcgtag

SEQ ID NO: 19243 - DNA, 973 bp, Triticum aestivum
  Clone ID: PAT_TA_19243
ttggaagatcaaggcctgaccggagtggctggggaaaaccagaaacaaaatataccaaggatgggcctggtgagcctggagggcaatcatggacagttgagtggttgaagtttgataacagttacttcaaggacatgaagtttttgagccaacttccctcggaagagcagaaggaacaggatcttctagttttgcccacagatgctgcattatttgaggacccatcattcaaggtatacgcggaaaagtacgcagaggaccaggaagcgtttttcaaagactatgctgaagctcatgctaagctgagcgatcttggttcaaagtttgatcctcctgagggattctcactggacgatgacatgagcactgcacctgcagacgaaaagacggaagaagatatctcttttgcagtggcaccgtcaccagtggctccagaacctgaaccagcagcagaacctacaccagaaccagtagcagcggcaataacaacagcgacagccgatgacaacaacggcgcagctccacagccggagcccttcgtcgctgccaaatactcgtatggaaagagggagctgtcagagtcgatgaagcaaaagatcagagcagagtacgaggggttcggaggcagcccggacaagcccatgcagtccaactacttcctcaacatcatgatcctgatcgcagggctggcgttcttgacgtctctgggcgggaactgagtgcgatatcatcgattcctgaagcctacgactgtccatattttgcaaactccgtaagcatatgaaacatatataaacggcatgcgaccaagtggctagcatcagagctacgtacactgtgtaaacagtttttcacatagcaagtgtttgagaaatagtgacctgactatcagcactctacatatatgatttatttactatgaaacagtgaatgtatagatattcacaaatattctctgtgcacccatatactt

SEQ ID NO: 19244 - DNA, 478 bp, Triticum aestivum
  unsure (1)..(478): unsure at all n locations
  Clone ID: PAT_TA_19244
agagcagcgagagcatggcggccacgagctccgcggcgctcttctccgtcctccccctccccacagcctccccggcctacgccagggcaggcagcagccattacaggcccacgcgctccaccgcggccttgtcccccatcagatgctctgccgcctcgcccgacctttcgcccggcgcaccggcgccggcgccgcccaagccccaaatcgagctcgagttcctcgggccgaagccgggcgccgacgggtcgtacccggtggacagggcggcggcggtcagcggcgacaagctcctccgggacgtcatggtcgagaacaagatcgagctctacgcggcatacgggaagctgatgaactgcggcggcggcgcagctgcggcacctgcatcgtcgaattatcgacgggaagaagctttaacgcccagaaaaccccagaacctttcttaagaaaaacggatcatngngtaacttccaaacat

SEQ ID NO: 19245 - DNA, 795 bp, Triticum aestivum
  unsure (1)..(795): unsure at all n locations
  Clone ID: PAT_TA_19245
aacggatgcaagccaggatggaggaagtaaagagaacccagagaacaatcctgattgcactactgtatatgttggcaacctcggacatgaggttaaccgggatgagcttcaccgccacttctatagcttgggggtcggggcaatcgaggaaatccgtgttcaacaggataaagggtttgggtttgtgagatatagcacccatggggaagcagcattagctattcagatgggcaatggattggtagtccgtgggaaaccaattaagtgctcatggggtaacaagccaactccacctggcaccacctccaagcccctaccccctccagttgctccataccagcctgctgtagcaatgccaggtgtcccgcaaggtttcacagcagccgaacttcttgcttaccagaggcagcttgccttaagccaggctgcagccgggcagattgctggccagcatggtctcgcgggtcaggtttctgcaggtcttcttgctgctgctggttctcaaggccctctacgatggctacccgaaccatcatcagcccagcagcttatgtactacaactagagttcaaagaggacggcgtttggcatcgtcgccctgtttttattttgtggttcatgtactatttgtgtgagagttcttgatcncttgtcgccccggattgtgttacnanctaattacngtacattgacattttcctggtgaatcattttagtatcncttttacagagtaagaatgtatccaagtgacttcccatgataagtaanctcccngncatcggntggtcctnggc

SEQ ID NO: 19246 - DNA, 751 bp, Triticum aestivum
  Clone ID: PAT_TA_19246
gcacgaggctcttattaaggaaaagaacaggagcatcaaatgctttttaatggaccctcctggatctggtctgttcaataaggttaccagaggggtgatgtacacaaaagaggaggctgagggaaagcggcttaagaacccttttgatactattactgaaggaataggaatcaatagggtcactaaaaatttcatgatggcggaactggatggagcttatcgcggatcagatagggaagctgttgagatgtcaaggttcttgctgaaaaatgatggactatttgttgggagttcttcagccatgaattgcgttggcgctgtaagagttgctcaagatttgggtccagggcatacaattgtgacgattctttgtgacagtgggatgaggcatctaagcaagttcttcaatgagcagtatttggctgatcatggattgacaccagcagctactgctctggaatttcttgataaatgagcatttcacaggcaattttcagtttcagggaagttggcatgctccctcttactgcgatgataccttgacacaggctgaacactggataggtgaaagcatgaaaatatgccatacagttagtgaaccctaatggatgaagcattgatatatgctaagtactaattgtagtctactaggcattgccattggataggattgggatagccagcgttttggcttttgttttgatatatatctattgaggctgttaccagttagaatgctgcactgagcatc

SEQ ID NO: 19247 - DNA, 882 bp, Triticum aestivum
  Clone ID: PAT_TA_19247
tttgtaaaactccttagatctgtcaagagggaaacattgaaattgattgagacttttgtggacaaagctgaagatctaccacacattgggaaacagtttgttcctcctatgatggatcctattcttgctgactatgctagaaatgttcccgatgctagggaatctgaagttctgtccctgtttgcgacgatcataaacaaatacaaaggtgaaatgcttgaagacgtgcctcgcatatttgaggctgttttccagtgcactcttgagatgatcactaaaaactttgaagattacccggagcatcgcctcaaatttttctctttgcttcgtgcgattggcacccattgcttccaagcattaattcagctttcaagtcagcaattgaaacttgtgattgactctatcaactgggcatttagacatacagagagaatcatcgcagagactggtctgagtctattgctggaaattttaaagaactttcaggcctcaggattccaaaatcaattctacaaaacttattttttgaatattgaacaagagatctttgcagttctgacagacacattccacaagcctggtttcaagcttcatgttttggtgctgcagcacttattttgtgtggttgatggtctgacggagcctctctgggatgcatcctcagtaccataccaatatactgacaacgctatgtttgtccgagattacacaataaaacttttaggttcatcatttcccaacatgacacctactgaggttacaaaatttgttgatgggcttcttagttcaaaacatgaccttccaagcttcaaaaaccatattagggatttcctggtgcaatcaaaggagttctcggctcaggataataaggatttgtatgct

SEQ ID NO: 19248 - DNA, 353 bp, Triticum aestivum
  Clone ID: PAT_TA_19248
atgtttctaagcttcatagctgttgccaaaatcccaatcattccttcttttttgatgaggatacgttaaacaaaatatctttaaacttcattccttttctagaactgtccattccgagtttttctgttccctttcagttaatcttctattttttttcatcagtttaacttgcaagaatctcaaacttcttgtacgtttacctccttccacatttcttttcttcctctacaatgaaagaattttgtaacgcttcttcatgacatctttgaatattttatctcctcaccactagagaaggttcaattaattgaaataaaattaattgcttcttagataaaaaaaaaaaaaaaaaa

SEQ ID NO: 19249 - DNA, 498 bp, Triticum aestivum
  Clone ID: PAT_TA_19249
aagctagatcaataccacatctgtttgagggaaaggatgtgatgggcgcagccaagactggctctgggaagactcttgcattccttataccagctattgagctgctctatcacctgcgtttctcatcgaggaatgggactggtgttattgtggtttgcccgacacgggagcttgctatccagacacacaatgttgccaaggagttaatgaaatatcactcgcaaactcttggatatgttattggtggtaataatcgaagaagtgaggctgatcagcttgcaaagggggtcaatttattagttgctaccccaggcaggcttttggaccatctacaaaataccaagagtttcatatacaaaaggctaaagtgccttgtaattgatgaagccgaccgcatacttgagcaaaattttggggaagatatgaaacaaatatttaaacgccttccccagaataggcagactgttcttttttctgctacgcagactccagaggttg

SEQ ID NO: 19250 - DNA, 946 bp, Triticum aestivum
  Clone ID: PAT_TA_19250
tgaaaaagatttactacaggaagagcagtctattttgtgggatctgaatgtcggtcttgaacctttgtggcaagagttaagtgattgtataagtgccacagaggcaaaatttgtacacaattcatcactcgcttcccatgccccattgatggatgctttagaagttggggcttcatcctctggttcatcttcgcttcctccaggcactcaacgcttgttgccgttcatagaatcgttctttgtcctatgcgagaagcttcaaacaaatcaaccagttacactgtcggattacagtgttactgcccctgaagtaaaagaatctgctggaagttcatcttcaccatcattgaagactagtgggatctgcaatgttacttttataagggttgcagaaaagcatcgacggctactcaatgtttttattcgacaaaatcctagcttactggagaagtcactttctatgatgttgaaagtgccaaggctgatagattttgacaacaaacgtgcttacttccggtcgcgaatcagacaacagcatgatcagcatctttcagctcctctacgcattagtgttcgcagggcttatgttttggaggattcatataatcagttgagattacgtcgtacccaggatctcaaaggtcgtttgactgtgcaatttcaaggggaagagggcatagatgctggaggactaactagggaatggtaccaactgctctctagagttatttttgacaaaggagctcttctcttcactacagttggaaacaacgcgactttccagcctaatcctaactctgtttttcaaacggagcacctttcttacttcaagtttgttggtcgagtggttgctaaagcattatttgatggccaattgttggatgtccactttacccgttcattttacaacatatcttaggtgctaaagtaacatatcatgatatag

SEQ ID NO: 19251 - DNA, 711 bp, Triticum aestivum
  Clone ID: PAT_TA_19251
ggcacgaggagaaggactacgccgcgtgcagagatctggtcctcgtcgaggatccggaggtggtcgccgtcgaggatccggaggaagctgcagcaaccgcagcacttcaggaagaaatgaaagcgcttgtggcatcgatccctgatggtgctggggcagcattcacagccatgcagcttcaggagctagagcagcagtcccgggtgtatcagtacatggctgcccgagtacctgtgcctactcacctcgtcttccctgtatggaagagtgtaaccggtgcatcctctgaaggcgcccagaagtaccctactttgatgggcttagcaacactctgcttggactttgggaagaacccagaaccagaaccagggaggtgtcggcgaacagatggtaaaaaatggcgatgttggagaagcactatcccaaatgagaaatactgtgaacgtcatatgcaccgtggtcgcaagcgtcctgtacaggttgtcgttgaggacgacgagccagattctgcttcagggtcaaaatccactcctggcaaggctaccgatggtgccaagaaggctgacgacaagagcccaagtagcaagaagcttgcagtggcagcaccagctgctgtgcagtctacataattgatgcagcattagtagtcgcagaaagagcataacagcgctggcaactagcgccttcttcttattgcatgtaatccccaaa

SEQ ID NO: 19252 - DNA, 944 bp, Triticum aestivum
  unsure (1)..(944): unsure at all n locations
  Clone ID: PAT_TA_19252
ctgagtctcccgagaacgcgaaagcctccggccgtgggcgccgacccaccaggtgaaggatgatgatgaacttcagggactggatctcataccggctcgggtcgtcgctgctgtcggcgaggccgttcgccatctccgggtccggcgccggcgcctcccagggcgatggggaaggtacaacacaaagtgagtttgtagaaaccgtatccgccaacagatttccttccaatgatagccgtgcactagaggtcgtcacatccaacccacaggatgctgtttcctctggtcttcttcagccagatcatgatcacaacaagtcagatccactaaagcaagttgaggcacttcaaattaagtttttgcggctggtacacaggactggagtgcctcccagtaccaatgtagttgcacaggtactgtacagactgcagcttgccaacttgatcaaggctggtgaatcagatgcgaagacaactaaccttgctatcaacaaagccagagttatagcagcagaacaagaagcacccggtggacctgatttggacctccccttgcgaattcttcttctgggaaagactggtgtgggaaagagcgccacaataaactccatgtttgatgaaacaaaggttgctactaatgcacttgtncctggtactantaggataagagggttcttggaanatntcaanggagtaagagttccagttcgancactgttctgtactcatacagcagcancggagaacaggcagatngctgctgcagcgtcataangaaacggctgantcgcgtcantcgnccggtgaccattacnnagnggaccngcgganctaataacgggtcacgacaggcgcancagcactcgagagctgnagctcgnagtcgctnctcgangagcnncnnagncnaancaaannacancnnaangnncacnnnnnannncg

SEQ ID NO: 19253 - DNA, 877 bp, Triticum aestivum
  Clone ID: PAT_TA_19253
ccatcatatagaagagagtagaactccaaatacgtttcttggacataaacaaggactaggaattattgatggtgccctaaaaaaggcatagcactactagacgcaattctagtggtagaggcatgaaagaaagataggagaggtctcacatggtagctatggaacaaactaaagaaaaggaaaggtgcatggataaaattagtagtgtcatatggagcaagaacatggaagattggagcttcatgaaatcccactgcgcctcttccttccaaaaaacagaagagacatcaaggagagatcataatgttccttgcagaacaccagaagcaagagtagagtgagcctgtggttccttggtttgtctacaaggtgaagcaaaatgcatccactgcaagatattgctatcctacagatatttcacacatggatagctgccagataatcagatgcagacatctaagcatttgaacagtactaagacactatcataccctgccaggcatgaactaccaggaacaaggacagactacgactaaaggttaatgatgtgagaccatggataatggtgatctaaaacctaaagaaggaatacccaaaaggctgaaagaacattagtaacatagaggtgagcacaagctacaaaggctacccagaaactgctgtgctctcatccagacaaccaacagtctcaccaccaagtcattcaccgcagtttcacgctgccatgcatacttgaggtgctttgcctgcctaaagtacctcctgttgatgaactatgcagaaccaccatccaggtgaaagatggccattctcggttactctatacacactaccaaggttagtttgcagatagcctatgtacaaggacctgcccatc

SEQ ID NO: 19254 - DNA, 686 bp, Triticum aestivum
  Clone ID: PAT_TA_19254
tcggcacgagggctgatttaaatgttgccattgctgaaaaggctggagagaaatcaaacgatgaagtgaaaagtcagctatctcattttcttccaacttctcgccggatcatgcagttttcaaatgggcaggctccctcgccaggtgctcgtgttgtctatgtagatggtgcatttgatcttttccacgctggccatgtcgagttcctcaggagcgctagacaacttggtgacttcctacttgtgggtgtctatgacgaccagtctatcagggatagaagaggctgtcgtcctataatgcatctccatgagcgtactcttagtgttctttcctgccgctatgttgatgaagtcattattggtgcgccatgggaagtttctaaggacatgatcactacgtttaacatttcattggttgtccatgggactgtagctgagggcaattcagctggtgaaattgatccttatgctgttccaaagagcatgggcatttttcagacaatcaggagcccaaaatctataacaacattgtcagtggcgacaagaatagttgacaatcatgaagcttacaagaagaggaacttgaaaaagaaggctagtgaagaccggtactacacacaaaagaaatttgtttctggagactagtgctgcacatatttctgccagtagtcttaggaaatgcatgcg

SEQ ID NO: 19255 - DNA, 688 bp, Triticum aestivum
  Clone ID: PAT_TA_19255
aacttcagcttcagcgacattcttgcccttcctggtgaatgcttcgtttgtgcttttggtggcctgctcctcctagctggtctgggcatgctctgctggattgaccaagatgatgggaggcactcctttggccattccggaggattcatctgtccattcgttcccttgctgccggtaatgtgtatcctcataaatacatacttgttaatcaatcttggtggcggccccggggtgcgagtggcggtgtggctggggatgggggtgttcgtctacattttctatggccgcacccacagctcattgacagatgtcgtgtatgtccctgtggctgaggcgaatgagatatatgggtcaccctcttcatcagggtttgtggcgtaaagagagatggagatgtttgttgaagcctatcttgagctagtcagggtacttttcacagaacctcaaggatcctgactttagcagattcctgcttgagctatcatacgcattgcagggatggatttgaagaattcaatttgtacgtcaatttttaaaatgtgtaattgtaatgcacaactaaacttgtgtgcctctgttcaaggaatgtaaatattacatagtagaacaatatattatagatggtgccagtatagaggtatttgaaaggggggttcagtcaaaaaaaaaaaaaaaaaaaaaaaaaaaa

SEQ ID NO: 19256 - DNA, 501 bp, Triticum aestivum
  unsure (1)..(501): unsure at all n locations
  Clone ID: PAT_TA_19256
cagggatcgagtagcccaccaccccaccccgcgacgctaaccgacgcaatggcgaccctcaccgtcccctcctccgtcccggccgtcgccgaggacgccgagcagctccacaaggccttcgaaggttggggcaccaacgagaagctgatcatctccatcctggcccaccgcaacgccgcgcagcgccgcgcgatccgccgcgcctacgccgaggcgtacgggaaggagctgctccgcgccctcggcgacgagatccacggcaagttcgagagggcggtgatcctgtggacgctggaccccgcggagagggacgcggtgctggcgaacgaggaggcgaagaagtgccaccccggcggccgcgcgctggtggagatccagggcgcgcgcgcccccgcgcagctctttgcggtcaagcaagcgtaccatgaccggtttaagcgatcgctcgangangacgttgccgcgcatgtcaacggcgacttccgaaagctttagtgcctc

SEQ ID NO: 19257 - DNA, 718 bp, Triticum aestivum
  Clone ID: PAT_TA_19257
cacgaggccggcacccccggccttttacggcgcctactacgaccgcgcggagcaggctctccccgcgcgggacgagctccgcaccctcttcatcgctggcctccccgccgacgccaagccgcgcgaagtctacaacctcttccgcgatttccccggatacgtctcctcccacctccgcacgggcaaatcctcccaggcgtatgcgtttgctgtgtttgcagatcaacagtctgcactaactgccttgagtggcacaaatggaatggtgtttgatcttgagaagaattgttctcttcatgtcgatctcgcaaaatccaattccagatcgaagcgcttgagatcagatgatacttcaccatattctcctgaaaaaagaactaggaaaccaaggggatttcctgattcaggtgctggaagcaatatttacatatctggaatgggtagttcttcacacagcttgagtggttatccttctgcacaaagttacacaagccttgagtctagtgcttctctcagcaaggacccatccacatttgcccctcaaattaatcctccatgtcctactctctttgttgcgaaccttggtccagcttgttcggagcaagagctgatagatgttttctcaagttgtgcgggatttgtgaagctcaagatgcaaaacaagcttggagctccaggtgcatttgttgatttcagggattcaatcaggtcaactgaa

SEQ ID NO: 19258 - DNA, 777 bp, Triticum aestivum
  Clone ID: PAT_TA_19258
gagggcgacgaccacgccatcctttgggttctcttcctcgccagcaacaaccgcttccgccccatcgtttggctttacaccgccagcaggaagcgcgactacggcgaacacggctccttccttgttctcatctgcttcctcgagccctgccttcgctttcgccaagagcacatccaccaccacagtaaccacaccgtcgtcctcgccctccactggcttctcctcggccacttcgcaggctgcacctgctccctcattgttctctaataccagtgcagcaggtagctcgtctgccactacgcctggattctcctttggttcatcttcggcagcttctacaccaactttagcttccatgtccgcaactggtgcctccactgtgccatcagctgctgcagcttctgcaacatctgggtcactgttcccagctgcttcttctaccagtagtttcagttttgcagttgctccatcatcgtcatcagccgcagcagctactgccactaccaccactgtcacaagtgcatctacatctgcaggcatgacaaccacagctcctttgactggaacaacggggtttccaaattttaatcttcaaacaactacaccagcttctacctcatctcccacactggcatttggtgtttctactactgctgctagcacatcagccaccagcagcacaactcaggcaacttcttcagctgttcaagctagcagcacaggtccaactactactacatctatcactccagcagcgtcccaggcacctaagctacc

SEQ ID NO: 19259 - DNA, 757 bp, Triticum aestivum
  Clone ID: PAT_TA_19259
ggaccatgtacataggagcattaaatataatgtttgggctagcacagccagcggaaacaggaagctggattctgcttaccgtgcggccagagagaaagaagagcattgccctatttgcgggtttttctcggtcaatggaagtggccaattctgtggcgtggctgagatgattggacctgtcgatttcgacagaagtgttgattactggcagcaggataagtggagtggccagttccctgtgaagtggcacataattaaggatgtgccgaacaaccttctgcggcacatcattcttgagaacaatgacaataagcctgtcacaaatagcagggacacccaggaggtgaagctggaacagggcctccaagatgcttacgatcttcaagagccatgaggctgagacaacaatcctggaagatttcgacttctatgagcagcgggagaaagccttgcaggagaacagacgtcaacagcagcctgccagcaccgaccctcagaagctggtggataccaaggctcaaggtcctgtggccgacatatcggatgcatttgctaaggccgttcagttgaaggatactgagaacagtgggacaaccccgacggctgagggcgcatcagctgaaaacggatccgctgccacagccaagggttgaaggaagtgcagacctgaacatgggccctgcggaggaaagcagttgatttgtttcccttctgtctgcaaatttggagcagcagatgaatagcatgctgcaatgtg

SEQ ID NO: 19260 - DNA, 255 bp, Triticum aestivum
  Clone ID: PAT_TA_19260
cggcacgagggtacctagcagctagtgtactagcagtgtagatgatgagggccaggtttttggaagtagctagctagaagtggtgtacattatggaaggaaagctaggatggatggagcatggaggggtataaagttagtttcattctttagttttcccctagctcgttaatgaattttgggataatgttttttccctttaatttgttcttaataatcttatctagtaccttaaaaaaggtaggaaaaaaaaaaa

SEQ ID NO: 19261 - DNA, 475 bp, Triticum aestivum
  Clone ID: PAT_TA_19261
cggcacgaggacttaaacgggtaaaatggtcaaaaatagaaggttaaacagaaacaccataccactgttagtgtttaaaagttgagtacacgagctaaataaccgtttagagtttagacaaataatgataaaaacttaggagataagaaagataataggaagactaatgctaaataatatagattctattgttggggatcaattcagaaggattaaacaagaaaaacactgatttttaattaactagctaattagagtatgtagtacgtgacaaactaatgtttgatagacaataataaaaataaaagatatgaagaaaatattagaaagatctagatttgatttgtataaaaaactattagagattaatatgaaataagaataaaaatcttagtatagataatattattaataactagttaattagacaattcagcatctaatttatgggatgtattaagggagttatgggaag

SEQ ID NO: 19262 - DNA, 600 bp, Triticum aestivum
  Clone ID: PAT_TA_19262
tcggcacgaggtgactgttgcattatccgacattgttgtcctacgtaatcttctcaagcctctccacaatcttcatgacgcatcttccctgtgcaagtaccttgaatcgttctatacactgcggaagccggttgcttccacaataaacacattggccggcgctctgtacaaggtcttcagtgcctcgcctgatcaagctaggaatgagatgcgccaagcttgttttgattacttgagccttggaggcgtcttctcaaatgggcctattgctttactctccggtcttaatcctcggccactgagtttagttgcacacttctttgctgttgctatctacggtgttggccgcttgatgctccctcttccttcacctaagcgaatgtggattggagccagactgatttctggtgcatgtggcatcatcctccctatcattaaagctgaaggcgtgagacagatgttcttccctgctactgtacctgcatattaccgggccgcacctatgggagaataagcatgaacagagcaccgattccgtgctgctgatccgaccatgatatatgatggcaactgatgtttcacggatggcatttttcctgt

SEQ ID NO: 19263 - DNA, 1113 bp, Triticum aestivum
  unsure (1)..(1113): unsure at all n locations
  Clone ID: PAT_TA_19263
cctccctctccgcccggtcttccttctcccccctcccctaccgacctccaaaccaagtcccatttccccatctccccctccctcaatcccacccataaatcccctcgcctcttcccaaatctcctctcgcgcctccggcctcacctccgccgcagcggctgcagaagatcggccgttactccggaccgggcccatcctccgtccccgtgtgccgttccaccttttcctgcgcatcttttggagcaaagttcgcgccggaaagcctttttctcgctgaaggagaaaggtcgcgggttcaatcacaggtggaaagctcgtcgcttttgctcccctgtccgtcttctttggcgtgggggggctttggggaaagaggaggagagatcgctcgctgctggtcctggcctggaacggatggagtgtccgaaagctcattgagaagacctttctttcaaggatagggttgaagttctggggggcatggcagagtgtcctgcagaaaagttcattcgcagcatccttggggatgttagagagagcgaaggtctggttgcaatccggagctctccggaaagaagttcagcgcagcctggtctttccggccatcatctccgggggaactctttcgggccaccgggtgagccacacggcggggctgtggtggctgatcagaatggctggggcgcgcttccccccgggggcctgcggcatgtgaggctggggccgcacgaaggcgggagcacttggcccgcgcgcacagtgccccccgcttgtgcggctgtctgcagcgcgtggagagagatctgtaaagatatagttcaagagcccggantctgtggggaaactcactttccggtgtcgcttaaacagccaggacctccgagatgggattaatccagtgcttcattaagaagggacaaacaacactaacctattatctctacctctgccttagccctgctgtgcttaatggagaacggaaantcctgctaacaacttaagaggaaccgacggacaacatataccgaaactatttccgtgggattccaaagaatctcgccgtcaaacaacggtatgttggaaaatangccaattcctccggacgaattaacntcc

SEQ ID NO: 19264 - DNA, 775 bp, Triticum aestivum
  Clone ID: PAT_TA_19264
cggcacgaggcttggatctgtcaagggtcttcatgtgggtctgaacttggctgttgctattgctttacataacataccagagggggttgctgtagctcttccaatctgtttccctaccttccgcgggttgctggcatctgttgtggcacccgcctctgggttggcccggccccttggggttgttgccgttgcgtgcttggttccttgcagtccgactcctgaccctcgcgttggccggcttggtgccggtggtggtgtcatggctttcctcactttgcatgaaatgctacctcttgcatttgactattgtggccagaagcaagctgtcaaagctgtctttgtgggcatgccctgcatgtctgcaagcttgtacttcttggaagtcagcttaccaaaggagataagcttgtagcatcgcgctgcaggtactgggaggcccttccctggctgtgcttcccggttgacccgaggtgctgcggcgcgtgtgtgccacgggcggggactcctcgcgccccgcccttgatcttggccttctggcccgctgcggtgggtgttgctccttttcccctgaatgtatcccccaggtgccgcgtgcggcctttccccagatgtgatagccggactggtcgtcgctgtcgtccggctgtggaagcttcgaagtcgtcaactaaactatttctagcactctcgtcggttgacaatggaagattctatgtaaaaacccatcagatagatgttaacctttaatctttaatttcttaaaaaaaaaaaaaaa

SEQ ID NO: 19265 - DNA, 733 bp, Triticum aestivum
  Clone ID: PAT_TA_19265
cacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccaatggccaacgccgggcccaacaccaacggctcccagttcttcatctgcaccgtcgcgacccttggctcgacggaaagcactcttcttcggcaagtcgtcgagggatggacgtctcaaggcatcgaaaagggggcaccgcacacctcacccaaagcggccaaggcctgccgcggtacctccccccggccgcgcttcgcccctggccgcgtccccggtccttccccgtttcgcattgtgtattggggggcgtcgtccactccccctgcgtcccgccccggggccggtccgcttcgatctgaataagatgatggtgatctgagtggtggtctgagttgagtcgtttgtttgtcatgcgtctgtct

SEQ ID NO: 19266 - DNA, 531 bp, Triticum aestivum
  unsure (1)..(531): unsure at all n locations
  Clone ID: PAT_TA_19266
ggcacggcgcccatccatccatcgccatcctctagcccagtccaaaggaaccctagccatgagcgccgcctccaagaagctcttccaggccgccagctcccccgccctccccgcctccctccgcgccgtcctcgccgccgagggccgcaccgccgcgctcgccacgctcaccaacttcggcaggaaggccctccccaccgcctacttctcctaccacaggcagggatcccaccacgccgcgtcggggtggggagccatcgccgccgcagtcccggctgcagtttacatgctccaggaccaggaggctcatgctgcagagatggagcgcaccttcattgccatcagcccggcgggcgtccaaagaggcctgatttctgagattatgagccgatttgagagaaaagntataagcttgttgccatcaagctgattgttccatccaaagaattgctgagaagcactaccatgatctcaaggaaaggctttctcagtgggttgtgtgatttctcaactctggcctgtgcttgaatg

SEQ ID NO: 19267 - DNA, 550 bp, Triticum aestivum
  Clone ID: PAT_TA_19267
tttgtaagactaacttttctaacgtgacgggatgctcagttcttaggaactgaactaacatatgttgggtgcccagctctaggcatgaatcagtgaaccttcaatctgaagcgccaaattgcaggaagagcaagagttctacgatttgaagaatgcctgaacatataataaaacatacagtggataggtggtgcgctggttcgtgactcgcgagtgaagggctcaatgagattgacttcaaactgctaactgcacagactagagcttgtatttatgtttgctgctgtaacctgtttcccgtccgtgttggtcggctgccgagcttcttgtttggaagtctttggagtttcggatttcttttttccgccactttgctgacttgcggcacttgagagttgttcaaacccttcgcttctaacttagcgccctagtaaactccagtttctcagtgaagagtcatcactcatgtcgtcgatgacttcttcaaaccttgtacatacatgctccgtaataactggaagccttctttgtgtccaacaaaaaaaaaaaa

SEQ ID NO: 19268 - DNA, 406 bp, Triticum aestivum
  Clone ID: PAT_TA_19268
gctgcacaagttccgcaagtcggcgtctttcgcgttccgcgggcaatccccggcgcccgtgcccacccccgccgagccagacgtctcgtgggtgaactctcttgtcaaggacggccacgccggcgacatatttgcgcagtggccggagcaggagcagatggtggcctaatttgattcaccgatcatcactggctcatagcatctagctgaccaaagctctttccttcaattattttttcccctttgtttgcttaatttgattcatatgagatgttttttactagtacatatatataggctgttcacaataatatttgttcatcaacaagaagcatatatggatgcccaaagggagctctaaaaaaaaaaaaaaaaaaaaaaaaaaaaaaaaaaaaaaaaaaaaaaa

SEQ ID NO: 19269 - DNA, 573 bp, Triticum aestivum
  Clone ID: PAT_TA_19269
cgtcttcgccgcccccctgcccccctccctcttcaagcacagcaacttctccagcttcgtgcgccagctcaacacctatctagatggaacaagatactggatgaagtaccaagaccagattgttttgttctagaagactctactgatcaccttcacatgctatagtatattgctgctctatcattattcctgataccctcattgcggttataaagatacaataagctgaaatttgcagagaacctcatccaagctaacatattgccttgtggctgacctgttgatgaccatttctggtctgttgcaatctgcagggcttcagaaaggttgatcctgacaggtgggagtttgcaaatgaaggttttctcaggggtcaaaggcacctgcttaagatgataaagagaaggaagccaccatcagctgtgccaccattgcgacagcagcaggcccctgcttctgccggaggtgggagttggattaggaaagatgatagctgaacggacagaacttttgatccaaagataaagctaagcaggagcacaactactaaatctgtgagggccatggagaaag

SEQ ID NO: 19270 - DNA, 489 bp, Triticum aestivum
  Clone ID: PAT_TA_19270
ctgattgggggattggccagccattgtcatcttggggagaagtgagtgacctccagggcccgtactatcaaggaacattccatcagtctgttacctgccctggtttcatagccgcccaagctgtgtcatcgttgcagatcagagaagagtcatcagagatcacctctccaagccaaggggcggctgctgcaaccgtggttaacaggatgcttggtggcaccaacaggctcaacctttacagagagatataaacattattacacttgccatagtagtattgtatatagtcacccaaaaaagatgtgtttgactgcattgcctgcgatatatagtcttctggttccgaaagaaatggatagaacatcttgtttgctgttttctttgccaaaggatattttgtatcagttaacattggtattgtaatgtgaacagatatgcttttgatgaattgatcgattctcgttgcttaaaaaaaaaaaaaaaaaaaaa

SEQ ID NO: 19271 - DNA, 966 bp, Triticum aestivum
  unsure (1)..(966): unsure at all n locations
  Clone ID: PAT_TA_19271
ccccgcccccctgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcacgcgcctcaaggtaccaccggcgctcaaccagttcaaccgcaccctcgacaagaacctcgctacgaacctgtttaagatccttctcaaagtaccggcctgaagacaggcttccgaagagggcgcgcgccgggagtgggccaaagcctgttgagaacgaagaaaccaattgttgaaaagtatggccttaaccagtgtgacttacctcattgagccgaactaggctcagcttgttgtcatcgctcatcacgcggatccgatcgaacttgttgtgtggcttccagccctgcgcgggaagatggtgggccccttctgcattgttagagggaaccctcgccttggatcaattggtcacaagacgaatgcaccagtcttgtgtctgaccactgtcaagaacgaggataagcttgagttcagcaagatcttggaggctattaagggcaaactttcaacgacaatttcgatgaggtcaggaagaatggggaggtggcatcatgggatcaagtcgcaggcaagacaaggcccgggaaaattctcccaaggaggctgcgcaggatgacctagatgtcattgtctactgccgtgtcgcctgccggtgacacgaggaccatatgccgatccggtcactgcgcgtttcctgacaccccgttcaaatttaaacgtccaccgatccctgtttaaacctcttncaattaagtttgccatttn

SEQ ID NO: 19272 - DNA, 700 bp, Triticum aestivum
  Clone ID: PAT_TA_19272
ggcacgaggctgcagtttcggaagttgtcaaaagaggggtggctcaccctgataaaattgctgttggtggtcattcatatggtgcattcatgacagctaatctgctggctcatgctcctcatcttttctcctgcggaattgctcgctctggagcttacaacaggactctaaccccatttggttttcagaacgaggatagaacactctgggaggcaacaagtacatatgtcgagatgagccctttcatgtctgcaaacaaaatcaagaaaccaattttacttatccatggagagcaggacaacaattctgggacactgacaatgcagtcagaccgattcttcaatgccttgaaaggtcatggtgcgctatctcgtttggtcatacttccttttgagagccatgggtactctgctagggagagtattatgcacgtcctgtgggagactgataggtggctgcaaaactactgtgtaaacggtactagcaaggttgactcagtgtcagaggctgacagtgaaaacaaaacattgtcagctagtggcggcagtgcagcccgtgaaggtctaaaccctgaggaactctcatcattaccaagatcgcttctgtgatcaactctcttcagttggtgttcatgaaacgttctctggacagccgacagcaagcctaaagggaaaaataaagtgtatcgttgcacttgtgc

SEQ ID NO: 19273 - DNA, 326 bp, Triticum aestivum
  Clone ID: PAT_TA_19273
aggctccatcttagttccagccaacttttaggggtagcagacctggctttggccgtggtggcggcggcgctttcggtgccggtggatcttccatggagtgatgtatcaacttgagctagcaggcgcattgattcgatggatagcttttcaaatgcagcgcgcaaggggcgtgtcttctctgttgatctttgaactatgagaacaatgagattttgttttactgagctgttgccgtgccttgacatggttttgtgatcctccttttttgtttagatgaaattattgaaatcaagcagcaagttatcattcaaaaaaaaaaaaaaaaa

SEQ ID NO: 19274 - DNA, 755 bp, Triticum aestivum
  Clone ID: PAT_TA_19274
aacgaaagtgcacctcgtgatccttctgatgcatatcctgtagactacttttctaaaagagaatatcctagtggaagccctatgtttactagtaatgccccatcagctccttatgagagatatgcagcagccacacgctttcctactagagaacttccctcggctttcggtcctggtgtggatcatatgtctcatcgttcctatcgtgaccatgtgcctgctgatagctactctagtaggggtacacagcaattaggcatcacaagagatggaaattcagatgcttatgactataccgagactgctggacaaattcatggacgcgaggattacagaggactgacaagtgctactggaaagttcttgaacactattgaactgaggattccaaatagttctttggagtctattgtcggtgttggcggggtcaatctagcagagatccgtcagatttctggtgcaagactgaggctacatgaggctcatgctggttcttccgagtctctggtggagatccagggcacactggagcaagcaaaagctgcgcagagcctcctgcagggctttattagcgcgaacagtcggagcatgcagcagcaaccccaatcttctcgcatgccactttacccaagttggggatagcttctggtctcatggtcgtcagtgccggtgcgggcatgtcaatcattctttgcagtgccgtcagtgcggtaaacaatttgtactcgagcatataatgaacctctatgtatgta

SEQ ID NO: 19275 - DNA, 548 bp, Triticum aestivum
  Clone ID: PAT_TA_19275
tcgagcaacatggaaaggcatgctaatgaatcgtctttcggtgtccgatgtttctcccctttgcgcgatcaggggattgggcccttggggtccaggtctagtacagagatataccagtgccaggtttggtacacgttctactggtgatttactaacagatcaagaatcggcattgttgacagattatatgtaccataccttagctgccaaagctagtgagagagctgtgcttgaaatatatattttccttcggggcatttgcaaggaaacctcttctgcagtgcgcgtccgattggaaagtgccgactactttcatatatgggcagcaagtttggatgaactaccaagcgccccggcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctgatggcctaatatctgcatgaagtggcatgttc

SEQ ID NO: 19276 - DNA, 703 bp, Triticum aestivum
  Clone ID: PAT_TA_19276
gggaactgtataaattaatgataacctccatatcaaggattttggaaatgcttgggacagccacaacagaacatattgtaagctctgttgatgagactagtccagagcgctctcaagatggcatggccggctatcatccaggatctgtcaatcctttggagcaacttggactgttcataaaggccgatgatgaggaagatgatgaagaaccgagcagtgttcccagcattaaagaaccagaggaaggagagatcaactgatggtgctgtgttttgccatgccctgtcaagggctagaggctggtgccaaactagtgatccaacaaagtgatcgcctcttgtgggccatcatgtgtggcacaatggctggacagcagcgcgtgttggatgctcaattggttctgaactggtggtgaaagccctcctccatattgctgctactgggttgttaaaatatgcttgggaaggatgaaggtaatctttgcatgattggtaaatgagtggtcatttgcttcgaggaggcgcacaggaggtcgagttggtcaaatgaacgtattgatgtgcctagaggatgttttttcagccaccgttccaaaacggcttgaatgatgccaccgaactagtggagttcaaattgctcattatttgctgcaacctccatttcaagccggtttgctcagcggctcatatagcctgatttctca

SEQ ID NO: 19277 - DNA, 605 bp, Triticum aestivum
  Clone ID: PAT_TA_19277
acgacacgcagcactggattaaggacatgaagtacagcactagggtgaaggatgaggaaggctaccctgccatcgtcctcgtcaacaaggccactggagaggctctcaagcattcccttggccagtcacaccctgttcctctgacccgctatgatccagacaaactggatgagtcggtcctgtggacagagagcagggatgttggggatggattccgctgcattaggatggtcaacaacatctacctgaattttgatgctttacatggagacaaggaccatggtggtgtgcacgacggaacaacccttgtgctgtgggagtggtgtgagggagacaaccagcgctggaagattgttccatggtgaacaagaaaatgtgtgggtgagctgcacaaaggagctcctgtcgtaataagggaagtgattggtactgaagtttctggaataagaggcgcttctgagatgcctgtgtgagtattgtgttccattccgttttcatgataataatacataacgcattaattattaatattaatattaatatatgtaatgcgcgacactacactagatagcagcgttggtgcatataatattgtatgaacttat

SEQ ID NO: 19278 - DNA, 801 bp, Triticum aestivum
  Clone ID: PAT_TA_19278
ttggtggagccataaatcgggactgatacattttatcactgctggttacaaaccaatcggtattgatagtccgaaagtgattgcaattttgtagtaatagtgaatagcatgcaaggatgaaataacctatgtcatagtgtacataaagaaccgaccaaaaagatatacaataataaatcaaatttaaaatcaaacataggtcatctaaaacgtgctagtacgtgacacacagtaatatatatatactaggacgctacgatgatatatatacatatatattccagaccccatttatttctatactatataaaaatactatactatataaatcggcggtaacgacatatatatgaacgagtttgggacccgcgcctggtaaatgaaactagtcaataataactagtggtggtgtccgtggcggcggtgcttcttggcgtctttcttctggtggtgttcgtggaaggcaaagccggcgctgcccacggcgacggcggcggcgaccccttccttgatcttgtgcgagtgcgcgtgctccgggtccttcttcgccttgtgcttctcgtgcacggcgtaggctcctgcggcgacggcgccgagctggccgagctgctccatgtgcttgtggtgcttctcctccttgcgccagtcggtcaccttggacgcctcaccgccatggtgcttgctgcccaggaaatggtgcgccattgtttcgatcgatcgagttgccctagctagctagtggcctttggggttcgatcgatctgcgtgatgatgatctgctgatacttgccggcctcgtgc

SEQ ID NO: 19279 - DNA, 764 bp, Triticum aestivum
  unsure (1)..(764): unsure at all n locations
  Clone ID: PAT_TA_19279
taagatacgaacaatataattggatggcaagcgtataaagctacagatttgggatacagcgggccaagaacgcttccggtctcttaccactgcgtactaccgaggagctatgggcattttgctggtttatgatgtcaccgatgaatcttctttcaacaacatccgaaactggattcggaacattgaacaacatgcctctgataatgtcaacaaaatcttggttggcaacaaggccgatatggatgaaagcaagagggccgtacctactgcaaaaggacaagcacttgctgatgagtatgggatcaagttttttgaaacgagtgccaagacaaacctgaatgtggagcaagtgtttttctccatcgcacgtgacatcaagcagaggcttgcagagactgattcaaagccagaggacaaggcaatcaaaattaacaagccagaccagggttccgaggcaccagctgcccagcgatctgcctgctgcggctcataagcagatgcgagatggccataatgattggttatttgacattatttatttcccgcttgggctgttataggaaggatttgaagaagccacttatgatataccgatgtggttgtactcgtggttgcttccattctttgaagcaaccacctcctgctgttgacgtactattgcattgctgggaactattgcaccctgcattgggntcgttggaaaatctccctccctanatgtgtatgaatgaanccanncgttggttgcatggaaaaaaaaaaaa

SEQ ID NO: 19280 - DNA, 480 bp, Triticum aestivum
  Clone ID: PAT_TA_19280
tgctgtaattcttgcgaagaagtcttgccggcatataagaagaaaggatgggctctgacaaatcctgacctaattgaccagtgcgctagagaggattttgttgagagagttaaaactcagcaagatgaaggctgcaacgtccatggctttttagatgtcagtaaagttgctggaaattttcactttgccccaggcaaaggattttatgaatcaaacatagatgtgcctgagctgtcagtacttgaaggtggtttcaatattacccacaaaataaacaaactgtcctttgggacagaattccctggtgttgttaatccacttgatggtgctcagtggatacagccagcttcagatgggacataccagtatttcataaaagttgtccctacaatatacactgatataagaggacacaatattcattcgaaccagttctcggtaacggaacattttagagatggaaatattcttccgaaaccc

SEQ ID NO: 19281 - DNA, 517 bp, Triticum aestivum
  Clone ID: PAT_TA_19281
cgacctcgtcacgccgagcggcattccccgccgactcgactcctcctccgtcgccgcccctccgcactcgcctcgactctccgccgtggcccctccgccttcgccttgactctcatcttgccatccccgtcacctcccagccaccatcccccttctgaaccatcgtcgtcctcgcctccacatcggcttcgtccccacacactggagagatgtgaccactgcagctactgagaggacggctccaagatccacttcagttcttctcagatttgtcttccctctgaacaaaagctcttggtggaagcaatacatgatttgaggagcccttgagctatataatctctctacttgggtactgaacatgcggtggcaatgcctatgtcatatgtgacaagcttctggaaagggttttaagtcatagatttatttttatttttttttgcaaaacttaaagtcatagttttttagtgttcaagtttttagtgaagagactcattccatttttttatatatatct

SEQ ID NO: 19282 - DNA, 679 bp, Triticum aestivum
  Clone ID: PAT_TA_19282
agcttgtacgcccgaacttgtaaagctaataggcatcacccctgaatagctatgaaggaagggaggggcgttcgcatggttaccggcaacggcgaaaacagctacgccgcaaactccaggctccaggagaaggccattttggagacaagtccggtgcttcacaaggccatagaagagctgtgcaagtcgctctcagcccgacggagcaccatggtcgtcgctgacctcggctgctcgtcgggcccgaacactctgcgtgtcgtctgcgaggtgatcggcgcggtccagttctacactcggaaatcggaagaagaacggcgcgccgtggaggtgcagttcttcttgaatgacctgccagggaatgatttcaacatcgtcttccggtcactggaggaactggaagatctcggcggcagagagacgcagccctactacgtggcgggcctgccgggatcctactacaggaagcttttccctttccggagcgtccacctcttccactcgtcctactccctcatgtggcgctctaaggtatgcatgcatcatattgtctgcaatgtgataattatgtcctagctagtattgttcaagttttagttaattaacgatgtgtaaacatcgttgttcgataaatcaagctttattttatgtgggcgttgtcagatatgaatgaagaaaa

SEQ ID NO: 19283 - DNA, 435 bp, Triticum aestivum
  Clone ID: PAT_TA_19283
gagggctgctgttacaaagagagcagcaatcttgaatgcacaaaaaagacaacaagcacgtgaaattgctattgctaaaaaacgtggtattgaattaccaaaaaaagcaccagcaatgaaatcattgagaacacgtgaaagacgtgtcaaggcattgattgcattaaaagcatcaagaccaaaggttgcaaaaaaaacaactaaaaagacatctgaaccagcaaaaaaaacagctgaaccagcaaaaaaaacaacagcagctaaaactacaacaaaagtagctgccaaaaaataaaaataaaacagcagtaataaatcaccaccaccaccaccatcatcatcaccacaacaacaaataaacaaatattaaaaggttgtcatgttgtttccttttataataaaaaatactgctagaaaaaaaaaaaaaaaaaaaaa

SEQ ID NO: 19284 - DNA, 447 bp, Triticum aestivum
  Clone ID: PAT_TA_19284
gacgccgtcgaccgcttgaagaccgggttcgaccagttcaagaccgaggtctatgacaagaagccggagctgttcgagcctctcaaggccggccaggcccccagggacatggtgttcgcctgcgccgactcccgtgtgtgcccgtcggtgaccctgggcctgctgcccggcgaggccttcaccgtccgcaacatcgccgccctggtcccagcctacgacaagaccaagtacaccggcattgggtctgccattgagtacgccgtgtgcgccctcaaggtgcaggtcctcgtcgtcattggccacagctgctgtggtggcatcagggcgctcctctccctccaggatggcgcacctgacaccttccacttcgttgaggactgggtcaggatcggcttccctgccaagatcaaggtgaagaaagagcacgcttcggtgccgttcgatgac

SEQ ID NO: 19285 - DNA, 294 bp, Triticum aestivum
  Clone ID: PAT_TA_19285
ttttttttttttttgttttttgttgaaactggaaaatgaactttatcatggctagttttcagtacaagcaacaaattacaaatgttatagtccttgacaaaggaagaagatgtgaatttgatatttaaatccaacctcaaaagtgaaacccatcaaatgcaggttccaatggaactgctcaaaaacatacgagtaatcaacttggtgcaaacatatagcaatatttgcagtatgtctattaattatatccttgaacagacttatacagctggggggggcccggtacccaattcg

SEQ ID NO: 19286 - DNA, 677 bp, Triticum aestivum
  Clone ID: PAT_TA_19286
ttcgtagaaccctacgtgataaacatgcgaagaatgaggttttgcatgaggaagaggaaaaacctgtgaggcgacggggccgtccgagaaaggttagagatgtgccagatgtaccagatctacgtagtggtcgggatgtacgtgggaagaaactttttagagatgacgggcacaattctagtggcgaggagtctatcagtgcatctgaccatcagggtcacggtgaagatgacgacagcgacggcgatgcagatcagcccttaatcaacacgattaggtcttccgctgccaagctacgatccttgaagattgctcaacagggaacaagcagccacaaaggggtctctggcccatcaggaagcaatagctgagagaatgcatgcagtatcgcacatcactggtgatgatttccagactttgaacgaccagttcaagcagcacggtggaccggcactaacatcagtttgacgaggacatcagtccacgcggagctgcatctaattgcttaggcgctgtacatgatttgcacttaggtgctgactctctttgtacacgttaggtgtcccgctaggtctttcttttaccccctcttctatcctcatgtgtaatatatagaaacaggttaatggactcatggtacgggctgttttttaaaaaacacaaaaaaaaaaaaaaaa

SEQ ID NO: 19287 - DNA, 759 bp, Triticum aestivum
  Clone ID: PAT_TA_19287
gcacgaggccactaattacttttcatgggattgacaactacaagactatcttctgggcacttagattccatgggcgcctactattcagagaaattgggcttgatgtatcacgcatttggcaactgacagagacttcaatagttgtccggtgggagctgtggggcactccacgtgtcccatgggaatcatatggctgcttcagtgggacgtcgagatacaaggttgacaggaatgggaaaatttacgagcacaaagttgacaacttggcgttggacttcccacgatcagtagcgaaagtgggcagcattgctgacatggtagtcgccacaccgagcccaaatttaacattttggaatgtggttgggccaggtgatggttgctcatggacaaagctttatgaagccgtggtggaagctgtggaacgggaagaacatggttccactggcattggcgttggaggtctacctgtcccctgcagcttcggctgcggctgtggctgcagtttttgaagtgcaaactactgtagcttgaactgctgcagccgcagccatagctgcaaccagctcaaacgagcagccagctcaagcgcataggccatcacttgttcataggatggaatgagctccagaactagttgcttggtagttcctaggggaaatgtatagaatatatatgggcacatgaatcacgattctactaatatctctttgtatattgtagctatagggcagttaatttagataaaacacatactagatg

SEQ ID NO: 19288 - DNA, 717 bp, Triticum aestivum
  Clone ID: PAT_TA_19288
tgcaataacatcacttccagaatgcgagacattggttgcattacagcatctcaacttgtcacacacacgtattaggatattacctgagcggctgtggttattgaaagagttgaggcatctggatctcagtgtgactgctgaactcgaagataccttgaataactgctcaaagttgctcaagttgagggtgcttaatctctttcgcagtcactatggtattagtgatgtcaacgacctgaatctggattccctgaacgcactaattttccttggaatcactatttatgcagaggacgtgttaaagaaactgaacaagactagtcctttggcaaagtcaacatatcgtctgaatctcaagtactgtagaaaaatgcattcgctcaaaatctctgatctcaaccacttggtgcacctcgaggagctgtatgtcgagtcgtgctataatctaagcacgctggttgctgatgctgatgctgagctgacaacttcaggcctggaggtcctgaccctctcagttcttcctgtgctggagaacgtcattgttgcaccaatgccccaccattttcggcgcatccgcaaattagccatttcgagttgcccgaagctgaagaacatcacatgggtcctcaaactcgaaatgctcgagaggcttgtcataaccagttgtgatgggttgctgaaggttgttgaagaagatagcggtgatgaggcagagac

SEQ ID NO: 19289 - DNA, 824 bp, Triticum aestivum
  unsure (1)..(824): unsure at all n locations
  Clone ID: PAT_TA_19289
ggcacgaggcctgatccaggtgtacgagggtgagcgcgcgaggaccaaggacaacaacctcctcggcaagttcgagctctcgggcatccctcctgctccccgcggcgtgcctcagatcacggtcaccttcgacatcgacgccaacggcatcctcaacgtctctgccgaggacaagaccaccggccagaagaacaagatcacgatcaccaacgacaagggcaggcttagcaaggaggagattgagaagatggtgcaggaggctgagaagtacaaggctgaggacgaggaggtcaagaagaaggtggacgccaagaacacgctcgagaactacgcctacaacatgaggaacaccatcaaggatgacaagatcgcctccaagctcccggcagaggacaagaagaagattgaggacgccgtcgatagtgccatcagctggctggacagcaaccagctggctgaggtggacgagtttgaagacaagatgaaggagcttgaggggatctgcaaccccatcatcgcgaagatgtaccagggcgctggcgcgggcatgggcgatgctgctggcatggatgaggacgccccgtctggtgggagcggtgctggtcctaagatcgaggaggtcgattaagttgttttagtgtccgaggtttggtttggtgaagtacatctgaactctaaaggttcttcgtgacatggttagacgtggtgttgcagtactgtgataaaacttatcagaataagttttcgcttctaatttgttttcttaaatcatgtgttgatcagcctatgagttgttcnaaaaaaaaaaaaaaaaaaaaaaaaaa

SEQ ID NO: 19290 - DNA, 990 bp, Triticum aestivum
  unsure (1)..(990): unsure at all n locations
  Clone ID: PAT_TA_19290
gcacgagggtagtgtttctgacaactggggagaggagccccttcctgaagaaccgccttctttctcaaatgaaatgacagtcgctcctgaggagccggtgcaacctccacctgttccgcctcctcacgtcgaggagcctgttggtgaaccagtaaagaagacttatgcttccatcctaaaaaccgcaaaggctcctcctgcattcccggtagcgcagcaagtaccagtgagtaagccttctcaccctacaacagagtcaatccagacccaacattcagttatggcttcatcaacgggagctgagaaaccaaggtctgatgtctatggtgagggtgctgcccatgatgatgaagagagcaaatctgtttatgttggcaacgtgccagcaaatgtaaatgaggctgatcttgaaagtgagttcaaaaagtttggtcggcttattcctgacggtgttgctatcagaagccgaaaggagactggtggctattatgctttcgtggaattcgaggaactcagcggtgtacacaatgcgttaaaggcttcaccaattgaaataaatggacggcagatatatgttgaggagaggaagccaaatagcggaataagaggtggaaggaggggaggacgtggccgtttcagcggtggaggccgtggatatgcgagaggcggaggtgacgagtacaatggtaaccgcagtaggtcgaacggctacggtcgtgttcctcaccaagagaggggcatactcgggagccacaccgcaaggaactgattcggtgcagcagcaaacataaggttttgatcctgtgtcgtcaaagcgagagagagatcctgaacaaagcagcctatcagctgctaggttgcgtttgggttttggggcttgtttgtcgatgaatgtgtgcacctatgtcacttaaacttttgctagcctgacgctatccctttacnttaaaaaaaaaaaaaaaaaaaaaaaaaaaaaaaaaaaaaaaaaaa

SEQ ID NO: 19291 - DNA, 766 bp, Triticum aestivum
  Clone ID: PAT_TA_19291
gagggcgggaggggccggtgctgtacctcgacctgacgagctaccagctgcacgatctgagcgaggtggagatcccgcccacgctggaggaggtcgacctcaccgccaaccgcctctcttccgtcgacccacgcatcggccaactcccccgtctccgcaagctctccttccgccagaacctcctggaagacgacgccgtcgcgccgctctcgtcctgggagactatcgccggattgcaggagttggtccttagagataacaaacttacaaggattcctgatgctggcatattcaagggtcttctggggtttgatgtatctttcaatgagatatcttccttgactggcatgtccaaggtttccagcaagttgaaggaactttatggttcacagaatgaacttgccaagatggaagagcttgagcatttacatgcgctggaaattcttgaacttggtagcaacaggttacgggtaatggaaaatcttgaaacattgacaaatctgcaagaactgtggttgggaagaaatcgaattcgagctgtcaacttgtgtggtttgaagctaattaagaagataagtttgcaaagcaacagattgacttcaatggatgggtttcaggaatgtactgcgttagaggagctgtacctcagccataatggaattcaaaagatggaaggcctctctaccttgcagaaccttcgcattttggatgtttcatctaacaagctaaccactatagaaaatattgaaaccttaaccaggctgga

SEQ ID NO: 19292 - DNA, 1565 bp, Triticum aestivum
  Clone ID: PAT_TA_19292
ctctaccccgaggaaacccaccttccccctacccggccgatccagatctccactccctcacacctcccccgtcctcctcgccggacgcccgtcgccggcggcgaccccccatcctccgcccccctccgcgtctcccggcgggcggacgcacgcacgcacgcaatggagcagctccggacgatcgggcgggagctggcgatggggtcgcagggcgggtgggggcagtcgaaggagttcctggacctggtcaagtccatcggcgaggcgcgctccaaggcggaggaggaccgcatcatctcccgcgagctggagcacctcaagcgccgcctcgccgaccccgacgtgccgcgccgcaagatgaaggagctcctcctccgcctcgtctacgccgagatgctcggccacgacgcctccttcggccacatccacgccgtcaagatgacccacgacgagtccctcccgctcaagcgcaccggctacctcgccgtcgcgctcttcatcgacgagcgccacgacctcgtcatcctcgtcgtcaacaccatccagaaggacctcaggtccgacaactacctcgtcgtctgcgccgcgctcaccgccgccagccgcctcatcggcgaggaggccatccccgccgtgctgccccaggtcgtcgatctcctcgcgcaccccaaggaggccgtcaggaagaaggccgtcatggcgctccaccgcttctaccagcgatccccttcctccgtttcccacctcgtctccaacttccgcaagagactctgtgataatgatcctggggtgatgggtgcaactctgtgcccactctatgacctgattttggaagatccaaacgcgtacaaggacttagttgttagttttgttaacatcctcaaacaagttgcagagaggaggcttccaacttcctacgattaccatcaaatgcccgcaccatttattcagataaaactattgaaaatacttgctgtgctgggtagcggtgacaagtcagcgagtggtcatatgtacactgtcttgggcgacatattcaggaagggtgacacagcgagcaacattggcaatgcgatattgtatgaatgcatatgctgtgtctcatgcattttcccaaactctaagatgctagacgctgctgctgaaacaacatcgaaatttttgaagagcgatagccataatcttaagtacatgggaattgatgctcttggacgactaataaaaataaatcctgatattgcagaacagcaccaattggctgttatcgattgcttagaggaccctgatgacactttgaagcgtaagacttttgagcttctttataagatgacaaaatcaactaatgttgaagtgattgttgatcggatgatcgagtacatgatcagcataactgatcaccactataaggcggaaattgcatcacgttgtgttgagctagcagaacaatttgcgcccagcaaccagtggttcattcagaccatgaacaaagtctttgagcatgctggggaccttgtcaacattagagtggcacacaatttaatgcggcttatcgctgaaggatttgg

SEQ ID NO: 19293 - DNA, 1094 bp, Triticum aestivum
  Clone ID: PAT_TA_19293
caaaagtcccgactccggaccctaaaaccctagtcgggcttcatacgccgccaccgcgccgcttcctccctcgccatggccctctttgctgccgcacgccgcgccgcgtcctcctccgtgcccgtcctcctccgtgcctccgcctcctcggggtcccaccgcagcgccgtcctgctccggcccctcgctgccgccgtggcgccgccgaagccccgcgcgatgccgttctcctcggcgcccgcgacgagacccagctccgacgccgagctactcagcgtcatcgactccgagatcaagtacgccgaggactgcgatgaccacgacagggttgaggagattccagaaaatttccctttcaaaatcagcgacgagaaggggacgaatgtagttacccttaaaagaacatatcagggtgagcagattgaggttgtggctcacatgcccagccttgtcactggagatgagcctgatcatgaccgtgatggtgaggacgagggtgaggacaaggagggagatgacgatgcggaagacgaaggccagaagcccgagcagtccagtgttcctctcacagtcactatcactaagggtgatggcccggtccttgaattcacctgcactgcctatcctgatgaggtcctcatcgacaccctgtccgtgacgcagccctcaggggatgatgaacatgacatgattgcatatgagggtcctgatttcaatgaccttgatgagaacctgcagagggcattccacaagtacctggagctgcgtggcatttcacccatgaccacaaacttcttgcacgagtacatgatcaacaaggacagccgtgagtacctgctctggctgaggaagctgaaggattatttcaagcagtagagatctacaccatcgctatcaattcccccaggcataaaatgttctttgcacaatgagattagagccctgaacttctcgttttagataaatatgaaagatgattgtgcacttacatgaacttccgaagttcgtttttttggctatggttttagtggtgtgataacgaccggttcatctgcgagcaagttggaaccagtatgttttggaaaggttaagta

SEQ ID NO: 19294 - DNA, 708 bp, Triticum aestivum
  Clone ID: PAT_TA_19294
ttcctcagggtgaccccaacgttgccaaatactttcatcaacttagcttcacccatagtagatgtcccctaccatacattcttactgggaactctcattggtcttatcccagctgcttatgtgactgtcagggctggaattgctctaggagagttaacttcgctgagtgacctttacgacacccagtctatagcactgctattcctgatcggtgttgtttcagtcacaccagcattgttgggcaaggacgaggcacaagaaaaaccatcagaaatggtggtaggcgcgtcatgatcaccaaagcaccgagaggtgtccacctcacctgtatatatcaacatccagcatgcagtggcttcattagttcggatccacaggcccttgtggctggatgacagaactggttggcatggctacacagcttggcgggtcctcggcctaaactccgtcgcaccgccggcctacagaggcacctgtgtcaccatcatcagaacatgattcggtggccattcaccacattatgaatgaatgaatgaacctgggaagcagaatgcccgttagacaagctgctcttatgtgtaaacgagtagtgctgttcggatagaacaggcatttagtccaatccctgtatatatagaccagattcattcaatccatattcagtggttcaaagatccctgtccaaaaaaaaaaaaaaaaaaaaaaaaa

SEQ ID NO: 19295 - DNA, 720 bp, Triticum aestivum
  Clone ID: PAT_TA_19295
aggcaccgctcttgctcggactaccaccaccgctccacacctcccgtcgcgccgccgagcgacggcggcatccgcctcctccggtccgtcccgccacccgcgccgtctcgccgccgccccccccccctccggcctcccccgccccccgccggcgtctcccgcgtcccctccccgcgtccctccggcggtgccgccgcccctcgtgcatccagggccgccgcgccccttccgcgcgcggtgcgggagcggcccgaaagatgattaatcttttcaaaataaagggtcaaaagaaagaagaggcagcaagtgctgctggaaaggccccggttaagaaacagtctgctggggagctccgtcttcataaagatattagtgagctcaacctgccgaagaccacatcaatttcttttcccaatggcaaggatgatctgatgaattttgagaccaccatccgacctgatgaaggatactacatgggaggcactttcgttttcacctttcaagtgtccccatcttatcctcatgatcctccgaaggtcaaatgcaagaccaaggtgtaccatccaaatattgattgggggcgctatgccggtctgtgccgtctgcgcggcggttgcaagcctgtccgctacttcgccgctcttatttatggcctgaatcttctttttacgcaatcaaacgacgaggatcctttgaaccatgaagctgcagttgtccttc

SEQ ID NO: 19296 - DNA, 611 bp, Triticum aestivum
  Clone ID: PAT_TA_19296
gatcttcatccggagatgatggagagcgaaacacctccccatgcctccccgcctcatgaggcgggcgacccggaggtgtcgtcacagaggatttctcctgatccgccaaggccagagggtaatccttcggcctcccgaagtccgaagtattcggctcctaaagggagcagcagaaaaagtctggagctgtccggtgcgcgaccggacgtattgatgagtcttctggagcaagcggctatctcagaagcgcatcgtacgctaatgggtatggtggttgagaggatttcatccgccgaaagtgggttgcatgaagcttttatgagcctgctgagaggctttgaggtacacaaagtaatatatatatttttgacggtaccgcacatgctaggtgtgccctatacagatagtagcccctgagactctggttgctgtccaaaggcagcaaacagagaatcatagtaccaggtgatgatcatgctactttcatgtgcaggcggctgatggtccggtggctggccggactggtgagtttgctgaactgaggcggcaacttgatgcggcagatgccgacatcgttcttgtaaacaagcagcttgatgaggcacagggta

SEQ ID NO: 19297 - DNA, 423 bp, Triticum aestivum
  Clone ID: PAT_TA_19297
gatgcctcggtgaatactcaagaatttttgttcatttctattgacggcctttaggtattttatatttatttttataatgattctgaaacgaggtcactccctactaatcttgctctccaggcctggtggcgggatgcttggtcaagaatgcagggtgagtaaaacaaaatgcttttatctctctggtcatctagagcatatggagggagcaagatagcgggctttgacagtgtcttcacaccgccccagagggggtgccactgagggctttctcatggaacacggtgcaatgtggttttatgcacgcctatgagcaggctaccctgcacgctggtcttctactactttcccaggcatattacttccctctgagatgcttccaagagctctattcagctccattgtatttttcttctttttttg

SEQ ID NO: 19298 - DNA, 1214 bp, Triticum aestivum
  Clone ID: PAT_TA_19298
cgcccgtcttccggccgctgcccccccaccgggaggtggaattgccttctggagtcctctcctgttttcagaggaatgtgcatatagcttggagtctgatgagtaatcagtcatgctgatgctacatgaaactgttccttttgtgaggcctagttcttgccgggacctaaaactctctgaaaagagtgcctctgcttttcattgtaaattaggatgcagtgcagtttgcagttcagcagaaggccatcatgtacagaagccacacattgttcacagccacaaagttaacttcactagaaccagccatcttctgtgtaaaagcttaaataaaagaactacaaggcactggctgcatcgattccatgttaatgcttcgcccgatgatgaattccgctcatcacgtaacatagcgatcagtttattcaagcgatataagaaaattattgatcgaggaggaggtggagaaaacctaaaagagtttgtcagtgctggagtgaccgcatatgcactagggtgtacagatgaggggcttagaaaggaacttatggatcttgaagattctggtctagagattgaaggcttagggtccttaggggggaccagctcgaagttcaaagtccactcctttgagattcgtgagtgcattatgtggctcagtatagtgttcatcacaatattgtgcacaccacaactaacagttaccaggtggtctactaacccaccggtgtcagctgacgtcttgcatcagtggaaaggattttgtgctataatcgcaaacgcttactatgtcaaaggaatggcatggttaccagtgaaaaccttgcagctggaacagatggctgtcacaggaaattcagaggaaccatcagtagttgctagccgcatgcagttagttttcagcacattagaggtagtcagcccacagtggccaagagtgtgattatatgaaagcaatacgatcaaacaaaggtctgcagttttattctgaccagaaagatatgcatgttcaagttcaaacctctgtcatggtgcaacaaatgatactcccctatgtaaattttaactcaaatgtcaaataaaaatgttagtgtactttattgtgaagtatttgatttgatatacatatacaacaacttctatgtgcatcaggagttctagtaagtaaataagtattccctactgctccaaaaaaaaaaaaaaaaaaaaaaaaaaaa

SEQ ID NO: 19299 - DNA, 773 bp, Triticum aestivum
  unsure (1)..(773): unsure at all n locations
  Clone ID: PAT_TA_19299
gaaagaaattgccagaacagtccaaggaacctcaggcgtgagagaagctattcacggtctccatccccacgccgtggacggggccgcagccggagctacagcagaagccggagctatagccgatccaggtccccgtctggatctcccaggggtggacgccgcgaccgtgacgagaggagatcaaggagcctgagctacagcaggagcgcaagccccaggcgttctgtgtcacctggtcgaaggaaaaggagcgcagccgcactcctgatggcagtaggagcccaaggagccccagcccaagggacgatgtgagcccaccaccaaaaggataatggtgcccacaacggcccagaccgtgtagacagccctnggggccagggagatcagcaagaggacccgccccccctctggcggcctcccccgcccggccgccggggcgccccgcccgtgccctagccccgaccctaccccgggccccacccgcccccctggggatcacgggcgcccccgctccccaaggggcaggcggtcccctcgccccgtcaccctcccgaccatccccgggcgcagtgccccgcttcgggggcatctgctgttttttcagtttgagtcagccaactggatttgcgcatttcccggtcttgcgccctttaccctagaaaacttgtgtaagaatttgttgccctcgggctatgcctggtttgtgatatggtgatatttgaactatttagcctgccaaatcttaatattgaactaccaagtatcttgagttt

SEQ ID NO: 19300 - DNA, 654 bp, Triticum aestivum
  unsure (1)..(654): unsure at all n locations
  Clone ID: PAT_TA_19300
atgttgctctggacatgagagcacccccttttcatcatctatcggcagggcaaaaaggtgactcttctgataggctaacagccgagacaaacttgtacacgagatcactcaacggcattgctgctactgcagcaggagtggcagcaactactcacagaaaagtcggtgttgttccatttggcatgtcaagcatgtattagtgaccggatcatggccaagttatggtgaatcctacgtgcctttgttggagctatgctgccttcaggtggctaaacatcgataatgaagcggccgctcgagcctttggctggatgctgccaagtttagagtgcagagcaatacagggtttntcctgcgtggtcaggaaaacaggaaccaccatcggcggcgtgaagcgtgtcaacatgtttgttctatttagggcaccagctagtatctgcctgtgcttgagaagtgtgcccttggttgcacactgaagggtactccagcggcttgtaatctgggcaaatttaggcgccaatttcttttctagagcgaggaggcagaagggaaaggaaggaacattaacgttttaaatattgtatagagatgtttctcatatatcaatcaacgtgctacaccagaattacttagaaaaaaaaaaaaaacaacaaa

SEQ ID NO: 19301 - DNA, 573 bp, Triticum aestivum
  Clone ID: PAT_TA_19301
tggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacagtgaggcgtgtttgctccggtaggtcattgggttgtcgagatggaattaattaatattatttcaaggcactcttatattgcattcttgtcaatagaggtggtttcgaaaggctcctgattttgatggtcccatggcccggtctcatctatttatatcacatatgccctgttatgtctatgaacaagtggtgctctactgtgattgctgtgttgagacatgcttaatttctttccaaaaaaaaaaaa

SEQ ID NO: 19302 - DNA, 604 bp, Triticum aestivum
  Clone ID: PAT_TA_19302
gcagcagcagagcgtgaggtgcagtgcactaccaggcatcaagaaatggagctccaggcgaggtgcctctgcgtcgtcgcgatgctcctggtggccggcctcgccgggctggagacggcgcacggtgcgggggagtgcggccgcgtcccggtggaccaggtggcgctcaagcttgccccgtgcgcggcggccacgcagaacccgcgcgccgcggtgccgccgagctgctgcgcgcaggtgcgcgccatcgggagaagccccaagtgcctgtgcgccgtcatgctgtccgacaccgcgcggaaggcccgcggcaagcctgccgtcgccatgaccatccccaagcgctgcgccatagccaaccgccccgtcggctacaagtgcggcccatatactctgccatgaagtgatcacgaggagcaaagtgatggctggcagagtggcactggcacctgaaggactccaaactctgactagcaatatgccgttacctgcgtcatatcttacttttcacagatccccagaataatgtggctgtaataatgcctgaactttggaataaaagtatttcttttccctgaaaaaaaaaaaaaaaaaaaaaaaaaaa

SEQ ID NO: 19303 - DNA, 312 bp, Triticum aestivum
  Clone ID: PAT_TA_19303
gagctattttgtttatgagttaatgaagatagtcctgaaagtggagtgaatacaaagtaattggtgagcctacgaagcaagttcaaatggtgaccacgtatcttgataaaattgccggaaaaaaaaccagtaacttatcaagttttctcgtaggcttgcttgacgaaagcaccagatgcagtgagggtagcttcaggttattgttcaactgaagctttgcacactagttgaccaaattgtacacgaggtcctgttgaagacctgattcgtggcttaatagaagattgttctctaaaaaaaaaaaaaaaaaaa

SEQ ID NO: 19304 - DNA, 919 bp, Triticum aestivum
  Clone ID: PAT_TA_19304
cgaggcagtcattataaacgtggaaagcttgagggagcaattggttgctgaaatcagtcgggtgctgaaagctggtggaagagtattggtgcagagccctgcactctcatccagtcagaagccaaacactgatattgagcgcaagttactgatgggaggatttgctgaagtgcaatcttctgctgccgacgcgcaggatagcgtgcaatctgttacagttaaggcaaagaaggctagctggagcatgggctcttcttttcccctcaagaaagcaacgagggcccttcccaagattcaaattgatgatgactctgatctgattgatgaagacagccttttgactgaagaggacctgaagaaaccacaacttccagttgtcggggattgtgaagtgggggcagcaaagaaagcatgcaagaactgtacttgtggcagggctgaggctgaggagaaggttgggaagctagagctcactgcagaacagatcaataaccctcagtcagcttgtggcagttgtgggttgggcgatgcctttagatgtggaacctgtccttacagaggtcttccaccattcaagcctggcgagaaggtttccttgtctggcaacttccttgctgctgacatatgatggcatcatcagatacatgcaagtgaacatcggcaaaacgaggagataggaatacttctgtcaatttgttcgttcgtttggatgctacgttgttagttgaggtcgatgctcaccggtttacgttcaaaaaaaattgatgctcaccggaagaactgcattttaaatagcttctgttagccaatgcgagcgtgcgtgtgacttgtctttcggataatgtactcgtgccgattgtttgatactacaagacggtgatatcctacatattttctctcaagttggccaagcgcgcct

SEQ ID NO: 19305 - DNA, 659 bp, Triticum aestivum
  Clone ID: PAT_TA_19305
cacgagggggtttcggtgttaatggacaggcaggtgaagtgatctccctgtttcgctccatggaagaagatggagtggtgcctaacgaggtcacctttcttgcggtactgaatgcctgtagccatggtgggttggtgtcggaagggaagaagttcatggagagcatggtgttgcaatatggcatcttccctaacactgaacactatggctgcatcatcgatctcctgggaagggcggggcggttggatgaagcttatgagctcatagcgagcctatcttcccagagtgatgccacagcatggagagccttgcttgcggcctgcagagtccatggcaatgccaacctggggaggatggtgcaggcacggttggataacatggacgactaccatccatcagatgccattcttttgtcaaatacatatgcattggaaagccgatgggatgagattgcacatgtcagagattcagaagatcagaaaattgtcaaggacaagaaggaaccaggttgcagctccatagaagtgtcttggtgaggaactattcacacttccaccgggcgtgactatcatgcaagcaagactgagaaaagcactggaatggaagactaaaaggacagcgctttagtgaattcgttgcagccccttacgctctcttgt

SEQ ID NO: 19306 - DNA, 770 bp, Triticum aestivum
  Clone ID: PAT_TA_19306
gcacgaggcttctagttttccttacctattccctttcattaatattccttcttttgttttcttgcacccatgtttcttgtttgattcataccttaatctgcctccaatggtcatttgatttagcatcgtgcatgtattgtttccctgatattcttattttttttggaactgggtaaattttattactcagcagctaacacatcattagcaacaagtacctgaacgctattaggaaccgagctcataatttgctcatatttctcagcgctctatctgtgtaccctatattatttgtttatgggattaaatttctactcttttggctgggactagaacaattaaatgcctttagttaccaagtttaggccgacttgcatggtactgttgtgtgagttcaggataagttaagcagcgttagtgagggtaatcttctctcatatttggtttgcttgcccttttgttacaacacaacaaatataggcagtagcttcatacagtgaagggaggccaattctaccaggtacaagattatcttggtgatggtaatgacagttagaatgttacatcggaacaatgccaccctcttattaagcaaagcagatgagcaacagctttagacagtggaggaaagcacagatagcaggtagaagattaccatggtgatggtactggtgattagggcgaccatcggccaatgcaatccacttattaaggttgggaaagaatggaattttggtgtttgcttccaagtgctatttccaaatttagcc

SEQ ID NO: 19307 - DNA, 952 bp, Triticum aestivum
  Clone ID: PAT_TA_19307
cggcacgagcaattgttgattctaatactgatcttcatgttaccatgaagaggctagctgttggcaagtggggatgtaacaacgggcaggcatgcattgctccagactacgttataacaacaaaatcatttgctccagagctggttgactctttaaaaagagttttgaaaaggttctatggggaggatcctttgcaatcagaagacttgtcccgtattgtgaattctaaccatttccgtagattgacaaatttgatagaggataagaaagtcgcccaaaagattgtatatggtggccaaacagatgagaagcaactaaaaatagctcctactgtgttgttagatgttcctcttgatacaacactcatggcagaggaaatttttggtcccttacttcccattgtaacagttgacaagattgaagatagcatccagttcatcaactcaaggaccaagccacttgcagcctatcttttcaccaaggacaagaaactgcaagaggaatttgtgtccaatgtcccagcaggaggaatgcttgtaaatgatgttgccctgcatctcgccaatccgcacctgccatttggcggagtcggcgacagcgggatcggctcctaccatggcaaattcagcttcgattgtttcacccacaagaaggccgtcctgatccgcggcttcggaggggaggcaactgctaggtacccaccttacacgattgagaagcagaagatcctgagaggactgataaacggcagcttctttgcactgattcttgccctcctgggcttccccaaagagaggcgttagaaaactttcagtagtttcagtacagtacttgtgcatttgagtgagtgcaggccatgctgtcaatggaagccatttcctgcatgttgttttacacaggtgtacattatatttgtcggattttcttgtgtaacttattgaaaattctacta

SEQ ID NO: 19308 - DNA, 670 bp, Triticum aestivum
  Clone ID: PAT_TA_19308
gaaatgcttgggaccactgatgagaatcagcctctgcaggccatgatgaaggatcagtttggtaactatgttgtacagaaagtactcgagacttgtgatgaccagcaacgtgagttgatcctgtcacgggggggggttcacttaaatgctctgaagaaatatacatatgggaagcacatagttgctcgtgtagaaaaacttgttgccgctggtgagaggaggattgcacttcaaccgcaaaatccttcttaatggcgtaaagatgactatgtacagctaaccatggctagacagatctaccttctgccttctgctttgggctgctacaagccaagtttaaaaataaacatgttgtactacgaagtctgtacattttgtagtttgagcttatagtcatgcaaagatgaggctcagacagttttaattttaccagatgtcagctgcggagaataggcgttctgtataagttgtaggtgtaaagagaggaaagtctatattttgtgacgagactgtacaaatctgcgatcctgcgagagttagcatctgcttaggattaaattttattgcccaccttgttatcactaatggatgtttgtaatactgaataactgatgtaagggttccagcttctgaagctagatgcgtgttttgaaaaaaaaaaaaaaaaaaa

SEQ ID NO: 19309 - DNA, 755 bp, Triticum aestivum
  Clone ID: PAT_TA_19309
gtgaagaaaaagacggatttaccagttcgagaaaaaatatttcttctgttagatgctacacaaacatcccttggtggagctaaagcaaagtttcctcagtactatgaggcatactatgagttggtgtctgctggtgtgcaattttcaaatcgcccaaatgttcttgtcacacgagcagaagtgccagtcccagaaccgagaacagaaccaaataatgaaagtttagcgacccgtttgactgaagcccaacaggaagtgcacactcagcctgctcctgatgcaagtatagtccagaaagcctctagtgtcatggaagtattgagggatgtgcttaattctatggatcctaggcaccctgagggagcaacggatgaatttgtgttggaccttgtcgagcaatgtacgtttcaagaagcaacgaataatgcaccttgttatgacatcaagggatgaaacgctgggtatcacaagctatagagctaaatgaagagctacataaggtcctcgtccggcatgacgcgttgctttctgttcacccgacaacagcagtaccttctaatataaaggaggaagaggaggaagaggatccggaatctctccggcgcgcacggcgggaggggcttcctcggccccaggtcctcgccctcgtcccgctgccgtcgttccgcgcccgccccgtcgaccacctccggcggccccgggccatccaatcgcctcaccccgacaagcgactgggtgcgctgaacatccgctca

SEQ ID NO: 19310 - DNA, 792 bp, Triticum aestivum
  unsure (1)..(792): unsure at all n locations
  Clone ID: PAT_TA_19310
ggccacaacggatttccagtggtcgatgagccacctctgtcagaggctccagaacttgttgggcttgtgcttagatcccatctgctggtcttgttgaaaggcaagggcttcatgaaagagaagatgaaaaccagcggtagcttcgtgctgcaaagatttggtgccttcgattttgccaagcccggctcagggaaaggcctgaagattgaggacctggacttcactgatgaggaaatggacttgtacgtcgatctccatccaatcacaaacacatcgccgtacacggtggttgagaccatgtcacttgcgaaggccgccgtccttttccgggcactggggactcaaggcacctgctccgttgtgccaaagaccccaggggagacctccaattgttgngaatcctgacgaggcacgatttcatgccggagcatattcatggggctgttcccaaatatacacaagtcgcactaatgggagcactcattcagtaccatatctttcttccttgccgccgtccccttgtagctgtagcaactgtacgaaaaccaagctgctttggtccaatatatttgctaccggccatctggccttttcttttccattttgttctctcctggagtaccccgaaatcatataatcacgggataatattgtatttgtcgtaagcggcccctccccatgcactaatctggctgcgctcctgccggaacttattctagaaaccagggggccggtacaatccccnaaagggtctttacccnccaaggggtctttaaanctacggaaaaccgg

SEQ ID NO: 19311 - DNA, 580 bp, Triticum aestivum
  Clone ID: PAT_TA_19311
gccgaggaccgaagtgcccagcaccaccccctccgcccttccgccgcgaacccgccgctgtgtcggccccctccccagcaagatggccgagattgagataaaaacagcacctgctgacttccgcttccctacaacaaaccaaacaaggcattgttttactcgctacgtcgagtaccacaggtgtgtgaacgccaaaggggacgatgctggtgattgtgaaaaatttgccaagtattacaggtccctttgccctggagaatgggttgagaaatggaacgagcagagggagagtgggacgtttccaggacctctctgaatctactgcccgaggcctccccttggaccagtcaacaagttggccagtcctactgttccattctgcattcctactttcagaatcgtcaatgccttttgtcccttgctcttcaaccagtcaccgcaaaactgttagtgatgctctctttttgcagctctaataattggctacagttgcctcacatgcagccttgttttgtgtgtggacctcattttattcacgtataaacgtctgtgaatgaacttgcatttctttcgtgccaaa

SEQ ID NO: 19312 - DNA, 459 bp, Triticum aestivum
  Clone ID: PAT_TA_19312
attccttccctcctctcttctattttttttccctctcttttcttgctttgtttttctttttttttctattattgttacaagataaaaaattagaaagtgatcgatccatggagggtgttggttattattcattgtcacgctgttcttgacaattataccatccatgaccttgaggaggaggaggaagaaaagcgttggccaaaaagaaagaaaagaaaagaaaagtcatgggaggcagagaagaaggtggggatgaaaagaagagagcgatgataatgttattgtagcggtggtggttgggtggaggcgggaaagaagcgatagggtaacccttcggtttggtgtgttgtcctgcttcaatcacaaatctctatatacatttttatatataccttgtataaaattataaagttatttatttgaattatatatggttgccaaaaaaaaaaaaaaaaaaaa

SEQ ID NO: 19313 - DNA, 628 bp, Triticum aestivum
  Clone ID: PAT_TA_19313
cgtgagagctgaaatccactggctgatcactacagcatcgccgagcgtgctctagctagatagaagcgaggagacaaagatggagaacaacggcaacaggcagcaggcgccgccgccaccaccaggctacccgacggcggctgcaggcgcggaggagcagggaggcaggaagggacgccgggggaagacgacctcgcgtggggagaaaggcttcatcgaaggatgcatcgcggcgctctgctgctgctggatctgcgagatgtgctgcgactaggcaggcatgcacgccgcagcacgctccggcagtccggcggacaagagagaattgctcagctgtgtacttgttgtttaatttcggtgtagtaaaggagcttattagcttataatttgttaataactgtggtgagatgatacatgcgcgctagctgcctgtcttttatttgtgctgtaggtagtacgtgtacatcccgtactgtaccgttacttgtgctgtgtgtgtatggagtggagaaggtggcgttggtgatctatatacgtgaaccttctaggtgctacacgtacttgaaaatgtctcatccaatcactctccatgaattattatcgaaaaaggaaaaaaaaaaaaaaaaaa

SEQ ID NO: 19314 - DNA, 693 bp, Triticum aestivum
  Clone ID: PAT_TA_19314
ggcatgtcgcaacagctacaaacgcccacatcacacgcagaaatccgcatcaacaagcgcagccagccatggcgtccacgctgaccaacgtcggcctgtctaccccggcggcggcggcgtcgtccctcgttaggccggtcgccggagctggacgcgtggtgtttccccgtgttggccgcggcgggttcgcggcggtgagggcgagcgggccggcgacgccgccggacatctcggacaagatgtcggagagcatcgacaaggcgaaggaggcgtgcgcggaggacacggcgagcggcaagtgcgcggcggcgtgggacgaggtggaggagctgagcgcggcggcgagccacgcgcgcgacaagctcaaggagacctccgacccgctcgaggcctactgcaaggacaacccggagaccgacgagtgccgcacctacgacaactgattcttaccattatatgtttgctaatctctctgtaattaattataagttactgggttgaaaagattatttgtcgtagaagacagaggggagtttggtggaatggtggtatttacggatagttcaagggggaaatgggaaaaaaaaggttttttacacttgtttgtctggatgaatttgtatggaacttttctgcttgataattttcgcgtgtgttagtatttgcatatgatgatataagtgggaaataaat

SEQ ID NO: 19315 - DNA, 986 bp, Triticum aestivum
  unsure (1)..(986): unsure at all n locations
  Clone ID: PAT_TA_19315
gcacgaggctcgcctcttcagatcgaccgaccgtgaggaagcgaatcggctcgtcagcccgtcgccatggccgccgtggaggtgtgcgtgaaggcagccgccgggaagcccgacacgctcggcgactgcccggtctcgcagagggtgctgctcacgctggaggagaagaaagtcccctacgaggtcaagctcgtcgacctcggcaacaagcccgaatggtttctggagattaacccatagggtaaggtgcctgtgctcaaaggtgatgatggtaaatgcattgctgattctgatgtaatcacccaagtcatcgaggagaagttcccaactccatctctggtcacccctccagaatatgcatcagtgggatcgaagattttcccagcctttgtcaagttcttgaagagcaaggatgctagtgatggttcagagaaggcgcttctggatgagctgcaggcactggatgagcatctcaaagctcatggcccttacatcaatggggcccgtgccgcagcggctgatcttagcctggcgccaaagctcttccacctccaggtcgcactggagcatttcaaaggctggaagatcccagaaaacctaaccaacgtccacgcctacgccaaggctcttttcagccgtgaatcttttgtcaagactaagccatccgaggagcacgtgattgcgggatgggcgcccaaggtgaatgcataagagccttgtgctttggtgctacctggtggactccatccatttatcttatcagtctttgtcagtggtgtggataggtgtcaagtctgtagcctagatgcatgattcagttggaattatgcagtgccgtgtctcgagtactcagttctgggctgttgcggttgtgcatcttaccttctgttgctgggttttgtttganggcatggggcatctcttgggcctaagctgtgagaacgctgtaatgtggggtancaaataatgggagctgcttttatgct

SEQ ID NO: 19316 - DNA, 703 bp, Triticum aestivum
  unsure (1)..(703): unsure at all n locations
  Clone ID: PAT_TA_19316
ggcacgagatttctcatacctacaagctctgctcatctatcgctagctccctctagctaccagatcttcttccaagcctggttagcagtccaagctagctagctagctagctagcttgggtcttcgtcctcgagcgcgcgtggcgtggcgatgatcatgtccgacccggccatgctgccgccgggcttccggttccacccgacggacgaggagctcatcctccactacctccgcaaccgcgccgccgaatcgccctgccccgtctccatcatcgccgacgtagatatctacaagttcgacccatgggccctgccatccaaggctagctacggggacagggagtggtacttcttcacgccgagggaccgtaagtaccccaacggtgtccggccgaaccgcgccgcgggctccggctactgggaagccaccggcaccggacaagcccatccgctgcagcgccaccgccgagagcgtcggcgtcaagaaggccctgtctttacaaggccgccgccaaggcatcaagacaactggatcatgccgaatacgctggcgcgcgacgcgacgcgcacactacgccatgagtcgacgctcatagntgatatggtgtggcgantaaaaaanncagatgcntggggcacgtgcaccactgcacttgntcgtccagnangcgataanaggccggttctagcggcggcnagncaac

SEQ ID NO: 19317 - DNA, 669 bp, Triticum aestivum
  Clone ID: PAT_TA_19317
tttttttttttttttttgtgtggcttttcgttggcttttttgacggtttaaactcgaagagttgtcatctgtggaatcacaaaagattacatgtaactaaagtccacaaacaagcagtattagctgatctagcaaccattcgattacaggtgtatcggttatgatcatggtggccacaagggggagttggcttctagcagagtcttaaaccctagacgttcccagcttgcgctcgaagagccggcgcaggagatagacttggatgacgctggcggcgatcagcgccgctgactcgaagagcgccttgtggactgccctcctgctcatgttctcgttcaatattgcttgacggtcagtctgggcctctagcccagtgctgttcgaactgaatattgtaaagtgcctcgtccaacttgcctatttgctcgaaaagtggtgcaaaatgctcatctttggcatgctgctcgaaatatgaaaaatggccaacatgcacatcgaagtctatcgtttcgtgatacggggattttgtttcgtgaagcagaagcgatggacgcctctcttctgaactatgaactcaaacttgtcactagtcttatctcgggaatcacggacttgaccgccattaggatccttaaccacaagatcaacgccttcctcgctgtaatgcca

SEQ ID NO: 19318 - DNA, 698 bp, Triticum aestivum
  Clone ID: PAT_TA_19318
cgccgccgcttgctcccgttctcgccgtcgcagcccgggaagacgagagagtgtggccgccgcctgcttcttctctagcgctacacctcgatgggtcaaggtctgagccagcccgcgcaggcggtggaggagccttctccgcctgccgtcgaggcggcgccgtcgtcgtcgccgtctcctgccccggcgccatcttccctcgaggcgctcgccgcagaggctatgtcatttgacgaggatggcaatgagtattttgtgtattcagtcaattgatgtgaaggtacagaaagcactggactgtccatgtgtagctgagttgaaaaatggtccttgtggaagtcaatttgttgatgcgttctcttgcttcctgaaaagcacagaagaggaaaagggatcagattgtgtgaagccttttatcgcactgcaggactgcatcaaaatcaatccagaggcgttttctaaagagattttggaagaagaggagaatgacgaggaggctgagaagtccaacctgaaagttagagcaccagcatggtccagagaatctaagccaaagctttgattagatggtgtggtgtttggctgatacactgatacaggcattcctccaccagtcgacacacaacatcaccttgtttcttctacgagtgcttccgtattagatcaattgtttttgagatggtggtacataaatttga

SEQ ID NO: 19319 - DNA, 642 bp, Triticum aestivum
  Clone ID: PAT_TA_19319
agggttttatcggcggcggcggcgatatggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgccttcttggttgaggaacagaagattgtcaagaaggtcctgaaaatacagaaaaccaaggacaagacagctgcaaaatagagctccaggaatggaagcctagcactgttttgtacactgcgaaaagtatttttggtggatggaaaatctagttgccttgtgttgagcatttagcatgtgagacatacctgttgaagtgttgagtttagagagtctggacactggaatatccctttcacctttgaattgttggaatattgggacatctgttccccaagttgctttgttatgaattcagaccatatctgggtaaaaaaaaaaaaaaaaaaaaaaaaaa

SEQ ID NO: 19320 - DNA, 745 bp, Triticum aestivum
  Clone ID: PAT_TA_19320
gcacgaggcctcgtgttgccggcggcgacccacctgcccggcggccggctacccccgccacgcaccaccgccggatcaagcctccctgccacaaaccaggagctcttcctcgccggcgctctcctcatccacccgtagcaggaatggagaagtatcacagcaactcccgatttgctcccttcagagatgctccatttgctctccgtggtgcccttggtagctcaggctcatctttcagcagcatcgacagcctcagacgctcctcaacccttgagcaagctagggggtacacatctcgtcccctaggagctgtgcggccaaagatgctcccatctggatgccgacccctgcacacaagccatcctctgtcggctcctgttgctaaccgccccctgtcaccccaccttcctctgaagaagccacagctgagtgctacattctctatctcgcaccgtatatttggtgctgcgttgggtgctgccattatatccattcctctcgccaccaagttcagcctcatgtttgatgtctgagagagaaatgtggtctgcatgatgagaaagaaatgctatatttctgtgactatctcagcatctgaatttgccttgcaatgcaactgtagctgccgttggaataatatctttgctgtgcttgtagacttgtgaataataaacaaaacatgcaatgaccatactccctgtgagatatgatgttttatgctaagtgttaattttctctaccaaaa

SEQ ID NO: 19321 - DNA, 708 bp, Triticum aestivum
  Clone ID: PAT_TA_19321
cttaggaaagagcagtccaagtgccttgcgtgcggcagttctggtggtgccagctctcgccggcccgctttttggtgccggtctgtccgctaaacatgaactccaagagatgatccaatatcccgttgaataccctgacaaatttttaaagttcggtatgactccatccagaggagttctcttctatggaccaccaggttgtggtaaaacacttttagctaaggctattgccaatgaatgccaggctaacttcatctctatcaaaggacctgaactgcttactatgtggtttggtgaatctgaagctaacgtccgtgatgtttttgataaggcaagagctgctgctccttgtgtccttttcttcgatgagttggactcaatcgctaaagctagaggtggcagtgttggagatgccggtggagctgctgatcgtgtcattaatcagattttgactgaaatggacggtatgggtagtaaaaagaatgttttcatcattggtgctactaacaggcctgatattatcgatcctgcaatacttcgacctggacgtttggatcaacttatctacattcctctacctgatgagaagtcacgagagtccattctcaaagccaatttgagaaaatctcctattgctaaggatgttgatttaacttacgttgctaaagtcactcatggtttcagtggagctgatttgactgaaatctg

SEQ ID NO: 19322 - DNA, 622 bp, Triticum aestivum
  Clone ID: PAT_TA_19322
atcgtgttcaccaccaaccacgtcggcaagctggacccggcgctgatccggacggggcggatggacaagaaggtcgagatgtcctactgcgactacgagtccttcaagttcctggcgcggatgcacctccgcgacgacgacgtcgtcgaggcgcacgaggcgcagtgccgccgtgttagagcgttgctcgaggaagtgaacatggtgcccgtcgacgtcggcgagcacctcacgcccaggagccccggcgaattcgaagacgccggaccgtgcctcgataggctggtgaccgcgttggagaaggccaaggaggaggagggtgcgagactaccgcctaccggggccacaggcacaacctgatgtcaacggcattggcatcgttgtggacgatgatagtaataactaggtacgctagggcgttggttgctactccggtgactcgatcatctgttgtttatctttttgcttattatctttttgctttcaatcaagaataaactagtgtgcagttgcgcagctaatggctatcagtgtgtcctgctcccaaatcagggtttgggtgaacttcagcagatctagaggagatatatccttaaaatttataaaaaaaaaaaaaaaaaaa

SEQ ID NO: 19323 - DNA, 1383 bp, Triticum aestivum
  unsure (1)..(1383): unsure at all n locations
  Clone ID: PAT_TA_19323
gcaccgaggcaataatgtaccctgagataaatgctcttgtggatgagctacaccgaagacacatatctacgtttctggttacaaatgctcaatttcctgaaaagattaaggcattgaaaccaatcactcagctgtatgtcagtgtggatgcagctacaaaggagagcttgaaggctgttgataggccactattttcagacttctgggagcgtttcctggattcactcaagtcattgcatgaaaaagatcaaagaacagtttaccgacttacactggttaaaggctggaatgcagaagagatagatgcatatgcgaaactgctagatctcggccagcctgatttcattgaaatcaagggtgtaacatactgtggctcgtcagcgacttcaaagttgacaatggaaaatgtaccttggcactctgatgtatgggattgctccgagctggtggctgcttaagccggtggtgggcgcgcaggggcgtgtgcccgtgctccttcatgcggggccctccctgcgacggtgggcatgttctcttgttggcgaaccaattatgtacccagagataaatactctggttgatgacctacatcgcagacacatatctacgtttctggttacaaatgctccatttcctgaaaagaggctggctctggagcctatcacccagctgtatgtcagtgtggatgcagctacaaaagaaagcctgaagcctgttgacaggccactcttttccggacttctggggagcgttttctgggattccgctcaagtccctgcatgacaaagatcaaaggacggtgtaccgactgacactggtcaaaggctggaatgtggaagagatagatgcatatgcaaacttactaaaacttggacaacctgatttcattgaaatcaagggtgtaacatactgtggctcgtcagcaacttcaaagttgacaatggaaaatgtcccctggcacgctgatgtaaaagaattctctgaggtgttggcatcaaaaagtggtggcatatatgaattagcctgcgagcatgtgcattcatgctgtgtcctgctcgcaaaggtggacaagttcaagatcaatggaaaatggcatacctggatagattacgaccgattcaatgaactggtgacatctggcaagcctttcaagagcagtgattacatggccgtgacaccttcttgggccgtctaggccgccgacgcgcgcggcctggaccccctccaggcgcgccgcatggacgcacgccgccctgcctgcctgctgcccccacaggtggacccctcgcacgatgcctcgcccacacgccggtggctggggtccggctgcttccccctcctatcggtcatgtccaacggcaanattccaagaggggaaaattt

SEQ ID NO: 19324 - DNA, 722 bp, Triticum aestivum
  unsure (1)..(722): unsure at all n locations
  Clone ID: PAT_TA_19324
gcacgaggccgagcccttcttcctaccccgtccccgatccactcccggcttcccgctccgatcgatctgattcgccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctccggccgccgagctccgccatgtcatgacaaatcttggtgagaagctaactgatgaagagtggacgagatatccgttgaggctgatgtcgatggtgatggccagttcaactacgaggatttgtcaaggtcatgatggccaagtgaccacagaaccataatctgaaggcaagaaatttcatgcatattatccagatcactttgatccacgactcactgaaaatcgctacggtggcgcagtctgcttgttccgcttgccgccacgcgatgcagttccggctgtgctcttcccccccgcgnttatgagtaacaagttttncncnaataatttt

SEQ ID NO: 19325 - DNA, 1048 bp, Triticum aestivum
  Clone ID: PAT_TA_19325
tatctttgcatctctccctcgccggtctcagtttatgagggggagcgggagttttataatccatacgctgcatcagggactcaattatagaggtcttgacgttaagctaaaaggggcgccctggtctagtacgcttctgattaaggctagctcctcatacctttcttttcctttcttcttcctcctccttcgtcttcctctcctctcctctcctctgcgcttcctttcttgctctgggactgggcaacaatgtcccccgtgccaagcccgcatcaatcacaacttctaggccatgaatcaaggaaagagaagcgcatgaggaaggtggatacctttgcgccgcacaacgacggccaccaatggaggaagtacggcgagaagaagattaacaactgcaactttcccaggtactactacagatgcacctacaaagacaacatgaattgcccggccaccaagcagattcagcagaaagatcacagcgaccccccattgtaccaagtcacatactacaacgagcattcatgcaacagcgccttccttgccctcacccctacagagttccagctgcagaccgcatctgggtaaggcagtctccatctgctttgattcatccggggctcagggagcccggagccaatgccagctcgccatcttcgagtgcggcgccacgcggcacgccttccgagagcaagaacaagccccttgcgctgcgttcagaggcgctttcttccttggcccctggcgttgtggagcaaaagacagcctgtgctgatctccagtcctgcagcaccgagtgcaaagatgcatacatttccgaagacatagatgcagggagattcggttctatcagattcttccattttttgtaaatggatcagtggaaggcaattgatcttacctcaaagaactaatatgatacacatgttttttcccatctacacgcatgctagagcaccagatacttgcatgtgggatgtagccaagattttcttagttcaattgaaatgaaataccactgctaattcagaaaaaaaaaaaaaaaaaa

SEQ ID NO: 19326 - DNA, 783 bp, Triticum aestivum
  Clone ID: PAT_TA_19326
cagcagcagcagcagcatcatcatccaagaagaggcgcagccatggcgagcgagcacgcggcggcgggtgaggggaagcacgagaagcagagtctgatggacaaggcgaaggagttcgtcgccgacaagatcgcgcacatcccgaagccggaggcgacgctggacgcggtgacgttcaaaggtctgagcagggagtgcatcacgctgcacagcagcgtgaacgtgtccaacccctacgaccaccgcctccccatctgcgaggtgacctacacgctccggtgcgccggcagggaggtggcgtcggggaccatgccggaccccgggtggatcgccgccagcggcaccacctcgctggagatccccgccaaggtgccctacgacttcatcgtctccatcgtccgcgacgttggtagggactgggacctcgactacgagctccaggtcgggctcaccgtcgacctccccatcgttggcaacttcaccatcccgctctccacctccggcgagttcaagctacccactctcaaggacttgttctgatctgatagcttgctttctgttctgtcgtcgcctgagctgagagcctgagacggatgagtgacagcgatctgtactgtactctgtgttgcgcgtgatctgaatgatccctacgacgaacgcaccatatcttgttgcaaataaacgcaggtcctctgttccattccattgctttccagtttgtttcccaatgaatgaatgcaaaaggaagatggtttgattgcaaataaaacagcgagaggtctg

SEQ ID NO: 19327 - DNA, 292 bp, Triticum aestivum
  Clone ID: PAT_TA_19327
agatttttttttgtgtcatggtctcctggctttgtacaaatacctagggacttgtcagtgatctaacctgtgatatagggaccttgtaaatttcgttgagagttcatacaaagctaaccggtggatgcatttgtcacatgtgagaattgagaagtcaacttccacatactattattgtaagaatttctgtaaattgaagttggcgaacaaaatttttctcaacaaattggtgtcattatatcactctgatggtcattcatcaggattgagtttattaaaaaaaaaaaaaaaa

SEQ ID NO: 19328 - DNA, 660 bp, Triticum aestivum
  Clone ID: PAT_TA_19328
cacgaggctattgtcgttttggccttagcatcttttggcgctgatatgatgccttacttacatggtttcattggtgtctaatttaacccaaagttgtattcagtgtagatatatacacaaattcagagaattctggattcggcccgccttcgtctcataaataaagcctaaagcttgtagcgttcagatccgctatggcgctgcgttctcttctactgctaaggattcagggtgttgttctcccgtcaacgaaaggcccccgtacggggctcttgtccgggctgtcgccggcggcggcgacgactcgatttatgggcaccaaatctcagtgtgaacatcgcttcccgacaactattgctgaggctgaacaaaggatgacccaactgcgggattcaataaaggccatgcagcaagagaccattaaggaccagcagaagctacgggaagagctgactgagttcgataaaaatatcaggcgtgagttcgctgaggtatcaagttctgctgataaagccaggaaagttggaagcgcatttgtggctgccgtccttggcactccattgcttctgatatttatgagcaagtatcaaccaacagactgagttggaaacgcacttgtggctgccgtcctggcccccattgcctctgatatttgggagc

SEQ ID NO: 19329 - DNA, 644 bp, Triticum aestivum
  Clone ID: PAT_TA_19329
acagaagtttgtaggaaagagcaccaagctctaggaatctctctcgttacgtcatcccgtgcaatagctcttgctctcgcccccgccctcgctcgctctctcgctctccctcccgcaaagtacccaaatatttttcccaaagagtccatatttgggaggtttccatatttcctcccatgctttgtcatatcgatactagcaacaggatcatgtattgcatgcatttggcttccggaaacactgcactttcataatgatcaaaaggtcaaagctattgacgaattggaggcagaagttggtgactccaacttagaaggtggaaaagttaaagaatctagcgacacatctacaaagaacctactaaagaattggcaattgatgtcagcagtaattatctattgtatcttttgtctccatgacacagcctatcttgagacattttcactctgggcagtgagtagcaaaaaatttcgaggcctgagtttgacgtcccaggatgttggcattgtgctagctgtctcaggtttgggtgttctggcataccaacttgatctttatccttttattgccaagtcttttggaccaatcaggccattacgtcctgctgcggtcttgtctgtacttcttctcacaacatatccctt

SEQ ID NO: 19330 - DNA, 1140 bp, Triticum aestivum
  Clone ID: PAT_TA_19330
gctgagctgctaatccgtatggcggcgacggcggcggcacccgatgactccaccgtcagagagacgacgaaagcgtctgaggaggtgctgcccccaaccctgggttctggttctcaaccaccaaacctcttcgatggcacaacaaggctctacatctcctacatatgcccatatgtgcagagagtctggatagctaggaacttcaaggggttacaagaaaagattcagctggttgccattgatttgcaagacaagcctgcttggttcctcgagaaagtttacccaccgggcaaggtccccgtcctggagcacaatggcaacatcatagcagagtccttggatctactcagctacctggacgccaactttgagggccccaaattgtttcctggtgatcaggaccctgccaaacaagcttttgctgatgagttgattgccaacagcgattccatcatcatagccttgttcagggcaggccgtgcctatgccgaaggacaaggagatgatgatatcagtaagctacttgctcctgctcttgacaaggtggaggagtccctgggacgtttctctgatgggccattcctcctggggcagtccatgagcgcagtcgacatggtttatgcgccctttattgaacgcttcaaggatttcttcgctgcagtgaagcactacgatatgacacaagaaaggcctaaactcaaggagtggatagaggagctcaacaagatagatgcctacacagcgacctggggggatcgccgtctgcagcttgctgccttgatgaacaagtttgggatacaaagcccagtagcctgatctgatcttatcatccctaggggaggacatcttgtcaggcgtttcatgttgtatatgagttggaataagtctcaactgaataagatgtgtgtctgctataatgttacctatgttatggcccggccaggcctgtccgaagccagcccatgtccaggccatggccacattcgcattcgcattatccggcgccggtgacgagtttgaccgctgccgtatgtaagtgcagttgaataacctcgctgcaatctactaaacttgctactacgattctatactgcatggatgtaatttaaaaaacaggttttctcaaaaaaaaaaaaaaaa

SEQ ID NO: 19331 - DNA, 597 bp, Triticum aestivum
  Clone ID: PAT_TA_19331
gcgataccctacctcacttcgccgccccgcttcgacggcgcgcgcttccgacccggctcgtgttccgcccggccggatccgacggtcgctcgctgctgcagcgggcgcttgctgtgcgtcgcgtcggttcggccggagggagggagggaggcggagcctagccttccctgggtctcggagatggcggcgccgccggcgagggcccgggccgactacgactacctcatcaagctgctcctcatcggcgatagcggtgttggtaaaagttgtctccttttacggttctcagatggctccttcaccactagctttatcaccaccattgggattgacttcacaataagaacagttgagcttgatggtaagcgcatacagttccagatatgggatactgctggtcaagaacgttttcgaactattacaaccgccctactacaggggtgcaatgggaattttgcttgtctatgatgttactgatgagtcatctttcaataatataagaaactggattaggaacattgagcaacatgcttccgacaatgtgaataaaattttggtacgcaacaaagctgacatggatgaaagcaaacgggctgt

SEQ ID NO: 19332 - DNA, 696 bp, Triticum aestivum
  Clone ID: PAT_TA_19332
cgctcttgcagtgacatgtcacgcgccgccgccttcacctcctccaacggtccattgacgatgaagacggaaagagagagggcgagagctagaggggatggggagaggaaggcacgcaccgagttcccctccttccttcgtagcaattggtgcttccaccagcaagctttctataacgtggagtgtcgccgaccacggccgcagcctccttcctctggattggactccactgggaactcctccgacatatcaagtgtgcctgtccaccttcttcctctgaggcaaagagtggatcaagcaagctgagttgggcttcctgtttccacggtgctaaatcctcatttctccattctctacactcacatcgtttcctgttttttttacagatctgactcagcaccttgatctgctcaacaaccggagcccccacctccttctacatcccaaagatggatatgcatcttctgtattcagttaggataaggcttccaaggtctgcataaagcaaccgtttcacctgatgtttatgactgaaagtaatgcagtatcaggcatgcaaaaatagaagtttagttgatctactggtgcttcatctgcaaacaccatggatcagttcatgacagcatgaccataaggatgggagggacaagaacaaggtgtccattaaagttatggagataatgctgttcaggccgg

SEQ ID NO: 19333 - DNA, 826 bp, Triticum aestivum
  Clone ID: PAT_TA_19333
cttatgtcgtctggaaaacgctgggtttgccatcaatgcagaagtttttacatctgtgacaagtgttacagtgcagaacaacatcttgaagatagggagaggcatccgagtaatagtagagacacacataagctccatccagttgacattgttggggtgcctgaagagacaaaggatagagacgatattctagaaagtgagttttttgacaccaggcaggcatttctcagtctttgtcaagggaaccattaccaatatgacacccttcgccgtgctaagcattcgtcaatgatggtgttgtaccacctacataatcccactgcaccagcgtttgtcactacatgcaatgtctgtagccatgatattgaaactggtcaaggctggcggtgtgaaatttgtccagattttgatgtgtgcaatggttgttaccaaaaaggagcagtcaatcatcctcacaagttgacaaaccatccatcagttgccgaccgtgatgcccaaaacaaggaagcccggcaaatgcgtgttcaacagctaaggaaaatgctcgatcttctggtacatgcctcgacatgccgctctggcagctgccaatatcctaactgccgtaaagtcaagggactatttcggcatgggatgcagtgcaagacgcgtgcttccggagggtgtgccctgtgcaagaaaatgtggtacatgcttcagctccatgcccgagcttgcagagattcaggatgcagtgtgccacggtgcagggatctcaaagagcatcttagaaggctgcaacagcagtccgattcccggaggagggctgctgttaatgagatgatga

SEQ ID NO: 19334 - DNA, 816 bp, Triticum aestivum
  Clone ID: PAT_TA_19334
gcacgaggcaaagatcttaatcagaccaagaaaacgcacagcgaaatcttccaacccacagactcacttcccagttcgcactcagctagcatagcaaatcagaagcagcaatgtcgctggtgaggcgcagcaacgtgttcgaccccttctccctctgacctctgggacccgttggacaacatgttccgctccatcgtcccgtcggcctccggcgactccgagaccgccgcgttcgccaacgcgcgcattgactggaaggagacgcccgaggcgcacgtgttcaaggccgacctccccggcgtgaagaaggaggaggtcaaggtggaggtggaggacggcaacgtgctcgtcatcagcggccagcgcagcagggagaaggaggacaagaacgacaagtggcaccgcgtggagcgcagcagcggccagttcacgaggcgcttccgcctgccggagaacgccaagacggaggaggtgaaggccggcctcgagaacggcgtgctcacggtcaccgtgcccaaggctgaggtcaagaagcccgaggtgaagagcatccagatctccggttgaagagccatgggggcggtgagagctcgcggcgtcggatctccggtttcagtttcagctacgcgacttgtgtgtgtgtgtgtcagtgcgtggttactctgagcttcggtatgtttggtgtgtactgttcagtgtttcatggtgcttcctagcagtgtctgtcgtgtactttgcctgtatgttgagctcggctcagtatgttctgggagtgaataaataaaaaaaaaattaaccagaaaaaaaaaaaaaaaa

SEQ ID NO: 19335 - DNA, 740 bp, Triticum aestivum
  Clone ID: PAT_TA_19335
agggttcctcttaaattggaacagctatttatactgaggacgccagatatgtcagccatgcatcatgacacctcacatgatctcaagcacctgggagctaagctgaaggatattctgggggttcctgatacttctctcgaagcaagatacattactcttcatgtgtgcgacctcgtcgcagagagaggtgcacgcttggctgctgctggtatatatggtattctgaagaagcttggcaaagacaaattgcttagtgacttcagtcaacaaaggactgtagttgctattgatggtggcttatacgagcattacaagaagttcagtgcctgcctagaagcgacgcttacagacctgctcggcgaggaggttgcctcatcggttgttgtcaagttggccaacgacggctcaggaatcggagctgcacttcttgcagcctcacactcccagtatgctgaagttgcatagttctaggagctcggctcctagtgtaacctttttcgttttgctcccttttccccttcaatcgcgagccaccctcgtgcgaatgtgcgattcgcatctctctcttttttgcctcagccgcggggtatagctaggatggtgccattgagcttggagtacattatcactagcattagcaacggcagaaaaaaaagtggaagcggaggtctgaataagccattccactcctgccaattctattttttcccaatcccttgaagttgtatatgatgcgatat

SEQ ID NO: 19336 - DNA, 644 bp, Triticum aestivum
  Clone ID: PAT_TA_19336
ctcatttggctcgttatgatgtggcgactgtcctaaaaaagttctattccattgaaatagataatctcagtgctccttctggagtggagatcatagactttctcgaggcatctccctcaccacttccttggatcagtgaggaagaactaggccaatatgctgaaaagtttcagaagtctgggttcactgcgcccctcaactactaccgcatgtgggagacgaattggaggcttcttgcaccctggaacggagccaagattacagtgcctgtgaagttcataggtggtgataaggacatcggtgtccagtcctttgggactgagaagtacatcaacagcggggcattcaagtccattgttccagatcttgaagtcaccgtcattgaaggccaccattttctccagcaagagcaggccgagagggtgaattcggagatgatttcctacctcgtcaagtttactagccaggaggcatcatcttgatgttttgttgatgtacgatgggtctccatttctttctgaactgaaaaagtcttgaataaagtgtgagctaagcatttgctggcttgcgtgtatgaatatgaataaaaagagcatgtgacaaaaatacttggtgctgaaaaaaaaaaaaaaaaaaaaaaaaca

SEQ ID NO: 19337 - DNA, 655 bp, Triticum aestivum
  Clone ID: PAT_TA_19337
ggcaacaagctcgcactgctttgagaacccgccggcgctggagccggccagcggaggaggcgaggtcgttgacgacttcggcgggcagaaggcatacatcaccggctccgccgggtccaaggcggccgtcgtcctcatctccgacgccttcggttttgaagcgccaaacctgaggaagatagccgaccaagttgcttcgtccggttactttgttgtggtgcccgatttcctgcatggggatccatatgacctcagcagcagcaatcctggaatgtggatacaggctcataatccgcaaaatgcatttgaagaggcaaaaccagtaattgctgcaataaaggagaagggagtgtcgagaattggagctgcaggttattgttggggagcaaaggtggttgtggaactggcgaaagttcacgagatccaggctgctgtattgttgcacccttctttactaactgacgatgatatcaaagaggtcaaatgtcccatttccatacttggagctgaaatcgataggtcatccccgcctgaattgttaaagcaggtcgggcaaattctttcagctaactctgagatcgatcactttggcaaaattttccctggcgtgccgcatggatgggctgtgagatacagccacgatgatgcatccgct

SEQ ID NO: 19338 - DNA, 677 bp, Triticum aestivum
  Clone ID: PAT_TA_19338
agggttgcgtttagcggcgcacagaggacggcgtggctgcgtcaggctgcgcgtggagcacagcgcaactgcagcggcacggggagattgctaggtacgtcgagattctgaagcgcttacgccgtgtccgctacgccatttcctcaggttttcctccacacatggattacacccaacacatgttcgataaaatgcgttcaaggtaataagaatttctgacatcctccatcaatctaccttcacccgcccgtcctcattgagatccagatccatatgttctctacagctagtggtgctacgtaatcggcacgccgcagcataggtcattgacgctggcacttaccatgcagtattgctacaaaatgttttgctgcctattactactttctccggggacggtgcactcggtagagtaacgctaagcttgattgctatcagtcttgttgtacttatattttagttacttggtcaatattagggaccgctagttttctgatatcaactgttgaggtgatgttcaggtacccgatgtgatttagtggtagttttatggtaattcgacagttgataatattcatttgactgagcctgttgactaatataattgtaattttcttagatataaccaaatgatatatataatcacaatattaattttcaatatctatctttattat

SEQ ID NO: 19339 - DNA, 754 bp, Triticum aestivum
  Clone ID: PAT_TA_19339
atacaacaagaaatggattcatttaagcagaagttgagcttcattgacaaaaggggccctgaactagaggctgaaaagaaagttgcagctgctgcaagaaactttaaggaagcaggaaggatagctgcagaggcaaaagctcttaattccgaaaaggacgaactgcattgtaagttggagaaagcttctactgatttggagataatagaaaaggatattgtagcaactacagacaagatacaggaatgcgaagggcttattgtactcaaagaaaaagactcagcattgacaagttacaaaagactccgggtagattgtgctgctgctagagcagaattgactgctgcaactgaaacagatgataatgaagaaggtgagatcctacgtaaagaagctgaagctgcagagtctaaagcaattgaactcaaaacatgctatgatctccaggtggaggatgatgagttcatgtttcagcctgtagtccctatagcattcataacaaattcaacagggcagcacttgtcagaaattgcttcttcattcggcctatctcctcagaagtgaaattggacagtggatttgcacactacgaggtctgcctgttgcactgtgatccaagtcctacctgttcctgcacatattgaagggaagatctgtgctagtgtgaaactctctccttccaggataccctcctcaacggcccttctttaactcccgcatttggaatctactccgaactagagtagggatccta

SEQ ID NO: 19340 - DNA, 356 bp, Triticum aestivum
  Clone ID: PAT_TA_19340
agtggaagggggcaggtcaggggtggccgaggaagaggaagaggatggggtggctaccgctgagatgacctggaaactctgttcaaacctgacaagggatgagctttctgcttccacttgagagtaaatgcaaaggtcgatgtttatttgtgtgcattatcgcaatgagttcaaattgatcaaggcacacaacagcagaatgcctgagaaatgtcagcaagagttcatctttcctattcatttaccatctcattgtgttctttgccaccgtaactgctgtttcacctgtgttggccgtttgatgaaatgtcggcaagatctgtgcatctttcatattcaaaaaaaaaaaaaaaaaa

SEQ ID NO: 19341 - DNA, 644 bp, Triticum aestivum
  Clone ID: PAT_TA_19341
atcctcgagttcagattcccatccgagcaaaccctaccgcccttttccactcaccctagaggacccgatggcgcccaaggcggagaagaagccggcagcgaagaagcccgtggaggaggaatccgcggccccggcggagaagccccccgcggggaagaagcccaaggcggagaagcgtctcccggcgggcaagtccgccagcaaggagggcggcgagaagaggggtcggaagaagggcaagaagagcgtggagacgtacaagatctacatcttcaaggtgctgaagcaggtgcacccggacatcggcatctcctccaaggccatgtccatcatgaactcgttcatcaacgacatcttcgagaagctcgccggcgaggccgccaagctcgcccgctacaacaagaagcccaccatcacttctcgggagatccagacctccgtccgcctcgtcctccccggggagctcgccaagcacgccgtctctgagggcaccaaggccgtcaccaagttcacctcgtcttaggcgtttgcgatgtgtagctctagtaggtcggagccttggtgtcgtgtaagtgctacggtggcttttgaccgatggaatggaatggaatggaatgctattgttattttaatgtttcttcatc

SEQ ID NO: 19342 - DNA, 689 bp, Triticum aestivum
  Clone ID: PAT_TA_19342
gcacgaggcctaggtgttggatgagacaggtgggagttctttgtgctgctgctcatgttgccattcgtgacactgtgggaaagctcgcggatgaccacagaaaggctaaagttttggcagagggactgaagaaaattgaacagcttacagtggattcggcttcggtccagacaaatatggtattctttgatatcatggatccaagaatatcacctgacaaactgtgtgcagtcttggaacaacacaatgtgcttgcaatgccagctagttcaaaaaggattaggttcgtgatccattaccaaatttcagatagcgatgttcagtatgcattgacatgtgtcgagaaagctgttgaagaactactgaaaggcagtactgaattcgagcatctgacaaacggaactaccaaaagctcatatgggcactagatcgatcacttcgattctgccgacctgatgcattcacactagttggtgccctgcttgtttgtgagtgaccgaagctatagctagctattgtagtcaggccgcatgtcccgaataattgttgctgttcagtctttgcttggatttgctcattcttgtgtctctgctttcaccggtaataatacgggcgctgttaagttttttttttttttttttttgaaagatcgacatcgcttgagtttatttgccggatctgtcaaccat

SEQ ID NO: 19343 - DNA, 516 bp, Triticum aestivum
  Clone ID: PAT_TA_19343
tgttgtttcttgcaatcctcatggccacaatgcagtcataatatgtctgccatggcgtcgctgatacccagcgacaagtgaccagtttgagaaaggatatttgccagatttgctttcttggttcaccagtattttgattgacagcccatttccagatcaaaagtctgatgattcccgacaggagcataaaggcaattccttcagaacaacgccagaagtgattcagatgcgaagcaagatactttagcgccatggaatgggttagcctttatatgtcagaaacaatcatcatcccctagctatctcagaacggctcgtcaaggtctacgatcttttttcctataatgcatgtaatatatacctctctataatcagctccaaagacatcaaggtctatgacctttcacctatgtactaagccatcaacatatgtaatataatatacacggacaaatatatacctggacatgtatatctccatcaatataaccttatcatgcataatctgcatggaaa

SEQ ID NO: 19344 - DNA, 773 bp, Triticum aestivum
  Clone ID: PAT_TA_19344
gcctgctgaagatgaggagcttccatcagcttacattgaagagtttaggtgtgctttagatgttgaattgtcaaaatacgttgttgaagcttatcccaaaggggcctgtgccatttattgtactagtggaaaggatatagagggaccaggatcagatttcagtttcacagcagttatttctgcggctaagcgtagcccacagaacttttgcaatggcagctggcgttcaatttggaccatggaattcaattatgagttgcagtttgttaatattaaaggaaatatacaggtagatgctcactattttgaagagggaaatgtccagctggatactaatattgatcgcaaggactccaccataatgcagtcacctgatgattgcgcggtttcaattactaacatcattcgacatcatgagtctgaatatttgtcatctctcgaggaatcatacttaaatttgtctgatgcaactttcaaggatcttaggcgaaaacttccagttacccggacccttttcccatggcataacacattggcattcagtcttacgagagaccttgccaaagaattagcacttggaaaatgagtctcagcaggccatgtcaccggatggcttcaagtggaatttttatatccatgccatgttgtgctgttctgtagtaatcagcattcttcattgtttgatgtctgagcttcccaatcccagtgtaaatcaagaacacacttttgtagagaatggcattcagaaaatattacactcttcacatattttt

SEQ ID NO: 19345 - DNA, 894 bp, Triticum aestivum
  Clone ID: PAT_TA_19345
ctcatcccactcccgcgccagccaccacccaaaccatagccccctttcccctggatccccacagcctctctcgcctcctccatccctcctccacgcctcgccgccgcctccgcctactattcctcctccaccaccgttgctacttatccaccacgctagcccctccacttcagcttccttttcttcgttgtctgcacgcgtcagcgaggcctggctccagatctggcgcgggttaggcgagctcggtggtgggatgaatgggcaggggaggtgggcgactgagggcaggcaacagtcggctcgtcgcgatgtggtgaagctgcagggaagaggggggaggtcggcgataggggtgcagcgcgctcggcacacgacgggcgcggcggtcaaggccaagggcgcagctggggagttgcacacgcgtcgagtaacggcgaccgcatccgctgccaacatcgagtggccagacattgagacatggaggccgagtggcacaacacctctgctacaaccagttcgcgtgatgttgtaaccggcttagcccccagctacaaccggtgccaccgctgtggagctatccgaggccggccatggtgaccttccatgtcgaaagctgcaaccacctctacatagctggaacccgcggcgccgaaagttgcaaccactgccggggaaagctgcaaccactacccaattttgcatttttttgctaccgtcgtttatttttttgctggaaccagcacaattttttgctaccactggtttttgggtatgctgaaacaagccccaatttttgtaatttttgctaccgacagcgttttagtttgctagaacgaactttattttttgctaaaaccggcgcccgttcctttgcccatcaacgcccaatttgca

SEQ ID NO: 19346 - DNA, 681 bp, Triticum aestivum
  Clone ID: PAT_TA_19346
cgggcgcgtcgcggcggcgtccgtgctggtgctcctccagctgccgacttgctcttgcagcaccttgtcgcggctgttcccgagctcccggaggtcgtcggggacacctcccccgcgttccgcacccctgctccccgtgccctctgcggcgtggggacctccctcctggccgtcgccgccgcgaccccggtcctggactccctcctgccgcccaagccgccgcgcgctcgggccccccgccgcggcagccccgtccccgccacctccgcggtcctgcgcctcccgctgccgcggcccgccccggccgccagcgcctcctacgtgcaggcgtcgggggctcccccgcgggccgctgctgtggagggggcgggccggggcctgtccgtggcgcccttgccgcgtccccagcgcctggggccgcgcccgcggagcggtttgtgggcgctgtgccccgggtcaaggcctgttcttcaacctcggggtggtttcctccaattgccggcgcccctgggattcgactaggaggtgcgccggttgcgtgcgggtgggcgccgcggtccgcgccctcgagctcctcatccctgctggcgttggcctctgggacgtggtgaccaacgaggaagccgttgccatggcgaagccgatcctggactcggagcaggcggccaagacgctgctggc

SEQ ID NO: 19347 - DNA, 1150 bp, Triticum aestivum
  Clone ID: PAT_TA_19347
cgctcgcccaagcgcaactcaatcacccgcttctcttcccccaaattctcaaatcgcgagctcggaacacttgcaccctactcggataggatcggcgattcgcccccctagttcctcgtcgggaacttcagagagcttcagtacaagatgcaaaggggaaggggcgggagaggtggtctctttggttttggggacccttttcctgcttttggcggctttgtaccacctgggaaccttatgtccagtttctttcgtgggtcaagtccctttgatgatcccttcttcaccaatccttctggttctttgattggacctagcctatttgagcaaagcatttttggttcaagcatgttcgggccacacacagctctaaatggaggaggcttccagcagcaaggtcctgaaccaagcaggccaaaagggccggttattgaggagttgtcttcagacgacgaggatggtgcggatgcgaatgaacatgatgagaagaagaaaactaactctatgaaacatccaaggatttgcaaagagccatatgtggaggactctggtgatgaagttcaagataataagagatctaggcatgagaaatttgggaaagagtacgtcagggctggcacatcatatcaacagccacagacctatatgtttcagagctcaactgttacatatggtggtccaaatggggcatgttatatgtcttcaacgactaggaggagtggtggagatggagttacaatggaagaaagtaaggaagcagacacaacaagtggtaaagcaactcacaggatcgcacgtggcattggcaataagggtcatgcactgactagaaaactgaactgcgatggaaaagttaacaccatgcaaactttgcagaacttgagtgaagatgagcttgctgggtttgaggaatcatggcaaaggaatgcagggccttgtctgcctggttgggatcccagattaaacacgcttaacagtgataaagcaggaactcttagcactggcatccaagaagataatggaatgtctgtacttccaacacccaatgatatgtttgcgcttccagcacccgaacaatatcgtggctttatttcctctgatatgtttgcgcttccagcacctgaacaatatcgtggctctatttcctcga

SEQ ID NO: 19348 - DNA, 1689 bp, Triticum aestivum
  Clone ID: PAT_TA_19348
ttcctcgccctcgcgccgctcgcccccccgcttctcttccccccgctccccttcccccagctccgcacacttgcatcctactcggctcgcacccccctcgcgcccgtcccccgctccgccccccgagctcctcggcgcgtccgtccgagagcctcagggcaaggggcggggggggtgggcccggtggggtgggcgccccggttccggcgtcccgcggcctgcttccgccggcgttcctcctccccggttcctttggtccggcttctcccgtgggtcatccccccttcaccatcccctctgctcctatccttcggcctcgccggttggacctagcctttttgggctcagccttgttccggccaccctgtgcgggacacgcacggcgcttccaggagcaggctcccgacccaagggtcccgaaccggccgggtctagaggacttgccttcagacgacgacgatggtgcagatgcgattgtgcaggttgagatgaagagaactaactctatgaaacatccaaggattagcaaagagccatatgtggaggactctggtgatgaagttcaagcgagtaagccacccatactgaggaactttggcaggcaagatttcaggcctgggacgtcagatctaccacatcatacccactgggttcagagctcaactgttacatatggtggttcacatggggcatgttatatgtcttcaacgactaggaggagtggtggagatggggtagttacaatggaagaaagtaaggaagcagacacaacaagtggtaaagcaactcacaggatcgcacgtggcattggcaataagggtcatgcactgactaggaaactgaactgcgatggaaaagttaacaccatgcaaactttgcagaacttgagtgaagatgagcttgctgggtttgaggaatcatggcaaaggaatgcagggccttgtctgcctggttgggatcccagattaaacatgcttaacagtggaactcttagccctggcatccaagaagataatggaatgtctgcacttccaacacccaatgaaatgtttgctcttccagcacccgaacaatatcgtggctccatttcgtcgaggatgaagaggcgccctttgaatggttcatcccagggcagtccccgtccatgatttcctcgggaatttaggcagaactgtgttcccggtttgaagaaaaggaagaggatgaatcgctagctgcagctattcagaaaactatgtctacgttttactcagcttagcttaaaaggttctgttgctattgttgatgtatattgttgttcccttcagcatggatgcgcacgcaatcataaaaaatgcaacttctgtttacaagaaatataataaaaaaaacggcgtctcattcactttgaaaacaagaacatatacaatccacgttagcacacacgcatcttatagcatcacatccaatggctataaaaggtgattgagaccaaaatatatctcatctagatgagttctagcaaaatgtaacttctttccacaatgacttctttctacaacgactgttgtgtaactttgtaaggcaaggctgcattcctgtattttctatgtactatgttggcactatggtgcatgggttcgatgtggagattcagtaatcttccaaagcaatcccaccaatttatggtgtactatccttagtttcctg

SEQ ID NO: 19349 - DNA, 516 bp, Triticum aestivum
  Clone ID: PAT_TA_19349
gcattcggcggaccagatcatgtagcacctatgttgcaaaatgcatcttcctcgttagctgttcaaggaggcaccaatgctgtacctgcagttgggacatctgccaacccatcatcagcaaatgtaggccactcaaagtcaaagaagcgcaagggcagagtttaaggatcaagagtcaatgaaacaagggttgccaaggggctggtattaacttctcagccatcaacatcagggataggacaatatggtcaaccttttagcattttattcgccttggtatctctgcatgtcgtgttggttgctcaaagcattgcattgcacatcgttttaggttgtttcttttaacctgaacttttgacacgttagggatttgtaactgcataacaatttggctgcatgtggagcaattcgtccttcctaaatagggcctacatctatatctacatgtatatatatctcttataaagtaaaaccctactagaagctttaacttgcaaaaaaaaaaaaaaaaaaaaa

SEQ ID NO: 19350 - DNA, 705 bp, Triticum aestivum
  Clone ID: PAT_TA_19350
tgaagtctgttttgcctccctctgctacagtgtcgtccctaacctccagccggctggagacagagcccgagccgggtgcgccccgcccctttccccccccaatccgctccaatccgaccccgtttcttccggatttttgacgggttttgatcctctcatcctcctctatcttttcccccaagaatcggagcaaatcgttgggtattttatccgaatcaaactcgttttcgagtttatctccaaaaccgagttttgtttttcccggagcgatttcttgcgggaggggtccgatctcttcgatccaaggctataaataggaccccctagtcctcctctttcgtttgccccctctcccgtcctctcccgtgacccgtagagccgtcgccaccgccgaccgagccgccgccgccgtcgctccttcgtcgccggccgtcgtccgtcgtcgattcgtcgcgtggcttgtcgtttccgtcgttgcgaaggttcgtgtgtgcgcccgaagtgttcaagaagattaattgaagaccgattattgcaagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgt

SEQ ID NO: 19351 - DNA, 415 bp, Triticum aestivum
  Clone ID: PAT_TA_19351
gttactcgagcaacgagtaggtggggagccactttctgatgtcccctcttgcttaagcaactggaaatggtgctagaaagagtccaggcgtcgcgatctgttgttttgtcactgctttgctttgatcctgggaagttgttgctgtgtgtggtgtaacgggcctgtccaggcgtcgcgatctcggtttgttgagctccggaaagtgcgtgtagttggcctacaactacaaagcgtcacggttcgagaacggaccagagaaaaaggtcgacgggtgaggacccggatcggtgctttgcttcacttggcattttcgtttcagttacgcgtcagtgcgtgtgcctgcctgctgtctgtgtctatagctggtgacccactccaatagagatgctacctcagaaaaaaaaaaaaaaaaaaa

SEQ ID NO: 19352 - DNA, 311 bp, Triticum aestivum
  Clone ID: PAT_TA_19352
ggttgggactgaatatattacctggtgagaccggcctgcctgcgaactaaatctgtcacctgggctcccatatgataccaaaatctgttgtaggtttatagtgttatgatctaccagacatcttggttttgaccaaggtgacaggctctgtcgtcgatgtgagtacatgttctttggctttcctgctgtcattttagttagttttattttatttatgttgtttcaatggagtaataaacagacattttccattgttgaatggattcattatcgatgttctgtttaaaaaaaaaaaaaaaaaaaaaaaaaaa

SEQ ID NO: 19353 - DNA, 805 bp, Triticum aestivum
  Clone ID: PAT_TA_19353
tgccgctctcctcagattttaccctgggaggcagcacgatgatcgtctccctggtcaggctggacggcaacgagcccctactggatcaagtcttatactggctactggggtcaggcgtgttccgggaagtacatcgtcagtggcccggtcgaggtcctctgcatgtggaccattctaccgatccaccttgtcggacgcgtgatcatgcgggcgggaatacccagggtgtcattctcagcgccgagacagccagcagcgcgggccatcactgacgtctgaccaacacacaaggggctatgcattggggtcatgtcagaacgccgtacccaggttgctctttatgcttgaggagcactcctgctgtatgggaatgccggggctgcaacgccgggtccttttcggctccgatattctaacatgtgttattgccgctgtcagtgcggccactatgccacattcatcctggtcctccgacctctggctagacgaatctgaagctgacgactcacaatgtgatctaattctgtcccatgtaattttgggtgctacaatcttgttagtgacattaggtgttacagccttcagggtacattccgtgtagaacaacacccatggatgacaaagaacttgatcagcagttattctagaagagacatctcgatctaacattcgacttataagatcccgtccaagaactgacattgattcccatggaccgctgttgaaatcaagctcaactgtctttatagcttcaaagacagcttccagagagcccccttgaaatggaagtgaaccaagcagtagt

SEQ ID NO: 19354 - DNA, 657 bp, Triticum aestivum
  Clone ID: PAT_TA_19354
gctgtaggtggtcatctccgggagaaatccttgctccggtcttcttcggagccggcaatgactgggagaccggtggatggcggcatcttcgccgcggcggttgcggctcctctcccgcggggttccctgcgccggccttctccggggcccgggtcgccggcgcgtaacgctgatggcgtggaagcgtcatcgtggaggtgctcctgcttcgcccctcggctctgcctcccgagggaatcctcagatccgctggatcgggcgcgcgaggcctcctcacgtctctcgcctccttcggcgcctcgtcccgggcgcccgcttggtcgcgcatgtcccctgctgtgcgcctgctccaccgcggtggctggctggctctttgccgcgtggccttggcggtggcggccttcgctggggcccgggtcgcccgttcggagctagccgggcgtgacgatgacgcttgcgactcctcggcggatgtcctttcctctttgtacctcctgtgattctgtttcgcgtgggccaacttggccggtggttcccgtttattttgggttggattgtatcggttttagcctggttttccatcaattaaccgggcaattctcactccttcttaattaatgaaaatggcaagtcttttgccttgttccaaaaaaaaaa

SEQ ID NO: 19355 - DNA, 408 bp, Triticum aestivum
  Clone ID: PAT_TA_19355
gatgtgacgagtgatgactgagtttttctgctttaaacgatcgatggtgacgatgatggtcgatcgatcgggagctagtagccagagagatagctgctagagatttggttgctcttaacttttttggttcttcgtggtatcgttgtacgatgatgtgatctgaggtagctagtagtatagcatcatcatcagtagtataggacgggcacctatccggtactagctagctagctaggagtttgttgtacatgtacctgattcctaatgagcccatcaagctctgcacttaatttcattaagctgggggcatgcatgcagtactgtactgttgagcagtcgcagtattctggcacgttacccgtctattctaattatgccatttacttcctctaaaaaaaaaaaaaaaaa

SEQ ID NO: 19356 - DNA, 673 bp, Triticum aestivum
  Clone ID: PAT_TA_19356
agtgaatcttccaaagactctttttgagatcagccaagacaaggtttttggattgacaataaacccagtggttcttcaagcaattagaaagactagggccaaagctctaggttttgctgatgggcagagcaattatgctgaaatggatcatgtgaggcaggaactgctccatgcaaatcaaatttttgctcaaaatccaatgtggccagtcattgcggtcactgggaaagctatagaggaaacagctgctgtcgttgtgaggatttaccttgacaggaaacagaagtactccatgccacgcatatcaaaacggtactagcattgtgttctatcccttctattacaccttgtaatgtgtgcgtgttgataagctctgtgtcaagcaccatagcctttatgtttttttttgttagaccaccttctaggtggcgcagcagaaacaaatgtatattgtatttacgaccaaaaaaaaaaaaaaaaaaaaaaaaagtcggcctcactttatttggtcattagagaaattctatgccaggtaaaatagtagggtgaaatgcctttgtgcaaagaaaatcagagtaatatctcctgcaggaatctcaaccccatgaccacaaaacttttagttgtctgggtggcagggacaaatcatcacatgtgaacctgaatattctaa

SEQ ID NO: 19357 - DNA, 764 bp, Triticum aestivum
  Clone ID: PAT_TA_19357
aattagtgatctggttgctagagtaactccaggattggtcggtgcagatctagcaaacattgttaatgaggctgctctattagctgcacgaagaggtcggaatactgtgtcccgggaggatattatggatgcaattgagagggagaaatacggggtcaacgggagacaagaaactgatgattctgaaaggcaaggcctcaccaagttatttccatggttacctaaatctggaaataaaccatcaagccctgatgatttccgaggactgatgggttatcatacattaagctaacttagcagttcttgcaagaactgagaaagaatataaactgcaactaaatctgggaaactgtttcctgtagttttatgtatatcagcaaatatacatcttgtatgtacgaaggatgttgcaaattgcagtcagtggctattggtactttcagaagaaagctgttacaagctacatgaggacagtttgtgaatacagaattccaggatttttcctagggcctgtttggatatcaagggggctaatcagtttcatgctttgtatttttgttagaaacatcgctaagttttgtcacatagcctacagtgttgatagaataggctaaatagctagcaagctagtggcgctcctgctgctgtacacagaacagtcattcatctgattcttcccaagtctggaagttttgcgagttggatgtgcaagtttacaaatgcaatgtcaagtgcacatgggaactgaatctgcagcgatgtgc

SEQ ID NO: 19358 - DNA, 472 bp, Triticum aestivum
  Clone ID: PAT_TA_19358
aacagaggagcttgtcaaccaagtccttgatgaaattggcattgatgtcaactcagagcttgtcaaggctccagcgactgcagttgcaaagccagtcgcagctgggaaagttgctgcacaagctgaagccgcaggtgggccagatggtggcatagatgatgacctacaggcacggcgcgccagcctaaggaagatgtgatcactggagcctaacaaagtttatccacacgctttgtttgtaggtttgtaccataaaaatatagccatatcatggcaaattctttttcgtatctgagttgcagagtgtttggcattgcccattgtacatagaatatatatctagcaccatgcactaggctgtgcgttctgttccaaagttccaatgccatcgggtgcattttggtcattattcagttgttgtgaggctctactgataagaagaagggaataagctcaaacatcaaaatataat

SEQ ID NO: 19359 - DNA, 160 bp, Triticum aestivum
  Clone ID: PAT_TA_19359
aggagtttagcattaggagtgcttagggcagggtagaacctgaagagattgaagtacttgttttgttgttcaagatatcaccctcttgatttggatagttgagtctcctagatatactttattaaattgctgtctccataaaaaaaaaaaaaaaaaaaaa

SEQ ID NO: 19360 - DNA, 834 bp, Triticum aestivum
  unsure (1)..(834): unsure at all n locations
  Clone ID: PAT_TA_19360
gggctcgccatcgaggccaccaacaagaacctcatcttcaacgttcaccctgttcttatgcttatcggttatattattatcggcggtgaagctataatggtatacagggtacttccaacaacgaaccatgacacaactaagctgatccatctaattctccacgggattgcacttgtccttggtgccgttggaatatattttgctttcaaaaatcacaatgagagtgggattgccaatctttacagtctgcactcttggattgggatcggaacaattactttatatggtattcagtggataattggatttgttacattcttcgtccctggtgctgcgccaaacgtgaagaagggcgttcttccttggcacctactctttgggctctttgtctacatcttagcactggctaatgcagaactcggctttcttgagaagctcactttcctcgagagctcaggtctcgacaaatatggcacagaggcattcttgagtgaacttcacagcattggttgtccgtgttatttgggtgcctctgttgtggtgggctgctatagctcccgttcgccttngaaagaaccacagggttatgctccaatcccaagaaaactagcgcaaaatgaaatgtacagcgttatgcagttcccaggattggcggttaccacatgggagataagatatccatctctccttattattggcgaagaaggtggtgggatttatcacaataagatgttagcgcatcgtctgtgtgtgcattcccgtgccgcgtcacttcccattttcgctatctgttttcgcctcaatagcctgcttcgctttccaaaaaaaaaaaaa

SEQ ID NO: 19361 - DNA, 216 bp, Triticum aestivum
  Clone ID: PAT_TA_19361
gttttaggtacatctgaagtgagtgaaggtggcatgaccggcggcagcgcgagaagagaggagaggggtgcgatgggaatgagaaggttgtgttcgagatcttgtttttcaatgacttgacagcatttgccaggatgtctctctatggcaagtgggtccagactctagagagaaacacccaaaattcgcaaccagcaaaggagaaggtgctagcgc

SEQ ID NO: 19362 - DNA, 707 bp, Triticum aestivum
  Clone ID: PAT_TA_19362
gcacgagggtcgcctgtcttgaagttctcagttgtactgggtgccctaatattaagaaagttgttattccttcgatagcaaactttctacatctgtccaaaattagtcttaatctttcgaccaacttgaaggaagtggatttaacatgctccaaccttttcatgttaaacttgagcaactgtagctcactggaggtgctgaagcttgattgcccaagattgaccaatctccaacttctggcatgcaccatgttgcaagaggaggaattagaatctgcaatatcccgctgtagtgcattggagatccttaatgtgcattcttgtccaaagatcaatgctctggattttggcagactccgtttggtttgtcccagtctgaagcgcatccagagcagcctcatctcataatacagaggctgctaccctataacggagcgcaattcatgcaataagcctctgttcagatttgaagaaaaaagcaagtcaggaaaaagctctccttggtgctcttgtacatagtacccaagcattgccggtatattgcatggcatggtatattaggagccaggggcgatgtgatcctatttctccagtccattcatggtgctgtaataagtatttttgtgaatctgttttgttgtcggagataacaaaatatctgttcatgtttgtttgtctttaaaaaaaaaaaaaaaaaaaaaaaaaaaa

SEQ ID NO: 19363 - DNA, 615 bp, Triticum aestivum
  unsure (1)..(615): unsure at all n locations
  Clone ID: PAT_TA_19363
gcacggccggaaagcgacgcaggcgccacagaccacaccgccacctgttacccgccggtcgattcgtcgagctgccccgccgtcccccgcccctcctcgcctcctcggctccccgcaccggcggcgatgacgacgccgacggctacagccgcgcccctcaccgggatggacaagtacgaggaggtgcgggacatcgggtcgggaaacttcggggtggcccggctgatgcgccaccgcgagaacgacgggctcgtcgccgtcaagctcatcgagcgcggccaccggattgacgagaatgtgtaccgggagatcgtcaaccaccgctcgctccggcaccccaacatcatccagttcatagaggtgatcctgacaccgacacaccttgcaatcgtgatggagtacgcggcgggtggcgagctctttgatcgaatcgtcgatcgcggccggtttagcgaggacgaggccagatatttcttccagcagctgatctgcggcgtaagctactgccatcacatgcaaatatgccatagagatttgaagctggagaatgttctcctggatggtagcccggctccccggctcaagatatgcgattttgggtactccaagtcgtcn

SEQ ID NO: 19364 - DNA, 642 bp, Triticum aestivum
  Clone ID: PAT_TA_19364
agctagaaaaggttgcatgtcattgccagatgtctcgtccttctatgtgaagtctgctaagccatcgcaagagcgagtttatggaaacagaactgtgagattcatgttatcgcgcatggaaaaacaggcacagagaccatggccaaaggataggatatgggtgttcaagagtgatccaagattctttggtagtccaatgatggacgccgtgttgaataattccccgcttgacaaggagatggtgcattggctcaagacgagaccaaacgttttcctaggctagtaaaaaaggattgtaggcagataagatggttttggctgtttctcccttttggagattttagtctacaggattctttttccgactcacaccttggctacctgatcatggggagtttagcttttagatagcagggtaacagtctcaccaccccccatctgtacattctcctctccctaccttccttgtagaaatgtatctggttaataactgatagattcgtcattgatttaatgtagggaattttccccataggaatcctccctctcttttgtttcatgtaaatgcagaacaatttcaatcttgaattcagtaatgagttacaggcatgttgcatttcaaaaaaaaaaaaaaaaaaaaaa

SEQ ID NO: 19365 - DNA, 1505 bp, Triticum aestivum
  unsure (1)..(1505): unsure at all n locations
  Clone ID: PAT_TA_19365
gcggccgcccttttttttttttttttatacaatagttgcttgtactagttcatcnccatgttggaccaccccccaaacacaaatatgnagagtacatgtcaagcaccaatttctgaatacatgacaagacacacanaatttctgaatacatgtctaagtggatcatcctgggcagaaatatttgagtgcatgtcatctatcttaattcggctagacaaacatgacatggtgtacatgaacagcgagcctgagaatgaaggactgaaatgatgcccgctgaataaacattgctaccaaaacttgcatcggggaaaatactaatcttgttcctggatttctgggttcgctaattgggattcgtcctggtgagactagaacttttcctattcagttccctgagtcgtttgagcaggaaactctacaaggtgtccgtgcccagtttactgttgtctgtaaagaacttttcttcagagagttgccagaattggatgactcgcttgccgcaaagctccttccaggatgcaataccatcgatgaggtcaaagaacgaattttggaaagatgcaaagaagtggagaagacggctatagaacaagcaacagataatgcaatccttgatcaactgggaaagttggtagacgttgatgttccacgttccttgtttcaagaacaaggccaacagttgtatggagcgaaacttctccaacttcaggcagaaaggaagctagacaaagaccagctagcatccctttcaagcgagaagtcggtccaggagtacctaaaaggtgagagggagaacattactaggatcattaagcaaatgctggttgttggtgaaatattcaaggccgaaaatttgcagtactcgacagaccagctcgtcaaggaagtcgagaactctatagaagagttcaaacgctataatcaagactacgatgaggggaacatcaagcagcaggttcaggatgttctggaggctgccaaggtgctggagtggctcaaggagaactgcacgatcgagtacataaaaaaatgagcgcgacgctagatgctctgtcagttttcaaggatggcaggcgtgcaaactctctctggcctaccttggttttgcagacagaagagtttgctttgttcatagcacaagagagaaaaaatactcccttcttgcctccagttatagtgcttcttgctcttcagtcttcatgttcttgatgctgagcctgcaaggcaaagaaggcgagcagatcgagcaccaccagcttgcctacggtgagatactgctggatctaggagtaccagggaggaggcgaccgtggaggcaccaccgcccactcgaccactaccagcttggcgccggaaaggtacaaataggcagctgagctggtggggagcccgtggtcatcggggtggaggagaccgtggcggcggcggcccggtccctgacgaggagtgtgcaacgcgtcgtcgggatgcgcagtagatggagccaagagactggaagccgg

SEQ ID NO: 19366 - DNA, 434 bp, Triticum aestivum
  Clone ID: PAT_TA_19366
aaatctaaaatagcacgatcctgagatttgcataagcagctactgttttagctaaaacgcaaatacagcatctggttccagaacgtagggtttcaaccaccttgatcctgcaaatgagaagaaaaatggtgacaacacaatggatgaaaagttgatgtccaagcatatgaacttctgaaaagaggttgcggtccttacaggactctgcaagctactcatcattggtaatccttttggatgcatgtaatatcccaggtcctctggtgtacaacgtctggattgttactccacaatctgacactagctggtaggtgaaaacttgtaaaattatgttttcttagggcttgtttggtacagctcagtttcactgcaaatgagaacaaaaatggtgagaacacagtagttgaaaaccaaaaaaaaaaaaaaaaaaaaaa

SEQ ID NO: 19367 - DNA, 565 bp, Triticum aestivum
  Clone ID: PAT_TA_19367
gtcgatgctttctgcaatgacgggtgtgtgggttggtgtggtgtccaaggtccttggcgagaagaggtgcatggtctacttcaggccttggaaggaagagaatgaattcgagcatgcacagctgaggttgcactctgactggatgggtggaaggtggatgcgggcttccccggctctggagatgtgaaggctgaagaaccacacaatgacgttagaataggagcttgagggtaatacccgacgttgaagtgtgtcctcactaacttaccacattttgtcggcctctgcacgaagttgcccctgtgccatctgcataggaaggtcagcaagttgggtgatgatcatagtgcagttgttgcaagttgccacaccatcaggtctgattctgaatgcttgccgatggttgaccccattgtcttgtactaggaactagtaagcacattctgccagtgttaaggggtggaagaaccggaagctgggaactgcagtgctaatgtttagaggtgtcatcaagtgaaccccttcatgattgcgtggggtatcctaaaaaaaaaaaaaaaaaaaa

SEQ ID NO: 19368 - DNA, 630 bp, Triticum aestivum
  Clone ID: PAT_TA_19368
ttttttttttttttttttccggaggatttgatttctttatttcaatttgaaaccatgtttaacacgtattacaaatctctcagcttaatgcttgttactttctaccaacgctgggatgcaacgggttacatccgtatttgccagtcctaaaaggtaagttctaaacaagtctcagtttaatgcatgctactttccactaactctgggaagcaacgggttacatccgtatttgagggtcctaagagctaagatctaaacaaggacgctaacttcaaaaactcatatagctactgcctccagaatgggaaagagcccagggtcagctataaacaacaggaagtagctactgcctccacttcgtgccaactaccagttgtcagaattgctatcattttgtcctcgttatgtcctctaatgtataatgtatagaccaccggagttaaaaggttaaccccctcttttgaccaaaaatcaaaatcaattaacccactagcaccgacttgctgctagaaccatctgtgcaatctggactcgaatgacctccggggcctatttgaggtcctgttgtaccttgtcttagctaatccgctatcagaaacactaatgcacctggtgttctattgcccttat

SEQ ID NO: 19369 - DNA, 459 bp, Triticum aestivum
  Clone ID: PAT_TA_19369
cgagacgacactctgctcggctcgctcggactcaggcgagatggaagccgcgtccttgccgctcgccacctcccgcttcctctccccgccagcggctgcggcgtcctgctcccgcacgaggagcctccctttcgtccgcgccgccaatcaggcactggaagcacgtaaagtccccaaagcccagcggccgtccccccggcgcaacgccgtcgctgaggtcaaggccgcccccgaccccgtcgccgccctaaccaggctcgaggatgtgttgcagacacaggactgcaacataatcttgcgccactatggagaaatcaggcgatgggatgtgctttctaaggtcttcgggtggatgcaggagcatgacatgctcaacattgcgtcttacagcagctatttcaagtacctggggttgagccctaatgctgcgaaagctctgcaagtgtacggttccattca

SEQ ID NO: 19370 - DNA, 910 bp, Triticum aestivum
  unsure (1)..(910): unsure at all n locations
  Clone ID: PAT_TA_19370
ctgcagctcctccggcgaggtcctccggtccttgtccatcctggggcgggtggccctgtgggcccgcggcttcgcccccgtgaccctccccccagcggcctcagggcagcccgcccgcgcgggcgtgtccgccttcgaccccgtgcgacgggaggtcaccccctcgggcttaacgcaggagttgagccgaaatcccgtcaacgaggcccgtcccgcggcgccgtgagcggcggcgtggtacgttgtgccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttaatgctgcaaaaaaaaaaaaaaataaaaactgttgtctcctcctctcggctcctttanactcctactggaaacctgcttaccaactaaccctncagaancccttcccaacggcttatacaaaagcccacgatncctcaaaattccaccnatgcaatgacccccgttcggcataaccgngtntggttcccacttncgtaactcangccaancctcctnctttcttctt

SEQ ID NO: 19371 - DNA, 690 bp, Triticum aestivum
  Clone ID: PAT_TA_19371
gcacgagggtcagatctactgaggcagtagctttccccaagcttgaaactttgttcatcaaggatatgcccaactgggaggagtggtcttttgttgatgaagaagaacaagaagcaacagcagccggtctggaaggagcagaggatgagactgatgcaaatcaaaagggggccgccccacctccaaggatgcagctgctgccacgattgaagcagttggaacttgaccactgccccaagctgagagctctcccacagcagcttggacagcaggccaccagcttgaaagtgctccacttaagacatgtgcacagccttaaggtggtggagaacctctgcttcctctcagagcacctttcgatccaagattgtgaaggcctagacagaatctcaagtcttcctcatgtgagagacctgcgggtagctcgctgtccaaatttaaggcgtgttgaggagttgggtagtttagagcagttgtggctggacgtagatatgcaggacctctcctcactgtggattcccgggctcaaatacggatgccaagacctcgaagtgttcacatggcctaggaaataagaaacatccggtcaggtgggcaacgcagccacaaggaaggaggggggactgctcatcaaggagaagaacatctgcctaccagaatgctttgtgtctatttatgcctatatataca

SEQ ID NO: 19372 - DNA, 665 bp, Triticum aestivum
  Clone ID: PAT_TA_19372
ccagcagcaatgccagagatgacgctgaagcaaatgatctcacacccgattcactgctgactttggttgaggagttcagcgtgacatctcaggcagtcgagcactcattccctgctctgcttgtgaccaatggtgaggtgaacaccgaatctctaagtgcagaatacataaatgatgatgagtctgaaacaagcattgctggaaacgaagagggccagctcgagcagtcacctgatctctgtggcgatgaacattttgagcttgacatgcttgagcgtctggagtcatctgtgccattgggatcgctgccgattgacggcatgatagagcagctgaacagtgagtgaactacgatgagcagttcattctgtccattggggtaactactgatgatcagattgcaacctctgattgcaacctcagtctgatgatgatctcaatagctgagaattttcagcgatttggtagcaaacatgatgtaaagaaaataattgtagcggatgggcatgtggcccagtggtgaaggctccaagagaggagccggcccgtgggggtttgatcctccgtcccgcatctgctcccctgtgaagggcgcaccaggtggtgctttctaaaaataataataatataattgtaatataaaaatgcactaaaaaaaaaaaaaa

SEQ ID NO: 19373 - DNA, 458 bp, Triticum aestivum
  Clone ID: PAT_TA_19373
ctactagttctcatgacaatcattgacacatcaagtgacaccaccgctcttgccgtggcctgctacgacctctcacagttcctccagtaccatccatctggccgaattgtggtggcagacctcaaggccaaggaccgagtcatgaagctcatgaatcatgagaacactgaagtgaggaaaaatgcgctgctctgtgtgcagaggctcttccttggcgcaaagtatgccagtttcctgcaggcttgagagaaactgagtcttttgtatttagatccagaggacccctggccatttctcagaatgtctgttgagaacgaaaaaccttgaaaattcttttccagtatatcctattgttatttgattcctgaaactgattgtataataaataatcagagccataccatgctcgatgtaataaagtgtccatgggcttgttgattcaaaaaaaaaaaaaaaaa

SEQ ID NO: 19374 - DNA, 742 bp, Triticum aestivum
  Clone ID: PAT_TA_19374
ggaggaggaccggtcctaccgctcctccaggagttcatggtaagacgacgctatccattagcaaattaaagtggaaaattccattcagaatattatgctctattactggaaatatccttgttagcatacatatacttcagtaagcaatatgcatcacgtaaaacccacattgaacatgagctagttatggtgtcttgatgtgatttttctgtattgggtttgttatgcagattgaggcattgagaacgagctcaaagcatattcaaagttaaatcatattagccattgcatgagtggttaacttgaattcatattagctcaatgcctcattaaagttacgtttaattcatatagctcaaagcattctcgaggtaagaaagaggaactgcacctccccaattgaattggttgtgcatgtgcttatttgactcttagcctgggattttccttgtgcagccaataggccggagcaaggttaattaacatgtttctgaagattaatgcaaatatgatgattggttgctattgcaatgccaagtctatctttgtctgaaggtatagaaaattcagtcatttagccttcatctcttccttagtattctaaatatatagaataacaaattttcaagtgtatgtataagttggtacagtcaaataattttctctgtgtacattactttccaatccagggatgatgccgcagccaccaacaaacataaatgcaagtcagccagcacctaag

SEQ ID NO: 19375 - DNA, 959 bp, Triticum aestivum
  Clone ID: PAT_TA_19375
ctttcattcgccgccgccgcctgctctctgctgccgtcgccccgcctccgccgacaccgactgcctacctcagctgccgtcgccatgggcagaaggcctgctagatgctatcgccagatcaagaacaagccgtaccctaagtccaggtactgccgtggtgtccctgaccccaagatcaggatctacgatgtcgggatgaagaggaagggtgttgatgagttcccctactgtgtgcaccttgtctcttgggtagttggagagtgtctcctacttaaccaattctgcgatggccaggatgccttccaccatcagggtcccgggttcagcacgtacaggttccttccgacatcaacaagctggtttcacctgttcggtgctcaccggttccaaaacagggattcattgctgcccttggggatgcatcagcgccaagtgtggtaaggtggggcgtttttggaaagtctccctggcacttgtgatacgagggcaaattggccacgccttcctttcaagttgcgatgcaacgcacaacaatgctgccctgggccgagaaaagctctgggatcaacataaaagtcgaagttccctcaggcgccaaaaaagaagattacatgaaagcaaattgaccgagggcaaacatcatacgcggacgacaaaatgtgccaacgcccctcaagttactacggtaccctatctaaccagtgccccttggagagtattccccgggggcggggctggttccactcccccttaggctttcctccaagccgttgctttagtccggatgcgaaccctgacgttttgctttagcgtatcttactttgcttcgtggaacatgaatttcaagtgttttgagggtattacagtgccttatgtgaacgcgcctatcttgtgctgaacatcggaatgtatcctccgagtatgtttaatcgcattaattttattggaaaaaaaaaaaa

SEQ ID NO: 19376 - DNA, 677 bp, Triticum aestivum
  Clone ID: PAT_TA_19376
tcacttttggtggttggtttgctaccctcacggttgcaggatatacagtgttagctgtgagaaaccttgtgaaaacagagcttattccagatacagagcctgtgagcaagccgtcgccattttctacgtcggaaatctggtcatggactgctatattcgtcgcatcatttggtgttgcatatttcaatcccacggcacttggtaccaccgcaaaaacatgccttcctttcctgcttgctgctaacgtgctgggatacatggttggttctgggttaccagctggtgtcaagaaagtgttgcatccagtcatctcctgcgcactttctgcagatttggcggcagcagcgtatgggtacctctccgggtctggatttgatgctgtgctaggtgattacctcacaaaggcggcctctaatcctggagccggtgacatactgatgggtttccttgggtctgtgatcatatcatttgcattctccatattcaaacagagaaagcttgtaaagaggcacgcagcagagattttcacatcagttgccattggagctacattctctctgtactcaactgctatcatagggcgcctggttgggctagagccatcgttgaccatatccatgctgccaaggtgtattactctggcgctggctttgagcatagtatctttctttgaagga

SEQ ID NO: 19377 - DNA, 775 bp, Triticum aestivum
  Clone ID: PAT_TA_19377
ggcaaatatgcatggctggtggcttgtccacaggatggatagaatgggatggagaaaggtttgagtttgaaaatgctccatcttactcagaaaagaactggggtggaggttttccaagaaagtggtattggatccagtgcaatgtcttctcaggagcttctggtgaagtttctttaactgctgctggtggattgaggaaaattggacttggtgatacctatgaaagtccttcactgattgggatacactacgagggacaattttttgaatttgtaccttggactggaacagtaagctgggacattgcactgtggggtcgttggaagatgtctggcgagaacaaaactcatctggtagaaatagaggcaaccactacagaaccaggaactgctctgcgagctcctactatcgaggctggactggtaccagcgtgcaaagacacctgctatggggatctaaggctacagttgtgggaaaagaaatacgatggtagcaagggagcgatgatactcgatgccacaagcaacatggccgcactagaagttggcggaggcccctggttcaatgggtggaaagggacaactgttaccaacgaggctgtaaataacattgtgggcaccccaatcgatgtagagagtctcttcccaatcccatttcttaagcccccaggcctgtaggatcacctaggaatgtcacaatgaagggggaagtgtcattgatatcaatgtggatcatgcactaaaattttgtccacctcaatagtaattcatgattt

SEQ ID NO: 19378 - DNA, 834 bp, Triticum aestivum
  Clone ID: PAT_TA_19378
cgcacaccgcagacgcagaggcagacgcggaggaggagagggaggcgacgagcgatggcggccgggacgggccgggtgctgccgctgctggccgtggcggcggcgctcgccgccgcgctcctctacaccgcgcccttctccaagagcctgggcggcgaagggtgcagcctcctcccgcacggccacttctggatcgccagccagcgggtcgtcgcgctcggccgcgtcggccccgccgcagtggaggtgaaggaggggctgatcaacgccatcgccgtgggggactaccggagcttcgtgctccgccgcccgctcgtcgactacggggacgccgtcatcatgcccggcctcatcgacgtgcacgcgcatctcgacgagcccggccgggccgagtgggagggcttctccaccggcacaagagccgccgccgcaggtggcataacaacgttggtggacatgcctctcaacagcttcccgtccacggtctctgaagaaactctcaaactcaaggtggatgcagctcgggataagctatatgttgatgtcgggttttggggaggccttgtgcccgagaacgccttgaacccaagcaaattggagagcctgctaaatgcaggggtgttaggacttaagtcttttatgtgcccctctggcatcaacgacttccccatgacaaattcaagccacatcgaggagggcctggttacattggcaaagtacaaaaggccccttacttatccacgcagagcgcataccggatgtggtgagtgacgaggagctcgatggctatttaaaatctcgatcatacgcaacatacctgaagtttagaacttc

SEQ ID NO: 19379 - DNA, 810 bp, Triticum aestivum
  unsure (1)..(810): unsure at all n locations
  Clone ID: PAT_TA_19379
tggacctcttccacccgatgctccatcatggtgccaggcaccatttgatcctgaaggcctcctcagctccgttatggcaattgtcacttgcttgattgggcttcagtttgggcatataattatacattttgagaaacacaggnggaagaatcaccaattggttgatcccttccttcagcatgttagctctagccttcttaatggacttcagcggaatgcgcatgaataaaccattatacacaatgagctacactttggctactgccggagctgcgggtcttctttttgctggaatttatgctcttgtggatctgtacgggttcagaaaacctaccagtcccatggagtggatggggaaccacgccctgatgatatatgtcctggtggcatgcaacatcctgcccatgttcatccgtggcttctactggagggaccccaacaacagccttctgaaagtcattggtatcggggcgtgaagccatgatcttctacatgttcaggcctaaacttggacacggatttttcttcttaatataacgatgcacagctctctcacgtgttcgagaaaattagacttagacacggacgggatgcagaagtaggtcctcaggccaagttttgctatgcggttagagcacgatagtgctcagctcatcgccatggggctgcctattctatcagcactcccgcgctggctgttgccacttgcaggagagtccattctccctgaccactttgtatatggtggagttgagcatgtatatgacatcatacgagtaatacgatgggattcagatgaaaaaaaaaaaa

SEQ ID NO: 19380 - DNA, 412 bp, Triticum aestivum
  Clone ID: PAT_TA_19380
tttttttttttttttttttgcgacaaaggaccatgctactatatcaccaaggcgaaaaaaacgatcaattcgcagcacaacacaaatccaaatactaccagctgggcaacccagaatattaaagttcacacaccacagccttgttttgctgcatctaccacaatcacatagccactagtctctaaacaaaacaaggccaggcctacttccaccgacattttttccagactcacttaaacctcccatgcttcgccttcgaagactcagttgtacctgcgactcacttggcaccatgcttcgccttcgagtgagcctgaagtgccatctcactgttgaaagtcttggtgcaagatttgcaagggaccgagccaccagattttggagacttctcctttgatttatcattgtttgc

SEQ ID NO: 19381 - DNA, 845 bp, Triticum aestivum
  unsure (1)..(845): unsure at all n locations
  Clone ID: PAT_TA_19381
gacctggagttcggtgctagctgctcctccgtcgccactcaacacaacggcacctactgcatctcctccaacgcgccgttggagttggagtcgcactctcctttccctcaatcgcgcccaggcctagtggtgccgtagtgcggcagtgcagtacgactgttctcgcaccttccgttcacgcaagcgcaacctttgctcctgtcgttgtctcagaacccctgcgccacgcctcccccctgcaaccgggataagaagaagggaaaagaaaatctctgatcgagattcctgcccggctgatagaatctttggcagccacatccatggatatactgctaggttccgggagattcttggcgcgacggcttcctcccctcgcgctcgtccctcgctgctctcgaggctccccggacaaaagcggcagcgacaaaggtgaaacctctactgactgggacaaggcatgggctagctttaagaataaagggaagaggaccctcttttctgatttctcaccaaacaagtacgtgacctggaacccacggcgcagcgagtatccattgtcagaagaggttgatccaatcaagagaactgaaagatctaacttgatgctgtggacaagcccccagttcaccttggtcggggcgattatcatcgtcttgacattgctaatctatacactagttgttcctcctcccaagtaactgcagaggtgacaactactanggggggtgagctgtaaactagtagcatttcaattgggaagtctgcattgtacattttttacgtgtactatggcaactatagcagtattgattcaattgcaatcatgtagatacaaaaaaaaaaaa

SEQ ID NO: 19382 - DNA, 568 bp, Triticum aestivum
  Clone ID: PAT_TA_19382
acaagcagcccaacccccgcacctcaggcccaggcagactcgtcgatcgcggcgcgcgagggagatggtgatgcggaccgcgctgacctccctccccgcgcgcctgcgcgcccccgcggccccctcctcggcggcggcgaccggcggcggcctgcgcctcctcagcgacgggaagggccgcgtgctcagcgaggaggagcgcgccaaggagaccgtctacatccagaagatggagaaggagcggcaggagaagctcaagaagcagctcgagcaggagaagcccggcgccgacaaggccaagcccgccgacgccgacaagaaggccgagggatctacctaggattgaaatggcgctgatggaaggcaatcctgtttcgcatgcatccgatggacagctttgtttgtacatgtccagcgatggaagaataaattctgtaaaacgttaatggcactggatatgctgtgttttcggttggttgcatgttgaagacgacattcatattttgagactgctgctgttgaacctaaaaaaaaaaaaaaaaaaaaaaaaaaactacctaaaaaaaaa

SEQ ID NO: 19383 - DNA, 760 bp, Triticum aestivum
  Clone ID: PAT_TA_19383
gtttgatggagatgacgaggtgcgcgatagagcgaccctcgacccccaattgttaggtggggaagctacagtgggtgagacagagaaggatgtgaatgaatttctcttcggctcacttgatgttccactagcaaacttggagacgagtctgcggaattatgaaccttcggatgtaccttttgatatttcatctgtttcgagggagacaaaatcccaaccccttgcggagaaaaagtctacaggcaagaaatcagctggtccggcatctgctgtcagtggccctgtttctactgttgatgctccgtatgagaagcttctttcgtccattccggaatccgctgatttgggaaagctttttaagtcatctgcacctgtagaattgactgaagctgagaccgaatactcagtgaatgttgtgaagcatatttttgatcgacatgttgtgcttcaatacaactgtaccaatacaattcctgaacaattgcttgaacaggtgggggtggttgttgctccgtcgcggcctgttgaattgctcgagcttgcttccaggccttgagccccggtacccttggggtctcctggccaggcccttgcgccttgtccaatgccggaagctggcagtgccaccgcccggttctcaattagcctgtatctctttgttaacctccgtgatccggccacgcgtgaagctgaggatgatggtgttgaggatgagtaccagcttgaagatcttgaaatcgtttctgctgattatatgttg

SEQ ID NO: 19384 - DNA, 467 bp, Triticum aestivum
  Clone ID: PAT_TA_19384
gagggctgtccgtgtgagactctggacgctgagcggctgaaggagccgtacaaagcgagcccgttcctgttcgtccccaacgagacctgggactctcctgagggcatccgtgtgttcatcgagctgaaatgaagtccccatttggaaagtcgtgatttattttatcctatttttcacaagaacctagactctgcatccaacttttgcattccagatagacttgaaatggtgccccgagcacccgtactccttttctttcaaatggtaagtcattccatttcatatgtagtttttgttattcagctaagataaggttacaaaagctggcggccctgtggtattcagtacttggtgtttgtttcgctggtgactgattatgttacttgtgtttgtttcaattggcatgggcggccctgtggtattaagtacttggtgtttgtttaaaaaaaaaaaaaaaaaaaaaaaaa

SEQ ID NO: 19385 - DNA, 1086 bp, Triticum aestivum
  unsure (1)..(1086): unsure at all n locations
  Clone ID: PAT_TA_19385
cgtccgcccacgcgtccgccgaccaccccccgggccccacccgaccccccgcaccctccgcgccggtggactcagccgcagagggatctctgatctcggccctcctggccaacaccgccccgcgcgacgagtccatcgcgagcccggcatcctctcgacggcaaaacctagccttcccgccgcgtcccgtcggatcgcgtccgtcccctagcggaggaggaggcgggcgccctaggaggggcatcgcgaggtagtcgtggcgctgttccgcggctgcttctcgttcgggtcggccgggcgtagaaggcccgcggcctcgcccttgccctcgccgccgcgcgcgaccgccgcatcggcatcggacgacggcgccaagatgaagggcctcttcaagtcgaagccgcggacgccggccgacgtcgtgcggcagacgcgcgagctcctcatctacgtcgacctccacgccggctcgcgcggcgcctgaccccaagcgaggaggaggagaaagatggcacgaattaagcaaaaatataagggatttgaagtgtattctgtatggcaacggcgaacaggagcctgtcactgaagcttgcgtgcaattgacccaagaattcttcagagagaacactttacgattattaattatgtgtgttccgaaagtaaacctggagacaaggaaagatcctactcaagttgttgcaaatttgcaacgacagcaagtcaactcaaggatacttgcgtccgaataccttgaggcaaataaagatcttttggacaccttaattccggggcacgaggcgacgggcgttgctttgcgttttggtgcaatgttgagggaatgtattcgccatcagagtattgcaaggtatgttctagagtctgatcacatgaagaagttctttgactatatacaaattccaaattttgacatagcatcagatgcttctgcaaccttcaaggaacttctgacaaggcataaagcaaccgtggcggaatttctttcgaagaactatgactggttctttgcagaattcaactctnnnctgctttcatcatccaactacataacaaaaaggcaggctatca

SEQ ID NO: 19386 - DNA, 813 bp, Triticum aestivum
  unsure (1)..(813): unsure at all n locations
  Clone ID: PAT_TA_19386
gccgcgctctcccccccccgcaccgcccccccccatcgcgccgcataatgtgggccccccccggggtgttctctcccccccccccccccctcccccccccccccccccccccgcatctgagccacaatagctcccccatcgcccagccggaggatccccagatcgacccaccgcctcctccggacggtcacctccacctcctccagcgcagctgagctgatctagggatataccaatggcgacatccaagaaggggcctctctatcccagcagggacagggccaccaggatggcccccaacctcaagccctccagcagcgagacctcctcctccggctacggcgcgcgccgggcgaggtcagtgccgagctccccagatcgcaagctcggtccttcggctgccgctgcggcggctccttccgcctccccggacatgtgccgtccctcattgtcacacgctggccggtccatctcttcacgaacaatgtccggctcaggctcatccattcatggcagcaagccagcctcaaagccggatctggctagagcgaaatccgacaaagtcaccgccaactcacagcggcctcatgcgctcgctggaccgctgagcagttccttcaaggacatggccaacacagtgccagcctccaactcgccttctaccttgctgaagaataagctttcgccaaggcccgcccctggcaaaggggtggcgcccccaaagccgagcatcgagagggcgccatcgccggggcctttgagaggtgggaagcctctgcccgcgtnctttgcgcgcgcgccaggcactgaggg

SEQ ID NO: 19387 - DNA, 697 bp, Triticum aestivum
  Clone ID: PAT_TA_19387
tttttgcagataccatcaggtcgccaatccaatatcttggacactcgtgttcagttccaccaagatcaaatgcattttcttgttgtgcatgaaacccagattgccatctatgaaactacaaaactagaaccagtgaagcagtggcctgttcgagagaattcacctccaatcacacatgccacattctcgtgtgatagtcaactgatctatgcaagctttatggatgctactgttggcatatttaatgcatcaagtttgagacttcaatgtcggattcttcctgcttcatatcttcctccaaatatcagtccgagtgttcatcctgttgtggttgcggcacacccttcggaagcaagccagtttgctctagggctgactgatggtggtgtttttgtgttggaacctttggaatctgagagaaaatggggaaatcctccaccagtagagaatgggtctgctagcaacttgtccacgccgcctcctaatggagcttcaagttctgaccaaccagaaagatgattaagaagttggaactggtagatttttcgtggcatgagtctaaccaagatgggcttcaaagggtggtgcaactaaccttggcagatcggttccaagggagtcagacaatgcgctcaataaaaacaagctcaacagcagtttatccgttgcttatatatatttctaatgactgtatcga

SEQ ID NO: 19388 - DNA, 737 bp, Triticum aestivum
  Clone ID: PAT_TA_19388
tcgagtttttttttttttttttttagtcgcagcaactaagcatccgatacttaagcgaaggcaccgtatgcaaggaaaattgcccgacagacaccccatgggcagactcggcggaccctatgaccataaatgtttttggggaccgatgtcaccacctagtaggatagttacgagtgtttggagatctaagtctccatccaaaacaaattgttggaagaatcctccctctaacatgagttattaatttcttcggatatgaaaggcaaaaacttcacctagatcctgattggaaaggaccgggaacacacactgctcttgttcgtcatcatatttctccaatttaagcaccgccggggccgtacttctttccgaagaagaagatctggcagctggatcatagccagaaagcacacctagcaccagcaatggcacgaagaatgttagcaccagcacccttgaacagggacttgggcccttccttcttaagaatctgctggaacgcgtccaaggagctcttgtacttgacagcctcaccagatgtcatcatcatccttctgcggacggtatcgatggggtaagatgcaagaccagcaccattagtgatcagccaacccagagcgaaactggccaagcttgagacattcggaaagtccgtaatacaggccacgataaacaataattccaacacaagatatgttaaatccacggtaaagcccagcaataccatcagatttgag

SEQ ID NO: 19389 - DNA, 603 bp, Triticum aestivum
  Clone ID: PAT_TA_19389
acccaaaccacaccaggcgctcctcctgtcccccaccgtctccttcctcgccccctccccctcctccgctcctcgtgcccgagctctctccagctccaccgccaccgccaccgccgccagcaataatgccttcccttacctcgcctcgagacttcagtgcaagactggcgcctcagtcagccatgtttctcttgccaagaagatgcccgtggttgtccacgcttctgcagaggctggtccaactgatgcggcagagcaaccagagaagccaaaaccagtggcttcgatcgaggacatgccgttcgagtccaagcagcggatgatcctggagcagagggcacggatgaaggtggccaagaagctgaggcagcggcgcaagcggctcgtccaaaagaggcggctgaggaagaagggcaggtggccaccgtccaagatgaagaagctcaagaacgtgtgaccggcacatgatgtcggacagctggtccgtaccattcctctgtaaacctacgtgttgcgttcctctaatgcattggtgtttgtttcgtttgtacaatttttctgttctgaaacacgcaatcggttataatgcaattattttttacc

SEQ ID NO: 19390 - DNA, 1089 bp, Triticum aestivum
  unsure (1)..(1089): unsure at all n locations
  Clone ID: PAT_TA_19390
gtccagcacgcacatacacacacagcccgcgcgccccttctcccccccaccctctcctcaaaccccccccccccgcgctcctcctctcccccaccgtgctccctcctcgcccacctccaccgcctccactcctcctgccccacctctcttcacctccagacttcagcgcaaccgccgcccctcattcagccatctctctcttgcccacgaagatgcccgtagatggtcgacgcctcaggagaggctggggcacttgataccgcggagcaaccatgagaagccaaaacccgccggttccatggaggacatgccgctggagtgaaagcagcagatgatcctggaagcaggggggcacggatgaaggtggcgaagaagttgaggcagcggcgccagcggctccgtgcaaaaagaggcggctggaggaagaagggcaggtggccaccgtcgcaaggatgaagaagctcaggaatgtctgacaggcacatggtgtcggacagctgggtccgttccattcctttgctaaacctacgtgttgtctacaacttatgactgggacttgatttcgtatggctaattcttctgttctcaaccatataaccacgtattatgtacttctaatgtattggtgtttgtaacatttgtaaaaattaatttttctgaaaaacgcaatatgtaataatgcaacttatcccttaccaaaatttccacccacggggggcaaaaccagggtaaaggggtnccccaaattnnncccttatagngggggnngnntttacaaattnaattgggccggnngntttaaaaannnnnnggaattgggaaaaaccctggnggttnccccaacttnaattgncnttggnnnnanaanccccnttttnccanntnggggnnaaaancnaaaaaaggcccnncccgatcnccctttccaaaanttgnccnacccnaanggnnaaagggnaacccantttnaagggnnaanggggnaaaannncgnntnnaanngnnggggntttaaaannnaanncccagggtntttnngncccnnancnnnannnnnnnntngnannaanancnnncccattnnnnggg

SEQ ID NO: 19391 - DNA, 657 bp, Triticum aestivum
  unsure (1)..(657): unsure at all n locations
  Clone ID: PAT_TA_19391
ggtggaatttggaggnatggngctntgtatancngtgnaaggggttncncagngttagtggtanncaggtttccnncagagtttaacctccgctctcgcccgcgcgctcgtcctccctgcgtctgcgtgcacctccccggctcccccactcaccgctgcaggctccgcccgccgacgtcgcccacccgctctctcgccggcggcggcaacatgactacttcaaggcgccttgttgacaggaagaccgcaaagttccggaagaacatcaccaggagggttctgtccctgaaaccactgtcaagaagggaaatgactaccctgttggccctctagtgcttgggttcttcatctttgtcgtcattggatcatcgttgtttcagatcatcaggacggcaaccagcggcggggtggcttgagagccggcccacatctaatccccagtatagagagttgcttgttatacatgcatccagctaggattgggtagcagctaaaatgttaaacgtgacaagactgccctgcattccgttcatttggtgggccttgaatctggaactgaaccataaggcagaatcatgtaccttatataaagtgttaaatgggtaactggatctcagtgtttcatttaaaaaaaaaaaaaaaaaaaaaaaaaactcg

SEQ ID NO: 19392 - DNA, 861 bp, Triticum aestivum
  Clone ID: PAT_TA_19392
ccacgcggccgccgacgcgcgcgcggtcgcgcccgcgcatgtccacctccttcaccctgggatggatgtcttgaggcggaagtagaaatcgaagaactctttattaatcccgagcaaatccaccaagaagaagaaggaaaatcaccataaaccctcgcgtccgaataaccacccccattcaacccccaccaccgtgccgggcaagcagaagcagccgcacggcgtgatggcgccggagccggagccggaggacgggagggagctctacgcgctgctgcacctctcgccggaatcctccgacgaggaaatccgcagggcataccgccagttcgcgcaaatctaccaccccgacaagtaccaggacgcccagatgaaggatgtagcaactgaaaacttccaacggatacgtgatgcatatgagatactatcggatgagaacaaaagacagatctatgatatttatggcatggaaggtttaaattctggtctggaacttggtcccaagttaaataaacccgaagaaatcaaacgacagttggaagagctgcgacggcgtaaggaggaagagaaacttttcgttcatgctcgatccactggatcaatcctagctaatatctcagtgccacaatatttagatggtgacggcatcatgggaggaatggggaatgtctagtgaaattgagctgccagtatccaagcaaaacactgtcactgttggtgggaatttggtcgtcaatggtacgactggatctggtgcagcaactgctgtgctgcgccatcagttgtcttctgtgtcttcgatagacttcatggcaacagctggattacgttcccttattggagtacagacatttcgtcaga

SEQ ID NO: 19393 - DNA, 469 bp, Triticum aestivum
  Clone ID: PAT_TA_19393
ggccaaaatctaagacaaagaaggtatcccacctgaccaacaacgtttgatcttcgctggtaaacagctcgaggacggtcgtactctcagtgattataatattcaaaaagaatctacccttcacttggtcttgcgacttcgtggtggtatgcaaattttcgtcaaaaccctcactggtaaaaccatcaccttggaagttgaaccttccgacaccattgaaaatgtcaaggctaaaatccaagacaaggaaggaatcccacctgatcaacagcgtctcatcttcgctggtaaacagcttgaggatggtcgaaccctttctgactacaacattcagaaagaatcaactttacatttagtattacgacttcgtggtggtcaactttaagaaaattaaaagatacaaatttctttaattgtatcatctcatgaaataaataaattttggtaatcaaaaaaaaaaaaaaaaaaa

SEQ ID NO: 19394 - DNA, 450 bp, Triticum aestivum
  Clone ID: PAT_TA_19394
gattttgaagacgatgaagaggacatgcttgagcattacttagccgaacaatcagggaagtcaacagcttaaccttcgaggccaaacaaactaccttttcgggcacagctttaccttaggaagccaaatgtggttatatgttgcaagtgtagctctagagcccactattttgtgatgcttctcatcatttggttgtatctgaatggatgctttcaagctctatcaagtggctgtgggctcattaatatataagctgaaggaattagaagatcaagctgcctaatacttggctgtataatttactgtatttttgatcggctattacatgtgtgttttgccttgtggagcatgttgcatgcttgggacaaaactttatagtaatttatggaaagatattcaaaactccaatctctaggagcttggaacaaaatgaactctgaatcaacataa

SEQ ID NO: 19395 - DNA, 446 bp, Triticum aestivum
  Clone ID: PAT_TA_19395
taggaacgtcctctgcgaggctgtcgagaggcaccgcgccgagatgctcgtcgtcggcagccatggctacggagccatcaaaagggctgttcttggaagtgtgagcgactactgcgcccatcacgcgcactgcaccgtgatgatagtaaagaagcccaagcagcacaagcactgatcaatgatccagtttgactgatcactacgtgtactgcaaataatatgtactactgcaaagttgtgtgtgcgtccgcccgtttgtgaataattgggtcatcaaccatcacatcttcggttgcttctacaagtatccgatccaatccttctacgtgtgggattgggatttacaaataattgattgttctctgaacctgaaaacaatgtatttgtattaatgtgttgggacattatattggttgcaacttcaaaaaaaaaaaaaaaaaaaaaaa

SEQ ID NO: 19396 - DNA, 504 bp, Triticum aestivum
  Clone ID: PAT_TA_19396
acccatcggccatcgcccacaagcgctcgcaggagaggacgaaaccctagcttttgcggcggcggcggcgaagacaatgatctacgacgggaactctcccctcttccgctccttcctcagccagaagggcggcgccgacaagaggaaaatggaggagcataaaccaaaggagcagaggcccaaggccagcgagaacaagcctgtgatgaacgaatgaatatctccagaaactgcgttcaatgcgcaaccaaattcgatgtctgcttgctctgtttagcttaaaaccaaagcttccaataatcttagtggtgtcttagtttctccttagtgtggtaattgctcagcttgaacatggcaacagtgcaacagacatgaaacttgaactacctattacactattatcaatttgagacgcccatgattggcaacttttgagtagctctcctgttactgccgtttgggtggtaccaaattgtgggaaaaaaaaaaaaaaaaaaaaaaaaa

SEQ ID NO: 19397 - DNA, 793 bp, Triticum aestivum
  Clone ID: PAT_TA_19397
tcagggagttaacaaggggatttctgtggacaagatcattcagaccatggtcagtaaaggggatgtaccagatcttttgatgtgcatcggaaacgatcgatcggatgaggacatgtttgagagcatcaataaagctacctccctttctgagcctgccattccagaagtatttgcctgttccgttggcccaaaggccagcaaagcaaactactatgtcgatggctgcagcgaagtaatcagattactgaagggtgtcacagccatttcaccccaaaaggatactgtcagccatagccatgcggtcttcaaggatacactcgaggttatcagctgatccacacaagcagtcagctcaaactacctacatccaactgtgttcagcctgtcaatctcaaatttccactgcatgcaagctatacatcactcaaaaacatatctgccacgtggaactctaaattggacaagaacaattgcaattgttgacacgaagacaacagtgatcacaaactgcaagttcctgcaaatggcatcaccattgatgatgcaatgacaacagaaatcacaaaccgcaagttcctaatttgtaggtaagactaccagtgggatgccatacattttgtaggcggttgatctgatggtgaaaggatttcctgctagagccccaactttgcagcagctgggagagccctggacctgtgtacagctcgtgggttgcacctaccttcagaatgatttgcaattcatcccatctgacgcttgtgctgcactgagcactattacactatttctttat

SEQ ID NO: 19398 - DNA, 899 bp, Triticum aestivum
  Clone ID: PAT_TA_19398
tcagggtcctctgattaacgaagctgctgttcagaaggtggagaagttcataaatgacgcgacttcaaagggagcaaatatcatgctaggtggtaaaagacacagcctggggatgacattttatgagccaactgtagtagggaatgtcagcaatgatatgcttcttttcagagaagaagtttttggtccagttgcaccccttataccattcaaaactgaggaagaagcagtccatatggccaacgatacaaacgcaggcttagctgcatacatatttaccaagagcatacctcgttcatggcgtgtatctgaatctcttgaatacggcttagttggggtaaacgagggaattatttcaacagaggtggcaccatttggtggagtaaagcagtctggtctagggagggaaggttcgaagtacggcatcgacgaatacttggagctcaagtacatctgcatgggaaacttgggttgagtcctgaaatcggccccaggctagaaacgcttggcagatgatgatgaaccgagaaaccaagtaagcaggcgtgcttagaagggtgcgagttgcgtttagctgcaagatcggagatgggaaaggggccggccactggttgtgggtgagcagttttagaataaagcgaataagtcgtggagcatgaataagaaagccgaatgagttgtaaatgacgtgaactattaaagtatggcttcgccttcgtacttttgtatacataatcatggcacttgtctatagtgtctccaaagacgttcatgttatacggaataaaagcatgtaggtcggatagactgtgtcccatgctacattacaggctgtcggtggtatgtacagcgacctcagcgggatcctgaataaaggtggatcctgcattcctgcctgc

SEQ ID NO: 19399 - DNA, 792 bp, Triticum aestivum
  Clone ID: PAT_TA_19399
ctctctctctctcatataatctcttggcagtattagtattagtgccgaattgcacctcttctaatccgtggccaaagcaaaattacagcctaatcgctcctcttcgtatatacttagtgccaatagaaggtaggaaagaccacatatccaggtttccttgctaggctctgctcatatcccgcaaattgagggttcagacttcataagttcgagctctgtccacaagaaaggaacaagagatcgttcttggcagttggaagaagctaagaacttggcgagtttgtggccaaggtgctcttggagggttcttggagcagtacaatgttggccaaaagattgaaaagatgcagcattcttctgttcgcctttctcctcgcagacgcatccgggagtcttcttgagagcagcggcggccaggccgaggcgatcggtccacagatctccccggcgacagagggcgagggcaagaggcggtcgctggcgacggggatgttctgcgtggcgctgccgaacgcggacccgacggcgctgcaggaagggctgaactgggcctgcggccagggccacgccaactgcgcggcgatccagccggggggcccgtgctacaaggcgaacaacctgccggcgttggcctcctacgcctacaacgactactaccagcgcaactccggcgccggcgccacctgcagcttcaacggcaccgccaccaccaccgccaccgaccccagttcagggcaatgcgtcttctcaggaagctccatggccggaggcaccacgccggcggcgaacgcg

SEQ ID NO: 19400 - DNA, 667 bp, Triticum aestivum
  Clone ID: PAT_TA_19400
ggcacgaggcattccagaatgtgcttcccttctgtactggtttcgcagcaggatgcatgatatggattgttatagctgaggttcttcctgatgcttttaaggaagcaactccatctcaagttgcttctgctggaacacttgctgttgctttcatggaaacattaagtacggtgcttctgggatttacagatggcaacaactcggaagatgcatcaggcttcttagtatcacttgtgtttggacttggtccactgatcggtggaattatactagtcacattctctcttggcttcagcatgccacaccctcttcttactggtgttgcatctggtattgctttccgtcttgcggcatggagacctgtgcagcttctaatgtcctcaaaaatgggtctctttaccaccctcttcctcctcattggaggttccctggtctatcatgctgctacatcaagcatccttagagtgtttaatcgcaaaagatcttccgcaaatgtgatcacgtcatcctctggcctctctcttagtgtcctcacaatacaatcactccttgcttgtggtgctgtattccttcacgcatatgcagaagggcttgcacttggtgtagcggctcgcaaggcttatggccttggccgttacatggatctcccagcctccctccatggtct

SEQ ID NO: 19401 - DNA, 643 bp, Triticum aestivum
  Clone ID: PAT_TA_19401
gacccttactggaaataccattacattggaagtagaatcttctgattctattgaaaatgttaaggccaagatccaagacaaagaaggtatcccaccagaccaacaacgtttgatctttgccggaaaacaactcgaagatggacgcacactatcagactacaacattcaaaaggaatctacccttcatttggtattgcgtctccgtggtggtatgcaaatcttcgtaaagaccctcactggaaaaaccattacattggaagtagaatcttctgattctattgaaaatgttaaggccaagatccaagacaaagaaggtatcccaccagaccaacaacgtttgatctttgccggaaaacaactcgaagatggacgcacactatcagactacaacattcaaaaggaatctacccttcacttggtattgcgtcttcgtggtggatctcaataattttaacttgatttaatcattctagtttattcaaaatgtgaaccaaaaatgttttcaaaattttaaatattcctaatgccaaagcatttttttttttttttttattgcagtttcatcactttattataacacaacatgaaatatgaaagtcaataaataaaaataattttactattcaaaaaaaaaaaaaaaaaa

SEQ ID NO: 19402 - DNA, 684 bp, Triticum aestivum
  Clone ID: PAT_TA_19402
ctgcgtctaccgcgacctcgccgcgctcgccatcctcgcccccgtcgccttcctccgcgagagaaggttgaggcctccggtgacccctcagctcgtcgcatgcttcgctcttcttggcttcactgggctcttcgtgaacccgctcctcttcctcgtcggcctccgctacaccaacgcttcctacgccgcggcgttcgagccctcggtgccagtcttcgcgtttctcttggctgtgattgccgggtaatcgtcagagatcgatgcacatgcatgcgcatgcaggcagctccaatagtttcactgtcagttcagtttcatcaggagacgtgaccaaattgagtgttcattcggaaagcaagagcaggtaataagctacattatattctgaataagactctaattaaattaaaactcttttcagcgttgaagcgatcaacatcttcagcaaggacggcatcctcaaagtcatcggcacagtcgtgtgcgtctccggtgcccttctgatggctctgtacagaggcccgtccctgattggtctcctgggaggcgccactgcatcaccagcaagtgaaaatgtcaccaccattattcctgctgctaaatggctgacatctaccgagctcgagggtggtgtacaaacatggtttcttggggccctgtgccttataggacacctgtttcttg

SEQ ID NO: 19403 - DNA, 405 bp, Triticum aestivum
  Clone ID: PAT_TA_19403
tgaaggtttgcagtcagcaaccaagatctcacaaagggggttgctggttcttctcagagatcttctcaaggcgctgcaatatcatctcatggacgctaggtggtgatagcttgttggaagaaagggtggaagggtgctgggagtaaacttgaatgcttttgaactaggtgctttcttatggtgaattagatgctgtctttgaatgcttctggactacaatctgtgttttagtttgtggacttgaatcacttttggttgatgatgacttagctagattatgtattcagctaatctatgcatgcttgtatattggcttgatggcacatgattatatatgtactcatttgatatggatgtatgagtaatgtgcccatttgtgtaaaaaaaaaaaaaaaaaaaaaaaaa

SEQ ID NO: 19404 - DNA, 915 bp, Triticum aestivum
  Clone ID: PAT_TA_19404
ggacgaggggggcttcatgtcgcagccggccaaacccaccggcaatgacatcaaggttccagaagctctgtatggtggcacaggcaactatgccagtgcactgttcctcacagcagctaaagctaactcattggacaaagttgagtctgagattaaaactgttgtagaggcatccaagaagagcccgttgttctctctattcataaaggacctgtcagttccaaaagagaccagggtgaaggctgtaaccgaaatatttgctgacgctgggttttcggatgttacaaagaatttcttggctgtcctggcggacaatcgcgcgccgtaatatattgagcgcattgcggagagatttgttgatttgactatggcacataagggggaggtgaaggttgtggtcaggacagttattccactccccgcggaggaggagaaagaactcaaggataccttgcaggatatccttgggaagaacaaaactattttggtggaacagaagattgactacagcatcatgggaggattagtgattgaattcgggcagaaggtgcttgatatctctatcaggaccagggcgaagcaaatggaggcgttcttgaggcaaccccttgacttctaacagccttttggataaaagaagcatcatcggaatgcagaggctgtcctgttgaaggttttcctgtgtctgcaattttaatctggccttttgaataaaatgtttcctctaacaagtgaagggcactgtttttattgtctcgtgggccacagatgcctgctgaacaatttatgttcatttcttcttttcttaaagaagcatgcactaagaacatgaaggatgcatgccatggaaagtttttgaaagtcattgaaacgtatgagctcctcatgcaatgcattattctccttaaaaaaaaa

SEQ ID NO: 19405 - DNA, 577 bp, Triticum aestivum
  Clone ID: PAT_TA_19405
gggtcaatctcaatccctcttccatagccataagcacttctgtctctcttcactctgcgaaatggagaagaagcagcagaaagagaaaagcgaagagccttgggtcggccgccgcatcctcggggtcgccgccgccggcgctgtcgccgttgccgccggtgccttcttcctgctgtcctcagtcggggacagtagtgcagacaagggcgaccaagcggaagatgatacggcggccaggccgatgaggaagacgatgaaggggccgggctccggtggcgagctcatctcccgcgacaagttcaacgaggacgccgcgaactatttcaggaccgggcgtcagaagggatccaaggccgccgtcgacgaattccagtagccggcgacgtaaggttaaaagcagtatatatacagcgctcctctcgcctacatatatatgtgtgtagttcccacttcaagcttgcagtatatacatgtggcctgtgggcatgcatgtaggaatactatatctactactactatattttctgtaatcagaatggacctagggcatgcataccactatggacctgtgcgtacg

SEQ ID NO: 19406 - DNA, 520 bp, Triticum aestivum
  Clone ID: PAT_TA_19406
taaggcctgaagggactgtgatcatcagggacaacgtggaggtgttggtgaaggtacaagctatcactggaggcatgaggtggaagagccaaatcatggatcacgagtccggtccgttcaaccctgacaagatcctagtggctgtcaagacttactggaccgggaagcccatggaaaagcaataatcaccgcctttggtactgttttatctgcgaaaatctagacatgacttgcttttgagttctgtcttcattgccattttttatctagcttcaggatatctgtatataggaggcatgtggaccatgtagctggaattggtatcaaacatcttcattagccatatagtatgtatgtgacacattgcaatggtgtataagatgttcactcatattttgatgtgctattgcaatctaataagctgatgcctgatgtgacaaaaggatattgtaactgataatatgttcctgtcaaaaatacgatgacaaggttgtggtacagaaaaaaaaaaaaaaaaaaa

SEQ ID NO: 19407 - DNA, 685 bp, Triticum aestivum
  Clone ID: PAT_TA_19407
tggctaacttaattggcggggtgttcaggcgtgcaaacactgatattcactttaaagattacgttattccaaagggctgcaaaatattcgcttcgttccgagctgtgcaccttaatctggaacactatgagaatgctcggaccttcgacccttggagatggcagagcaagaacaagcttcagaatgcagaaggggcaagtctgttcactcccttcggcggcggacctcgcctgtgcccgggctacgagcttgcccgggtggtggtttctgttttcctccaccatctcgtcacatgctcgagctgggaagtagctgaggaggacaggattgtcttcttccccaccacccggaccctcaaaggataccccatcaacctgcggcggcgaccggattatgcatgatttctgacctcatgttagtagtttccagttgttatccttatcttcggagcaaggcaaggctaagcatagataagaaagatgatgccgtcgtcgctagtagttagtgatttccctcactctctctctgttcctctctctctctctctgttctctcttctagtctgtaacttggtaccggacagcagccagcaaacttcgttttgcttgtaaaatgagaccccagaaaaaactgctatgaaacgcgtactactaggctttgtttagttcaaaaaaaaaaaaaaaaa

SEQ ID NO: 19408 - DNA, 1447 bp, Triticum aestivum
  unsure (1)..(1447): unsure at all n locations
  Clone ID: PAT_TA_19408
gcccaacgccacggcctcgtgggtcctccgccccgtccccctcgagcccctctcctcttttgctcaaggcgccttctcgcttccgcccctctccttcttcctcgccctcctctccgcccgccgcctgctcgccgtccgatccgccgcccccgctccgtctccatgggtctcctgtccaacaggatcgggaaggagagcctgaaggcgggggatcacatctactcgtggagggccgcgtgggtctacgcgcatcacggaatatatgtgggcgatgataaggtgattcattttaccagaggaagggaccaagaagtcggaaacaggcaactgtcattgattttcttcttgtgagctctggccctaataggagcaccacaccagcttaggatgcacccgcggagaagccaccaccaccgcggagacaaatggtgtgacttcctcttgcctcagatgtttcctggcagggggtgccctctatcgtttcgagtacgacgtcaacccggcagtcttccttgcaacgagcgaggagggacctccacgcttgccgccactgatcccggcgaggcggttgtccgacgcgcccaaatacttgttgacccatggtttcaggtgctacagcctgttcaagaacaactgcgagtacttagcaatatactgcaagactggttctgcttgtggctgtggcagggcgacgttgggcctctgggcagagtggtcaggctgagtcggtcgtcggtggcctctagctgctgtggtctcaacgcttttgctcctactgcatcacaaacatcaacggcgaggaagtgatgactgtcggggagtactgtctgagtgtgtacgcacaggacattggcaggcgccgagaggtgctgcagctggaagcggagaacgggagtgccgggcctgcaagcggccggatccgtccaccgaatatcagccacgaacatccttccggtggcagtccaggctccggcagtgaccacagtcgttactgcttaaaattgagcattgaaattgtaaaatattgagatgaatacatgaccatcactactgctctatgctccaccggaatagttgtccaaacccgctaatcatgcgccaagaaactaagttcccagtcaacattccctgtgtgacgagtcgcgttaccgcttagcgttccggtgtaaggtttttatatggagttgtaaacatcgtcaaaactaggtctatatgtaccaccgaaatccttgttcaaacctgctaaaactgtgccaagagtgaaatccccattcagcaagagctgtatgtcgagtgttgtatccgctacggtcgtgtatggtttgtcttcagtattgcaaagaaggttgaacattggtgtgtggtttgcttgaaaaaataantctgttctgtgcctgaanaaaatctcgagngggggccggtacccattncncccaatnntgagnct

SEQ ID NO: 19409 - DNA, 953 bp, Triticum aestivum
  Clone ID: PAT_TA_19409
ctgcataaataagaaagaatgtgagctgcatggtctccaaaggaccctgtattttccagataatgaaccagatgctaatgtcctttgggaggacaagaatgtcagggtggattacataaagttggtgctagaactctcagagttgtgtgcagaacaaaatttagaggtatggtacctagaggatgaattaatcagcccctgcttgtttgaagaactacagagtcagggtgatcaaacagatgatctaaagcttctgtttgactgtatctgtgaagctctaacagagatccaagagagatattttagactctcttcttggctaacgtttctaaaacacgacatacggacacctccgataggagaaaacctcatcacagaagttgatagatatgtttacgggtatatccaatatagtcttccaagtactctagagcagacaatgaagagggatctagaagttcagacgtggatgaacattagatcgaaaactgaagggattgttatggagatctgggagtttgtattggatgagttgatagatgagactgtctttgatttgtggatgtgaaggtctgattatatctcgtccatggtgctttgtgagtgagtatagtgagtaggatacatgagttttcgtgctgacaataaccaattctatgcggcagaataacatgatgggctactactactagtcaagtgtgtaactacagtggaaatggttctcgtggattgagaacaaaagtttaggtcagcaaaatctccagagttgtgcagtttgtacggatgaagttgggcacggtctgtcaccagaactcacagccatgcctctgagcagcgaagtgtacagcagtctgaagcgcattgcaattttcctcttgcccattgagatttgagagtttgtgtgcatacgtgtgatgcgtcccacttttcagcgggatcggatcacgcttatt

SEQ ID NO: 19410 - DNA, 1311 bp, Triticum aestivum
  Clone ID: PAT_TA_19410
gaaaaagagcaacggaggaacaatccaagaccctcttctccgccgcgcctgccacccgctgaggcccgcctatcggcccaaatggcctcacccccttccccgcccccgccctcgccgccgccgcgggccgacgagccacgcagcggcgggggcagggcgccgatcccgccctacgtcaaggcggcggcggggtcgctcggcggcgtgatggaggcgtgctgcctgcagcccatcgacgtcgtcaagacgaggctgcagctcgaccgcgcgggggtctaccgcggcatcgcgcactgcggcaccaccgtcgcgcgcgccgagggcgtgccggcgctctggaaggggctcacgcccttcgccacccacctcacgctcaagtacgcgctccgcctcggctccaatgccatgctgcagtccgccttcaaggaccccgtcaccggcaaggtctccgcgcagggccgcctcgcctccggcttcggcgccggcgtcctcgaggccctcatcatcgttaccccattcgaggtggtaaagattagattgcagcaacaaaaaggactaagcacggacctgctgaaatataaagggcccatacactgtgcaaagacaattgttcgtgaaggaaggcttttttggtctgtggtctggagcatcaccaactgtcatgcgtaacggtacaaaccaagctgcgatgttcacagccaagaacacgatagacattcttctctggaagaagcatgaaggggacggcaaggttctccagccatggcagtccatggtctctgggtttcttgcaggaaccgcagggccgatctgcaccgggcctttcgacgtggtgaagaccaggctgatggcccaagggaggaccggggacatcaagtacaagggcatgttccatgcgatacggacgatacacgcggaagagggcctccgagccctgtggaaaggcctgcttcccaggctcatgaggattccacctggtcaggccataatgtggacagtggctgatcaggtgatgggcctttacgagcgaacatatctgcagtcggctcaggtgtaacccgcctatttgcgaagctgctgcgcattcacaaccttcccctattggccggctgcccgtgaaacacataggctcccatccgaattggttggttagttgtcaccattttgggtttcctggaatcatggatattcatttgttcattgcttgagaggctggtattggtcggagcaatgagcccatgtactttagtagtcaacaataatgattaaacccctcccatttttgataaaaaaaaaaaaaaaaaaaaaaaa

SEQ ID NO: 19411 - DNA, 638 bp, Triticum aestivum
  Clone ID: PAT_TA_19411
tgcccaggcaagtccgcggccgcgatgacaacgcgcttctcgccggcggcgatgacgacgcgcttcaagaagaaccgcaagaagcgcggccacgtgtccgccgggcacggccgcatcggcaagcaccggaagcacccgggaggtcgcggtaacgccggtggcatgcaccaccaccgcatcctcttcgacaagtaccatcctggctacttcgggaaggtcggcatgcgctacttccacaagctccgcaacaagttctactgccccgcggtcaacatcgagcgcctctggtcgatgggtgcccgcagagaaggcggcggaggcctccggcgacaagcccccgcaaatcgacgtcacgcagttcggctacttcaacgtgctcgggaaggggctgctgccgcccaagcccatcgtggtcaaggcaagctcatctccaaggccgcggacaagagcctaattgccgccggcgcccccttcttgcgcatcatctcgatctgattcctttctggcttcctatttttgagagccacatcggttctagccgtgcctgcctgtgtcacctatttgtgtcaaggcccccccgtgtgcttgcttctgtggctgctgcctgttgggacagtgctttatgaggattttgatgc

SEQ ID NO: 19412 - DNA, 491 bp, Triticum aestivum
  Clone ID: PAT_TA_19412
taccattgccatgttgggctatgctgatgaggacaagacaactgttctggagttgacatacaactatggggtcacagaatacagcaagggcaatgcatatgctcaggttgccattggcaccaacgatgtgtacaagagtgctgaggcggttgagctggcgaccaaagaactaggtggcaagattttgcggcagccagggccgctacctgggatcaacactaagatagcctcttttgttgatccagatggctggaaagtggttctggttgacaacaccgacttcctcagggaactccactgaagaccgggatacccagttgctgtcctaggatgtagtaatgcttgtctgtgaatgtaataagatgtgagtggtttgtttccgcctggatgaactgataataatggatgttgctacagaggttgtgcttctgccagtgaggtttgggatttgttatgtgactgtgcctgctactaaaaaaaaaaaaaaaaaa

SEQ ID NO: 19413 - DNA, 356 bp, Triticum aestivum
  Clone ID: PAT_TA_19413
taaagaacctttaaattaaaaactcactattttgctcactaaaaacagatgaaacatatacgatatatactctttgctatacaaaaatcttgccggattcaagcgagaattttcaagactatttcgagctatcgaccaaacaaaatgtgttatgcaggcttcaataatttgtgaagaaaattagccaaaaacattcaaaagcattaatacaactgtataacattgaactgactatcatgagctgtattgaaaggctattatcgtttgatgatgaccgtcatttgatttatttaaaatttattaaagaacagttaagaatagaaaaaaacactgactgcaaaagaaaacatttgaaa

SEQ ID NO: 19414 - DNA, 727 bp, Triticum aestivum
  Clone ID: PAT_TA_19414
gaggagaaattccccacttttgaagaagtattcggacaaggctcctccaagtgataaacttgcctctcatgaagtcaaagttgattatgagtacaagagcgttgtcgaaccagacaaaattgttccaccagaccagaggattaaggggtatctttatggtcctcaagttattcctgtatcaaatgctgaatgggaggcagtcaagttcaagccagagaaaggtgtgaagcttctaggatttacagatagatccaacgtaccacggcaccattttatgaaagacgtatgcttgtttatacctgaaccaggcaacattaaagcaactcttgcagtttctgccatagcaagagcaatgcatcaaatgaacaaggctgctattgtgcgatgtgtgtggagacaaggtcaagggaatgttgctcttggtgtattgacaccgaatatttcagcagtggacaatgtccaagattccttttacttcaatgtactcccatttgctgaggacatcagagagtttcagtttcgatcctttagcagcctgccatcatcatctcagcccactgaagaacaacaagaagctgcagataacctagtgaagatgttagacctagcaccacctggaagagaggtcctcaagcctgagtttacaccaaaccccatgttggagagattttacagttaccttgatctcaagtcaaagcagccagatgccaatgtaccaccacttgat

SEQ ID NO: 19415 - DNA, 2050 bp, Triticum aestivum
  Clone ID: PAT_TA_19415
gtggaggggttgcggcgtggatgccaaccgggagaggccctacttcgttcttgacgacctatgggaggcgtacaaggagtggagtgcgtatggtgccggggtgccgctcgttcttgacgggtgcgacggggtcgtgcagtactatgtgccttacttgtccgccatcgagctctatggagactcatcagtcctgcagtcatcgtccaacccaagacatgatggacgacagtgatgaagatttccatgattccagcagtgatggtagcagtgattatgaacatgcaagggtcaaacactttgctcaggaaggcttctcaagggatgttggtgaatctggagttactcatggccgcttgctctttcagtacctcgagtttgattctccgttttgccgtgaacctttgactgataagatttctagcctttcagcccgattttcaggattgaggacccttaggagttgtgatttatcagcgcgtagttggatgagcatcgcttggtacccaatttatcgtatccctactggaccaacattaaaagatttagatgcctgctttctcactttccatcagctttcaaattgcccgcaaggagataatctgtgggctcctgataatctgtgggctcctgatagcacaccaaacataccactcccagtttttggtttggcttcctacaagtttagcaactcagtctggtcctcaactgatggtgattggaaactggctagctgcttaaggcaagctgctgccgattggctgagagacagccgtgctggccatccagattatcagttcttcgtctcccgtggtgcatacaacaggtagtgacaccaaatctgtgctttccgcagagctcatgaaagaatgtccgaagagtgtcttgtgaacatgattaagttccaagtgactgactggttgactgcttccaagtgtgcgcaaagtggcgggcggctgtttccccttgtcgtctcttccaccgcccccttttgagagtcgcttatccccggccggggcgatctgatgcctcgttcgtcggcgatgctggctggcgatggttgaggagaggtgcctggttcttccatatgtatattagagtagcagtagacttagttagacttggcgttatgccatggtgtggcctcatgccagtcgggatacctgctgctagaccttgtgagcagagtctggtggtggtcgtcgttgtctcctacctcgcctccatggtggaggggactggtggacattggatctggcagtatccctcccaataagctcagtctgtccagcatctaggagccacggtggttccttcctctgtttcttgccgtcgtggtgatggtagcagaaaggtggagagatctcgcctcggcctcctcgtggtgctgggcctcgccggatccgagcttccggcgtaggtggtgttatccccgcatctgggaaagggcttccgctatctcgttggaagctggtgatggggatcctgagcttattcgatggtggatctgaaggagctacgacaccggtctcctccaacaatccatcgattcctctggtcgaagggcggccatacttgttcctcccagccacgatgccagaaggaaggcagtgctgtgccaaattggagtctgtggcttgctacagaggtctcgccggaccaagtggtctgtcccaggcgtcggcgatgattgtatccactgcggcacagcgtggacccgatcgcgttttcagttttatgtttggggtcctttctataagatgcagggatttgtttttattttcagcttctttagtgtccttgttgtaagctataatgtctcttcgtcataatcaatgaagtgctgggtccttctgggcccttgtagtgttcgaaaaaaaaagggaagctggtatgagaatgaaaaaaaggaaccaggagtgagaaatgaaaaaaggtggtgaaaaagcgggcgcttcagatgtagtttgagctgttcaacttatgtaatacaaatagtatggggacaaattttgatgaaaacacccctcatgtctgtacacatatcaagtgt

SEQ ID NO: 19416 - DNA, 684 bp, Triticum aestivum
  Clone ID: PAT_TA_19416
ccgcgctcgcaaccttccccagccatggcgaccgcgacgcggaggctgctccccgcgctcctcaggaccctagctccagccggcgcgcgcggcctctccaccgagaaggctgttggcgcagccgccgtcgtcggcagccacaccgctaagtggatgcaggacacgagcaagaagtcgccaatggaactgatcaacgaggtacctccaatcaaggttgatggtcgcattgccgtctgtgaaggggcttctgaaggtgttggacttggccacccaatctgagtacatctgccttgaatctggtaggcacctaatgtgtgcaagtactgtggtctccgttatgttcaagttcaccatcgactaaattgagaagataacgctgtctaaccgctgcagaagctgagtttaggagttcatgtgcacacacatttgttccacaatgttctgttagcgtacttcgaaccatgctggcagggcaaaaccttacctttgctgcctctcctcggctcgccctttcttaatcctgtgttaactgtgggttgttctttctatagatgaattgtgctcccctttctgaacactatgccagctgtgtgcctgtgtgtattgaaatccaactctgaatatgaaaagtatagaattaattctgagggcaatttaatctcagaagttttaaaaaaaaaaaaa

SEQ ID NO: 19417 - DNA, 589 bp, Triticum aestivum
  Clone ID: PAT_TA_19417
tagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacgggattggaggtggcatgtcagtcgatattgatgcatctggcaggaagagcacggggaagggtgtgtaccaattcgttgacaagtacggcgcaaacgtcgacggctacagcccaatctactcgccggaggaatggtctcccaccggtgacacctacgttggtggaaccaccgggcttctgatctgggccgtgaccctcgccgggctcctcggcggcggcgccctcctcggctacaacaccagcgccctcgccggctaaatttcacccaaatccaggctatgtatgtaacaccaagctgggtgtctgcatattcatctgtaatctaagatagccttcctctgaatgcgatgtgatgatgcccactgcttaatcaaactgcattgtgattaatctatgtaacactgtac

SEQ ID NO: 19418 - DNA, 485 bp, Triticum aestivum
  Clone ID: PAT_TA_19418
gggaagcacatcactccagttgatgaaaacacaattcccactggtgagataatgcccgtcaatggcacttcttttgatttcacaacagagcacaagattggagagcgcatcaatgatgttcctggagggtatgatcataactacatgctggactgtggcgatgagaagaatggcctgaagcatgcggccaagctgagagatccatcaagcttgcggaccctagagctctggactgatgcacctggcatgcaggtctacaccgccaactatgtgaatgacatcaccggccaagggggtgctgtctatgagaagcatgctggagtatgcttggaaacccacgggttccctaatgccatcaaccaacctaattttccctctgtagttgttcggcctggtgagaagtataagcacactatgctgtttgagttctcaaactgaatactgattggacaacacaaatagctctaaaacctgttgaatgaatc

SEQ ID NO: 19419 - DNA, 787 bp, Triticum aestivum
  Clone ID: PAT_TA_19419
gaggccaagttcccagccagccaatcctgtccaggcggcacaaacagctcaagctgtagttccttcatctggaccaaatgctaaccctctcgacctctttccccaatctcttccgaatgcttccgctaatgccggcgcagggaaccttgatgttttgcgtaataacgcccaattccaaaacctgcttggtttggtgcaggctaaccctcagattttgcagccattgcttcaagaattggggaaacaaaatccccaggttatgcagctaatccaggaaaaccaagcagaattcatgcggttgatcaatgaaccactggagggagatgaagagaatgaaatgatgctggaccagatggcggatgcagctgagaccattgcagtcactccagaggagaacgaagctatacttcgtcttgaagggatgggctttgaccgggcacttgtcctggaagtgtttttcgcctgcaacaagaacgagcagctggccgccaactacctcttggatcacatgcacgagttcgacaacgatgacgggctcggagggccaccactatgagaggcggaatagctctcaatctctgcatcatgcgaaggcttgtagggcagaaataggaaaacgttttgggatttgtctcgtctcgtctgtccgctccctctacatttctgtttggctttgctgttttagtacataaattctagatttacagacagactttataacctgatatagaggtaacggatcagtttactcttttctggataaacttattagcttactaaaaaaaaa

SEQ ID NO: 19420 - DNA, 728 bp, Triticum aestivum
  Clone ID: PAT_TA_19420
cgcgctgcctagctcgttcgggctcgggggggggccagcgccgcggcggcggtggcgatgcgcagggtggggggcgtcgctgccccgagcccggggggccgctctccggtcccgccaccacggcggggcggcctgttcgtgcgctgtgtggggcctcagcctgggggccggccctctcctcgcccttcaagcttgcagagctggcccaccccctcccgctcgtcttgggcctccacggtgtcggtcgtcccggcccgtgtgcttcatccttgtacggcgtgctcgcgccccccccgtggtcccgctcctcgacctaggcggtggtgaggtccagcgttcggccctcccctcttgcggggctgatgccgggggtcccctcggccgaaccctcccacactcggattgtcctcgcatggccgctccagccctgtcctcccaagctgctctgtggggctggcggcgtgaggccttcttggtccggggctggcggtccccgtctggccttcggcgctcgtgttggccgtctgtgtgtctctgatcggtgtcccgttgtcgtagtacctgccgcgcttcgtctggcgcctgctcgcctgggcctgccggtcctgctctccgtagtgcgccgctcatggtcgcatctggcctgggggttcctgacgaaccgtcaattcgtgctcgctctctcacccgcgtccgcagtcttggcgatgccgacatttttcctcatc

SEQ ID NO: 19421 - DNA, 317 bp, Triticum aestivum
  Clone ID: PAT_TA_19421
gggtgcctataaacagtgtaccaaaagaacaaacaagatgagcctcctaattgaaatcccgccccttaactgctgttgacattctttttccactcataagagaactgtacataccagcaatggtcgctgctgttgtatcagtagtatgcaatgtggaaccaataagcttcgtgtgcagcgactgcaaacctacctgtataagactgatctgtaaggtcttgctggactctggctcagtggcgcttacaactttgttattttgtcgcatgatgattgtacgaaaaaaaaaaaaaaaaaaaaaaaaaaaaaaaaaaaaa

SEQ ID NO: 19422 - DNA, 879 bp, Triticum aestivum
  unsure (1)..(879): unsure at all n locations
  Clone ID: PAT_TA_19422
caccatcgacagnagtatgatgatactgatgcactggaagtagcacgtctcgttgcaattgaggtggagcgggaagtaattgactacaggggagactattgcagttctcctgacattagttccaaaaatgtagatagtcctcatgtggaagcaaggcagcacactgaaccccctgttcatgaatcaaatgagaataaatcctccactacggtggtggattcaggaaattcctcgtctcttaaggaggatggtgtgggcatcacagatgacagcggtcctattaatagcagaaagaacacacagggtgtggatatggtagactttgatcttaatgcaaatcagtaccatgaggaaaccgattatcatccaaagtccagtgctaataattctgtaaatttatcaactcctatagctgtggctgcttctagaggctcacttgtatttccagctcgcctccaattcgaaggtgcactggggtggaaaggctctgctgcaaccagtgcttttcggccagcttctgttccgcgtactcctgacagagagaagtcaatgtcagcctcttcacagaaaacaagaaatgtgatgtttgacttgaatgtagatgaaagtgaaaatactattgctggtgagtcactttcaacagccttctggcttcgttcctccgacatagctcccaaggatatctctggagctgatggtgctagtacggggcttgaacttgaccttaataacccatgtgaagaggaggaagctgctaccacctcacctgctgtaccatcattctggagtcatgaacaatgtcatggcagatggagccagccctcttcctcttcatcttcaaggcaacctactgcaaagaactttgacttgaatgacaat

SEQ ID NO: 19423 - DNA, 979 bp, Triticum aestivum
  Clone ID: PAT_TA_19423
ggcacgaggcaggtaggttaggccctcttcgccggcggagaccatggtgtccttgaagctccagaagcggctggcagcgagtgtgctcaagtgcgggaaaggcaaagtatggctcgatccgaacgaggtctccgagatctccatggcaaactcccgccagaatatccgaaagctggtgaaggatggcttcatcataaagaagccacagaagattcactcaaggtcccgcgcaaggagggcccatgaggccaagcagaagggcaggcactcaggatatggcaagcgccgcggtacccgggaggctaggctccccaccaagatcctttggatgcgcaggatgcgtgttctcaggcgcctgctgcggaagtacagggaggcgaaaaagatcgacaagcacatgtaccatgcaatgtacatgaaagtgaaaggtaacatgtttaagaacaagagagtgctcatggagagcatccacaagactaaggctgagaagaccagagagaagactctctctgatcagttcgaggctaagcgggcaaagagcaaggcctctcgtgaaaggaaaattgcgaggagggaggagaggttagcacagggcccaagggaacccacggcagcaccagcagcagctcctgccccagctgcagctgcaccaaagaaggcgaagaagtgaagtgatcagaagcattggctttctggtaccaggacttaccctaattgtggagctccttgtctcttttgctggcatatatctaagctgtcatctgagatatctggaacatcatatctcgtttgttatgctggatgatttagtagacttgtttattttaagtgcctttggaactaattatcacaggatatggctgtgctttcgtgagccctagttcttgttaagctaatttatcttttatctggccgctgaggctagcgcctgtgctggttttgcccggaggaccatgaccttaaaaaaaaaaaaaaaaaa

SEQ ID NO: 19424 - DNA, 771 bp, Triticum aestivum
  Clone ID: PAT_TA_19424
cccagaggtccgatttagtctctcagtattccatggccaataacagcagcgctgagaagcagcgagcgcgggtgctagtttgtgtgacgggagcagggggcttcattgggtcacgggtggtgaaggagctcctcctccgtggctaccgtgtaaggggaacggctagagacccagcggaccgcaagaacgtccacttgcaaaccttggagggggccaatgagaggctatccttgcaccgtgccgatgtcctggactgcgacagcctccgtgccgccttcgatggctgccatggcgtcttccatgtcgcctctccagtgtctaacgatgttgaactcatgccggtcgcagtgaaggggaccagaaacgtggtgaacgctgcggcggacatgggcgtgcaccgccttgttttcacttcttcgtatggcgcggtgcacatgaaccccaacagaagcccagacaccgtgctagacgagacatgctggagcgactatgaattctgcaaacagacaggcaattattattgttgtgccaagatgatggcagataaggcagcaacggaggaggcagccaggagggggctgcagctggcggttgtggtgccgccaatgaccatcggtcccatgctgcagcggtctctaaacggcagcaactactacgtcgcaaggtacctgatgggcacaaagaaggcctaccccaacgccgtcgccatctatgccgacatccgtgatgtcgtacgtgcccatctcctcgtctacgagcaccaccgcgccc

SEQ ID NO: 19425 - DNA, 1163 bp, Triticum aestivum
  Clone ID: PAT_TA_19425
cggacgcgcgcgcgacggaggacggacaatcacagaaaacgaaacgcaggcatccatggaggtggtgggaggggtatcgctgaggccggcgcggctccggcacctgacgcccggggaggccagcgcgggctccttcctgccgcggaggctgcagctggcacggaccgccgcgaggccagcgaggcgcgcgctggtggtggaggcccgcgggggcaggggctggtcggaccggcagtcccagcagcagcggcgcatgccgcagctccccaagatcgaggacgacggcaacccccgcttcgtcatcttcatccgcaccgccaatgtgtacttctggtacccgctcaacatcgtcaccggcggcaccaccgccaagatcatgctcgccgccaaggacaacttcctcggcaagtacatctacaaggacacgctcgcccggaacctccgccaccgtcatttacaaagacgaggacgacataatcgtacttggcgaaagagcagttccgcgtgctcaaagggcgaaaccgagttccggtacggctacatgatcgtgggagaaggggaacctgaggtctgcactggcgacaagcaacgtgctcgagctcccaaagaaagaagagctcaaaagtgtggttgacaaggtgagggacttctttggtgaggtaacctccggtgccaaagaatcctttgcgcagataacaggatctgccagcgcagcggaggccgaagcagaagcaaaagcagaagacaagaggccccgctccaagagacgaggaagcaagaggaaagggaagcagcagaagcccaagcaagggttcaagcccgagagctgattggaagcgtggatctcaatggaccgccggctgtagttttcccagagctgctctgtagcacacctgaggcttttgagttttgcagcacacaatgtgtaacctccctgtgggtaacaacaaactttgttcatttctcacagaatatatatgatgttaggcagccccgcgaaatcttagaaatgagccaattgatgtacttacagaacggcgaagatcacagctgtatattgaatttgaattctttgcaagagttaacagttgttgtatagcgcgcatggatggtatccccttatatgaggtggtatctgaattcagttggaaatgtattatgtg

SEQ ID NO: 19426 - DNA, 732 bp, Triticum aestivum
  Clone ID: PAT_TA_19426
gaggtggaggtatcggctcaatgttgagaagcccgaggggatcatatatgtgacagatgttggtcagcagcagcactttgacatgtttttcagtgctgcaaagatggccggttggctcccagatccaagtgaaaagaagtttccaaaaacaagccatgttggatttggtcttgttcttggttcagatggcaagcggttccgaacccgcagtactgaggttgttcgattggtagagctacttgatgaggctaaatctcggagcaaatcagaactacaacaacggctcactgaaaatggcaaaattgttgactggacggatgaggaattagagcaaacttcagaggcagttggatatggtgctgtgaagtatgctgatctcaagaataatcggctgactaattacacatttagttttgaacagatgctgagcgataagggaaatactgctgtgtaccttcagtatgcacatgctcgtatttgttccattattcggaaatccaacaaggatgtggaagagctgaagatgagcggagccatttctctcgaccatccagatgagcgtgtgttggggctatatcttatccgatttgcagaggttgttgaagaggcctgcacgaatctacttccaaatgttgtatgtgaatacttgtacaatctatctgaaatgttcacaaaattctataccaactgccaggtggtcgggtcaccggaggagacaagccgcctgttgct

SEQ ID NO: 19427 - DNA, 381 bp, Triticum aestivum
  Clone ID: PAT_TA_19427
ttgtggcctgctgggatgaacgacagtgcattgaaggagatggatgccgccgaggcgtcggggagccgcgaagggcggcgatgttgtgcgcggtggagacgagtgtgatgttcacttcagggaaggagcggcggatgaggcatctaagctcatcctggtgatgactcgggtgtgagctgatttggcaggcggcgagtgaatttgtgatactgtgcttccaaacaatattccacaaagcgaattgttatccactggtgttcttgtgcacatcagaatacaagtgtaatcattttacaggtgtatatgttttagtcacatccaaacaagccttaatggattaggctatttggcttggaaaaaaaaaaaaaaaaaaaaaaaaaa

SEQ ID NO: 19428 - DNA, 625 bp, Triticum aestivum
  Clone ID: PAT_TA_19428
cgcatcccccgccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccaaaagatttatggtggccgccaagaggaatggctcacgcccacctcacttctgcaagagcagtggggccatctcacgcaacatcctccaacagctgcaggagatgggcatcattgatctcgctcccaagggtggacggctcatcacatcccagggaagccgtgggccggtccctggggctgctggggttccggctgccgcttgggctctcgcagcttcggtttctgggtggtcacgtttggcgcttgggttggcttcgctttatttccaggtttcggcttggtcttcgtaggtccgagacctttaaggtttaatgcatctaggtatggc

SEQ ID NO: 19429 - DNA, 719 bp, Triticum aestivum
  Clone ID: PAT_TA_19429
tattggacaaggagagacgtggaccatctatggaggggtcagatgggtttgtctgaagaagagcagaggaaagccctggagtctaaacacgtgacaaatggtgtgaccgaggatggtgcccatgaatcccctgaagaaactaccaacggttctgcttgcaaccctgtcgctgcaggtggttgctgccagggcaatggaggctttacctgctgccagagtgatctgccaaaggaggataagagcatcacagctgagcagaaccagaagagctccgagaagggggctgacaaagagtgtgctgctggcagcaagaagaggcacatgaagatgtgttccatgccaacctggtttgagacatgggaaacggctgacacctatgctgctcttggtattgttgcagctgctgcatcggtgttcgtcgctttcaggatctacaagaacctcaattgagaatcctcagaacagggctaggttttgtgcactaaggacagtctactgctgtaaaacagtctgctgtgagaataatatactacgtgtgcatagtaatgcaagattagaactttaaagtagctaatctgaagaaagtgaccaaagttgttttgggtaatgtcgtcctcatgtgaaactctgcttaatctccaagttttcccacgccttgcctatttgtttaccttcgcaaggcagtgaccctgctgttcgacatgacgatgttatcttta

SEQ ID NO: 19430 - DNA, 929 bp, Triticum aestivum
  unsure (1)..(929): unsure at all n locations
  Clone ID: PAT_TA_19430
gatctgctctgttctatcgcccctgcccaacatccacgagataggcgcccgcggtcgcaggcgactgaagctagcctccgcgtccgatccggcggccatggagaagctcggcgcgaacccggccaactcgtgcccgctcacgccgctcggcttcctggagcgcgccgccaccgtgtacggcgactgcccctccgtcgtctacggcggcaccgtcttcacctggtcccagacccaccgccgctgcctccgcctcgcctccgcgctcgcctccctcggcgtctcccgccgcgacgtcgtgtccgtgctgctgccgaacgtgccggcgatgtacgaggcgcacttcggcgtgcccatgagcggcgccgtgctcaacagcatcaacacgcgcctcgacgcgcgcaccgtgtcggtcctgctccgtcactcggggtccaggctcatcctcgtcgacccggcgctgctgcccgtgctcgacgaggcgctccggctcctcccgccgggccacccggccccgcgggtcgtgctcgtcgaggacccccaggagaaggacttccctcccgcgcccgccgcggccctgacgtacgagaggctgctccagaatgggcgacccggattcaagtggnccggccggcaagcgaattgggaccgatnatcctcaactacactccgggacaactntngngccaaaggggttcttgaatggcaacgcgggacttcntggncacaatggatcgctcgtctcctggtcctnccngacaaccgactactttgacctccatttcaagccaacggtggacttcccttgggatggcctccttgcggacaagtngctcnaccttgacccccaagncaagaacaatcccgccgcgggtaacactctggggaacgtctgtaaatctggaacccccaggctcgagccctcgggaagg

SEQ ID NO: 19431 - DNA, 410 bp, Triticum aestivum
  Clone ID: PAT_TA_19431
gcacgaggtggtcatctcttgtgttgctgcacacattaaccagatcattattgattctatcatagtaaattggtggcgccagaaggatcaacaatttacttctgcaaagtaacttgagaattcaatttcggtgtgtaacacagggaatcagtcagtcaggagctcttaatgtttatctcatgacgccaaagcaaaatgagatctacatgttcagttgtttggaacgaaagcagtcatatcgagattattttacacagaattgctttcgtgcctgaagaaacgatattatgtctttcctccacaatcttcagatttcttcctctcaaggtttttggatagttaaataaaaaaaatgaaaaaagtaattgtacttgtcatgcaggaagttcagtaaaaaaaaaaaaaaaaaa

SEQ ID NO: 19432 - DNA, 793 bp, Triticum aestivum
  unsure (1)..(793): unsure at all n locations
  Clone ID: PAT_TA_19432
cctctgcgagggcgtcatagccggaggagctgccggggtcgtggttgaaacggcgctgtaccccatcgacaccatcaagaccaggcttcaggctgctcgagctggaagtcaaatccaatggaaaggcctgtattccggactaggtggaaatcttgtcggtgttctcccggcttctgctctgtttgtgggaatatatgagccaactaaacggaagctactggacatgtttcctgaaaatttgagtgctgttgctcatcttactgcaggtgctgttggagggttgggtgcttctctcattcgtgttcccacagaggtggtcaaacaaaggatgcaaactggtcaattcaggactgcgcctgatgctgttcgtctcatagttgccaaggaaggatttagaggtctttttgctggttatggttcatttttacttcgagatcttccgtttgatgccattcaattctgcatatatgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacgaagcaatactccggaatcgtaagctgtgctaagacgatcttgagagaggaaggcccaggggcattcttgaagggcatcgagccgcgagttctgtggatcggcatcggtgggtccatcttcttcggcgtgctggagaagaccaagtcggngctcgctgagcggagcagccgc

SEQ ID NO: 19433 - DNA, 1246 bp, Triticum aestivum
  Clone ID: PAT_TA_19433
gcccccaccccctctcctccctccggctcaagcttccgttcccctccaggcctcgcgcccggtgctccgccgctcgtcagcgcctggccgaaggtttcccggcggccggcgtgcggacatgggcggcggcggcggcagggaaggggaagtgaagcccttcaatttcctccagatcctctgcgcgggggtcatggcggggggcgcggtcgagctcgtggtggccacggcgacctaccctatcgacaccatcaagcccaggcatctggctgctaaagctggaagtcaagtctgaagtaaagacctggttgctgtattggctggaaatcttctggttgtgctcccagcttgagcaattatagggaaactacacgaaaggtctcatcgaaatttactggatatttgtcttctaaacctaagtgctgttggggtgctgggtgcaggtggtattcgtgtccccggggagttcgcccaatagtggacgcaaactggtcgtttcacgacggatcctgatgcggttcgtctcgtagttgcctaatgatgttcgtctcatagttgcaaaggaaggatttagagggctttttgctggttatggttcatttttacttcgagatcttccgtttgatgccattcaattctgcatatacgagcaacttcgaattggttacaagcttatggcaaagagggagctgaaggatccagagaatgcactaattggcgcctttgccggtgcgattactggtgctataacaacccccctcgatgttctgaagacaaggttgatggttcaggggcaaacaaagcaatactctggaattgtaagctgtgctaagacgatcttgagggaggaaggtcccggcgcctttttgaagggcatcgagccgcgagttctgtggatcggcatcggcgggtccatcttcttcggcgtgctggagaagaccaagtcggtcctcgctgagaggagcagccgcaaggctgcgctggcggagaaggacgagtgaaccaaccaacccaccaagcaattgtgcatcctatgctgactcactccacatcattacccgttctttcacctgaagttttgctccaattttatgtgatgggctttgcgtatctcgttccagaactattaaggcatacaatcagtttcaagagtttgttttgatgtcggcgatgatggttataatcctgtatgagtccctgtaaacattactctcctttaataaagtttagcagattgttcttcaaaaac

SEQ ID NO: 19434 - DNA, 747 bp, Triticum aestivum
  Clone ID: PAT_TA_19434
cacgaggctacattctattacccacttgcttattatggctgtccttatgaagctgataagcatgaaaaattttataaccaggatcctttcgttgaaacttacgacatttatcgtacttcatattccccaccacctcatgtatattcagtccttcgtcgtgatggagaacgtgatctcgcgtttgtttcctatggaaatttatcccaattacagcggtacaagaacggcgattattattcaaacgctgatattccaagatcccacctaatttactatgatggtagagatcatgcattacatacaaccacacatgtttattctatatcacacctctataagtctccattttccgtacttatacaaaatttcaaggaactgtttgaatttatgtttttgcgtattttggttctccttgagacagaaattgtttcaattgggagaattattttaaaacttttaaaatttactttaaatttcatattaactgatgtcgtatttgcaatttttggtgaagaattctatacatattttattttgtttgtgtcagtatatatatattatcgtgatatattgattgcagtgtgttttatttcgtttgtgttttggttcttttatgttttaagctaaattttaagtttcattatttaaacatgaatcgtaaccaatcgaagtcgtttgtccccagtcgtcagttcacacgacaagtccctcggggaccgcgtcagaaaacattccggccggttacta

SEQ ID NO: 19435 - DNA, 641 bp, Triticum aestivum
  unsure (1)..(641): unsure at all n locations
  Clone ID: PAT_TA_19435
aaaccacaaacacatctcgcggcggcggcggcggcagaggcaggcggcggccgccgagcggcgtgggcagcgtcagccatggtgcacgtgaacttctatcgcaactatggtaagactttcaagaagccaaggcggccttatgagaaggagcgccttgatgctgagtttgaaattagtgggtgaatatggcttgaggtgcaagcgtgagctgtggcgtgttgcagtatgccctcatgccgcatccgaaatgctgcaagggagctgctccacccttgtatgagaagaacccccgtcgtacctttgagggcgaggcactccttcgccgcatgaaccgctatggccttcccggtgagggctagaacaagctcgattacgtgcttacgcttagcagttgacagattcctgcaccgccgccctcagaacacttgtctccaaaaatgcaatggcactctcccttcaccaccctctccggcgcggcaacccacgccgtgggggggaagagcaaaaccacttcccggcgctggcgtcagagcagtgatctcctccgtcaactagggcctcattgtcttccacagtcccggcttaaagactaattgtnataaacaaaatgggggcagttttccccccgaattcattaatct

SEQ ID NO: 19436 - DNA, 749 bp, Triticum aestivum
  Clone ID: PAT_TA_19436
tgatttccgatcttcaagaacaggaaactatcctgaagcagtgcatttctcaacttgaaagtgtagatgttgcaaggatatcactgctaaatcaattaaaagaagctctcattgaacaggagtcaaagtcagaaattcttcgcatccagttgcaagttgctcgagcagaggctgaacatgccattcaacttaggcaacgatttggtggtgccgttgtcgcaaatggcacaggatctagttctagtctgctaatgattaccccaacagaacaaacagctggtatgataaagggttctggagtaaggctaatgtctccccagttacagtcactgaatccagcaatctcacttgcccctacggtcagtgcagtgggagatgagcccaagagaacagcagcagcaatggcagataagctggcatctttgtcggcacctgtgcaggttctgagctccattttctcatcttttgttgctgaacatggcgcttcactatcttccatgaatagtgaatcgccttctggggaactctctggaggaccaccgggcttcaagattgaaaagaggcctaggcttgagaataccgcacatggcagtgacatgggtgcacctccctttcctgtgcaagtgccacagatgcaacaacagattggagcagtgcccacgcaactaccagcgcagatcaaccaagcaccaggtccatttgcaccacctccaccgccatttttgccaccacttctgcaacaatttggt

SEQ ID NO: 19437 - DNA, 357 bp, Triticum aestivum
  Clone ID: PAT_TA_19437
gagggtcgaggtcgaatgccgttgtcgaggtcgaatgcagcggcattgtgctcgtcgaggtcgaacgtagcgccgttgtcgaggtcgaacgcagcggcattgtgctcgtcgacgtcgaacacagcggcgtcgtctttatcttcagcgatggtctcgttaagatccaaaccagacctccaagcagccatgctaagctacaccgctaccggttttattaatcttttcctgtatctctagcgtcaaattcacgagtgtgatgtcgagaaaaatgaaaggacgtcgaacacagcggcgtcgtctttatcttcagcgatggtctcgttaagatccaaaaaaaaaaaaaaaaaaaaaaaaaaa

SEQ ID NO: 19438 - DNA, 619 bp, Triticum aestivum
  Clone ID: PAT_TA_19438
tactgtagtatggagttaacagctgatgatggtttgtcaaaagggaacaagatgaaaaggagggagaaaagaggagagcaaaaggggaaaaacttgagtcataaatgaatggatgaatggagatttcacctgaaaagtgttgaattgctcacataaaccatttttcaagctgaatctgaacaaaatctgagttaactaacagaatcatcagttgttaatgtttttttgctgtttttaaaattagtttcgattcgtctttgatgatctaatttcaataaccatcaaaatgaacattgaaatttatctttttgtgctgcttcttttaatgatgtgattaagaaatgaaaaattaaatacggaattttcgtttcaaatgagtttatgaaaaaaatgtaataaattattaggacacaagctcggcaatatttgtttgagtatttttttgagagtcaagataattaaatagatcaatcttgttgaactgtttggtcttgttgaacgacttgaggttcctgaacaacttgttgttcattttgttgaacagtgacatccttttgttgactgatttttcgtttgtaaaaaggaacacctttcactggtgaaccaacttttcccatgt

SEQ ID NO: 19439 - DNA, 1256 bp, Triticum aestivum
  Clone ID: PAT_TA_19439
tttgctcatcatccttccccccaccgcgttcgagctataactttggtctcaaagacaatcttcatacttgtcgatccaaaccaacacacggatgtttagctagtaaaaataaattgtgaaaacaacatcattatatgctcaacatcatcgtacactgattatatagtgcccatataaataacagaaacctgatacccaacatatatctcagttatgaccaggtctcaatgataaacttgccattctttttcagacccgtcacccattgcgaaacatcattttttggaacaccaccctgctgacataaaacttcttccaatgcagccgtaacatcagcaggcattctggtagaagacccagcaacgtatattgtagcctcagaggagcataacatgttcaacactcttgcaccctgctccctaattttatcttgtacatagaccttttgaggttgatccctagaaaacgcaacaaataaaccaccacccttttctagggaaagcaccccctggtcctgggcatgatttaaccagaagtccttgtacagaaaatcattatcttgatttctacagccaaagaagaatagaacaggagcagttggttctgtcacactctgtgcagccctttcctccacaaacgcacggaatggtgcgcatcctgttcctggtccaataagcacaagaggaactgatggctttggatgaggcagggatcctcggtatatccaacacggtataatactctcttcatttggagagagccccgctagccatgtagagcagagaccatgtcgtgtcctctttaaaggagtacgccatgatacaatactaacagtcaagtgtatctgatttggatggactaatggggatgacgaaatggaaaatgctcttctttttaaaggcggtgtcagttgcaccaaccattcaaaaggcatgtgcaccgaggaaaactcctgcaaaacttccaaaacagtccggttctccttctgattgtaccagtaaaggtcgtctcttccttcaggagaagttaaatactgaagttttgccttttgatcggcatctggcgcgagaccgctcttgctgccccagtggttctcccatctccgtcccctccgccttttgtcgctgtcatcatgagctatttcgcaacagataccgatcaaaaggaaaaacttcagtatttaacttctcctgaaggaagagacgacctttactggtacaatcagaaggagaaccggactgttttggaagttttgc

SEQ ID NO: 19440 - DNA, 535 bp, Triticum aestivum
  Clone ID: PAT_TA_19440
cttggcttctattattttatacacccctgtcaaaaggtcaatttgtgctagagagtgtcatgcaggatgtggtccattcactggatggtgctctgagggctggtaaggtcaactgtgacaatgaaaaaactctttgcaaaaggtctggtgtttctatagggaaattggcccgcctcttcatctattcatatgctactacagaaaaagggtctttgcatgagtattctggagaacatgatgctaacagcttgaacacattttgtcaagagcacctgccaagattctccaaacgggtagatattggccaattcagcttccctttaaatgttctaccaaaccttcctcaagtgctcttactatcgagtaagaaggacacaccagcaatgtggcgtgctatcagtgggatgttccgcaatcgattaattttttatgatgctgaggttcatgatgtttctcatccgctgctcaaaagtcttggtgtgaagaatcttccagctgtaattggccgaaccgtcaatggtgaggagctccttct

SEQ ID NO: 19441 - DNA, 590 bp, Triticum aestivum
  Clone ID: PAT_TA_19441
ttcgagcggccgcccgggcaggtaccatcatcagtatataagtcgcgtgggattgatcaccttcttattcctacaagagattatatgtttgctccctcacttgtggatattagtcgagctgttgatttcattcatagaaacgcatctcgtgggaggatgacatacatccactgcaaagctgggaggggccggagtacctcggccgcctcctcgcttctggtgaaatacaagaatatgacgccttctacagcttttgagcatgtgcggtctaaaagggctcgagtgttgctgactcgttctcaatggagggtggttcaagatttcagcaagaagaatgcagaagcagaacttcccacagtcacaagccactcagcagcagcatctccagcagggaatgtggtatcggtaacagaagcagatttggagagctctgaagtaacagcagctaatattcctgatattacagagcatgccagcttgtcttctcacaagactaccccaaccaagccaatgacaaatatgctctcatgtttgattccatctctgaagtgactcctctctagctgagcatcaataatccaagactctga

SEQ ID NO: 19442 - DNA, 802 bp, Triticum aestivum
  Clone ID: PAT_TA_19442
ttttttttttttttttttgcagcgaataagagggttcaacttagaccaccaggacgagcaccatctataaatactagggtactatgggctcgtccaatgcatatataaaagaaaagcatttaagctccactaggaaacctatggatacattgccttttcctcccagttgttacttcagacgaccagctgcaaaggcattagcagttctcagagtcaagggaagaggcggataggctgccaggtgtctccctagcagtagagcccctttccattgaattagcaaggctgtcctcggaccttgaattcagggtgcccggattcatcctctggacctcctcccttgtgtagatgaagatcttgtggaccatgttgcagaactcattccagggatcatccccaaccagcatcatatcaccttcattgtcggtgtacacaaccatccattccttgttagaacctttcagctccccattgaagtcaaacatctcatccagctcagcaatcaattccgtgtagccattgaactttgtaagatccacagacctgccaagtgcgattccttgcttgtggaccttcttgcagctcctagttgatccaccttgtgatttgcactgtgtgcctcttgaaacttgtgaacatttctctggaacaggatctacctgtgtagcatcgagttgctttggcatcttaagtggatcagaacatctgtctgcttcaattgaatcaaccatccgccattcagctgctgctggagtttgtggcatcccatcataggcaacacttggtggagattcaaaggtca

SEQ ID NO: 19443 - DNA, 600 bp, Triticum aestivum
  Clone ID: PAT_TA_19443
agagagtccacagcacggcttacagagtccacggcacggcttgtttaccaccaaccatccggcccttccccgaccatggcggcggcaccccctcgctggtggccgctcctcctgcagctcgcaatcgcccttggcatcctgctcgcggcggccgaggcttggacgggggagatccgcggccgcgtcgtctgcgacgtctgcggcgacgcagccatcggcccggaggaccacgccctcgaaggtgcggaggttgctgtcctctgcatcacaaaatctggtgaggttatcaactaccaagccttcacaaactccaagggcgtgtatactgtcgccgagactatgccggagagcgacaggtgggactcgtgcttggcgaggcctatcagcagcttccatctgcattgcacacggcggggtgatgctcactctggggtgaagttcacttacaacaaaccgtctgggaactcgcacaccgtcaagcctttcctctacaagccggccaccgcccctctgtattgtagctaaacagctccctcgctggttcctggagggcgaacttcaggaacatatctgggtcgggcccggtcttccgcttatata

SEQ ID NO: 19444 - DNA, 393 bp, Triticum aestivum
  unsure (1)..(393): unsure at all n locations
  Clone ID: PAT_TA_19444
atccccgccgccaatccggtagctgaggaatcctgggtcctccccagcgaaattcgtggcggacctgatctcagctcgaagatctgtagtagcgctctctgtatctcccgccgccgcgcgttgaaatccatggttgttcttcgagctccggctcttgaagcattctgatttggaaatcgcttctttcttgagtcataggaatcagctgttccgcaaagattgcgctttttctttctgttggattcttccattagagcggcggcctctccggagatgacgaccggggccgtcacggagagcttcccggagagcagcgagccgctgctcccgacgaagcggcgatgggagggggagcgcggcggcnacnacnaggccgncttccacgagttcaac

SEQ ID NO: 19445 - DNA, 761 bp, Triticum aestivum
  Clone ID: PAT_TA_19445
gaggctcgatagagaagagaggataacagatttgcccttagacaatggtgtccgtgcactgctgaggggctgcacgaaacttcggaggtttgctctatacttgagaccagggggactttcagatacaggccttggctatattggacagtacagtggaattatccaatacatgcttctgggtaatgttggggaaacagatgatggtctgatccggtttgcattggggtgtgagcacctgcggaagctttaactcaggagttgttgcttcagcgagcgagctctggccctcgccatactacgcatgccttccctgaggtacgtatgggttcagggctacaaagcgtctcaaaccggccgagacctcatgctcatggcgaggcccttctggaacatagagtttacacctcccagttccgagaacgcaggtcggttgatggaagatggggaaccttgtgtagatagtcatgctcagatactcgcataccactccctcgccggtaagaggttggactgcccacaatccgtggtccctttgtatcctgcctgagtgtaaatagactaagctggtgtttttctccctcatccctgcttccttagcctcctggtcaacaagaacgatgttgatgacttgatatctggttctcgtgtgggcctgctgcgctggcccctacgtaccgtctggtgcctctggtggccgggatgtcccgcttctagcccccgctcttctcccctctaatcctaaaaacaaagaaaaaaaaaaa

SEQ ID NO: 19446 - DNA, 527 bp, Triticum aestivum
  Clone ID: PAT_TA_19446
ggcacgaggctcgcgcttctttgtcctctgtctcccttgctccatagcaggaacgcccgaggcgaccgcatctccaagatggtgctgcagaacgacatcgacctgctcaacccgccggcagagcttgagaagttaaagcacaagaaaaagcgcctcgtccagtctcccaactctttcttcatggatgtcaagtgccagggctgtttcagcataaccactgtgttcagccactcccagactgtggttgtgtgccctggctgccaaactgttctctgccaacctactggtgggaaggctaggctcaccgagggttgctccttccgccgcaagggtgattagatcctgctggttctttagagaagagagaattttgctgttttgctaccttacatatgtactcgttgaggattttcttaattatggctgcttagcatgccctgttaatgcttgtgtaaaagtgcacttctgctaaggggcccgttggtttagctgagaaaaaaaaaaaaaaaaaaaaaaaaaaaaaaaaa

SEQ ID NO: 19447 - DNA, 830 bp, Triticum aestivum
  Clone ID: PAT_TA_19447
gcacgaggccaaggggaaagcagggccaccgttagcgcctcctctccccgctccgatccggatctccccatccattccggcgagccctcgccgcgtcgcttccacgcgaccctacttccttaataaattcaacctccccgccgctgctcccgtcaaaccccgaatactatcggactacttcctcccctgcccgcgccgcctcccgagcccgacaaaccctaggcgacgcccatggacttcgaggccgacggccgcttcggcaacaagcgcgtgcacaaccgcctcggaccggcgcccggcgccgcctcttcgtcttcctctaccaaggtctgcatccattggcgcgctgggcgatgcaatcgcttcccctgccccttcctccacagcgagctccctgaggcggccaccaccaagcgcccgaaccaaagggatggccctggtgggcacgtctggcgcaaccccaactcaggaggagggggccgcggtggcggcggcggcttcaacaaatgggggaggggccccggaggtgcagacggtggcgtcaggcacaaggtgcccgaccggccctgcaagttcttcctcgccggagactgcacctacggcgagaagtgccgctacccgcacacatattgcatgagcaatagcatcacgctgctcacccctctccagggccacgagaaggttgtgacagggatcgcactgcctactgggtcagacaagctgtattctggcagtaaggatggaacagtgcgcctttgggattgtcaaactggacagtgtgctggtgtcctccccgtggggggtgaggttgggtgcatgatcagcgaggg

SEQ ID NO: 19448 - DNA, 670 bp, Triticum aestivum
  Clone ID: PAT_TA_19448
gcgaatccagcggcagaagcagcagcagcagctcagccgccgccgatggcgtccacgatcatggccccaacctcccgcgtcctcgccgccaagacccccttcctcggccatccccgcccctccaatgcccccgtccgcgacatcgccgccgccgccaccggccgcatcaccatgagcaaggagctgtggtacgggccggatagggtgaagtacctggggccattctcggcgcagacgccgtcgtacctgaggggcgagttcccgggcgactacgggtgggacacggcggggtctccgcggacccggaggcgttcgcgaggaacagggcgctggaggtgatccacggccggtgggcgatctcggcgcgctgggctgcatcacgccggaggtgctccgagaatgggtgcgcgtcgacttcaagacccccgtggggttcagcgccgccgccctgatcgtcgccgcccgcggcctcgacccccccggctgcccccacccggcgcccgccctgggcccccgccccctgcggcgcttccaggtccgccccacgcgccccgtcgggggcggccgctccaccggcccccccggccccggcgccggcaccgtcctcgcccccggcggccagtacttcgacccgctcggcctcgccgacgacccccgtcaccttcgccga

SEQ ID NO: 19449 - DNA, 235 bp, Triticum aestivum
  Clone ID: PAT_TA_19449
atccgaacattttacttaattggcttttgcagaagtcatcgttgagcagcgcctttggacgtgcaacaagactgggagctttagctgggtcgtataggctggattctgttctaagtgccacagtgtgcatcacctttactgccttcaatgggtacttcccgtgggcagtttcaccagatagcataatggcatcagcagcttcccgaacagcaatggctatagttctagatcgcga

SEQ ID NO: 19450 - DNA, 810 bp, Triticum aestivum
  Clone ID: PAT_TA_19450
tcgtttttttttgccacgttggaggagtagcacaataaaaaattcagtgttaaccagcaaaaaagcccacccagcctcaaacgcccacgttggagcagtagcagcagcacagagccggagccctccagccgtccgatcgtccgacacagacagatccgatggccctcgctctctccggctccgctgctgcccgcgcgctcgcccagcggctggccccagccaccgccaggggctacgcggcggcggcctcctccggggcgatgaggcgcggcgccgcggcgaccgcggacggaaaggcggccagggaggctgagaaggccgcggccgacgcctcgtgggtgcccgaccccgtcaccggccactaccgccccgccaaccgcgccgccggcgccgaccccgccgacctccgcgccgcgcacctcggacagacctacgcacgggcttgaagccccgctcgacgaccctcctggccccgccatggaaggaaaactgctatgctaggtaacgagggaagaggcaggcggcgctcgttcgccgagcgctgcgcgcgacgcggcttaacgacggatcatcatcatgatcgatcctatactactggggaggtgcgggttggatgtttcccattgtgtgcgtgcgttcgtctgggcttggatgccctgctatagtgttggtgtgctcagatcagatgtatctctcgtcgagcagggcttgtaccttttacttttatttacagctagtaataataacgaaagaatccagcgttttctttgttctaaaaaaaaaaaaaaggaaacgacgcgtggggcgacc

SEQ ID NO: 19451 - DNA, 752 bp, Triticum aestivum
  Clone ID: PAT_TA_19451
tctgcaggatgcgattcggaaggcggggctgcagtgggagggccgcctccactgtggtctggatgatgctctaaacaccgctcacctcctcgtcgagctcatgcgccggggaacccttctcaagatcaccggctctttggagccaaagcggtcacctcctcgccctgaacctaaggcggcgctgtcatgtgttggcccacgctcggtggtgccgacgctacctcctcagcctcaggtgccgctgccatgtgccgtacccaccgggatggacacagtgccctgctgcttctgtggtgtggccagcaagctaggcgtggtggccacgccgggccagatgcaggggcattacttctacggatgcggctggtggactccgacatgttctttcttcatgtgggcaatataactgcctgcagtctgcacatatgaattggagtagctgcgcgccaggttcacaagttcatcctctgttccatccctttactgctaactgttctccagtttttgcttagtttcccatgcaggtcaatctattctggacattgctaaggtggaaccggcttaaatacttcagcgacggcaggccaagaaaggaaattcagggattccacaagtctttgtgtgatggacatgatgcaacaaaatgggaggctactttcttctgaagaagacactttcacaagcgcttgattggagtccagcaagttctggaagcgtggatgatgtcacagctgcaactacgtctcaagctg

SEQ ID NO: 19452 - DNA, 734 bp, Triticum aestivum
  Clone ID: PAT_TA_19452
gaggcaatctctctctctctctctcaccaaacccatccacaaattaactggcacaacacaggggaggtaggccggtatatggcgccatcacggcgtaggaacaactcctccctgttcgagtccgccaccatcatcacggcgaacctcatcatggcctcctcgtcgttcctcctatcgaggatcgcaccccgtgtggcaaccgcatcgccgccgccaccgccgacgatggtagcgaccagcagggctccgacatggtcttcggcggcaacatccacccgttctgtggagcccatggccgggtgcaagacgatcctcatgaagcccgtcgatgggcaggatggcaaagtagaccaacgagcggaaatgttcatcaggagtttccgggagaggacactgtcggagacagctcacttcgaaacagctaatgcaggagctcgcccgcagccgcaagcgcgcagatgcccacgttagaggtgcaggatatctctagatgtaagcatttgaggagccatgtgggctgtttcttgcaaaactgctggctagctagtcctccgaaccaggttcaggaaatcatatggatttgtgtcgtaaacggtttacttctaacagaataagatcatcacatcctgtataaataaaaggtcacgacagattacgggtatgtaatcaatcaaaatgaattatcatctaccttttcatatatcttaaagccttgcttttccatccataaaaaa

SEQ ID NO: 19453 - DNA, 589 bp, Triticum aestivum
  Clone ID: PAT_TA_19453
gcctcgctcctcctccttccgcgccgccgccctcccgcggggggcgcccgcccgtccccttggccgccgccgagctcgcctgcagcctccccgcactccgcctccgcgtccgccgcccccccctccacccccggcggcttcccccgctccgccgggcggcccgcctccagctcggaggccggccggccgcaagtcctcgccccgccccggcggggagcgccacctaagcgccccgcatcatccccgttgtttgaggtggtagtcctccccctggggctgcggtggctgccgctggtccagttggctgctctccgcccccagctggcggtgctgcagctgctggtgcccctgctggcagcggggtggcagcatgggcccaagccggttcctctgaacaacccgggcttcagcctgttcgaccgagtccgccgccacacaccccttagttaattcccttatgctgttcaaaactttttttacgttatgtcggatggtgtgcgttatctaaagcactcaggtttagatcaaaaaacaatacgcttagacgatcccatgatgctcacaaaaaaaaaaaaaaaaaaaaaaaaac

SEQ ID NO: 19454 - DNA, 734 bp, Triticum aestivum
  Clone ID: PAT_TA_19454
atatgcaggggtaggaagccggcggcggcgacggcgaagaaggggcagaagcggccgcgacagccgcggttcgcgttcatgacaaagagcgagatcgatcacctcgaggacggctacagatggaggaagtatggccagaaagctgtcaagaacagccctttcccaaggagttactacagatgcaccaacagcaaatgcacggtgaagaagcgcgtggagcggtcctccaccgatccctccgtggtcatcaccacctacgagggccagcactgccaccacattggtccattccaacgcggcggcggcggcggcggcggaggcgcagccacggcgcgctaccacagcgcggcggccgtggcactagcggagcaaatgtcttcatcgtcgtcgttcatcccagcgcggcagctctacagcttgccgccgttgcacccaccacagagctccctgtcctcagaagccgtcgttagctcggcggcgactacatcttttcatcagcatgttaacgacggcgacgagctgcggcaggctagctacagctcgagggtgtccatggcgcagtcgccatcaactccatcgtcggtgcctccggccatttcagttgagaaggccgggctactggacgatatggtgccccatggtgtgaggcatggaacaccatgatgatgccaatatgcatggctctctcttgtctccgcccgccggtcggcacctcccgcaggtcgggactacca

SEQ ID NO: 19455 - DNA, 504 bp, Triticum aestivum
  Clone ID: PAT_TA_19455
gaagggtgaaccgagattagcggtggcggcgatggcactcccggcgtcgagctccggcctcttccgattcgtctccccgcgcagccgcccccagtccaccgacatcgtggccgccgcctcctggggagtcttcgccggcaccgccggcctctacctcgtccagccatttgactggattaagaaaactttctttgagaaacctgaaccagaggcatgattctccaggcataaaaggctgcaagtctgcaactgcaactttgatacaccacttttgtccgggatgattcctgattgaagagaacttgtataactcagcaaataatatgagaccccctcatgtttccttgtttgattttattcagatgtaggcattcctcttgcatgtaatcctcacgaggggagtgatcatttgacttgtttttcatcacacagaaactgcttggttcaactgtgttatatgatcttgatggcatttctaaaaaaagaaaaaaaaaagcacaaaac

SEQ ID NO: 19456 - DNA, 786 bp, Triticum aestivum
  unsure (1)..(786): unsure at all n locations
  Clone ID: PAT_TA_19456
gannnnnnttatncctttantcccttgctcgacttaaccctcactaaagggaacaaaagctggagctccaccgcggtggcggccgctctagaactagtggatcccccgggctgcaggaagtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttgggtgcagaccagcctgttattctgcatatgctggatattgaatttgctgctgaagctcttaaaggcgtcaagatggagttgatcgatgccgcatttccacttctcaagggagttgttgcaacaactgatgtttgttgaggcttgcactggtgtgaatgttgcggttatggttggtgggattccccaaggaaggaaggaatggaaaggaaggatgttatgacgaaaaatgtttcaatctacaaagctcaagcatctgctcttgaagctcatgcagcccccaattgcaaggttttggttgttgccaacccagcaaacacaatgctctcatcctgaaggagttgcccaatctaccctgagaagaacacaattgtttgaccgcctaaacacacaaggaatcggtcatctccaaaaacggggtcaagttccacttaagatcctatcggggaaaccccccttcccacccacggcacatcacgtaaanccatggaaacccgtctaatttcaaaaaag

SEQ ID NO: 19457 - DNA, 543 bp, Triticum aestivum
  unsure (1)..(543): unsure at all n locations
  Clone ID: PAT_TA_19457
gcacgactagcggaataatatccaccggcgacgggaacgggaggcggcgcggccggcgattcgaagcgatggcgttcacgatgcgggcggtgaaggtgcctccgaactcggcctcgctggaggaggcccggcaccgcgtcttcgatttcttcaagcaggcatgccgctccatccccaccgtcatggagatctacaacctcgacgacgtcgtcacgccctcgcagctccgctccaccatcgctaaggagattccgttaaaaaccagaacgtcaccaaccccaaggtgattgatatgcttctgtttcaacgccaanggaggagcctgaacaacatagtcnaacatgcaaagcancgccatcaagttaattgggcatatgttatttnggcaaaaaggcctggtgcaacaacttgggtcnaagntttaaggactctactttctgaagaattctacacaacaatacttccgttcgtgttgcaattnaaacaccnggnnaccccggtggnccctnataagacacctgagactatcaggacnattgttcc

SEQ ID NO: 19458 - DNA, 787 bp, Triticum aestivum
  Clone ID: PAT_TA_19458
atagagtctttgaggtttgcctagctgatcttcagggtgacgaggatcaggcttaccggaaaatcaggcttcgtgctgaagatgtgcaaggcaggaatgtgctcacaaacttttggggaatgtcatttactactgataaactcagatccctggtcaagaagtggcagacactcattgaagcccatgttgatgtcaaaacaactgacaactacatgctgcgcttgttctgcattggcttcaccaagaggcgtccaaaccaggtgaagagaacctgctatgcccaggcttcccagatccgccagatccgccgcaaggtggttgagattatggccaaccaggcttctacatgtgacctgaaagagcttgtttctaagttcattccggaagttattggcaaagagattgagaagtccacctccagcatcttcccactccaaaacgtcttcatccgcaaggtgaagatactcaaggcccccaagtttgatctcgggaagctcatggaggttcatggcgactacaaggaggacgtgggggtgaagcttgagaggcctgtcgagggtgatgaggctatgcaggaggttgctgctgccgagtagtttatttgctacttctttatctagacgaatctggacaggaggtcccttatgacgcgaacttcataaaattgtctggcgacatgttttcttctgtccctgccctaaactctaaacccaaaggttattcgtaacaagtgttttaagattatttttgtttatgtttgggttcgagtacctcgagactagttctc

SEQ ID NO: 19459 - DNA, 888 bp, Triticum aestivum
  Clone ID: PAT_TA_19459
caatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaggggagcctggtgaccgggtgcagtttacggagttcatacagaagaacctccacctgtaccagttccgcaacaccatcccgctgtcaaccgccgctgccgccaacttcacacgcggcgagctcgccacagcccttcgtaagaatccatacatggtcaatgttattctcggtggttacgataaggatgttggccgcctcactgtactacatcgactacattgcaaccttgcacaagatcgacaagggcgcttttgggtacggatcctatttctgcctgtctctgatggacaagctgtaccgcccggacatgaccgttgaggaagcggtagatctcgttgacaagtgcattaaggagtcgccgctgcggctggggcgcccgcccctcggcttcgtggtcacaagggccggcagggtcccggcgagggagtacgcaaggcgtgaactcgtcggcgacaatgcacctgttgatgctgcaatcacagttgctgcctgaggcatgaacttgttggaagttagactgtgttaattgtgttttctcagcgaggctacttatgtaatcacaggatactggtgggggtcccacaactgttttatcaatttgagcccagacgtgtgtatttctgtttctgcactattcatgtctttgctgagtacaagtttacaactagtgtttaacgcttgacaatgctgcatgtgcaccatttatgataactgaaat

SEQ ID NO: 19460 - DNA, 625 bp, Triticum aestivum
  Clone ID: PAT_TA_19460
ggtctggatgcacaacaacaagcacaacttcctgggcggccacagcgcccgccgcagcgcctcagcctccgcctccgcaggcgcctgcgcgccgctccaaaccccaggcggcgctgctgcaccgtcgtcattcaacccgtccaggatcacccctccgcctcccgtcctcacctcttccccgaccagcgccacaggcttcaacatcaacggcgccgcctcctcggcgcccaccgtcgtcaccgccgaccacacggacaacgccgccaacggagcttcatcgccgcagtccgcttaaactactagagaagagagggaatggagaatggagagagaaacatgtagcttaatttcagtgatctgatcactcgttttcattttttttttctttagactttccatctgctaagaaattaaccccaagaaagcatgccgccatgcgccatgcctagaaatccaagcttcctcctactgtagtaccgtgtatgcctcttgggatccgatgatgatgttgatgctgattttaggattagattatctcatcccatcccaaccaaaaagaggtactactagtagtagccagccgttcttggttgttgttcttgtcctctctttgattgagctaaaa

SEQ ID NO: 19461 - DNA, 796 bp, Triticum aestivum
  Clone ID: PAT_TA_19461
ttcgcagcactcattattgaaggacctcaactagtgcagcatggatttaaagatgcaattgccaaagttggattagcaaaattagtttccaatattttcttggcaggcttgttctatcacctttataaccaggttgcaacaaacacattgcagcgagtggcccctctaacacatgccgtcggcaacgtgttgaaacgtgtctttgtcatcggcttctcaatcatcattttcggcaacaagatcaccacacaaactggaattggcacagccattgctatttctggtgttgccctatactcagttatcaaggctaagattgaggagaaaaaggaaggtgtggcggcggcggctccttgaagatggaataaggtcctctccgcctagcccccgtcctgacagtgcgtcttgcgttgttggagggcatgtggatgtgtgtcttcggcggactgcttgggattcagtcggtattggtctttgctgaatctccgttgatccagtgtttgtccgtgtgtgtacaagttgtaccttccgatctgtggttctcttcatcgtcgatggttgatgttctggtgccttggtcgtgtggggtcttagcatagcatgatgacttcccgactatatttagtacaacaagttttgcccggcccgttgagggagaggcgatgacagaggtgtgctttcggctcactccagtgctttagtcggcgctaggttgtctatgaaactagatgtaatttttattatttttagtgttctttgtactgccatgatagataatgcatagatcccttttttt

SEQ ID NO: 19462 - DNA, 810 bp, Triticum aestivum
  Clone ID: PAT_TA_19462
aatcctagtggttctgtgaatccgagtgacaattatgcacaacggccacgtgagaccgtatctatgtcattaaaggaaattatgcatagcactgaccggtctggggaaaggactgtggagagaccacgtacatcctcacgtacaggcagtgcatcccgtagagctgttgcatcaagcagcaggccagcctcatctgtggaaccaagtgagcagtataaccggacaagcagattgttctctagcaacagtggcagtcgtccatctagcacccagagagttaatccatcgcctggcgagtcaagggctacctccctttcacgggctgcagttgcgagaggctcccgcgacgagccactccaccgcagcctggagcttctgtccctcggtggtggtaaaaggaaatagtgggaaggaagaaagcgggcatccgagagaagggaagaatgcttgtttgcgactctgtaaatgacagaatatcacctattcgtcaacagttcccctggggcatcccataatttcatagtgctccggtctgttgtaccattgcttcatagatagcaataattcgttgttaaatgtgtgcgtgttgcagctgttgttgttgcgttagggccaagtcctagcctttgtgatgattaaatttaggggtggtcaagattcacatatttatgtttcttcacccctctcctggacttggcgacttttcctcccgagactagtgctcgtgcatttcatgttgaactctgaatttgcttattcaacagaagttgataaaaaagagacttcctgtgtaaaaaaaaaaaaaaaaaa

SEQ ID NO: 19463 - DNA, 306 bp, Triticum aestivum
  Clone ID: PAT_TA_19463
cgaggcataaatgtaacaggcaaacttttcaagaccagtgcaatctaaattaggatcaacgtttttagtctttgatcacagcaagttgtctttgaaagataaggccgggctcaatagggaaaagagaagagccttcttatattttggtagataaacaattggaaattttggtgtgttctgcttgttacttttacagtaaaatgatttgcatggtgaaatgccgttttgtaatctgaataataatgtacagttgttttggtttaattaatagatgtaaatttgtctaaaaaaaaaaaaaaaaaaaaa

SEQ ID NO: 19464 - DNA, 641 bp, Triticum aestivum
  Clone ID: PAT_TA_19464
ggccccggctcaccctgaccgccgccgctcaccactcacctcgcctccccatcttctgccagctcccatcccgccgcaagaaacgcctgtgccggcgtgtcgccgccgccggcgccctagcccctaggccagtgcccaggtccccatcttctggcccttcgccggcgacgacccccaataggtctgaaggatgaggaagggactgcatcctcagatgcaatggatttcatatgtgacgcagagtggtaggctgatcaatatcatgatgaccaaggtgaaccatactggcaaagtgtaccacatgagggccaagcgacaaatggctcaaagcctcggtcagattgcaaagttcaaacgtcgatatgagcaggaaacagaggaaagcaaagacaagtaggatggtgttgagaaggaggagctgtagcctctgtaaccttagtcagttctgctgactgcaaagttctcagttaaggaactttgatcacatgattttattttagatcacaacatcatcttttgttccacttcagaattgagctgtacccccatcttgagcaagctatggcacttgttgcaccttaaagccccaagaaaatagtctatcgattgctttttcccaaaaaaaaaaaaaaaaaaaaaaa

SEQ ID NO: 19465 - DNA, 735 bp, Triticum aestivum
  Clone ID: PAT_TA_19465
atgttttctcgaaaactttcttctactgcattgtttaaaccacattttctaagctatttttaagtttatttcttaaaatgtttagtttatccatataatcaattagataatctgtgaaaacaatatgcaatgccaaatgtaaaattgtaacagatctgtgactataaactcaagagtcccaatctgaatctgtccccctcaatggaaagattgtgtcatgacattgcaaaatcttaagcaatataccagttctttaaactgccttggttttttagaagttatatttcagagaggtgctcctatgcaccttctttcagatttgcacaaatgttatgttattacgattctgcttaagtcataatacttctgccgcagaaggttatgagacataaattacatacttttttttgttccatgtttgctgaaccactttttttttcccttgcccagtctagagacagttattcagacatgcttgaaggaggcaacttttccaaccaggagaccttgtacgaagttctatccgtgaggaaagatgctacatatgatgaaattcgtgcagcatataagtctgctgtactaaatacacatcctgacaaagcacagatggctctcaatccattggtgtcttccagtgagcgaaatgaatttctcagtgtgcaaaaggcatgggaaatcctacgttatcccaaatctagagcagaatatgataagcaactgcaatcttcccgacag

SEQ ID NO: 19466 - DNA, 626 bp, Triticum aestivum
  unsure (1)..(626): unsure at all n locations
  Clone ID: PAT_TA_19466
ctcgtgccgaattcggcagaggggaggctgtttatccatttgtatcctcgacggcgcgagagttttgcctgcgaccgacgacgatggccaccgtcgcggcgaccatggcggcgccgacgcgccaccgccagttccgcgtgcgcgccgcctgggacatgaatccgggcgccgccaccgtcgccgtgccgaagccttcaaaggccaagcccaagcccgccctggggcagtcgccggcgacggcgaccaccccggcgcgcgcgccccctgccacgcacgccgactcttcgcgcgcagcagcgagggccaagcaaagaagagcacatacatggggtttgagaagtggtggttgcccgcccgcgccggaagtgaagaagccccgttcactctacaacgcggatccctggatacttggggggatgcatatatgaaccctatgctccggaacactcttttttttctactgtgcatcaatgaatacaataacgtgtgatggngtntgaaagtggancaaagatctgctgctgacaaatctgggagagatttcaacngaanaagaaaggantactcgttgggaaggacatgtntaacaaaatctnnagaaacggaagaattnatgnaatcacann

SEQ ID NO: 19467 - DNA, 624 bp, Triticum aestivum
  unsure (1)..(624): unsure at all n locations
  Clone ID: PAT_TA_19467
cccacgcgtccggaagcatcgtgatgaagaggggaaggcgaaggataaattgaagcgtcgcacagatgaaaaggcaactgaggctgattcggtcgcagaaaaaggtaagcaggaggctgtggtaggcgttgcggaggagaaagaaggccacaagcgcaagaaagggaaccgccgcagtgaggagacgaagagcaaggagaatgttccagtcgtttcaggtagcatagagaacggtgttggtgaggagcacgccaagaagtcgggctcgatggcgctgaagccttgttcggagggtgccatgaacaaagacaatgtgaagaaagacaagaagagaaggaaggaggagaagaagaaagagaaagaagctgacatgaccgagcagaagcagagttttgatactactgttggtaaggagcaagctgaaacttctggcttgatggcggtaatgccctgtttggagcgtgcccagggtgatatgagcaaagacaaggtgaagaaagtcaagaagaaaaagaaggaagagaaagaagctgagaagactgggcagcagaagcagacatttgatactactnnngaaaattcnnnngcagagtatgcagagggagacnnnnnngnnnnnaaaca

SEQ ID NO: 19468 - DNA, 738 bp, Triticum aestivum
  Clone ID: PAT_TA_19468
ccgccgcagccatccgcttcttctcttcggttcagctctcgagtttccaggatgaaggtaatagctgcctacctgcttgctgttctgggtggaaacacttccccgactgctgatgatgttaagagcattctggaatcagttggtgctgaagctgatgaagaaaaactagagtcctgctcacagaactcaaaagacaaggacataacagaagtgattgcagctggaagggaaaggtacctctgtgccttcaggtgggtggtgcaatttgacatggggactcccagcactgtagctgggcggtgggcgcaacacctgctgaagagccaaagaaggaggagaaggtttaagagaaggaagagcctgatgaagatatggtttcaacttgttccattaaaacaccactgccagtttacatttccccccgcgaatggccccataatatcggccggtgtccacaaaataacactgtcaataccccattcatacgtctcccatgttatgtccaatgcacccccaaacaccttattcaggagccctaaaataggatgcacccagtagatgactgccgactatgtacaaccgcctccgtctcgtacgggccttgatgtacgtacacctcggtatgcatcaaaaagaggcgccggtccattcccatcggcctttcccccggcgcgcttggaccccgcaccagatgcatgattttttgacgtatttaaaaaaaaaaaaaaaaaaaaaaaa

SEQ ID NO: 19469 - DNA, 685 bp, Triticum aestivum
  Clone ID: PAT_TA_19469
gtacactggtactgtacaaaaattaccaacgaaatcaaatacagattcaaatatcatgagatgctctcaggttccaagattcaagtacctaccaatcagtgccccagctatatcatcaagatcacacaaatcatcactacagtcgccgtctagcgactccacatctaaaagtccttggaaatcctattcaaatggagatagatctactacaccagagtttgatgataatgcaagtcttgtcggtgctgctccattgcttaagtcatttgttactcaggtggggagcaaatttggggagaacacatcgagatgggggtccatgctctctgacgggcaggttggtaagctaagtgacatccttccgggaccagcagctgggtttttctcttctttcacatctggaactcgatatgattcatagtaatggcaccatgacccttgatctttagcccttactacacgtcatacggaaacccacatgtgtcatcaagagagcaaaagaactgttggcaagtgtaatatgcctttggaaatctgctgctcacagaatgatgccacattgctggtccagtgttgcttggcatatcctgccgcgcctctgcacatcttattgtgactagacagtgtcatggagaagctcaggaaattatgatggagaagacgagatttattctatatcggctgc

SEQ ID NO: 19470 - DNA, 407 bp, Triticum aestivum
  Clone ID: PAT_TA_19470
cggacgcgtgggcaagtggtagatttcatcgaccaagtacatagctgcacctgcacgaaggccaattgattgactggcggccatcttggaaaacatctgcccgcaaagtgtatatataagaatcaatggagtggagccaaggatctcagcagggaaaaatattgtcagacgctcagacacctccagttccttcaggattgccattggttggcaagggtgaaaaatcggatgtaacgtcgttatgcataatagcattcaggttcacactctggagcagtgttggcaatttactagtggtatttcattatgatggatccagcaaagacacaacgctttacatcaagctcaatcatcatactggtgatagccatgggaaagttactccaggatcttctaacatcgacgag

SEQ ID NO: 19471 - DNA, 1199 bp, Triticum aestivum
  unsure (1)..(1199): unsure at all n locations
  Clone ID: PAT_TA_19471
atgcgacgcaactaaagcttacttcacctagatcagctcgatcgctgtcgtgagattgcacgaccggtatgcgctgcgctggtctgctggtgtgccggccttcctagcatgatagattgggctgctgcgcgcgcagtcgccgagctgattggggcgagtccgcacggtgcgaggagctagcggacggcttggcggtctctaccaccaccacggcggcggcggcggccatgcggatcccgcggcggaaggccggggtgcccgatcggcgtgcccacgcgcccccccacgcgcccgcaccacccgtgcatcgacagctaacaagtggtagatttcatcgaccaagtacatagctgcacctgcacgaaggccaattgattgactggcggccatcttggaaaacatctgcccgcaaagtgtatatataagaatcaatggagtggagccaaggatctcagcagggaaaaatattgtcagacgctcagacacctccagttccttcaggattgccattggttggcaagggtgaaaaatcggatgtaacgtcgttatgcataatagcattcaggttcacactgttgagcagtgttggcaatttactagtggtatttcattatgatggtaccagcaaagacacaagtgagctgctaactggcacaattgaggttgctgcttacttctattatttgagcacattagcgccttcgaacgtgcgccccaacgcacggaatttcatagacacaggcgctcttgttattatgtcttatctattattactggacatcaacttgagctttttctggctcgccatcttgcccaccatggccattgttttcataacagcgctttacatcaagctcaatcatcatactggtgatagccatggaaaagttactccaggatcttctaacatcgacgagaagaccatcaagacaccgatggagcttcggatcatagtggtggcaactttcggggctctcctagtcatggatcagctcgacgacgatacagctggtgggttcaccatctcccagttcctcctatncctgagcnccacggtggcggcactgacgtgtattgngaggaagctgcctgccgaccgtnttttgggcagtnctccggtgtcagagttgctccaaaagacctngcttctncnccnactggtgacggtgcacacattnggccgcggagttgttggggcg

SEQ ID NO: 19472 - DNA, 686 bp, Triticum aestivum
  Clone ID: PAT_TA_19472
cgaggctccggctcgctcccggttccctctccctcccgccgccgccccccccccctccccccgcctggatcgtcgccgggggccaggatgccccgcggcggcttctcggggtccctcaggtcgcccaagatcgacgtcgtcatcgacatggggaaccccttcctcaaccgcaccgtcgacggcttcctcaagatcggcgccgtcggcgcctgcaaggtggccgccgaggagaccttcgagtgcctccacaggggggatgtttcgaagcacaaggttgagcatgccctgaagaagatgtgccaggagggcccatattggggcactgttgctggagtttatgtgggcatggtgtacggcgtggaaagggtccgtggccgcagtgactggaagaacgcgatgatcgggggccccgtcccgcgccctctgtccgccgctgccagccacagccgcaggcaccagggccccatcgcgcccagcacccccggcccggccgctacagcgctcgacttccccgccggcctttccttcttgcgctaccgcaactgcatttgctgcgccctcgtcgtcctctacgattaacgtacttcttcagtggatccatgtccagttcaataaaccacccatcttcagtcttcctttctgaccggccgtgctttcttcgtgtggatatcctgagcaaccttttt

SEQ ID NO: 19473 - DNA, 585 bp, Triticum aestivum
  Clone ID: PAT_TA_19473
tcgcgggtcgacggcgtccagcatccacagtcggaggcggagttccacatcgactccagcgacgactccgacgaccactccagcgacgactccgacgacgacggataactagttagtcatctatacccatttatgtgtcaaatagatcatagggtttctctagttactcctgcctccccctttttggaatagaaatcctatggttatgttctcccaatccatgaaatctgagtaagtttcgttagatccgtgtagtgtattgattgtttgaatggtacaggtgataagtgattagttgtttcatctgtgcaaatgatttctgctagtaatccgactagggtagtgttcgtgctaataattcctagccaggacttgacaattgattttgaatgacctacctatgtttgtgccattattttcttcaagattggtctgtacatagacgactgtgcttaaaaatcgaaccataatctctggatatgtataaataaatagccataaattcctaatcctacttcatggcatgtaatcagtgatttgatgccaaatttgttttactatttgtataggtgatgtcccgtcgac

SEQ ID NO: 19474 - DNA, 609 bp, Triticum aestivum
  unsure (1)..(609): unsure at all n locations
  Clone ID: PAT_TA_19474
cttcccagctctctctgggctggagactctcacgcgtttgcttcaagcattgacccgagcataaatcttccagccacttgttcctggcctcttcttgatttctttctatcccctgcctgtcagtgtagtgctcaaatttggtcatcatgaagccatgaacagagcgggcgccttcggtgcaggatcctgacgacctgcgtctctgaagggggataagggcttcttgtctcagtgcttgaatctgctaaacttccagatcttcttgaagacttgtgaaaaatgaagccacctttggaaaggaacccatccaggaagcgccattcatggtggtggcatagtcacattagccccaagaactcaaaatggcttgcagagaacctggaagaaatggagaaaccagttacggaaagggtggagcttattcaggaagatgccgactcctttgcaaagaaagctcaaatgtattatcagaggcgcccagtcctcggtacccgggtcgggtacttcttccgggggggccgcgctgtgcccccgcgccaaagaaaagctcnaaatgtnttaataaaaaggggcccaattgctcaaacaaccaatgtccannaacttctn

SEQ ID NO: 19475 - DNA, 844 bp, Triticum aestivum
  Clone ID: PAT_TA_19475
gggcgcaggttctggtgctggcggccgcggtctacgcgtacgccaagcagggcgcggggccgctccgccccggcgttgaccatgtcgagggcaccgtcaaggctgtcgtcgggccggtgtatgaccgcttccatgccgtcccgcttgacctcctcaagttcatcgatcgcaaggttggtgagtccgttgaggagatagaccgccgcgttcctccggtggtgaaggaagccccaaccctcgcccgctcggctgcaaaggaggttcgtgaggctggccttgtgggtacggccacaggccttgccaagtcagccattgcccgcgcggagccaaaggccagggagctctacacccgctatgagcccgtggcagagcgccgtgctgctgaagcttgggtggccctgaaccgcctcccgctggtgccttcagtcaccagggccgtcctccccactgccgcacagctctctgccaggtacaattcggcggtgcgtgatggtgccaagcgcgggaacgccgtggccacctatctcccgctggtgcccactgagcggctcgcccgcgtgttcaggtaccccgtggctgacgttgctgcagcaccagagatgcagcccattccttcccagtagaagatgaaatggaatgtgaactgcataaaccaatatcaagaagtattactgtgttttgtctttgcgtaccttatggtgaactcatgcgtggttcagtatcgttgcattcctttttgttgcagtgagcctacacaagttcgtctttgttttatggataatatgtataacattatctattggaatagcaatgttgatgcttgtgctttgtcaaaaaaaaaaaa

SEQ ID NO: 19476 - DNA, 817 bp, Triticum aestivum
  Clone ID: PAT_TA_19476
ttttttttttttttttggcagtaaaatacttgtcgatttctcagcatcaactttgtgtaacgacgaatcgaaagttactcgaaccggcgaatataacatatgaaaataccaaattgtgcctgactcaacgacgaccgtttcatatacatcatggaactgatcttgtccgacggcaagttattcaaagatgagttcaaagttcaaattagactcgtgtcctcaacagtgccgagctttttgatagaagagagcaaactcctaaagcgctttcaggatctcctcagcaccggagattgtgaactgtcccccttcctcgatgtttgcgacagtgaccttgaggtcgtcggccagaagagcaaacctcttggagcggacacccacccctttttccgtcatatcaagctcaagatcgagcgccttggtgtacgctccagacccgtcggcgaggaacttcacgtgtttgttctcggggtaagtcttcgcccacgccttcatgacgaaggggtcgttaacgctgataagcaggatctcgtctacacccttggctttgagctgctcagcctgtgtgatgaagcctggcacatgctggttgctgcaggtcggggtgaaggcgccggggacgccgaagaggatgaccttcttgccggcggcgagcgcgtggacggagacctgctgcagctggtcgttctcgtcgaaccacccgagctggccgtcggggagggcgtcgccgacagcgatgggagccatgggcgagcaggaggggacgggtgggtgagcagggggtggggaactggggcggcgagggagcgcaggcgag

SEQ ID NO: 19477 - DNA, 700 bp, Triticum aestivum
  Clone ID: PAT_TA_19477
tcgtgtccaatgtgattgacctgggtacagtggcccatgctgcgctctccaccgtcagtgtcatcgtctacttctgctgcttcgtcatgggatttggtcccatccccaacattctatgtgcagagatctttccaaccagggttcgcggcctctgcattgccatctgtgccttgacgttctggatcggagacatcatcgtcacctacagccttcctgtgatgctgaatgctattggactggcgggtgttttcggcatatatgcagtcgtatgcttgattgcctttgtgttcgtcttccttaaggtccctgagacaaaggggatgccccttgaggtcatcaccgagttctttgcagttggtgcgaagcaagcggctgcaaaagcctaattccttccgtacctttgcctgcaactttttgcactgtgagttagaaacttgaaggggtctcaccaagaagctcggggaattactttcgatttgtgtaaatggtgagggaacagacatctgctcatgctccccaaccgtcagcaagaccccctcgggggctaagagcggttgttgcgtggtctacgctgtttcccttgtcgggtttcccatcagcacccggtgtgccaagcctttcaccactggttgttggtcgagttgtttcgaacaatgagactgctcccatccggtggtataatattcaaatctcaaataaa

SEQ ID NO: 19478 - DNA, 1026 bp, Triticum aestivum
  unsure (1)..(1026): unsure at all n locations
  Clone ID: PAT_TA_19478
aggaggtcaaggaacaaaccaggtcctaaattcaccatgggatgtatgctacgatcccacagaggagaccgtgtatattgcaatggctgggcaacaccagatctggaagcacattgtacgtgatggagtaaccaaagttattagcggtgatggctatgagaggaatctgaatggctcaagcgccaccagcacatcgtttgcacagccttctgggatttcattagcttctgaaatgcaggagttatttgttgttgatagtgaaagcagttccattcgagttgttaatttgaagacaggaggctcaagattgctggctggaggagatccagtatttccagaaaatttgtttaggtttggagattatgatgggactggctcagatgtgctactccagcatcccttgggtgttgcttatgccagtgacaatcaagtatatatagctgattcctacaaccataagataaaaaagctagatcccgtcacaagaaaagttacaactattgctggaaccgggcctgcaggatacagggatggtccaggcttggcagctcaactttctgagccagcaggacttgttgacgttggtgatggaaggcttcttgtagcagatacaaacaacaacgcaatcagatatataactcttagtgacaaaggtgctgaggtgaagacactagagttgatcggagtgcaaccgccatcaccaaaaccgaaggcgttgaaacgcctaagacggcggttatcggcagatacagatgttattaatgtcgatggtggntcttcaaaggaaggatcctgtctcctgcagttacagtacctgatgggtacatttctccaanggaagcccgcagtaaaattgnnggtggaacanagcgcctaagccnttgagatngaccagcgacngttttcnaacccgganggtggaacnctgaagtcaanaggtatcacacctngcaatggaaggtaactgcaggttacacngtaagaangaattgnccacaancatgcttnggcaantcgnagagggac

SEQ ID NO: 19479 - DNA, 1678 bp, Triticum aestivum
  unsure (1)..(1678): unsure at all n locations
  Clone ID: PAT_TA_19479
ggagattgctgcacctcatggaagcataatgggtggtgtgggaagaagcagcaccatggtggggggggaggcagtaagcagcatgggcattggtggggggtggcagttagcttggaagtggactgagagagaaggtgcagatgggcaaaaggaaggcggcttccagcgtatttacttgcatgaggagggcgtgtcaggtgatcggaggggctctatattgtctatgccaggaggtgatattcctcctggtggtgagtatatccaggcagccgctctagtgagccaacctgctctttattcgaaggacctgatagagcagcagcttgctggtcctgccatggtacatccatctgaggcagttgccaagggtacaaaatgggcagaactatttgaacctggagtgaagcatgcactgttcgttggcataggattacagatcctgcagcagtttgcgggtatcaatggagtcctctactacacacctcagatacttgagcaagcaggtgtcggggttcttctatcaaacattggtctaagctcttcctctgcatctattcttattagtgccttgacaaccttgctgatgcttcccagcattggcatcgccatgagactcatggatatgtcaggaagaaggtttcttctcctttcgacaatccctgtcttgatagtagcactagctgtcttggttttggtgaatgttctggatgtcggaaccatggtgcacgccgcgctctcaacgatcagcgtcatcgtctatttctgcttcttcgtcatggggtttgggcctatcccaaatattctctgcgcggagattttccccacctccgtccgtggcatctgcatagccatctgcgcgctaaccttctggatcggcgacatcatcgtgacctacactctccccgtgatgctcaacgccatcggtctcgctggagtcttcggcatatatgctgtcgtttgcatactggcctttgtattcgtctacatgaaggtccctgagacaaagggcatgcccctggaggtcatcaccgagttcttctctgtcggggcaaagcagggcaaggaagccacggactagttgctctgatctggtgatccgcgtcgctggtggtaattttgtggtgtcataactactactacactggttaacctgcgatgctttggtgaagaaacttcaaagagagcagatacggaagactttacatcgtgaggctgaatcgtgtcgtcgtaggccggcttttggaagtaggatatgtacttagatcatctgttcttttcgctttggaactttctatttgtgttattcagaatttcttgcccatgtaactagtgctgttatcacaatttatgtcgtttatgttttttcccaaaaaaaaaacatggttgccttgtttatccccccccgcgtcctcgctccggtaatggtttttggtcttggctcgggtcgattcaagtttattccctttttggttggccactaagtttctccaagttggcccagtccactttcagccaggtttaagttgtgctattagtactnatttttgagggattaagtaggtgtttcctggggttgtatggggaaatatgcacacaacattttatgttactcccttggtttcataatgtagtggatatagattttgtagaagtcaacttaaaaaaaaaaaaaacccnc

SEQ ID NO: 19480 - DNA, 739 bp, Triticum aestivum
  Clone ID: PAT_TA_19480
gtctattgaggggatgtttctgcagaggggtgtggcaaggtttgacctcgagtatttatgtggacgtcaatgctgtctggtcaagaagagatgttcgcgttccgaaggccgatatcccggctcatagaaatgcagaccccgctgtatctcgagcgcgtccagcgtgtccattcttctccccttcgacaacagcagggcacgcctgttctcgcaaaacagagcactgtctctcagtctgctcccttgtagattggtagtacctttctattcgttcttttttaaataatcttgcatccagtttcaaactggagccgaagggtcaaagttaaggagggatgtttccgcacaaggcaatgttggtgcagggccctctactagacgccccgtggcatcgctgccgggcctcggcgcggggttcccgtgccttggggcgatatctcggctcgtagaaatgcagaccccgctgtatctcgagcgcgtccagcatgtccattcttccgcccttcaacaacagcagggcacccctgttctcgcaaaacagagcactgtatctcagtctgctcccttgtagactggtagtactattctattcattcttggaaaataatcttgcaactgtgagcaatgaggttggagaggccaagctcgacattgtcggaaactgtatcgagtatatgtaacacaggtgatgtcagcaagaccaaccgttgcttccgggctgtgcatctgcacagtttta

SEQ ID NO: 19481 - DNA, 916 bp, Triticum aestivum
  unsure (1)..(916): unsure at all n locations
  Clone ID: PAT_TA_19481
ggcacgaggcagaagcattggtgatccttgctagtgcttcagatcttcttcttcgagcaactgatggaatgcttgttgatggtgaagcttgtactttaccacaattagagctattggaagtaaccgccagagcagtccatctcatcgtcgaatggggagattcaggtgtatccgtcgctgatggcctctccaatctgctgaagtgccgtctatcaaccaccatccgctgtctttcgcaccccagcgcgcatgtccgtgcactcagcatgtccgtccttcgcgacatcttgaacagcggacaagtgtcctcctcgaagcccctccgaggcgaacgcccgattggccgccggcgcccagcctcccggtgcttcgcgccaacctccatcctcgcgcagcccgttgtgggcagccgcatggggtgcgtggcccgcgcccgcccccccgccgcgcggtccctcgccttcctcaccgcggcggcgaaggagctcggctgcccactcccttgctgacaaggcccacaccatgactgtcactgcaagcagctgctgtaggatcagcgagtaggaaaggatgacttgccggccagtttcctgagatgtgatttaggactgatattagctgatgttccncaagcatgatacggggcttgctccccaagatgtgatttttactttacttttggttaatgtgctaccgctgacattagatgttcaagcatatgaaaactgcttgtgctgtaacttgtatgtctgtaacgtaaaaatctttccatatggtaaccggggaagcagaggtatatccttttctgctgttgtatctatttccagtttcctgctgaacttgcaaatgaatattcagcaatttccgttttaaaaaaaaaaaaaaaaaaaaaaaaaaaaaaactcgagactatgcc

SEQ ID NO: 19482 - DNA, 742 bp, Triticum aestivum
  Clone ID: PAT_TA_19482
agacactgtgacggaactcctccagataggaagataatggtgggccggaagccgatgcgccggcgccgcgccgaccacccgcctccgccgccgccacagtccttcggtgccgcggcccggccgacctccccccgctcctccacctccgcctccgccgtcgccgacctggacgagctgctccacacgccgtccgcgtcggagccccggagcttcccgcacgcggtgaagcagcagtgctgggagaaggccgagaaggtgcctgggcgcgacccggagaggtggcgccgcgacgcgctcggcaacatcgtcttccgcaagctcgtcggctgccccggctgcctctgccacgactacgaccacatcgtgccctactccaaagggcgggaagagcacattggagaactgccaggttttgcaggctactgtgaatcgatctaaagggaacaatactgagatatccaaatctgaactcacacagagaagcgcatattgtcgggtttcaggacgggttttggatcttcttgaactctctgcccatggcaatgcacggcgtgggcccaattcagggggctacacaggccgatgcaccacatatccttgaccaatcacaaaaatccggtcggtgtagttgcctgaacctgaatggaatgtttgtactatgtagcttaacacttcaagtgatttacccgagaaaagaaattgtgatatataatatatttgaatcaaaaaaaaaaaaaaaaaa

SEQ ID NO: 19483 - DNA, 785 bp, Triticum aestivum
  unsure (1)..(785): unsure at all n locations
  Clone ID: PAT_TA_19483
cgccagggagacctcgcgagattcctgtgatgcaagccctgacgactggaggcaagcgggcgccagcgcgcgcagtgtcctcgtttcctctttggcgctaaagaggcaagtgcaggcgaggagtctcgaggcatcaggcaaaggtttccatatcgatgcaacgagaccaagaccagcaggacggcaagacggaggtcaccgtggagcccaatacgacatcaccaccaaagcctttggcaggcgaagcacctttagccaggataacttgtactagttgtctcccttcgaatttggccgttgttggatcccttcccgctcaatatttggggagaggaccagggcctctataaataggactagccaccaccacacccgctggacttcaccgagcggatcattcagtccccctctcaaccatgttcttccccccaagcacaagatcctctctcctagaggcaatccaccatcaccacactggagtaggcctcagcccaacaacgaatccaccacaccacactaaagtagggtattgcaccacatcggtggcccgaaccagtataaactcatgtctctcgttcatggcctatcatcgagctaggccaagactttggcgcgagagcgatcaaccgagaggttgccggttgcccacccgacagtggtcccaagtaaggtgctcgtacttccttgatatccgacattactgcaactgctcccacttgacctctttacccaacgtctgcacactgatacctgcatcatctataccccnaangcgcntttaantt

SEQ ID NO: 19484 - DNA, 229 bp, Triticum aestivum
  Clone ID: PAT_TA_19484
gaggcttctttgaactgctgcactgtacatgattcttggctgttgccttgtgtaattatgtttttggttagcttatacgtgtccagtggaggcaatgcaagtcgcatgcgcaatagtacagtaggagtacatgataaactgtactatcatcaagatggatttgaatgtttgcttcgtgaatgaacgaaactgatgcttgtggcgtcaaaaaaaaaaaaaaaaaaaaaaa

SEQ ID NO: 19485 - DNA, 1025 bp, Triticum aestivum
  Clone ID: PAT_TA_19485
aaaaaaaaatcgcatctcggcgcgagcatacaaagtgtgccctcgaggaataggttctaggtagatagatctaagcggcccatagcccgacaccagctgccatggcaggaggaagtggaggagctgggggaggaacagggggaggggactcgttggctcgcagggcctggaggcagtacctgctccagctgcagcgccacccactccgcaccaagatgatcactgcagggtgcctcgcaggcgtcagtgactccgtggcgcagaagctctctggatatcagaagattgagaagcgccgcctcctgctcaagatgatatttgggtttgcatatggtggcccatttgggcatttcctgcataaagtgttggattatatctttaaagggaagaaggataccaaaactgtagctaagaaggtgttgctggagcagatcacttcctctccctggaacaatttactcttcttattctattatggatatgttgttgagaagaggcctttcaaggaggtgaagactagggtgaagaaacaatatctgtcagtgcaattgtctgcttggatgttttggccagtagttggttggataaaccatcagtacgtgcctttgcagtttcgggtgattgtccacagctttgttgcatgttgctgggggatatttctcaaccttcgcgccagagccatgtctttgaagcagtcatagacagattagtgggggtataacactgctccatcatggttcaaactggccggagaacaaggatgctgattgctatgtaatataccgttgattgtcctagggtatttaaatagtaggatttcgatacctgtttggtatcaagttgcagatttgtttgtcaacgcatgcgaggccgcttatctgatttctctgttggtactatttaagctttgtgactgaaacgtaattgaattatattagctatggatatattcggtctacttcggagagcaaataatttttttttcttgggaaaaaaaaaaaaaaaaaaaaaaaaaaaaaaaaaaa

SEQ ID NO: 19486 - DNA, 861 bp, Triticum aestivum
  Clone ID: PAT_TA_19486
cccacgcgtccgcccacgcgtccgcaggaacaatatatggagtctttgctttcagtacttgcttatgcctccttcttcttccttgtcctagctgtgttccgacgcatctgccgtgtgccggcgcgggtgatccctcagccgatcatcgagatcagcgatgctgccgtcaccaggcgcgcactggttgagtacgccgacgctttctccaaccgcccaatgtccatgttccgcatccctatcgtcaaaggtcaccgccgccgacggagcgacaacataatctccgtgccatacggcccgctctggcgcaccctgcggtgcaacctcgcagcggagaccatccaccccacgcgctacgcttcctatgcgccgctgcgacgggcggccatcgacgacatcgtcgctagcgtccagtcagccgcaagcaagggcagggcggtggtcgtccgcgacggcctctatgccgccgtgttctccatgattgcacgcatgtgctttggagaaggcctggtcgacgaggccgacgtgcgggtcatgcagtgcgagttccgggagttcatcctcgccgccgtggaatccacctcctcgcccccgtcgaagcccccgccccgcgcgaggcgacgcccttgggatcctggcgccgtccgccgcccgctccccgcgccttgccccccccgctgccggggcgctccccccctctcgtcgcgattttgcgacggccacgcccgttcatacgtcgattcgctcatccgtctccgcgttccagacgaggacgacgacaatgacgagcatctacgccgagccctcacggaagacgagatggtgagcctcgtgttagaattcctcggcgccggcacggagacc

SEQ ID NO: 19487 - DNA, 481 bp, Triticum aestivum
  Clone ID: PAT_TA_19487
tagctccaagaaccatagagcagacaggtcagaacaaataagcttgtctgcatccacggaagacatatgagctagctgggagactgtgtgtctatgttgaaggctgaaatagttgctgggaattatcaaaactcgtcaaaaatgtttagtgtagttttcacgtgttcttgagacatgtgcatttgtatgtctgtgatgtgatctgtcagatcgtgcaatcgtaggttgctgttcttgtgccgtttaaaggccaaatcagggagctctctgcttcctgcgtgattgctttccagcattccctattaacctactctgaaatctcatccatcatgccataagaactgatggttcgtgatgtcaagaaatctgtcctaattgttcaattgtaaccctgtaattgtgttctttgacagcagaaattggtgctgcaatcagcttcctaccacaaaaaaaaaaaaaaaccaaaaaaaaaaaaaaaaaa

SEQ ID NO: 19488 - DNA, 653 bp, Triticum aestivum
  Clone ID: PAT_TA_19488
actcagtcttttgcacatactcctgaatatagtgttttcagttatccatctcaacctgctatgccttttcccccagcgttctttgcccctgggggcagtccgtacttggttgatgcaaagggtgcaccagtcataccgcctctgtcaggtctaagcctcggcatttctcatccatctttcagcaccagagcaacaccaccctcatctaatgaattgagttactttcatcctagcatggatttcagttatggagtgccatctgaaggcgcacgtagggaggcagggagctactggcccgtgtcctaccagggccagacaatgtttgtggatgaacgcatgaggaatgtgtcacagggtggtagttctgggttggtgctgaaacgaaaagagccagagtcaggttgggatatgtactcgcgtcgttgagtctgatgaaggtttgttgcagccataatcgattttgtcccgctttcttaaaaatggtatgttcaatgttccgtttatgacggaccttggacattgtattctagggtatttctttggcacctgaaaatgggtccagttctattaggtctgaagacatacacggagaactgaataagagatcagctacaggtagatttgagagatgttgacatggcaaggacattgtt

SEQ ID NO: 19489 - DNA, 660 bp, Triticum aestivum
  unsure (1)..(660): unsure at all n locations
  Clone ID: PAT_TA_19489
tccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgttcaatctacaaatcccaagcatctgcccttgaagccatgcactcccaactgcaaggttctggtggtgccaaccagcaaacacaagctcttacctgaaagaattgctcatctatccagagaacaagttactgcctaccgtctggacanacaaggtcttggcaaattctgagagactatgtcagttaggatgtaagatgttcaccgggaaaacgncccataccnagttacatcaatgaatcacnggaaacntntacttccatacatgtat

SEQ ID NO: 19490 - DNA, 561 bp, Triticum aestivum
  Clone ID: PAT_TA_19490
gccggccgtgccggggtctccacagcatctcatccagcagtaccacagaacttgaactcgaatccagccgaacaatttcttgagcttcgagagagagagagagagagagagagagagagagagagagagagagagagagagagagagagagagagagagagagagagagagagaggttgaagaaggaaggagagcgggatgggcatcgtggacgtggtgtcggagtactgctcgctgccgcggagtcggcggcacatgaagaggcggaagcagttccagacggtggagatgaaggtgcggatcgactgcgagggctgcgagcgcaaggtcaagaaggccctcgacgacatgaaaggcgtgagctcggtggaggtgatcccgaagcagaacaaggtgacggtgacggggtacgtggacccggccaaggtgatgcggcgggtggcatacaagaccggcaagcgggtggagccgtggccctacgtcccctacgacgtggtggcgcacccctacgccccgggcgcctacgacaagcgcgcccccgccggctacgtccgcaacgtc

SEQ ID NO: 19491 - DNA, 901 bp, Triticum aestivum
  unsure (1)..(901): unsure at all n locations
  Clone ID: PAT_TA_19491
cccagcgtccgcagnacttgaactcgaatccagcgcatctcatccagcagtaccacagaacttgaactcgaatccagctgaacaatttcttgagcttcgagagagagagagagagagagagagagagagagagagagagaggttgaagaaggaaggagagcgggatgggcatcgtggacgtggtgtcggagtactgctcgctgccgcggagtcggcggcacatgaagaggcggaagcagttccagacggtggagatgaaggtgcggatcgactgcgagggctgcgagcgcaaggtcaagaaggccctcgacgacatgaaaggcgtgagctcggtggaggtgatcccgaagcagaacaaggtgacggtgacggggtacgtggacccggccaaggtgatgcggcgggtggcatacaagaccggcaagcgggtggagccgtggccctacgtcccctacgacgtggtggcgcacccctacgccccgggcgcctacgacaagcgcgcccccgccggctacgtccgcaacgtcatgagcgacccctccgccgcgccgctcgccagggcctcctccaccgaggccaggtacaccgccgccttcagcgacgagaaccccaacgcctgctccgtcatgtagtagtactagtactctttgtaattgtaagaccccggccggccgggtagccgtcggcgaccttctctagcttccctgctctgctttgctcctccggggtggcggcgttgggatctctagatggtctctgctggtgttttcttctacttttgaaactagactagaagatgaagatgggtctgtattcttgcttcggtttggtgtaagatatgttgggttcggtgaggaggaagctccatcgatctccttgtttatgcgcaatgttcccaatc

SEQ ID NO: 19492 - DNA, 766 bp, Triticum aestivum
  Clone ID: PAT_TA_19492
gtctcacacagcatctcatccagcaccagcaaccagcagttctaccacagaacttgaactcgaatccagctgaacaatttcttgggctttgagagagagaggttgaagaaggaaggaagaaggaggagagcgggatgggcatcgtggacgtggtgtcggagtactgctcgctgccgcggggtcggcggcacatgaagaagcggaagcagttccagacggtggagatgaaggtccgcatcgactgcgagggctgcgagcgcaaggtcaagaaggcccttgacgacatgaaaggcgtgagctcggtggaggtgacgccgaagcagaacaaggtgacggtgacggggtacgtggatccggccaaggtgatgcgccgggtggcgtacaagaccggcaagcgggtggagccgtggccctacgtgccgtacgacgtggtggcgcacccctacgccccgggggcctacgacaagcgcgcgcccgccggctacgtccgcaacgtcatgagcgacccctccgccgcgccgctcgccagggcctcctccaccgaggccaggtacaccgccgcattcagcgacgagaaccccaacgcatgctccgtcatgtagtagtagtagtagtctttgtaattgtaagactccggccggcgaccttttctagctgctctgctcctccatggcgtcgttgggatatctagatagtctgttggggttttcttgtactattttttaactagattagaagatgaagatgggtctgtattgttgcttcg

SEQ ID NO: 19493 - DNA, 851 bp, Triticum aestivum
  Clone ID: PAT_TA_19493
gtcgaaaaaaacacagcatctcatccagcaccagcaaccagcagtgcttctctacaaaacttgaactcgaatccagctgaacaatttcttggggcttcgagagagagatcgagcaggatgggcatcgtggacgtggtgtcggagtactgctcgctgccgcggagtcggcggcacatgaagaggcggaagcagttccagacggtggagatgaaggtccggatcgactgcgagggctgcgagcgcaaggtcaagaaggccctcgacgacatgaaaggcgtgagctcggtggaggtgatcccgaagcagaacaaggtgacggtgacggggtacgtggacccggccaaggtgatgcggcgggtggcatacaagaccggcaagcgggtggagccgtggccctacgtgccgtacgacgtggtggcgcacccctacgcgccgggggcctacgacaagcgcgcccccgccggctacgtccgcaacgtcatgagcgacccctccgccgcgccgctcgcccgggcctcctccaccgaggccaggtacaccgccgcattcagcgacgagaaccccaacgcatgctccgtcatgtagtagtagtaatgtttgtttgtaagagagaccttctctagcttccccgctctgctctgctcatccatggcggcgttgtgttgggatctctagatggtcgctgttggtgttctcttgtacttttgaaactaggctagaagatgaagatgggtctgtattcttgcttcggtttggtttatgtaagatatgttggatttggtgaggaggaaaatccatcaatcttgttgtttatgcgcaaaatgttcccaatcagacgagcgttgcatgat

SEQ ID NO: 19494 - DNA, 473 bp, Triticum aestivum
  unsure (1)..(473): unsure at all n locations
  Clone ID: PAT_TA_19494
gataacatacagtgtcataaagcatcgcgtgggggggcttttttatcgccctagtatccccaaagtttgaggaccctcccgaaggcgaagaagccttggtccggccaagttttaggaactgtacggacggaccttacccacttgggttccngcaacctaggaagatgaggcacggttgaagtcttgtaganttttgtgtaagacaataagggcctgccagatggtttatataaggtacggaggttgtagattgagacccatgtatgagaattttccccaccgctgctccatctctttgccacccactgttttagtcatcagtgcccgatgggcaccctgtttatttcgacgtaccctttattgctagcattgtaataagcgatgggcatgcttgtagttgaataagtacaatgtccatgtattcaaacatcagcgtcatgtttatttgtntgttgaaaaaaaaaaaaaaaaaa

SEQ ID NO: 19495 - DNA, 751 bp, Triticum aestivum
  Clone ID: PAT_TA_19495
ccgtcggtcatggatccggctcttcggcgccgctcccgcctccctatccacctcctgctggtggccgtcactttactcgccgccctggccgcgcgatccggcgccgaggtcatcaccctcaccgaagagaccttctccgacaagataaaggagaaggacacagtgtggtttgtgcaattctgcgtcccttggtgtaagcactgcaagagcctaggaactctttgggaggacctcgggaaggttattgaaggtacggatgaaattgagatcggaaaagttgattgcggtgcaagcaaaccagtctgctcaaaggtggacattcattcatacccaacattcaaggtgttctatgatggcgaagaagttgcaaaatataaagggcctagggacgtggaggctctcaagacctttgtgttgaaggaagctgagaaagcaggtgaggtgaggcttgaagatgagctataggtgttcgtagcaggcacatgccgatagacgacgatactccggtcaagcaactttggaatgctgctcgacctgtttaaaattttcgaccgagttggcttgtactgccgcctcctggcgcttgtggctaacttagaatggtactaggtcaggtgcaagaagaaaacatttttgtaacttttaaccttttcaactcagttagatgaacctgctcggtgcaaacagttttcgaaaagctattctgcgggcttgggcttaactttgatgtatacaagatacaccatgtcct

SEQ ID NO: 19496 - DNA, 3122 bp, Triticum aestivum
  Clone ID: PAT_TA_19496
cccgccgtcgccgtggccgtcctccgaccggcccgtcgctcccgcccctcgacccctcctccccccgtcgcagtcacgttctgctcggccccggcacctcgctcccccgcctggccccgcgacccggcgccaaggtccttacccgaaccgaaaaaggcgtcggcgacaggataaagtgtgagaatacaggtcacttggtgcaagccttcgtccctccgtgcaactccttcggaggcctttgaactctttagtgggtccacgggaaagctatggaagggacagctgaaatggagatcggggaacttgatcgcggtgcaggccaacgatgctgctcaaccgacgacctacattcattctgttctgtaatggtgtgctaagttgcaaaagagaatggacctggggacgtgcatacacacatggggtatatcaagacctttgtgtagaacaaagctgacataagatttgaagatgagccttaggagtaggtataagccgtcagacgaggctagtccgttcaagcaactttggaatgtggaacgatccttgtaatattttcgaccggcttccattgtgcctccgactcgtatcgcttctcgagaacctaggatcatcggaaacttttctccagtaacctatgtggatttaacattgaacttttgcagctctgctagacgtggtaggcgacgtgatgctgattaccggcctgagttatgtagaggaacagttgaattcattgccaccaaggaatttctggttcgggaaccaatgccagctgtctatttcttccttgttgatgtctccatgaatgccatacagactggtgcaactgctgcggcttgcagtgcaatatcccagtctctttctgatcttcctgaaggtccccgaacgatggttggaattgcgacattcgattcaactattcacttctatagtctgaaacgtgctcaacaacagcctttgatgctcattgttcctgacatccaagatgtgtatactccacttcagatggacttaattctcccagtttccgagtgccgtgatagtttggagcaacttctggagagcatccccagcatgtttgagaacaatagggttgccgattcagcatttggggcagctatgaaggcaggtttcttagctatgaagcccactggtggaaagttgcttgtgtttcagtcagtgctaccatcagttgggactggctcattatctgcaagggaaactgaagctagatctaatatttcgactggagataaggaagcacataagctcctgcagcctgttgataagacactcaagacaatggcactagaatttgctgagtatcaagtttgtgtggatgtgttccttgccacacagtcatacacagatattgcttcgatatcagttgttcccagtaccactggtggcagggtttactactacttcccattttctgctgtttctgatccagccaaactcttcaatgatctcagatggaatatcactaaaccccagggttttgaggctgtcatgcgtgtcaggtgcagtcaggggcttcaagttcaagactattctggcaacttctgcaagcgtgttcctactgatattgatttgcctgcgattgactccgacaaaaccataatggttaccttcaagcatgatgataagtttcaggagaacacagaatgtggttttcagtgcgcacttctttacaccacggtatatgggcaaagaaggataagggtcataaatatttcacttccatgcacaagcacgctcaacaatcttttccgatatgctgatcaggaagcacagtttacttatgttgttaagcaagctgcaaatggcattccatcaagttctctgtcccaagttagggaccaggtaataagtacctgcatcaatattctccagtcctaccgaaaacattgtgcatctgtaagttcttctggacagttaattcttccggaggctttaaaacttctgcctttgtatactctggccttgattaaaagcataggactgaggaatgatgggagagtagacgatcggtcctattgggtctctattgtctcctcagtttctgtgttattagccattccattggtgttccctaggatgattgctctccatgatctcacatcaagggatgatgaggattcccttattccaaatccccttactctcaatagtgagaatatacaggatgatgggatttatttgttggaaaatggcgaggatggttttatttatgtcggaaatgcggtgaaccctgccaccctggagcaaatatttggtttctcatctttggctggtgcaccaaatctgttggcattggagcaatttgataatgcattgtccaggaaagtgaatgaagttgtgaacgaaataaggcgacagagatgctcttacttgagactgagactctgccgaaagggcgacccatctggggatttcttccgttcgctgctggtcgaggacaaaacacctggtggcctttcctatgtggagttcctcgtgcatgttcacaggcaaatccagagcaagatgacctgaggtggccccgcttcattggtgtgatattttggttggtagagatcaagaagaaatcgattcccgcatgtgggtatacaaagattatatggaccgtttttctttctgaaaaaagagttgtactcgtacttaattaccctgtttgtactgagattttcctataaaggctccttcgtggtacggctcaccgtgctctccctctccgacctcccatcctcttattactcctatcccttgattctggctctgcaggagatttcttccgttccctgttggttgaggacaaagcacccggtggcctttcttatgtagagttcctcgtacatgttcacaggcaaatccagagcaagatgacctgacatgacctgctttattgttgtaatgttttggttggtagaaatcaaggaattgatttctgcatgtggatatacaaaaaggaaacaacgtttttctttgtaaaacacagctatagcacatttgtaaggattctagtctttgattttacaaagtcagttttggtgtaggtggtatatgttttgtgttttgcgacaaggatgagtttggcaaggtaaatatttatctattta

SEQ ID NO: 19497 - DNA, 1150 bp, Triticum aestivum
  unsure (1)..(1150): unsure at all n locations
  Clone ID: PAT_TA_19497
aagccaaatgagtattgatagaacccgtgctgttgtgaaggatttgtactccagaatttgtgtggccattcagagaattgacatgatttccaagaacatagaggatctgagggacaaagagcttcaaccgcagcttgaagaattaattggaagcttaactcgcatgtgggaaacaatgctcgagtgtcaccggcatcaacatgagattattaagctagtatccaacagtggcggtataaaggtcttaatccggtcggaatcacagttccaagcaactctactccttcaggttgaactaaagtcactattttcaaacttccagagatggatagtatcccatagatcttacttgaatagcctacagtcatggttactgaagtgtgtgaaatcactaaggacgaagaaaaaatctagaaagaagaaggataccaattttcaaataacaaattttgctgttgcacccatatttacaatctgtgagcagtggattcagttactggatgagttgccaatcgaagacttggaaggtggcattaaaggtctccttgcagatataaaccattgtatgcctcgtcaagagaagaggcgtggtggttcaaggtctacattcgcaatagctaatggagggttgaatgatgaaatgaggggaatccatagaaatgccgctcatacggatttacagtcgagcctggagagcttcctagggaagcttgaattcttctcagatgtttcagtgcacaaatatggtgaactcaagaaaaaagttaatacggcaaaggagaaatatgagcaacagaataagtaacttaaggaggaggcaaatcgggtgcactaatttctggagtgaatcataatatagctcaaaagtcatctgagatggataaataaaccgtccattgtgtacatccgttcatcgaactaataggcacaaatcactgccatcatattttgcgagctcatgatagtctagggggacaggcgtgggggtaaatatgtagatatccggccttgtggctaatgccactcgaccttaatctgggatgtaaatgtgaggtgtaggtaaattaaactgtaagatgggggatacaagatgtatatttgtcctgggggtatatcagtatatgatatgnnnnntcnnnnnncnnnnnnn

SEQ ID NO: 19498 - DNA, 1010 bp, Triticum aestivum
  Clone ID: PAT_TA_19498
ctcagccgcgccgaggacgacaaggagacgctgctgaaagagaaggcgacgctgtcaaacaccgtcaacaagctcaccagagatgtcgccaagctggaagccttcaagaagacgcgtatgcagccacttcaggaagatgaaggcgatgcaagcagcaccaagcggaggagccccgccacggcggccgccccgtgatgtcggacgaaggggaggacgcgcccgtggcggcggtggcggcgggcttcgggctgccggaggagctggcggccgtgctgccggcggacccattcgagcagctggacgtggcgcgcaagatcacctccatcgcgctcgcgtcccgcgtcggccgcctcgaggcggaggccgcggggctccgcgcgcagctcgcccggcgcgacgacgccgccgaggacctccgcgagcgcgtcgagcagctcgagtccgcgctcgcgctcgccaccgaccgcctcagccgcgccgaggacgacaaggagacgctgctgaaagagaaggcgacgctgtcaaacaccgtcaacaagctcaacagagatgtcgccaatgttggaaattttcaagaagacgcttatgcagtcacttcaggaagatgatgacaaacccaacattcccaaggctaagctcaccgaaacatcgaatttctcccgggcgccatctgtcggagatgaagattctgcattgacaacttctaaatcatcacagtggtctcaaactgcgaggtctgctacattactcgcacgcatcgattagcagttctaccattcggtacctcttccccatggattaatctgtgagccagcttttactgccatttgtgcattaatatatttgttatttattgtatttaatatctgtagaagtcacctgctatcattgcagatttcggatatatagtttttaaaaattcttgttacagtcaatgtaaagtcatggattgtctgtaagctagaacctttacatattaatacaaatgcagaagtttgcaatttagaggc

SEQ ID NO: 19499 - DNA, 556 bp, Triticum aestivum
  Clone ID: PAT_TA_19499
ctcgtacgtcacaacgtgggaaaaaaaaaaaacacaaaaacaaagattataatggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggagagttccccggtgactacggatgggacaccgctggtctatcagctgatcccgagacattcgccaggaaccgtgagctagaagttatccacagcaggtgggctatgctcggagccctaggctgcgtcttccctgagcttttggctaggaacggagtcaagttcggagaggcgggttggttcaaggccggttcacagatctttagcgatggaggactcgattacttgggaaaccctagcttggtccacgctcagagcattttggccatttgggccactcaagttatcttgatgggag

SEQ ID NO: 19500 - DNA, 681 bp, Triticum aestivum
  unsure (1)..(681): unsure at all n locations
  Clone ID: PAT_TA_19500
cattggttgccaatgttgaatcaatgattaaagcagaccggaagatcacaccattgaaacaacttcagggtcatatttggaggactggatttcaaaagaaagagctacagggagttgtctttgaggatgtgcctgtggcgctaaagaactggcatgctaagtggcataaaggtctacatatactcaagtggaagtaagagaagcacaaaggctgctatttgggcaatacaacatacggtgacctgcgaaagttcctgtgtgggtattttgataccaccactgggaaacaaaagagaaacaaggagttattttgagatctctcaatcactggggcgttggacagtccatctcaaatcctattcatcaccgatgtcttccaagaagctgttgctgctaaaaacactggttttganggggataatctccatccgcccagggaatgctccacttcctgacaatcatggttcccgcactatcatctccctccgggaggtcggagctgggtgcggatcggcacatgtcgggtcccatggcttaaccccggccttcctgggttataatattagcccgcggaccagttcatgcagtggtaacagtataacgccgcagcatggcatgtaatactaagttggaatggcgaaataaaaactttggtccgttgtataattgtagctaagctgc

SEQ ID NO: 19501 - DNA, 433 bp, Triticum aestivum
  Clone ID: PAT_TA_19501
ggttctgataaccctggccgtctccctgaagccgctgcacccgcagtgcacggcgggcggcgactgcgccccggcgacgcggcagcaggtcgccttcctgtacgcggcgctctacaccatggccatcggcgcgggtgggaccaagcccaacatctcgacgttcggcgcggaccagttcgacgacttggacgcccgggagcgcgagatcaaggcctccttcttcaactggtggctgttcagctccttcgccggcggcctcgtcgccgtgctcgtccttgtctacgtgcaggaggaggtcggctggggcgtcgggtacacgatcccgacggtcggcctcgccctgtctctcgtgctcttctacgtgggcacgccgttctaccggcacaagccggtcacgcggagtacggcggccggcccggcgaggctgatcggc

SEQ ID NO: 19502 - DNA, 1156 bp, Triticum aestivum
  Clone ID: PAT_TA_19502
acactctcgggtagtcactcatacacaacacatagagcaagggtgagggggggaggaggcctcatcggagtccagcatggagaaggcaagcctcgaggaagcgctcctcccgaggagcccggtgtgcaaggagctcggggaggacgagagcctcgggctgggggtgggcgacgaggtgaagcggcagctgtggctggccgggccgctcatcgccggctgcctgatgcagaacctcatccagatgatctccgtcatgttcgtcggccacctcggcgagctccccctcgccggcgcctccatggccagctccttcgccgccgtcaccggcttcagcctcctgcttggcatggcgagtgcactggacactctgtgcggacaagcatttggcgccaggcaataccacctccttggcgtctacaagcagcgcgcgatggtgatcctcaccctcgtcagcatcccgctcgccgtggtgtggttctacaccggcgagatcctgctcctgttcgggcaggaccccgacatcgccgcggaggccggcacgtacgcccggtggatgatcccggcgatcttcgcctacgggctgctgcagtgccacgtccggttcctgcagacgcagaacatcgtgttccccgtgatggcgagcgccggcgccgccgcggcgttccacctcctcgtctgctggctgctcgtgtacgtcgccgggatgggcagcaagggcgccgcgctcagcaacgccatctcctactgggtctacgtgatcgtgctggcggtgtacgtgagggtgtcgagctcctgcaaggagacgtggacggggttctccgcggaggccttccgcgacgtgctcagctggccgcgcctcatggtctgcttggagatgtggtcgttcgagctcatagtgctcctgtcaggccttcttcccaatccaaagctggagacttcggtgctgtccatcagcctcaacaccgctgccttcgtatggatgatcccctttggcctcggctctgccataagcacccgtgtctcaaacgagctcggagcggggcgccccgacgctgcccgcctcgcggtgcgtgtcgtcgtcttcttggccatggcggaaggactggtccatggggttggtgctgatctgcatcagatacgtctgggggcatgccta

SEQ ID NO: 19503 - DNA, 489 bp, Triticum aestivum
  Clone ID: PAT_TA_19503
accaagtcggatattgtagcaaaggccgatggcacctttgtacctcgagaaagaagaaagagggtcgatgaaaaacctgaaaagaagcagaagcgcgagcaccaccatgatgctagtcaaattgggatgggtgtaaatgcttaccctggtgtatatggggctccacagctcacccagatacctatagctggaggacagagggtcattatgccagagattatcgtaccaaacaacatcctgttcgtccaaaacctgccacacgagacaacacccatgatgctccagatgctcttctgccagtaccctggcttcaaggaggttcggatggtcgaggcgaagcctgggattgctttcggggagtatggagacgaggggcaggccactgctgccatgaacaaccttcaaagcttcaagattacaaaagaaaaccagatggtcatcacatacgcgaagaagtaacaacctcccgagctgtgttgaccctgatct

SEQ ID NO: 19504 - DNA, 951 bp, Triticum aestivum
  Clone ID: PAT_TA_19504
accttttcgattagctgatcttgtaggttttggcgttgccgttgccactggaaagcaatattataagagttatccagagcgatgttataaatcacgtcttactgaaattatgctcgaggagaacaggacaggtgaatcttctcataggggattttatctttataatgataagcgacaagcttctccagatcctgatatcaaaaagtatgttgagaaatcaagaaacatggcaggtgttgcacaagatcctaagctgatgaaattaacagacaaggacattgtagagatggtcttctttcccgtggtgaatgaggcctgccgagtgctggatgagggaattgcactgaaagcatctgaccttgatgtagcatccattatgggaatgggcttcccttcttttaggggtggagtgatgttttgggccgactctctcggtgcggaatacgtgtaccgcagactggatgcgtggtccaaggattacggagagttcttcagaccctgtgaatatctagctgccagagctagtcgcggcacatccttggctgccaccacagctgatggcaccaaatcgcgactctagatagtttacctgggtgtgctgccatgtccagtcgggatggaggagctggaatgttccggatacaatcgtgtgttagatgtaataaagtgcacggcaaaaatgctaggttggttttgagtgttggtgggtgcggcttttttccttctgcagctgctgctgtgtgatgtgcgcccgtcctcttacccactgtgcaggggctttgtgcatcgcggattccccgtcgcgcgcggctgcgacgtgcccgcgaaacctctatgggcgtgtttggttaccgtttgctacagtatctacatcgcatacacttctcaatccagtctggttgagcaaaaacaggccctaatacgccatctgcaaaaaaaaaaaaaaaaaaa

SEQ ID NO: 19505 - DNA, 653 bp, Triticum aestivum
  Clone ID: PAT_TA_19505
ctcatccataaagatgattgacggatttgcaacaagttccacagcaatggtaagccgttgccgctgctcccctgacagaccgggcgcgccagcgagtccttcccatgcctggccccgtggcccctgccccactgcctcccgcgccgcctcattcatggtctttcttgtcgttgcagcgtccgccttgggagccccctgcctgttggtctggcctcggaatgcctctggagccctcgacttccaagtgcccgagttttcttacagggtggtgaaagaaggtgcctgctgtaattttatttttggttacctccacatgacgctgattccaagatttgtggtagtagacttgggaacggactagtcagttttgccgcaggaggtgtctgggactgttgctgggtctcagcagctgtgcttgactggatgtgttagcagcggctcttgtgctcagtgtatttggctaacattggtgcgtgtgctttgcccatgatatatcgtggtacagcattgtatgcttctttagttgaagtttatagatggatggagatttctgtatccggacactatccaaagctgataggaaccttgttatatctgtagtttactattctgtgagatgtctcatacacattccccaaaaaaaaaaaaaaaaa

SEQ ID NO: 19506 - DNA, 644 bp, Triticum aestivum
  Clone ID: PAT_TA_19506
aggaactccctgaggacatcatacatcgtatacatcctcgcgtcccaatacaagatgctgctcgtgctgcctgtgtgtcacgtagatttctgcattcctggagaagctattccagcctcatactcagtgaccgtacacttggtttggatgacacagattttgaggaaaggaaaacccatctcattgataaagttgacagaattcttaaaaaccattatggcaatggggtgaaggtgaagacacttaaacttgagcttggactttgcagcgatatcaaagcctcctacctcgacaggtgggctcccgaatcactaaacctgggattccaaagaattcagcttgggtgttgcctttagttaatgaataaaacctacaactttccgtgttccgttttatcctaatgaggcagctgcaagttcaattcagtctcttagcccctttgggtgcgcctttcaccccacatcaatactggggtgcttgagaagattgaaaagtttacacctgtgccatgtcaacgttacggaggatggattagggctcctccgctcctcgcctgctcccctggagcggcttgtgtgggatgcgcgtagtgcgtgacttcgctccaatcccccttgcacgatgcagcagctcaagttcctcgc

SEQ ID NO: 19507 - DNA, 886 bp, Triticum aestivum
  Clone ID: PAT_TA_19507
tcctctgatgctaaacttgatgacgtaacactgaaaatcgaacagctctgaaccaaagttcgatccctttctttctatggggggcaagaatcaatactgatgctatgcaattggctgaatcacatctatgtctgtttaacatgtgtttgtgcaacgtacttgcagctcgtcggtgcagcaaggagagaccattccctaggaatcatccagaaagatatcatacaaacggtcaacaaccaccccaacgccggatggacggctggacacaacccctacctcgcgaattacactattgagcaatttaagcatatgctgggagtgaagccaacgcctccaggtttacgggctgctgttcgcaccaaaactcattcaagatcggagcagctcccaaaggtgttcgacgccaggtcgaaatggtccggttgcagcacaattgggaaaatacttgatcaaggtcactgtggttcctgctgggcttttggtgccgtggattgatcggttggggaaccagttatgctggcgaggattactggctttttgcaaatcagtggaacaaaggctggggtgatgacggatacttcaagatcataaggggcgagaatgaatgtggcatcgaaggcgatgtttctgccggtatgccctcgccaaagaacccggccagaaacaatgatgtcgcctttggaacggccatacttttaggagagcccgaacccagttgaaattagctgtttgcatgtcaaatgaagcccctaatttaactctgtgggttccatgatactgtattttgtaccctagcgcaaacgctgatatgttgttcaaacaacccttgttcagaaacagaaggggataataatgtcaataaaaacataaggatgtcttcttttcc

SEQ ID NO: 19508 - DNA, 699 bp, Triticum aestivum
  unsure (1)..(699): unsure at all n locations
  Clone ID: PAT_TA_19508
gcgagaagaaggccgcgacgcctgggcgaatcaagccgatagtatacaagtacgtacgttttaaaacggttgctggctctggcgtggcagcacgcacgccgtcgcgtggtgccgatctgaaggcagaaaagggggccgacaggcgtatcgcagcacctgcgcccgcatcaccgtcccccggaaaccatttttgcagcttagctccagtcccctgcgacagcctacagctactcccctgtttaaagggcggtgtgggggagganggagaagcaagtccgccagctgcagctactcctgctgcttgcttcccccctgtcgccggtcgaaggagatggggaggctactcccgctggcgctgctcgtcctcctctctgccgccgccgctgccccccaggttcggttcttctcgtcttatctgaacgagatcccacctctgctgcagatttggtagtagtagtcgagcgcagcgaacctcggaagcttagtgggtgacgacctgtcctccgcgaagcgcgaacgaatccaccaccccggacctgatggaggggcctcgggcctcccgcgccgtgttgcagctagatggcgagcccgtcctctgatagactgatactgaaaaacgaatagcttggaacgaatgttcgatctcttcatcccatgtttttctctgcttgggataaaatgtgcccacccctactagca

SEQ ID NO: 19509 - DNA, 1536 bp, Triticum aestivum
  unsure (1)..(1536): unsure at all n locations
  Clone ID: PAT_TA_19509
agccagcgacttcctgctttgctttgcttcctcgtcgaggaagaggaagaagaagatggggggcgtcggcgtctcccttgcgctgctcgtcgccgtcgtcctctccgccgtcgctgctgccccgcagctagccggcacagccaaggcagagcattccctaggaatcatccagaaggacatcattcagacggtcaacaagcatcccaatgccgggtggacggctggacacaacccctactttgcaaactacactattgagcaattcaagcatatcctgggagtgaagccaacgcctccgggtttgctcgctggtgttccgatcaaaattcatccagaaatggatctccccaaggagtttgacgctagaactcaatggtccagttgcagcacaattgggaacatacttgatcaaggtcactgtggtgcctgttgggcctttgctgccgtggaagctctccaggatcgtttctgtattcatctcaacatgagcgtctccctttcggtcaatgacctactggcttgctgtggttttctgtgtggtagcggttgtaatggaggatatcctatcagcgcatggcgctacttccgtcgcagtggcgtcgtcactgaggagtgcgatccatacttcgatcagactggttgccagcatcctggatgcgagccagcttatcctacaccaaaatgtcaaaggaaatgcaaggtggagaaccaagcgtggaaggaaaataagcatttcagtgttaacgcgtacagagtacattctaatccccatgacatcatggcagaggtctacaaaaatggccctgtagaagttgctttcaccgtttatgagaagtcgtggcggatcctgggttggttgcagttactgaagtaaattattagcaaaagcttagaaacaactaacataggcactctagtgagtaagatgaagcatgcaatgctgttgtacggtgtttcttcagttcgctagtcatttgatatacagctcatatgcttggtgataagatgacaaagaatcaaaaggaagtatcttatttctcgggttactgatttagtactgccaaattttggacttcgcacactacaaatcaggagtatacaagcacatcacaggtggcgtgatgggaggtcatgccgtcaagttgatcggttggggaaccagtgatgctggcgaggattactggcttcttgcaaatcagtggaacagaggctggggtgatgacggatacttanagatcataaggggcgagaatgaatgtggcatcgaaggcgatgttactgccggtatgccctcgacaaagaacacggccagaaacaatgatgtcgcctttggaacggccatactttgaggagagcacgaacacagttgaaattagctgtttgcatgtcaaatgaagccactaatttaactctgtgggttccatgatactgtattctgtacactagcgcaaacgctgatatgttgttcaaacaacacttgttcagaaacagaaggggataataatgtcaataaaaacataaggatgtcatctcttc

SEQ ID NO: 19510 - DNA, 1548 bp, Triticum aestivum
  Clone ID: PAT_TA_19510
cgccgcgggcagccactagcaggcttgcagccaggcagctacccccctctcctggcgtccccctcatctcctccctccctccccccgtcgccgatcgaggacgaagatggggagcctactcccgctggcgctgctcgtcgtcctctccgccgccgcggccgccccccagctcgtcggtgcagcaaggcgagaccattccctaggaatcatccagaaagacatcatacaaacggtcaacaaccaccccaacgccggatggacggctggacacaacccctacctcgcgaattacactattgagcaatttaagcatatgctgggagtgaagccaacgcctccaggtttacgggctgctgttcgcaccaaaactcattcaagatcggagcagctcccaaaggtgttcgacgccaggtcgaaatggtccggttgcagcacaattgggaaaatacttgatcaaggtcactgtggttcctgctgggcttttggtgccgtggagtgcctgcaagatcgtttctgcatccatcacaacatgaacattacactttctgccaatgacctagtggcttgctgtgggtttatgtgtggcgatggttgtgatggaggatatcctatcagtgcatggcaatacttcgtccagaatggtgttgttactgacgagtgcgatccatactttgatcaggttggctgcaagcatcctggatgtgaacctgcttatcctacacctgtgtgtgaaaagaaatgcaaggtgcagaaccaagtttgggaggaaaagaaacatttcagcatcaatgcataccaagtaaactctgatccacatgaaatcatggcagaggtctacaataatggccctgtagaagttgctttcacagtttatgaggacttcgcacactacaagtcaggagtgtacaagcacatcaccggtggagtcatgggaggtcacgccgtcaagttgattggttggggaaccagtgatgctggcgaggattactggcttcttgcaaatcagtggaacagaggctggggcgatgacgggtacttcaagatcataaggggcaagaatgaatgtggcatcgaagaagatgttactgccggtatgccctcgacaaagaacattgccggtagcgccttcgcaatttaaagtttgggctgccccttgtcctctgatgctgttggaattagctatttgcctgtcaagtttaagcgggcaaattagcattgatggtaccaggattctgtattctgtgcactagctattaatgtgtccgttaatggcaataaaacaattattatcaaggcatctatgagtgacaaacaattatccatttcaattggcaaaaaagaaaaaaaaaaagctgtgttcattcacgggagaaaaacaatcagattatcccgtgcttgtcgggggtgagaaggacaacccctcatatgcggggctcaacaccccctctgctcccacgtgggactaaatattgcgcctatgtcatgcaatactaatggacctttgagattttcagaatttaaatgtttaatgtgccgagagccccataa

SEQ ID NO: 19511 - DNA, 711 bp, Triticum aestivum
  unsure (1)..(711): unsure at all n locations
  Clone ID: PAT_TA_19511
atatagcatagagggnaagggtcngatcacattcacttagcagaaaaagcaacttgaagaantagctataaatgaaatgttgtacaggcccatgcacttctttccattggagcttgacgcggactcagtcttggcttgcgacccggcggagttgagttacacgggagattgtcaatgcggtgccaaaactcaaactcaagtgtgtctccctttggtggtggcgtgacccaccgtataagaatgatggtttcagacgccgcgtacaattgtcgtagggctcttgagacccaaattcttcgctaatttcttccacactttggagggttagtcttcattccttggaggaaaaacgtttcttcgtcatgtgttgcacatctaagtcatcaattctgcataagtgttaggatgtgtgtccttttcaaaggacattcgaagattctaagatatttagctcacaccgcaacttgctaaatctcttctcatcccaggggctttgtgaagatatcggctagctgttcttcagtcttcacgtgctcgatggagatgtcgcccttcaacacatgatctcgaagaaaatgatgacgaatctggatgtgctttgtcttcgagtgctcaactgggttatgagcaatcttgatggcagtctcattgtcacagaagagtggcacattcttcacattgatgtcgtagtccttgagggtttgcttcatc

SEQ ID NO: 19512 - DNA, 533 bp, Triticum aestivum
  Clone ID: PAT_TA_19512
ccacgcgtccgcggtgaagcaatgtgatgtgttcagagagagcagcggagcatttgactccacggcccacgcgcccggtgatgaggggaatgggaaaagactgggcatcttcgatgcgagggcaaggctaggcgatgaaatttgtaggaagcaagaggaggggcatgacctgacactggtggaggagatcagttccaggaatgttgttgctggtcttgctggctcaggggaggtttctgccaaagccttttccgctacccagagcgattgtgatggaggtagcagcgctgttatccctgtgtttaccgtgcacgtggtcgactcggatgatgtttgttcgggagtgagagagcatcaaaagaagcccgaggagtgtaataagcagggagagaaggggaaattggctgacaagattagagtttttgagaaagcagcaacaagtggcgagggaaaatcggtgaaagctttgtgcagtgtgaacaagtacccaagcaagctgcatgagaagctggctgcgctggaagggagggttc

SEQ ID NO: 19513 - DNA, 483 bp, Triticum aestivum
  unsure (1)..(483): unsure at all n locations
  Clone ID: PAT_TA_19513
ccacgcgtccggaattaaaagggaaaattaactgcggcggcgacagcagaaatcgcccccccccccgccccccccctcccccccccgcctgatcccgccgccgcgtcggcgaccgtttctcgacgaggttgcagatattacttcgattgatggtgcaaagaaaataagtgcggcaacttgagtagggtgatgttattgagtctagtaagcactagagatgatggataatctagctattgtcgcgaaggagcttggtgatgtgtcggattttgaggttgatggcatcccaaacctctctggagaatgatgtcagtgacgaggaatcgaggctggaggagctggcccggcggatgttggaaagataaggtcaaggctcaaagaggatcaaaggagaacagcagagcttgcttttgggagcaagccgaactgggagaagtcctaaaccaaaagaactgtcctgatnctacccttccgcaagaagat

SEQ ID NO: 19514 - DNA, 1156 bp, Triticum aestivum
  unsure (1)..(1156): unsure at all n locations
  Clone ID: PAT_TA_19514
cactcagcctatcgctncaaggcacttgcatgctggtcttgctgcattatcatgcatgctcggctacaaactctggaacacatacaacatgggttggggacttgagaggctagctcaactccaggagcgcaactgcatgctactctggtagacggcagcgtaaggccatcagtggacaagcaaatggatcaaaaaggccaatctacggattcggattcctgcgtcctggagatggatcagttggcccatgagctggaaagtaaactggccaccctgaactcatccaaggcgcaggtcctcgaccgtcgccgtccttgttccatcatcgtcggcaaggtccgtgacctcacgcggaacgtcgacagcagcgagtacgatcctgaccacgtcgacatcggcccgtacaactaccctcggccccagagcaaaagcccacacctcgccctggagcacgacaagctggcgagcctcgacctggtgctctcggcggcgaaggcagcgagacccgccatgacggtggaggtctacgtcaaggagctggcatgcctggagcgtgacaccaggaactgctacgccaacacatttgatgacatgacgagcgagcaattcgtgcgcatgctgctcctcgacgcctgttacatactgtcccgcctcgtcggcctccgagcacatcatctagatctagatgatgtggggactgcggaggccgccgtctcgtcggcaaacagggcggaggcgctagcggtcgtccgcgacgtgttctatctcgcggagaaccagataccgttcttcgtccttgagaagatcggggagctgaccactttgggacggtaaggatccccggctttcgggggtctccggggggggccctttatctcatgaggagacaaatgtacgccatggccgcgccggcatggtgctgccagagcaagcggcacccggtaacctctccatcttcttcatatcacttttaaccatctctgtctcgcctgcctgccgtttttcacgctgatccatgtctgttccccgtggcgctcngggaccgataaattcccnggaatgnatttnaaggtcccggcatgggcnaaaaagnctcanccgctgcacctcnaantcaattnggacgcaatnggcgganctggaggccctgcctgga

SEQ ID NO: 19515 - DNA, 761 bp, Triticum aestivum
  unsure (1)..(761): unsure at all n locations
  Clone ID: PAT_TA_19515
gggcccttctgagggacccggccatcttagtactcgacgaagctactagtgcacttgatgctgagagtgaacattatgtgaagagtgtcatcacagaagttagcactgatcctaaggctcgaagaaccgtgattatcatagctcacaggttgtctacgattcaagcggctgacagaatcattgtgatggaaaatggcagtattgtggaggacggaaagcacagcgaccttgtcaaacagaatggattgtattcaagattagcgcagcgacaaaatgatgctctcccgtagcctgaaatcacagaaggtggtttagtccacgccgtattttttccaagtggagcagcaggtgagggaggcgtctgtcatcggtgtattctttacgagtgaccacggcctggttggtcaaataattgaggtttcctcaaagtaccgggtgcaaatgatccacagatgccaactaaccaagctaagttaaaacggtttctgccgcaaaaaggataagaagatagacagtatccgggcggatgtatatggtggtttaaggaaattcgggagtctttcccgtgctctttttctcacccagatgctactgtactattataaatatatanagcatctggactcaacatcggaacctgtattaacgtggtaacattactnnatttgaggggggccggtaccatccctanangntctatacnccgccacggcgcgtttaaantcggacggaaaaccngggtacaantaacccttnnnaac

SEQ ID NO: 19516 - DNA, 1217 bp, Triticum aestivum
  unsure (1)..(1217): unsure at all n locations
  Clone ID: PAT_TA_19516
ccacgcgttccataaagaagacgggaagggaatccaccaaagcctccgccgtttccatagctctcgccagatctcggtggcggcggcggcatcacggaggcagatggccggccggcgcgagcctcccctgatgcgcaccggcttgggcagcgggcagccgccgtcccgcgggtcccgcatcgcggcggcggtggccgtcggcgttactctcggctgcgtctgcgcgttcttctaccccgacggcctcatctcccgctccaccgactccgccctccactggcgtcgccgggctgactcagttacttgtgagacatcggaggaagttaccaacctacagtcacagttggcatcattggagagaaaaaatgctgacttcaggaagcagatcaatgaactctcgatgaagcttcaaatggctggacaaggaaaaaaccaggctttgtatagtgctggtccttttggtactgtgaaggctcttagaacaaatccaacagtcatgcctgatgaatccaccaatcccagactggctaagatattgcaacaggttgctgtgaagaaagaaatcatcgttgcagtggcaaactctaacgtgaaacagacgcttgagatgtggtttactaatatcaaaagagttggaatcacaaattacttggttgttgcattagatgacagcatagagaacttctgcaagtccaaagatgtcccagtttatcggcgggatcctgatgaaggcattgacagcatagggaagacaggtggaaaccatgctgtttctgccctgaagttccgcattttgagggaattcttgcagcttgggtacagtgttctcctctccgatattgatatcatgttcttccaaaatccctttgatcatctttacagagattctgatatagagtccatgagtgatggccatgacaatatgacagcctatggtttcaatgatgtgtttgatgagccttcaatgggctgggcaagatacgcacacacgatgcgcatatgggtttttaattctggatttttcttcataaggccaacaaattccctcagttgagcccttggatagggtagctgggcgcctttctcgtgaacccaaatcatgggaccaggctgttttcgaccaccttccccctctccccctcctcgcccctcgtcatggacgcctacatccctccgaagnantcctcaancgtaggaanccacttgattacnngttg

SEQ ID NO: 19517 - DNA, 1305 bp, Triticum aestivum
  Clone ID: PAT_TA_19517
ccacgcgtccgcgctccgcggcaagcgccgccgcgagaccgtctgctacgccgccaaggacgcgtcgtgccccgacggcctggcgcgcgtcaaccgcgtcgtccgcggcaacctgcgcctccgcctcggcgacctcgtcaccgtcgttccctgccccggcgtcaaggacgccgcccgcgtcgccatctcccccttcgaggactccgtcgacggcatcagcggcaacctcttcgacgcctacgtcaagccctacttcattggcgcgtggcggccggtgcgcaagggcgaccggttcgtggtgcacggccacatgcacgccgtggagttcccgcgcgtccgcgcgcgccccggcgggcgcgtcggcgtggcggccggcacgcaggtcttctgcgacgacgccagcccggtcaagcgggaggacgaggagaggctcgacggcccgggctacgacgacgtcggcggcgtccgcaagcagctcgcgcagatccgggagctggtcgagctgccgctgcgccaccccaagctcttcaagacgctgggcgtgaagccgcccaaggggatcctgctctacggcccgcccggcaccggcaagacgctgctggcgcgcgccatcgcggccgagtcgggcgccaacttcgtggtcgtcaacgggccggagatcatgtccatgatggccggccagagcgaggacaacctgcgcgaggtgttcgcccgcgcccgggcccaggcgccgtccatcatcttcatggacgagatcgacgccatcgcgcccaaccgcgagaagacgcacggcgaggtggagcgccgcgtcgtgtcccagctgctcacgctcatggacggcctccgcccgcgcgcgcaggtcatggtcatcggcgccaccaaccgccccaacagcctcgaccccgcgctccggcgcttcggccgcttcgataaggagatcgacatcggcgtgcccgacgaggtcggccgcctcgagatcctccgcatccactccaaggacatgcccctctcggacgacgtcgacctggagcgcatcggcaaggacacgcacggcttcgtcggcgccgacctcgccgcgctctgctcggaggcggccttccagtgcattcgccagaagatggacgtgatcgacctcgaggcggacaccatcgacgtggaggtgctcaactccatgtcggtgatcatggacgacctggtgcacgccaaggaggtgaccaagccgtcggcgctgcgggagacggggctggtggaggtccccaaggtgtcgtgggaggacgtgggcggcctggaggacgtcagcgggag

SEQ ID NO: 19518 - DNA, 967 bp, Triticum aestivum
  Clone ID: PAT_TA_19518
tagcgtggtcgcggccgaggtacgatctaataagcattgcttaaccgttgatgacctcccggccgccctcgcgtccggctcactgaatctactagcaacagttagaaaatggcacagctctcaaggtgtagttggctgtcaagaagagattggaaaaaagcgttatctgcaaatcatctcagagcattgtgtttgtcagggtgatgttagttctgtttcaagggattgtgcatgtcacttggaaagcagtgcagaggccgaagccagtaataaggagaggcattctctatgtggacaatcattaagttttttcttcaaggatggtgttttgatgccacaagatctcactgcagggaccacacttcattgcagctttaaaacactatgtgtttgctctctacctggaacgatttctatgctcgttcagatccccagttgatgtgatcatgcgggcagataaaaatacaatgtgttgtccatgctaaagatgccgcggtttaggatttttgctctgagctgacccacctccagttctgtacataccacaggagtagcaagtcttctgtttctcatcctcgatgcaacttcacgctagccttctgcaaataaatctcctttatcggttatggttgacagtggaatgcgccaatgcgggcttgcgtagtcggtgtgagatatggattggttgaagagaagtggagcaaatgatcttctgttaattaagtggctctgttatagacaaggactgctgttactgatgctggaatctgtagaactagatgaatgatgatgccttctcaaatctcattgtattatgtattacaactcaattaagccatcaagttgaaacaaggttgacaaatattagcagatttgggtgttacattcagactgctcactgactcgctggtatgctttgtaatgagcaaatagctttcagcaaaaaaaaaaaaaaaaaaaaaaaaaa

SEQ ID NO: 19519 - DNA, 865 bp, Triticum aestivum
  Clone ID: PAT_TA_19519
ccacgcgtccgcagatagagagcacaagatacatcttcgagccgagaacgatccttcgaatggagcttctcgtcctcacggcgctcaactggaggctccgatcggtcacgccgttcacattcatcgacttcttcgcttgcaaagttgacccgagagggaggcacatgagatacctgatcgcccgagccacacaaattattttagctgcgatacatgacatcgagttcttggaccactgcccgtcgtcgatggctgccgcggcggtgctgtgcgccgccggtgagacgccgtccctcacattgctcaaccctaggctcccggccggttgccccggtcgccccgcgcggccgggggtgagcagctgctaccaactaatgcagcagctggtgggtggaaagagggcaaaaaccacagcagcagcggcagttaacctgtgctcagacgaggttctgtcctgtgattcctcctcctgcaccaccccacccccacccaagaggaggaagaggtcacctccaccggtcatcacatgaaaacaaaggaacggcgagtagataaaccatcattttacatggtttttttgggggagggggttagattaacagagcttgattttgatttcttgctgttgttgtgttgttgtgattctttttcccatttgttctcttcttttggggttctttctttttacaccttggtgggggctcttccttgcttggccgtgctatcatggcggcccctgcgctgccagtctgtgaaggatgtgggaaatatcaaagaaagagagagggtcagagagaaacatgtgtgcttaccaccctgtggctatgggtcttcaccccgatgcagaactgcagaggatacattg

SEQ ID NO: 19520 - DNA, 561 bp, Triticum aestivum
  Clone ID: PAT_TA_19520
cccacgcgtgtcacaacgtcaccactcaccactcaccacgaggagtatctagctagctacgtagctccggcagagtgaatatataagctcactgagagctttggtaactcaggcatggacgagctttacgtccaggcgctggtgctggcggcggtggctgtggcgctcctgcagctgctgaaagcggccctgaacccgatgagggagagggcgccgccagggccgtggaagctgccggtgatcggcagcatgcaccacctggtgaacgttctaccgcaccgcaagctgcgggacctggccgacgcgcacggcccgctgatgatgctgcagcttgggcagacgccgctggtggtggcttcgtccaaggagacggcacggctggtgctcaagactcacgacagcaacttcgccacgcggcccaagctcctcgccggcgagatcgtcggctacgagtgggccgacatcctcttctgcccattcggcgactactggcgcaacaaccccaaacgggtggtcaccttccgcatatgacccaaacgcgtgcgctccttccgccacata

SEQ ID NO: 19521 - DNA, 388 bp, Triticum aestivum
  Clone ID: PAT_TA_19521
ccacgcgtccgtgcagatcctggccgacatgccaggggcgacgtcgatgaccgccggcacgacgcggtcggaggccaccgccgaaggagaagaggaggagcatcaggacgggccacaggactccccggcgcagcaggatctcctcagcatttagtggctgtacctttgtcgcggcccctgtaccttgtggtgtactcttcggaatgtggtggcgtgtccggatgcgtgtgcaggcatgtgctagattagtggtatgatgataatgttgtggattaattagaccggtgtaatctctgttgtagtgggtggtactggcttgtacaaagcggttagtgggtctcctctctccaatttgaatccaagcaattttttcctgaaaaaaaaaaaa

SEQ ID NO: 19522 - DNA, 652 bp, Triticum aestivum
  unsure (1)..(652): unsure at all n locations
  Clone ID: PAT_TA_19522
cccacgcgtccgtgtgtttaagccgcctcgcagaggctattactggagttattacatcatcacaagttctcaagagctagagtccgccctggcgcaccctctagcgcaaacctatccggtcgtgctcatgttctgggcgagctggaacgagccgtgcagggtgatgatgagacccttcagggccatggccgtggctaagagaagggcggccatattctgccaggtggacgtcgacaagttcaaagatatcgtggagcggtaccgagtggaggcgctgccgacgttcctgctgctcaagcaaggcgtggagaaaggcagggtcgtcggcgccaaagtcggggacctcagcaacatcatcatggccaacatataaataatacagtactactgggactagatccgatctgccgacagatggtctttctgtttggtatggtatttcatcaaccggcttcgttaggtctcctgtcgtcatccgtccctcctcttcatcactgtcaaatccatcactcttctaaacgctgctgatcgtcgtcaagaatacgtcaatacattagtgncacattgacataccactacggtgcaaacttgttcatcatgaggntacggntgggtaaaacacgtnnccataaggcgttaannaaaggccgnt

SEQ ID NO: 19523 - DNA, 906 bp, Triticum aestivum
  Clone ID: PAT_TA_19523
tcggcacgagcccgcgccgcgcacgccaccgcccgcgccagaagcgccgccgccgcagccccccgaggaggagaggagaggcgaggagagggatccggccggaaggttccgagagatgggagtcccggcgttctacaggtggttggcggaccggtacccccagacggtgtcggacgcggaggaggaggagcccgtggagctcgagcccggggcctgcgtccccggcgccccccgccgccccaaccccaacggcctcgagttcgacaacctctacctcgacatgaacggcatcatccacccctgcttccaccccgagggccggccctccccgaccacctacgacgaggtgttcaagtcgatttttgactacatcgaccacctcttctgcctcgtccgccccaggaagatcctctacatggcgatcgacggtgttgcgccgagagccaagatgaatcagcagcggtccaggcggttccgggctgcgaaggacgcggctgatgcggcggccgaggaggaaaggctgaggctggaattcgaggcggaggggaggaatttggtccggaaggagaagtcggaggcaatcgactcgaatgtcataactcccgggacgcccttcatgtttgtgctctcttcggcgcttcagtactacatacagttgagattgaatcactcccctgggtggcagtctgtcaaggtaatattgtccgactcaaatgttcctggagaggggggtcgcaggctctcgtcgtatttccgtcggccgcgcatgctcccggggtggggccccatcacaccccgtctcttatccggccgcggcgctgtcttcctcgggctggccctggcaccccccgtggcccacttcgccttgttgcgggtggggtcctccttgcccgggcaactcgtgag

SEQ ID NO: 19524 - DNA, 403 bp, Triticum aestivum
  Clone ID: PAT_TA_19524
ctcgcccacgtttccccggccggcacaggcggtcggcccacccggccccagcgcccagctctcgtccgcggacgcgtgggtgccggtgtgcggctgcggcgggccggagtgagcgaggatggggaactgccaggcggcggaggtggcggcggcggtggtgcagcacccgggcgggcgggtggagcggctctactggtccacccccgctgcggaggtgatgcgcgccaacccgggccactacgtcgcgctcgtcacgctcccgggtcgccgaggagcgccaggacgccgaccgcggcggcgcgcgccgcaccgtgcgcctcaacccgcgtcaagctcctcaagcccaaggagacgctccccctcggccacgtctaccgcctcatcaccgccaacaagtgacaag

SEQ ID NO: 19525 - DNA, 1274 bp, Triticum aestivum
  Clone ID: PAT_TA_19525
caagtacaggtgccctgagcagcgagaccaacattggcaatggcgtcctcaggagcgttcatggtagcggcggtgctcgggctggtgctcgcgtcggcgccggcggcgcgggcgtggagcaccgagggccacatgctcacatgccagatcgcacaggatctgctggagcctgcggcggcgcaggcggtgaagaaccttctgccggaggaggcgggcggcgacctgtcggcgatgtgcgtgtggccggaccaggtgaggcactggtacaagtaccggtggaccagcccgctgcacttcatcgacacccccgacaaggcctgcaccttcgactacgccagggactgccatgaccccagcggcgccaaggacatgtgcgtcgccggcgccgtcgccaacttcacgtcccagctcatgcactacaagcagggcagcgccgaccgcaagtataacctgacggaagccctgctattcctgtcacacttcatgggagatattcaccagcccatgcacgtggggttcacgagcgacatggggggcaactcggtgaacctacgctggttcaagcacaaatccaacctccatcatgtatgggacagggagataatactcacggtgctcgccgagcgctacggcaaggacatggccgccttccgcaaggacctccagcacaacatcaccaagggctcgtggtccgacgagtcttcatggaaagattgcgcggacctcatgtcctgcccaaccaagtacgccacggagagcataggcctggcgtgcaagtggggctacgacggcgtccacgacggagacacactgtccgaggactacttcggctcgaggctcccgatcgtgacgcggcggatcccgcagggcggagtgaggctggccatgttcctcaaccgggtcttcggagaccacaagccccacagccgcgacgtggctgcgccggtgaacttggtcgcggctcatgacgatgagctctagctcagcgtcaagtgacagtcgctgtattgcattgcgtccatgttgacctgaagacctgggcacgatgcacgatgatgcatcctaggagactactgctaacttgcatggaaatgatacagatgatcgggcactgaataattgtttgcgagcgccaacagctagcgtgtactccacatgtcatgtccaaagatgtagacatttatttggatgtaacccaaattctcttgtccttttgttttcaagtttgctcctattttaagttgcctgaatgaatcaacgtcgatacatttaaa

SEQ ID NO: 19526 - DNA, 660 bp, Triticum aestivum
  Clone ID: PAT_TA_19526
cgcctggttttggtgggcagagttttattgagagtcaagtaaagaaaatcgccgatttgagaaaattatgcgaagagaagggagtgaacccctggatcgaggttgatggcggagtcagtcccaaaaacgcctacaaggtcattgaagctggagcgaatgcccttgttgctggttctgcggtcttcggagctaaagactacgctgaagctatcaaaggaatcaagaccagcaaaagacctgtagccgtagcagcatgaagaaccggagtatgagcatgttacgctgtgtaacattttttttaccattatcgtggtttgcaatgcataggtgcctttcactgtcaagccatacgttgtatcacagagatcaccaccatcagatagggaaaaagaggcagcaaagaaagatatttttccttttccggttgtctgcgactgcgaggatgcgtatatcttgtactatgtccactccataacaagggcaacgaacgacgtgtcctgtgcgataacattaccgcgagctcaggattgttcataattaagcagcccctcctctcatctttcatctttgtaccatcagtccagtggtccatggtaattgaatgaagaaaaccttgctgatactacaaaaaaaaaaaaggctgcctttgatcctgtctac

SEQ ID NO: 19527 - DNA, 1459 bp, Triticum aestivum
  unsure (1)..(1459): unsure at all n locations
  Clone ID: PAT_TA_19527
cgaggagggagcgagagggagagagcgtgaggcttttggttggtggacccgcacagtacagatggcgtcgccctcctccccgctcggctccggccccggcttcgcccgcgcctgctcgtgcggcagcgcgagcgagttctggttggtggacacagacacacaagacgaacacggcggtacagatggcgtccccgtcctcgtcgctctgctccagcctcggctacccgcgcgccgcctccctcggcgcccgccgccgcgccggcttctcctcgtccaggaagctattccaagtgaaggcatcaagggtcgacagtttctccaagagtgacatcattgtgtccccttccattctctctgcaaacttcgccaagcttggtgaacaggtaaaagctgtggaggtggcaggatgtgactggattcatgttgatgtcatggacggtcgctttgtgccaaacatcacgattggaccattgattgttgatgctctgcgtccagtgactgatcttccattggatgtgcatctgatgattgtggaacctgagcagcgaattcctgattttatcaaggcaggtgctgatattgttagcgtccactgtgagcaaacggcaaccatccatctgcaccgaacagtcgatcagattaaaagtctaggagcaaaggctggagttgttttgaaccctgggaccccactcagtgcgatagaatatgtacttgaatctgttgatctggtattgattatgtcagtcaaccctgggtttggtgggcaaagcttcattgagagccaagtaaagaaaattgctgatttgagaaaattatgtgaagagaagggagtgaacccctggattgaggttgatggtggagtcagccccaaaaatgcctacaaggtcattgaagctggcgcgaatgcccttgttgctggttctgcggttttcggagctaaagactatgctgaagctatcaaaggaatcaagaccagcaaaagacctgtagccgtagcagcatgaagaaccggagtatgagcttgttgttacgctgtgtaacatcttttttttcttcaccattgtcgtggtttgcaatgcataggtgcctttcactgtcaagccatacgttgtatcacagagatcaccatcatcagatagggaaaaagaggcagcacagaaagataattttccttttcccagctatctgcgactgcgatgatgcacatatatatcttctgtactccctcggtttttatttacttcgcatataagagttgactgaagtccaggtattgttacataattaagtagcccctcctctcataaaaaaaattacaaaacaactatacaagtgaaatatattgaaaaaaaggggggccggtaccaaatcgcctaagtgatctantaccgcgctcacggccgtcgtttaaactcggactggaaaanccggggtaccacttaacgcntgagaaaanccc

SEQ ID NO: 19528 - DNA, 882 bp, Triticum aestivum
  Clone ID: PAT_TA_19528
tcgcgcgcgacggcggatgccggccacctcccctaacccttaacctccccagtccccacctcgccggccaccgcctccgcacgagctcgacggtgcacgcccgcctcctctcctcttctctgcggacgtcgctcgccgtctctgttccctgccgatctcacttcaccatcgacaacaggcccgcgtatggcggccagacgcaacattccttattctgttcttcctacggaggacagggatgaggacaatattgaccgtcggttcacatacaccccaaaatccttgaggaggatcccgtggaagtcgattgccctagcattattcctcctcttcctgggaagctctcttctgttcctttcgtattttatattcacaggtcacatggagggtgatagcactcaggtgtatggtctattgttcctgggtatccttgcctttcttcctggattttatgagacccgagttgcatactattcatggagaggagcgccagggtatacctttgcgtccattccagattattagcctttgattgtaactcatcgactggccagtaaatatattgaacagcaaaaacaaaaatatgaagcttcatcgcgaatggaatgagcacgtgttgttatgttagtactacaaatagtcaacatgtatgtgaagccaccttctgctgactctattgtcacataacgatgttgtttcgtgaggcaggcaagacgtgctgcagtgctaaagctgctcccttgtgctttggttgcttgttcattgctacgtagattggtttttggagttacttgagatatgattatatagcatgttaatctacaaataattcttaggggtttgttctgttttgcttgctgaagtatatattaccccaacttt

SEQ ID NO: 19529 - DNA, 1012 bp, Triticum aestivum
  Clone ID: PAT_TA_19529
ctcatctctgatcgttccccgcacctctccgcccctcgcggacctcacctctcccgctgcctctcacgtaggagacctcctccagtacgcacccgccggcaagggcgtgcccgccggtggccggcgacccacttcaaaggagcacgaacagcagtctggcggccagacggaacattccttcttctgttcttccggcggaggacagggatgaacgacaattctgaccgcctcctcactcatactccaggatcccggaggaggctcccgccttagcactgttccccctcttcttgggcagccccctccttgggcattctcttttttcttcctcggatattttgaaggacaatagtcacctggtgtgtggataactcttcatgtgtatggtcgcctttccctggggattccttgccttccgagttggattctattcatggcgaagttcgcatactttcacattggcagggattcccagaggttcaccttttgaatgccattccacgactattaggtatgcgaattctacatcaactaccgggatataaaggtttttagcagaacgagctagaatactattgttatttatgaacgacaggaacacccattgttgttgatgtcctattattagcttaatatgggacagtaccgccttgctgcttcaggtaacctaccggtgtgctgcaaacatgaagcttccccttggcttggattgattacgctgttcttgggcttgctatgtagattgaacttctggagttacccaagatagtactgacacgactgaaacacaacaatcttcgtgcctagtgctagcgcttcgtgctgctttgcgtgttgctggctcccctggtgcccccggtcccccgcgctcctgccttcctggttctcggggttttgggtgtctaccttgaccgtagtgttgtcctataagctatgttctgtccgtcacaatacttttcccgttggggccttggtcccgggtggtggcctggccgaaaaataaaaaaaaaaa

SEQ ID NO: 19530 - DNA, 809 bp, Triticum aestivum
  Clone ID: PAT_TA_19530
ccacgcgtccggtacaaatcccagtcatgagcgctctcctcgattcttcttccccaaatccctcacacgacaccacactccctccgtaccagactagggtttctcaccggcggcgggatgggcggcgacgcgacggagattgccatcctccacgcccccgggccccaggagatggcctcgctgccgatccccgacgagctcctgcctgaaatcttcctccgcctgcccacccccgccgacctcgtccgtacctccgccgcctgcgtctccttccgcggcgtcgtcaccgaccgccccttcctccggaggtaccgcaagatccacgccccgcccctcctgggcttcctcgacctgaacggagtcttccaccccgccgagccgcctcaccccttcacttcggcagcagaagccttcgccgacttcagcttatccttcctccctgccccagccagcgactgggccattcaagacatccgcgacggccgcgtcctacttggcaggcgcggcgtcttcacggagtttgtggtatgtgatcccttgcaccggcggcacatcctgcttcccccaatccctgatgtcaaccagtggcttccttcagtggacaactcacatatcttcctcatgggcggcgatgaggatgcttcggacgaaacatttttcagagtgatatatgtggcagtcaaccaacataagcaggtcgccttggtcttctcttccagcaccggacaatggcgagccactcctccatcaatagtgcgatcacctaactcatactggctccagtgtgcgtatggctgcttgtatgggtt

SEQ ID NO: 19531 - DNA, 791 bp, Triticum aestivum
  Clone ID: PAT_TA_19531
gtctcgtgtgggagggagggagagtgaggaccaagggtgcggaaggtgggaagaagcggccgcccaccaacgctggctgagctatccctcccgcgcgtcgcctcccaccccaccacgcacccgcacgcgcctcctcccccttcttctacccccctcccccgccccttcacaccatcacagcccaccccaccgcgccgccttctcctagctccgacacagcggcagccccctctgcgcagagtcaacaagtcaagcctttctcaagcccagagcagggtagacgcccggcctgaccagctcggggcagcaccctcggcctccggtgatagccactagccagccgcgtctcggcgaggaaacagcgggagctggctcaagcgattgccggccggcgttctactactatgaggaacggcagcaccgtgtgcgacgcggcggcggctgtgggactgggcgtggcgccgcggtacaggggcgtgcggaagcggccgtggggccggttcgcggcggagatccgggacccggccaagcgggcgcgggtctggctcggcacctacgactccgccgaggccgccgcccgcgcctacgacgtcgccgcgcgcaccctccgcggcccgctcgccaccaccaacttcccccacgacctcgtctccttccccacgctccccgcgctgccgcgtccgtctccaccggcttcccccggccccgcctgcagcgccagctccaccgtcgagtcctacagcgggcccagggcggcgaacgcgcctccggccgtgccgcgcgcgccagcg

SEQ ID NO: 19532 - DNA, 596 bp, Triticum aestivum
  Clone ID: PAT_TA_19532
ccacgcgtccgaattcttgtcgagacccagccaacgatgtccatggcggcgacccggatgctggcgcgccgcgccgcccccggcctcctccgttccgccgccagccccggcctcgcgctgccggcggtgctgcaggcgcaaggacggtggtaccgcgcagcaggaggggacccgtcgccgtcgttctacgagccgccgccgaccccggcgaacctgggcctgagcatcgtcccggagaagaaggcgtttgtggtggagcgcttcggcaagtacctcaagaccctgtcgtcggggatccacctcctgatgcccggcgtggaccgcatcgcctatgtgcactcgctcaaggaggaggccatccccatcccggacaactcggcaatcacaaaggacaacgtctcgatacagatcggaggggtgctatacgtcaagatcgtcgacccctacatggcctcttacggcgtggagaaccccgtctatgctgtcatccaacttgcgcagacaaccatgaggagtgaacttggcaagattaccctcgacaagacctttgaggagagggacacgctcaacaccaacattgtgaagtcaatcaatga

SEQ ID NO: 19533 - DNA, 603 bp, Triticum aestivum
  Clone ID: PAT_TA_19533
ccacgcgtccgtacaaggtcatgatttctgtggctgaaagcgaaccgattattctttacataagggatgttgaccacttccttcacagatcgcaaagaacttacaccatgttccagaaaatgttagccaagttatccgggcaagtgctgatactaggatcccggctactcaactctgacgctgagtacagcgatgtggacgacagagttagtagcctgttcccttatcatgttgcctccgaacccccacagtgaagaaatccatctcaatggttggaagactcaaatggaagaagacgcaaggaaaattcagattcaggacaacagaaaccacatcgtggaggtactctcggcaaacgatctagactgcgatgatttgagctcaatctgccaagcagacactatggtcctcagcaactacatcgaggaaattatcgtgtcggcggtctcttaccatttggttcataccaaggatcctgaatacaaaaatgggaagctccttttgtcttccaaaagtctgtcccatggattaagcatttttcaagaaactggccttggtgggaaagacacgctgaaactccaagcgaacgaggatggtctgaaa

SEQ ID NO: 19534 - DNA, 514 bp, Triticum aestivum
  Clone ID: PAT_TA_19534
atcctcaaggaacaggagatggcatctctccctgtcccgagtgtgcaggccatggtggcggccaccggtggagccgacgtgtcgccaaggtatctccgtccggcagaggcggtcgctggcgacagcgaggcccagatccccatcatcgactaccagaggctgctgctggagctggagctggaccgctatggcgaggagtctgcacgccttcacggggcctgccaggactggggcttcttccagctgattaaccacagcgtcccagacgatgtggtggagggaatgaaggccagcatccagcagttctttcagttacccatggagacgaagaaacagtttgctatggagcgagggcagctggaaggctacggtcaactattcgtcttctccgaggatcagaagctcgattgggctgacatactttacctctacacacaagccacatgagagcaggaacaccaagctctggccagacaacctgccaattaaatttcgatgcttaatagacgggcct

SEQ ID NO: 19535 - DNA, 1161 bp, Triticum aestivum
  Clone ID: PAT_TA_19535
cggacgcgtgggctcgaaccggtaacgcagcatcatgccgcagcatcaggcgattcgacctcgcccgggcgccggcgacgccgacgacgacgcggtgacggtgttcctcttccacttcctcaactgcgcggtcctcaccttcggcccccacgtcgtctactactccgccacccccctgtcagagtatgacacgattggcaccagtgtaaaagcagctgttgtttatcttggagcagcacttgtaaagcttgtttgtttagcaacgttcctcaaagtacctgatgcgaatgatagctttgatccctaccaggaattaatgaaaattctaattgggtttatagatgttgctggcctttattttgctttgacacagttgacccacagaaacatctcccagaaccataagttccaggctgttggtcttggctgggcttttgctgattcagttctgcacaggcttgcacctctctggattgagggcacgagggcttgaattttaccttggggagtacatattccaaggacttgaagcaaatgccaatcttgtgatgaccctctcccttgctgcattaggatccttgatgtggctgaggaagaacaaacctaggactttaattccaataatttatgcatgtgctctgcttctggcaacaatgccatctatcaccagttacttgggagtggcagactcccaaggtggtcggcttccgaggtcttctcctccgctggttatggctttcatcagctggcagctgttctcggcttgccagaggccgatgtgtaatcaacaagaacaaagcactgctagctttaaccggagatcgggcgctcccgagatgtctcttttttggtacttggggcaaaattagaatgctgcttagagccttgccactaccataactattttttgagggttctttagcagaacgttttacttatttgtctgctatagtgcagaaacacatgatctaatgagcgccactgtaacaggtgctcttgttaggaatcgagctaaaacgtagcacctttattccctgttctgtgtattgcatattctgctcaatagcattgcatcttctagtctgaagccaggacattcacagatttacgagaaaatacaccatccgctgccgttacagactttgggccgccactaaacgc

SEQ ID NO: 19536 - DNA, 646 bp, Triticum aestivum
  Clone ID: PAT_TA_19536
aaaaagtaggctcaacgtcgagagaaccaaatgtatgcaagagatagtatctggatgctggatacaacccccatgcacatatgaaggcaatatatgaggtttcttttcgatcatgggaagaatgataactatgaagagcgagaaacaaagggctcgagttgcttcgaaactgcatttaatattagtacttgtaatttaagctttacgaatcttgctagaaactaacaaagaaaatttttatgtacaaggtgaacacaccacgggagttccacgctagcaagatctacactcgagctatgtttgagaattttggtgagctcctgtatgaagcctaacaatacagtatagaagttaaaaattggtcgaaatatgacttacaccggacaatccaggggtgaaagttaaaaatggttcgagaactctacatactacatactgcatgtcgtcgtacgagatgtagtgtagagtactatacatactacatagtgcatgtcgtcgctgaggatgaagaactctcatgtgaactgtggtaacttcaagcacacatgactgtatcctgccgttccctcaaggggcgggctttcgtggctagagacatacttccatcccgcctgtccctcctacaaagagacaagatttcagccaa

SEQ ID NO: 19537 - DNA, 714 bp, Triticum aestivum
  unsure (1)..(714): unsure at all n locations
  Clone ID: PAT_TA_19537
ccacgcgtccgacccaaacaacccagcccacaggcgcccgagcaccgccgcagattccgccggacggcgacggaaaccctcgacacaggcccccaccgcccctcccccgccgccgcaccgcgccgccgcccctcccccattgcccgcccgcgccgcgcgcatggccgcctcctactacaacccgccgcctcccagggcctcctacgctaccctgccccctcccccgccgggcacctcctcgtacggcacgtaccgccagcacgagcacgcctacctcgcggcgcacccgccgcccgcgtacggcggctacttcgaccgcgcggagcccctggcgccgccgcgcgacgagctgcgcaccctcttcatcgccggcctccccgccgacgtcaagccccgcgaggtctacaacctcttccgcgacttccccggctacgtctcctcccacgtccgctccggcaaatccacccagtcgtatgcgtttgctgtgtttgcagatcagccgtctgcgctagctgcaatgagtgccacaaatggattgacatttgaccttgagaagaactgttctatccatgtagatcttgcaaaatctaattcaagatcaaactcatcaaagcgccccaagatcagattatgaggatttcccctaaatctactggggaaaaaaggtaanaatnccaaaggggaacgtccttgaattcaagtggcctggaagaa

SEQ ID NO: 19538 - DNA, 656 bp, Triticum aestivum
  unsure (1)..(656): unsure at all n locations
  Clone ID: PAT_TA_19538
aggtggtgatatcatatcatcattctcaacagtcaacactgcccgccccactcaccacatccacaacaagaacgccatgccaaaagctttagacgatggagctcatcaccttgctacctataacctatagctagtgcggcctaagactgctgccattgaggagcccgcgacttcatctcactttgcaaggctggagcgcgcgcgccgccgccgccatgcagctcgccgctctgtgcaccgaccccttcgtgctctcctgcaccctcctgtgcctcctgctccacctagcgctacgccactccctgaaccgcagctcccggctcccgccgggacctccgggcgtccccattctcggcgccatgccgttcgtcggcccggccccgcacaccggcctcgcggcgctggcgcgcaagtacggccccgtgatgtacctgaggatgggcacctgcggcgtggtggtggcctcgtcgccgtcgnncgcgcggacgttcctcaaggcgctggacgcgcggttcgcgaaccgnccggcgnnnnccagcgcggcggacatcacgtacgggcgccagaacatggtgttcgccgactacgggcccaagtggaagctgatgcggaagctgtcgagcgtgcacctgctcggggcgcgcgnnntcgcgnan

SEQ ID NO: 19539 - DNA, 1035 bp, Triticum aestivum
  unsure (1)..(1035): unsure at all n locations
  Clone ID: PAT_TA_19539
accggtccggattcccgggtcgacccacgcgtccgcaagctgcgggctgcgtctgcgtcggcgccgtggcggctgcagcctagggtttagcgcggggagaggggaagctagggtttgggtccgacgagttggggcggcgatggggacggcggggaagggcgcgtgggtcgtgccggcgccggcgtacaaggaggtggaggggtgggaggggtcnnnggacnactcgccgggctacaggtgcggccactcgctcaccgtcatcgcccccaccaagggccacggcccgcgcctcacccgccccggcggccccgcgccgcccgcgccccccgcgacctccggcctccccggcatcaggctcgcgggggtgaccaacacggtgcactcgtacgacgtggacaagcggaggtggacgaggttacatccagctggagatcctccttctccaagggctgcacattctgctgctgctgtgggcaccatggttgttttccagggtgggattggaccagcggggcattcgacagacgatctctatgtgcttgatctgacaaacgacaagttcaaatggcaccgggttgttgttcagggggctggtcctggtcctcgctatggtcattgcatggatttggtagcgcagcgttaccttgtgtcagtctcgggaaatgatggcaagcgggtcttatcagatgcttgggctttggacacagctcagaaaccatataagtggcagaaacttaaccctgatggtgatagaccttcagcaaggatgtatggcactgccagtgcacgctccgatggcatgcttttactttgtggtggaagggatgcttctgggacgccgctctctgatgcttatggactacttatgcatacaaatggtcagtgggagtggactctggctcccgggatatctccatctccaagatatcagcatgcagctgtctttgatggtgctcggctgcatgttactggaggtgtccttagaggagggagagctattgaaggggagggtgcaattgcagttctggacactgc

SEQ ID NO: 19540 - DNA, 819 bp, Triticum aestivum
  unsure (1)..(819): unsure at all n locations
  Clone ID: PAT_TA_19540
accggtccggaatcccgggtcgacccacgcgtccgatgctagaagagtgaagagctgatgagaaagcctggagtacagagttgaaagctattggcttccagcaagttcgaacaatgcagcatcttacactagcagcatctctgtctgctgctgttctctttgcatgcatcctgtatgctgaaagtgcccctcgcgtccccgacaagcaggctcttcttgccggtgctgcatccctgccccatggcaggaagctcaactggagctccacgacacctgtctgcacttcttgggtgggagtgacatgcacaccggacaatagccgtgtacacacactacggttacctgcagtaggactctttggcccaataccctcggatacgcttggcaagcttgatgccctggaggtgttgagcctccggtctaatcgccttactgttgacctccctcctgatgtaggatctattccttctcttcattccctctacctgcagcataataatctgtctggaatcataccaactacactttcatccagcctgacattcctagatctgtcctacaacacttttgatggggaaatcccattgagagtacagaatctcactggacttactgcaatccttctccagaacaactctctttctggacccatccctgacttgcgtctccccaaattgaggcacttgaatatgagcaacaacaacctcagtggtccaataccaccttccttgcagaaattcccagctagttcattcttnnngaatgcttttctgtgtgggttaccattaganccatgtcctnnnnccgcgccttctcctt

SEQ ID NO: 19541 - DNA, 686 bp, Triticum aestivum
  Clone ID: PAT_TA_19541
ccacgcgtccgatccagacgaagttaaagatagcgagcgcccaaccaagattaggcttccccagccagatgatcacgtcagatgctccaccgccataaaagaaagcgtccgcgatgttgtactcggaggaggcgaatatattgtgaacgacctgaagttcaccgtcaaccacgcggtggagccgatcaacgagaagatccaccagatatcgcagaacatgaagaagcatgataaagacaaaacaaacgacgacagctgcatcgactcgccgcgatccctgcacagggtgatcagtgggatcgacgacccgctcctgaacgggagcctcagcgacaacagcggccccaagagagcgcggaggcagcagcgcaggaggttgggtgcggtgatcagtggcgagagcagcgaccatgggctgggcgggtacgagatccggggacacaggtggatcacgaaggagtgaggaggatcaggatcgaagcccggtctgcactgcagcatcgaatactttccgaactgaagcgctggctgctctggatcttcaggactgctaaagcctgaaaggcagtgatcagaccacctaagttcttgatgaatctgggagtcggtgcttgcagaagcaagatatgtgtcatcacccccacgacatggcgaatcgagctagcgatttttttggctgactattt

SEQ ID NO: 19542 - DNA, 787 bp, Triticum aestivum
  unsure (1)..(787): unsure at all n locations
  Clone ID: PAT_TA_19542
cgattgggaggcaaaagctgatgctcgggatgtcccntagtgatagcaggattgaatttccaaggcaataaagcttgagacttgatgttgaggacaaacccccgcgcccgtgacacttgaaataagagttgaccggagggcgcatggtgatttcacaggtgatgttgtcaaatcggataaggatagccatcctactggaacttcatgcatagcctgggaaagataataaagaccatagaggtaaaagatgtgttgatcagccagatgatactgcaggatggcgttttcttcgtcctggtatgcaaggcactgatgaaactctcaaggttcaaactattgtggaagagcgcagctccaaggatgcacatgaatctactggtgagaataaaatagaacctaaaagtgaagataagtttagagacaaggacaggagaaagaaagatgaaaaatacagagattttggtgcaagagacgctgatagaaatgatcgcagaattggtattcagcttgcaggtggtagtgttgaacgaagagaaattcaaagggatgatcgggatgctgaaaaatgggacagggaaagaaaagattcccagaaggacaaggaaaacaatgaccgcgagaaggattctgccaagaaggattcatttgtagcagttgacaaggagaacacaatactggaaaaaactgcttctgatggagctgttaaacctgctgaacatgagagtacagctgctgaaatgaagacacttaaagatgacacatggaaatctcatgatagggatcttaa

SEQ ID NO: 19543 - DNA, 1190 bp, Triticum aestivum
  unsure (1)..(1190): unsure at all n locations
  Clone ID: PAT_TA_19543
ggaattcccgggtcgaccacgcgtccgcggcattgggcgctctaggagaatgccagttcctaaagttacgatgcagcataacgtgatgattgaggctgttgcaaaatcacatgcgcggaagttattgtgatcgatgagattggtacagaacttgaggcaatggcagccagcaccattgctcaaagaggcgttcaacttgttggaactgctcatggggtgacaattgacagcataattaaaaacccttgcctgcaaatgcttgttggtgggattgagagtgtgactcttggcgatgaagaggcaaagaagcggaaagttcagaaaacaattcttgagagaaaagggcccccaacattttcatgtgctgttgagatggtgtcgaagactgaatgtcgagtgcatcacaagttagaatctacagttgatgctattcttgcagggaagcctcccaagtttgaagctcgcatgatggatagcaagatcaccgagtcaggaggatctttggtgatatctgagagagtgtctgaaacagagcgcttacctgcgtatcatcaagatctggtcaccagggcggttacatcagaagataaattcatcgatgattttggttcctccaggcaagcaaaaagcaagaacatcccatcagacgataatgtcaatggagattttggttgtcaaagaaaacaaaaggcaaacaatatgtgtctggaaggctccagtccgtgtttacacttaccaggtttcagaactgatatcttgcaagtagcaacagtgatgggttttgagggatgaattggacataacagatgacattgaagcagccatgtgattnttgcgtcaagttctgaaatgaagcaaatccgnggatccgnaatgttgccaagtccacaagcttctatntttgttgttaaacaaataccatggctcaaatagtaaggctgcaaaagattgttggaagaataacttgtgcncccgcccgcagcactaaagtttggaagngaataaaattgaaatatctccaacggancctcttgnggaattgtgcttggggngnccgttgcattgatcattgatccagnggggccgnactctcagggtaaatttntttnntggcttnaaagtcaatctncnacttgacnccattngggnntttcnnaaaanaaaaantgnnngnctnggcncnccnaaac

SEQ ID NO: 19544 - DNA, 1259 bp, Triticum aestivum
  Clone ID: PAT_TA_19544
accggtccggaattctccggtcgacccacgcgtccgccagcctcggcccccacgattctacgacgagccgcaagtgttatggccaagcactgcaaccccctctaagtatcaaatgaagtatggaattggctgttctactgtaacagttttcaacttggctgcataggagacaggatcttagtattgacgcttcttatggcaatgtctgcttgttggtttaccctttttggcatttaatgtggatgccataacaactcagttgctgtgcaattggtgaaccctgacaaggttggagttgtgataagtggcaaacaaggaagggctgcggacctgaattgtattgatgcagctgtggttacatacttgtccgagagctacaagtcttgttgaaattaacatgacacgtggatacctaggaattcctttaatatgaatctgagttgtgtcttgttgcatcaatacaacctgaccaactcctccatttttgagtatttggcaattctgataacttcacaatgagttaagtcatgagctacattttggaattagcatcatggcgttcgtctgaccatcttttcaataagttgatggagatttggttgagaaaaatgcgctgcagataccggaataaagtacatcagcaagtgcagcagttgatatcaccaattggtacagggacttcaagcattagggatcatccattggttatgaatatgaggagtcacatcttgccacgatcaattgttggacctgaccaactgctccattttgaccttttgagacaaggagagtcctgttgaactcgaggtagtgtccaaggaagccgtggtcagtgttttggcgctgcctgaggttggggtgtcaacatctatctgcgctgggtctcgttgcaacctgaccaactccattttgagtatttggtaattctgataactttacaatgagttaggtcatgggatgcattttgggagtagcatcatgatgttcttttgaccgtttccccaacaatttgttggagattcgattaaggaaagtgcgctgcgaataccagcatagagtccatcagcgagtgcagcagttgatatcatcaatcggtacagggacttcggcattaggcatctgcatgatgtttggatactgaattgtctactttttgatatggaccactgatatttcattgtccaagaccctatgtgctagtaagattgcgagtttgtttgatggtaaagagaagattgaagcagacagaccacttggta

SEQ ID NO: 19545 - DNA, 671 bp, Triticum aestivum
  unsure (1)..(671): unsure at all n locations
  Clone ID: PAT_TA_19545
ccacgcgtccgaacccaaccaaatcctaactctgcaactgcaactcaccttgctcgtccccgttgccggcggcagcgtcgccgccgcgaccgtatcccttcgccggcggggcgcgaggccctgacctttccctccgcgctgaagacgtgcggcttggccgtgccaccgcgttctcgggagtttggatcttggctgtcctcgtagccgcccccgcatccctattgctcgtgcagtcgtgctcctccgaattcgccggctgccggtgtcccggctcggccacagcccgcaggaccatggtacaagaacagaaaggagaaacatccagtggcatgtatacttacaagcatcatggtgacaagggagttgatatccatgagattttcgttaagaagagcagaacccgtgttctgctgtcatactgtggcctcattttacttctagcaattgtctgccgatcattgctgggaaaggaaaagttgtgtcttgagtcagtgtggagtgttacctttggaattctggttgccaaatgtttgcaatacaaaccagtgaagaaagagtcagtagtgataatgccatcttttggggttcagctagaaatacatttnttggagcggaagagttgatcgtcattttgtgccaattggcaagattctaaagccactgctgaacga

SEQ ID NO: 19546 - DNA, 1106 bp, Triticum aestivum
  unsure (1)..(1106): unsure at all n locations
  Clone ID: PAT_TA_19546
ccacgcgtccgnntatccgnnnntatatgaggcagggctaattaaaggagagcnnnaatattacactcttctggatcacaatgctannnnccttgtggcaaagccttgtccttttccgggcccctttcttcccgtcgacccacgcgtccgtggacatatggagtatgggaagtttatggacaattgcggtggttatactggtcaatattcatctggccatggacattcaacgttgggtgcttataacccatctcgccatatggggctctatagctgcaacgtttttgtgcatggtgttaatagattctatacctatattccctaattacgggacactatacaatatggctgcttcaagaacttactggcttagtgtttgccttataatagtcttggggttgcttcctcggtttctttgcaaagtaatatatgagaccttctggccatctgatattcaaatagcaagagaagctgagttgttaaagaagctgcctcaacagttgcgatcaaggcctgaaagtgatatcagctaacaatggttcatgcagttagttcgtcacccagtttgggaactgtgttgattcatttgttgagctgatcttttgttaaaaaaagattatacatgaggacacaagttagcaaggacaagagatactggttgtagaagaggctgaaaaatgcactgaagcggcagttgcgaagaactaactgtacggcgaggcatcaaacagcttcatccttggggggtgtggactagtgatcaatcagatgacaaatgtacagataaggggggaatgatatatactctgtaatttaagatagagttgtgtctaggaggaaataaagaggtacatagatacagattcttttcgcactttgccaaatcttttgtattacctgacgatatgttaaccatttcccttttcttccccctcgttgaggttttaggtagcttatagtggtgtgcccggttggaattttacgctttaaaagggtacaggataaattttcctaagtgagatccagaacttcagaaatttgagtccaacattggaaatgtcgttctagcccttctttggggggtaatttcaaaaaaaaaaaactcg

SEQ ID NO: 19547 - DNA, 921 bp, Triticum aestivum
  unsure (1)..(921): unsure at all n locations
  Clone ID: PAT_TA_19547
ccgcgcctccgccctgcgcccggcccggttcttccctcccctgcgtctcgtgtgccgcatcgcctcgatcaaggttgtttcgacccgcctagctcagaatacgtttcccgtttagatatgctttatgattttaatctgggtttacgattttggtatgttccaatctctctaagaggttaggagcagcaaggatttgaaactttgacgtgaatcttgtagaaacctcagcgttttacacgcagctaattgcatctttccttggctctccctccccatccgccgctcggcttcgattcttctcagaaccttcctgcaagactttgtttcatggcttttctaccggcgcggttctaatctcctctgcgtctatagaattccagtctggatcaatattaggctttcagtgcgaaggaaaatatctccttcacaggaatgccggaagatgtgcatgcgtgctagagggctaccttggttgggaactggcagtctagcttttgaagatactgaaatacaacagttgctccatgggcatacgcaggatgatccatggaccacctaccatcttggtgaagatggttgaaacgaattgatcatctgcaggtcttgtccacatcattgagtgcccctgatcagttctgatcacctcaagttacaacatcactgccttttgtgtacataagatctggccaggatggcagagaagaagggaaatatcttgatggagagatatgagatgggaagactgctggggcaagggagctttgctaaagtttactatgagaggaatctcaagacttcacagagcgttgccatcaaggtgattgacaaagaagagatattcaagtgcgggcttatggatcaagtaaggcgagagatatctgtaatgaagntggtgaaacatccaaacattgtccaattgta

SEQ ID NO: 19548 - DNA, 545 bp, Triticum aestivum
  Clone ID: PAT_TA_19548
tcgacccacgcgtccgcgccgtgaggtcctgcctggcccgggacgctgtcccgatgtcccccgccccgctcctcccttacttggatacccttttgcagagcttggaagatggcctaggacaattcacttctatggactgggcaaataaagaggcaaagctctccagctcagaggatggcagccagatttttgaggctgtggggttgttgatcggtattgaagaggtatcaccagagaagcaggttcagtgcttgacagctttgctgaatcctctctgtcatcagatcgagtcgcttgttatgggtgccaaagcacaaggacttgaagaatcatccccgagagctacaagtcttctacagattgttgttgcattgaatatggttaccaagggctttaatgaacgcctcgtgatgataagtaggccaacaatcggtgtaatgttaaaaaagacccttgatgttgttctacaactccttgtttcatttcctaatgcgaggcccctgcgatcaaaggacatatcctttctgcaccgcatgattgagata

SEQ ID NO: 19549 - DNA, 686 bp, Triticum aestivum
  Clone ID: PAT_TA_19549
ccacgcgtccgacccgatgcgcctctgaagtaggaccactccagtcaagtgtccccgtggagcctccgtctccgtgccctacagctgctgccgtgccgtcgctcgacgccgacgcctcacagcccgaccccaacccctccgcgcgggccgccgccgtcgccgtccccgttctacttcgcggcgtccctgccgcttcggccattggcctctgagatttcggtcttcgaggagcgacagaggcgaaatggagacgaatgagaagaacgctaatgatttggaggagaagaaccagcccagcgggcacagccagcagccgagcttccacgggccggggttctcgctctcgccggaacctcagatggattcttccagcagtgcgctggccgccatggggaacccgttccctcctggcttatggaacccacctggccagaacttcgggttgggggagaccaacacgaacgctatgcttaatggacacctcccccccgcggccggggggatgctgtcagacagcgacgcccgcatatcccggacgccccgtcggggttcatggattgtggaacacgggtttcctggcttaagtgcatatcagtcttggagccatgatggatcaccctttttccaggaaccctcctatgggtagtttccagaacgatattgagacgtctagggagatgaatgtg

SEQ ID NO: 19550 - DNA, 786 bp, Triticum aestivum
  Clone ID: PAT_TA_19550
ggtcgacccacgcgtccgcaggacatatttaatattactgcaaaggccgtgagaggagatgaggagtcagttgcacttcaggccattgaattttggagctccatatgcgatgaggaaatcgacattttggacgactacagtagtgagtttacagctgattctgatgttccttgctactattttatcaagcaagctcttcctgctttagtgccaatgctgctggagactctcctgaagcaggaggaagaccaagacttggatgaaggtgcttggaaccttgcaatggctggtggtacttgtttgggcctggtggcgaggactgttggtgatgacgttgttcctcttgtgatgccttttgttgaggagaacataacgaaacctgaatggaggcaaagagaggctgcaacatatgcttttggatccattctggagggtccatcagctgataaactggcccctctagttaacgtagccttgaattttatgttgtctgcgctgttgaaggacccaaataaccatgtgaaggacaccactgcttggaccctcggaagaatatttgagtttcttcatggttctgcgcttgaaactgctcctgttattacagctgagaactgccagcaaatacttactgtgctacttcaaagcatgaaggatgtcccaaatgtggcagaaaaggcatgtggggcactctatttccttgcacaaggctatgtggatgctggatcggcgtcaccattagcccctttcttccaagatattattcagagccttattgtgaccagtcac

SEQ ID NO: 19551 - DNA, 522 bp, Triticum aestivum
  Clone ID: PAT_TA_19551
taccggtccggaattttccggtcgacccacgcgtccgggggacaattcacaatgtagtctcttgttccaccaaggaggagagcctcttagcaaagcaccagctgctcttctccctggttgcgtgtgtgtgtagagtttcatgtgtgggtgtgtgttcttgtgagaagatagagagaaacaaccagagaaagagagagggagctgtgagaggcagcaccaaggtagaagaagagcggcgctgcgaggaggcggcgccaacagttacagctacaatccttgacttcttgaacggaggggagctgccattgggtcttaactacacggttatcactcttattcccaagatgcgaaaccctcaaataatttctcaatatcgaccaatatctttgtgctcggtcatgtataatattgcagctaaggcaataaccaacaggctacgtggtctgatggatgagattattggggaggaacgaagtgtttttgtaaaaaaaaaaaaaaaaaaaaaaaaaaaaaaaaaaaaaa

SEQ ID NO: 19552 - DNA, 1438 bp, Triticum aestivum
  unsure (1)..(1438): unsure at all n locations
  Clone ID: PAT_TA_19552
cccacgcgtccgcacggcggacatcgcgcggtgcgcactctccctccctgctcgacaccgtgccggcgcccctccccacctaggcagcaggacggcgacgcccgacgaagcctcggtctcccctgctcgacgccgggcggcgcgtgccgacgccctccccgtcgtggccagtaggacggcggcgctcgacgcccccgtcccctccccgctcgacgctccctcggtctcccctgctccgtcggcgcctcggattggtacctcggcgtcccgatccgcctgaggtccgcgtcttccgagtctctggtgagaaatttctcaagctgcacaccaggagctggcacgtctggccggtgttcgatgcagatgcggtggatttctataatcttgaactgagcagcaccaatttgattcatcccgttcgagccccgcttcctcagaacctccccaccaccgcgaaactatgctcgctgtggccaatgtcgctttccctcccgcggtttcgtcctcgtccggtcaagatgacaaggaggttttcttggagatgtcgagcagaacgggtgtcagctgggtactcccagttggaggttagaaaagtcagctaccgacctcctggaactgagcaaaacttattgaatcaaactagtctctctctccaggagaaaagttttggtttgatatttggacggagtgggagtggaaagaccactcttttacagcttttggccggtctatcagaacctacctctggttcaatttgcattcagaagtatgatgatagtggaaatccaattggtctgtcggaagtgttagctcctcaaagagtcggtattgtatttcagtttcctgagaggtacttcttatcagatactatacttgaggaagttacttttggatggccaaggcaaaaggcagacattcctttgagggagcaactcactttaaaacttcagaatgccattaactctgttggtctaagtgccatttccttggataaggatccacagtccctcagtggtgggttcaagcggcgacttgctttggcaattcaactggttcaaactcctgatttattgttgcttgatgagcccctcgctggacttgattggaaagctcgggctgatgttgtgaatctcctgagggacctaaagaaagaccacaccatactggttgtaagtcatgacctaagagaactatacccgctggtagaccggtcctggagaatggaaatggggggtgttttgaaggaggaacctttacctgtatagattaacatttttttcctcggaaaattcataacgtttttttgtgcgtgtgcagctggaatgctgacccatttgttgttgcagtgaacaggctcatagctagctagggatcctaatgtaatgtttgtaatggtacaaggcaagttgcaaaatnctattaagaggactccacacct

SEQ ID NO: 19553 - DNA, 598 bp, Triticum aestivum
  Clone ID: PAT_TA_19553
gtcgacccacgcgtccgcgacccattctaccctactggtaaagttaacagtgatgttattgtgaatcctacggagaggcagaagtctgactcctctagaaagaagctgttgagctataggaggacttctttgaagcttgcaaggtcttctgaagcagaaaaacttcctgaaatttttgataatgagacgaaggtagagttaccagctaaagcaaaggaactggcacagcatgaagcagctgcagagaaggaatgtgccataagcccttctattgatcctgaagttgaaaaaacaatttcgagtttctctcgtcaaaatcagaatgtagcaatgagcagtgcatcacaggttaatatcattgaagcggtagcgacggactcgcagcatgacaaggaggtttctcatgcaaccatggaagcaggtgctcggaaagtatcggcttctagagtgaagaacgctggtgctaagaggcttcggagtgctacaaatggtagacgccaatcatctgcatgttgtaaaagtgagtccaagtctaagcatggtatcgaggcagttctttctcatgaaaacgtagaagcagaaaaaggaaataattgta

SEQ ID NO: 19554 - DNA, 992 bp, Triticum aestivum
  unsure (1)..(992): unsure at all n locations
  Clone ID: PAT_TA_19554
ctccaagcagagggatggaggtcgcggtggtcgtcgggccgatagtgaagctcttgccgaagctcctatcggtgatagatgggaagaggaagcagctggacaacctggaggtcgacgctggattcatccggcgcgacctgcagtcgatccaagaaatcattggccgctcgaatggcggcagatccatcacggacctctgggtccgagatctcaggcgcttggcggacgacatggaagactgcatcgatcgcttccaggtcgggaagatgagcagaatcagtttcgtcgggaagatctgcaagctgaagaagcggtcaaaggagactctcgagcagctacagaactgcatcagcatcgccggcgccgccgcacctgcacctgatccccccgctgcagctgggggcactgatcaggatccggaaggcccgcgtcttggcctgcttgcgcggagccaatcggaggggaatctcaaagtcatctccgtcgccggcttcagtggagtaggtatgactcgccccgccctcggcgcgtgcagcgacagggatgtgcgcagccagttccctctgcacgcctgggttcgtgcggcgcccggcatgagtgtgctcaagcttcttcagaaaatacatgaccaactgctgctaatcagcattgccaagaatcatggtgccactgcctccagctccaaaatcataccacaggtcaacggggacgacaccgaacatgccgcgactgaccaccgtgctcgccggactactcaagaccgcaaggtgtttgttcggccctctgcctgtgcctacgcatcggtccttccgcggcctgcctgccttctcttgggctgatggagtggacggcanaattatcatgacgacgggcattcagctgccaaaaacgacatgctgcaaatgtggnaacggttcaccactcnccataagatagcacaaagcaagttttcatttggggaagctgacaaaaaagtgggttttgtggggggn

SEQ ID NO: 19555 - DNA, 392 bp, Triticum aestivum
  unsure (1)..(392): unsure at all n locations
  Clone ID: PAT_TA_19555
gaccccccactcccaatcgccgcaaccgcaccaccagcgccgccctgatcggcaccgatggcgggcgatccgaccggcggcggcggcggnctccgcggcgggcaagggtccccgctcgtcgacgcggcaccagcagttccgcgaccgcgccaagacccgcgtggacgacctccaggagatcttctccggcctccagtccgcccgcaaggagagccgctccgccgacgcncgccgtcctcgaggagcaggtcaaccaagatgctccnccaattncgcnccgaagtcaacgtnngcttccccgctcttcctggaaaaatctctgggaaacancaaggtggcccngnttcgcnttcgganaattttcggttgctgaattgctttgagaagaaggg

SEQ ID NO: 19556 - DNA, 1840 bp, Triticum aestivum
  Clone ID: PAT_TA_19556
gggctgcatttacaccaccgctcctctttcgcacaccagatctcctcaccctcaagttttacaccagtttggctcgccgccgcatcgccttcgccggaatccgtccactctcagacccccatggtgcattcatacgaaagcccgccgagtggatctaggatagaagtggttttaaggttgaatacaagttcattttctgccaggcgggggcgataggtgttggaaacaaaagaaggaagattctcatgtccagagcccatcaccaaaggctataaatagagagcgtggcgcacaagactgaaccacacacaccacaaccaccaagcaagagcgtacgtagatagtggtgaggagagataggatggcgtcggagatgagcaaggatgtgaagttctccgaggaggaagtcacctcacacccgcgcgttctcgaaggtgaggagcaggcggttgcgccggcgcggcagtcttccatcttcgcgctgacgctggacgagctgcaatactcggtgtgcgaggcagggcgcaattttgggtccatgaacatggacgagttcatgagcaacatatggaatgccgatgagttccaagcggcgaccggcggtggcttggtgggcatggaggtggctcctgtggtgggtgctggtgggggcggaggtggcgttgatgcaggaggaagcaacctagcccggcaggagtcgttctccttgcctcccccgctgtgccggaagacggtggaggaggtgtgggctgagatcaacagggagccccgcccggtgcatgcccagcctcagggcgcgcgaccctcacagcagcctcctgtccagccaccggttccggccaacgaccggcaggggaccctaggcgagttgacgctggagcagtttcttgtcaaggccggcgtggtccggggatctggcgccggcggccaggcgcctgtgccggtcggcatggtccatggacagatgaaccccgcgcagcaggggcagcagcctggcccaatgatgtacccgatggcaccagccaacggcatgttcccggcgatgggcgacggcatggggttcgtccccaacgggtacgcagggatggccgtggtgccgccgccacctcctcctcaaggtggggtgggtatcgtgagccccgggtcgtcggacgggaggagcgccatgacgcaggctgacatgatgaactgcatgggcgaaggagcgatgatggagaacggcggcgcccggaaacgcggtgccccggaggatcagtcctgcgagagcagcatcgagcgccgccaccgccgcatgatcaagaaccgtgagtcagccgcacgatcgcgtgccaggaagcaggcttataccgtggagcttgaagctgaactgaaccacctcaaggaggagaacgctcgtctgaaagctgaggagaagacaattctgctgaccaagaaacaaatgctagtggagaagatgatagaacagtccaaggagaacgtgaacgccaagaagggtggcaccctctcgcggcgctgcggcagctgcatctggtgaaaggtgacccgccatccagcttccatagccgtgctcgcaggaggatgaggaggaattgtggtgtttatagcagtaacattatctttcccgagcggggtcgtatagtaatttactagtagtacctaaaaccataaggacccgaatgtcagtgtttatctggtcaagcaagtgaacttctgttgttgttactgtttataggtatatgggtttgtcagaacttcagacaaatggaacaaaagaaaattagcattatgttgatgtgaaaaaaaaaaaaaaaaaaaaaaaaaaaaaaaaaaaaaaaaaaaa

SEQ ID NO: 19557 - DNA, 820 bp, Triticum aestivum
  unsure (1)..(820): unsure at all n locations
  Clone ID: PAT_TA_19557
gatgcctggagcgaaggctccggccgtggtggatgcctggagcagggaggctccggccgtggtggtttgcgtggggtgcagggcccgatatggtttctgcaggctcggcgtaaaggatggtggtggcccggtgcagcgttggcgtgctcgttgcatcgggggtgtgcgatccagtggaggtacctgttggcctttggtcggctgcgtgggaatggttgctccaggtgaaagcctggctggtgctcgtcggccggcggcgacggcgcgcgtgggcgtcgttatcctccttggaggcgtcgtcagggatctttgcagccctactcccggatcaagacctttaggtgaaaatcaagatcctgctgtaggatcgggcggtggcgtcgtcttcagcgtccgtttcccctcttgaagggcaccgtcttgaagatctttgatcccaaatggtgctttttacggactgggatgtgcatgggtggctccagtggcaatggatgatggggtgagcaaggtccaaggcatggcactggtccaggtagtcctctcttctccggcgtgtccctgagattgcctccgctgtttgttgtggtgaagtccaagctgccgtggggaggcccaggtggcgtacgcgacaggccgtccgttcggcgatcctccatgatgcctactatgcctagctttccgtatcaacaacaantcngaatgatnccttgtggnggtggatggnttcaaaatgnangttgtccgcacaanaggtgcggttttctttcttatctcgnntaaaagtanctcgtgctcgctactaacaacanaattcngtttt

SEQ ID NO: 19558 - DNA, 671 bp, Triticum aestivum
  Clone ID: PAT_TA_19558
tcgacccacgcgtccgcccacgcgtcccacctcgcacccgaccggcattaatcggccggccggtggtgaacgagtcgtagccgtcgtccgactccgactgtggtgggatgtggttggcgcgtataaacagaggaggtggggttggcgctctgctttccacccccccccgccgaaaacacgagtccccttcggcccccgtcgccatcacccgcgcccacgcccgccgcggcgccgctgggccgctcagccaaccccagcaacccggcgtacaaatcctacacgcataccactcgccccggcggcccggcataatcgtctcgtcgatcgatcaatctccgtgagcgcgtccatggcgccgcgtggaacggcggcgatgagcaggttcccgccgttgtcgtcctacgacgcgtcggcgcgcgagcggcgcacggcggcgtcggacctggacggcaccctgctggcctcctcctccgcgttcccctactacttcctcgtggcgctcgaggccgggggctacctccgggccctcgccctgctcctcctggccccgttcatcctgctcctctacaccgccgtctccgagccggccgccatcgggctgctcgtcttcgcaacgttcgcggggctccgggtgcgcgacctggaggcagtggcgaggggcgtgctccccc

SEQ ID NO: 19559 - DNA, 703 bp, Triticum aestivum
  Clone ID: PAT_TA_19559
aaagagcagaagcatttccagcggggggtggccccgcggccccccacggtttactccctgcctgatatagaggaatgttgcttggaaaacttggtctctgaaacccatattgggctggctgggagctgaggtgtggtaaagctgcaccagcagcagactgcaaacttgaggccgtcgatgcgggctgaggataatgtgactggattatggcaggatcattgtgcaggggagctggttgtggttgtggtggcggcggtgacgacttaacttgcaaatccttgatatcgcttccgcggaagagtatgtactcatagaccttgtcgctagcggggatctgtatcccgtccttcttccgcccttcggttccaaacgaccgcacgttgcgcaggccgatgctggactcctcggtgttgatgttgtagaggacgccctcgtacctgatctcgctcttggaggtgaggctgatgaggctcccgaggtacgtctccggggacgccgccccggccgccgccgcctgccgcgcgggcgccgcggcggaggaggaggaggacgaggagggcggctgcggcgggggcgcttcggccgccatggacggatggccgccgcggcgggggtcgtcgctagggttagggggcacgggcagcggggagcggaaaggagggggggagagaccgagtgaaaccctaagcgggcgctccgccgc

SEQ ID NO: 19560 - DNA, 530 bp, Triticum aestivum
  unsure (1)..(530): unsure at all n locations
  Clone ID: PAT_TA_19560
gcttatatatcgccgccgcgtgcccgctcccggttcgcccccttgcttcctctctctctctgtgttcgtgtgcctgctctgctctcccgaaccccggtcaccaccaggtaaactaacccagcaccagccactcaatataaacgcacgtactcttcacgccaaagcagcaactccgacctactacaagctaactagctccttcacactcgtggtcgtggtactgtactactgtgcgccctccttttggtctgacctgtgacgctacctgcgacgcgtcgagacatggcactcacggcgttcgagaccgcggagcatcgcctgccgtgccacgccgagcatgccgacgccggcggcaangtggccgctgctgctgccgccgagcaagccgtgccgctgcaagaggcggacacggcggccgtctcgagagggacacatatggaaatgttcaatcgcagaagccgcggnccggcgttgacnccgaacaaggccttactnccggccccgtgcgccgtccccagctgctaacaana

SEQ ID NO: 19561 - DNA, 1456 bp, Triticum aestivum
  unsure (1)..(1456): unsure at all n locations
  Clone ID: PAT_TA_19561
gtcgacccacgcgtccgattgacttcgacggccgcacggcgctgcacatcgccgcctgcgagggccggggggaggtggtgcgcctgctgctcggctggaaggccaacatcaacgcccgcgaccgatgggggagcacgccagcagcggatgctaaacattacggccactttgaagtgtacaaccttctcagagcaagaggagcaaaacttccgaaaaccaagaagactccaatgactgtgtcaaatcccaaagaagttccagagtatgaactgaaccctcttgaactcgagttccgaagaggagaggaggttacaaagggttactatgtagccaaatggtatggctccaaagttttcgtgaagatacttgacaaagatagcttctcagacggagatagcatttctgtcgtcatatcaactcagagatgcattcaaacacgagcttactttactggagaaagcgcggcatcccaatttggtccaatttgtgggagctgttacacaaaatgtaccactgatgattgtttcagaataccaccaaaaaggtgatctagcgagctatcttgagacaaaaggtcgcgtgcaatcttataaagcgatcaggtttgcccttgacattgcaaggggactaaattatcttcacgagtgcaagccagagccaatcatccacggtgatctgtcaccaaaaaaaattgtgccggatgatgaaggaaaacttaaggtggcaggctttggatcacttggatctgacaaaacgctcccaagataaactacagatggtgcagccagtgtcaaatttggacagtgtgtacattgctcctgaaaggtacagaaatgaagcatttgacagaagtgtggatacatttgcgttcggtctcattccttacgagatgattgaaggatctccctgcatttcacccaaagcctcaaagaggaagcggccaagatgatttgttcagagggtttgagaccattattccaagaataaacccaaatcatatcctgagggtgtgaaatgagctaatacaagagtgctgggatccaacacctcccatcaggccaacgttctcggatataactctaccccctggaacaagatatccgcaagttgttcccaagcaaaccccgctggagagacaacttcaagctaccctgggaacaagctgtgcacaaatagttctgatcttccacgagactgtcgatgagatcccccccttttttgcatatgttagtaaacacggtgaatattggattgctttctgggtcggccgttgtgccttgtcgtcgtttttgttcctcctgttcccggttctgtttctattcctctccttaggtgtatttcgagttatgttcatccgaatgggaagaatgtattaagttcctgaatgttgcaaatatgctcataccatatgcctccgaaagtcaatgacatatttttctgtttttccgaacactnn

SEQ ID NO: 19562 - DNA, 500 bp, Triticum aestivum
  Clone ID: PAT_TA_19562
tcgacccacgcgtccgaggcccttttgccagtgaaggtggaagttactcaccgtggcaacattcggcgcaagtaccggatatctggtttaacagctcagacaactaggtgagctaacttttcctgttgatcaagggggcacggtgaagtcggttgtccagtattttcaggagacatatgggtttgccatccagcacatcaaccttccctgtctgacagtcggcaaccagcagcgtccaaattacctccccatggaggtctgcaaaatagtggaggggcagaggtactccaagaggctgaaccagggccagataagagctcttcttgaggagacatgccagcgtccgcatgaccgggagcgcgacatagttcagatggtgaatcacaactcttaccacgatgatccgtatgcaaaagagtttggtattaagatcagcgagcgcctggcatcggtcgaggcacggattttgcctgctcctcggctgaagtacagcgagactg

SEQ ID NO: 19563 - DNA, 649 bp, Triticum aestivum
  Clone ID: PAT_TA_19563
ggtcgacccacgcgtccggagaagaattaagtatagagatgtcagtgcaattacgagatgaactgttgatagcgcaaggacaagacagaaacaagaagagtgcaaaggcaaaagcagcagctcgtatattggcagatctgaagaaaagaggcctttcaatgaaacaatgttcttctaaagctaagcagttggatattatatcatcggagcagtatcctttggcaagtttggaatcaccacttgattattgtcacgtgaatgccaatcctagcctaggaggccttccctcactgaaagaagcagttgttcttcggcttaaaatggacaaaggtggaccacgaagtgctctttttaagctatgcaagaggttgccgtggccaatgccagaattcgaatttgttgaacaaaggttcaggactcctattgttctggacggggtaaccacaacgaacttcaatagcttcgtgtcaaccatcgccttgcacatacctgatgtaacagccattacacttcaaggcgagcggcggactgacaaaaggagttcccgggattcagcatcgctggcaatgctccacaagcttcaagagctccaggtctgtatatgcaagacttagcaaagcatcatggatccacttgcgagctaactgct

SEQ ID NO: 19564 - DNA, 1130 bp, Triticum aestivum
  unsure (1)..(1130): unsure at all n locations
  Clone ID: PAT_TA_19564
gacccacgcgtccgcttcatactccactggaggattacgctggtcgtgcttgccacgtatcccctcatggtcagcggccacatcagtgagaaaatgttcatgaaaggatacggaggcaacctcggcaagtcgtatctgaaggcaaacatgctcgccgccgaggcggtgagcaacatgaggacggtggccgcctcgtcccccgcggccgaggtgatatagctctacgctgacgagctcaaggagcccgggaagcggtccttccggcgagggcagggagccggcgtcttctatggagtctctcagttcttcctcttctcttcctatgcgctggctttatggtacggttcgcacctgatgagcaaggagttggccaccttcaggtccgtgatgaagtccttcatggtgctcatagtgacagcgctggcaatgggcgagacgctggcgatggcgccggacatcatcaaggggaaccagatggcgtcctcggtgttcgagatcctggacaggaagaccgaggtccagatcgacaccggcgacgacatcaagaaggtggagggagtgatccaactgcgggacgttgaattccgttacccgtcgaggtcggaggtggccgtgttcaaaggtctcgacctcctgatgaaggccggcaagagcatggcgctcgtcgggatgagcggctccggcaagagcaccgttctctcgctcatcctccgcttctacgatccgatcgccggaaaagttttggtcgatggtatggtcatcaagaagcttaagctgaagtcgctgaggaggcacatcggcctggtgcagcaagagcggcgctgttcgcgacgacnatctacgaaaacatcctctatgggaaggacggcgcgacggaggccgaggtcatcgaggcggntgaagctggcgaacgcgcacaacttcatcaactcgcctgccggaggggtaccaaaccaaagtcnggggancgcggcgtgcaaacttgtcggggcggggcanaaagcaaacggcaatcgccatcgcngcgcgccantngtcaaangaacccggccatcctggctccctgggaccanggcganaaaccccnctgggacgtngaagtcccgnaccntgttggttcaacaaagcgg

SEQ ID NO: 19565 - DNA, 503 bp, Triticum aestivum
  Clone ID: PAT_TA_19565
aaaccgaccccgctaacccgcgcctcctcctctctatcccgccgccgcagctcctccatcggccagccgcccccaacgccggcgagcgagacactgccgccctcccgacgcggccactggggccacgcccgctattgagccagcgtcctcactcctcaccccggccacctccctctccggctccaacggcgcctccccacgatgagttccgacggcaggctggacctcgacgcgacgacaagcaccctcggcccggaggatgacacggcgcagggtctgatactgccgaccaaggataaggtcatgtaccggcctccgccggggagatccgcgctaggtttggacctgctcgcacacaagaaaagagaaaaggaaggtaacaattcatttaagcggcctcctgagaaggtagtgacggctgcttcttctatggatgaagatgagaggccaggatctacagaaaatgatgcaagcagcctgtccggtgttgaccgtggcatcgt

SEQ ID NO: 19566 - DNA, 964 bp, Triticum aestivum
  unsure (1)..(964): unsure at all n locations
  Clone ID: PAT_TA_19566
ggtcgacccacgcgtccgcgtcgccgccgtccacctcgcggacagcctcctcgtcctccacctcatcaacgaccaccacggcctcctccacggtctccggcgcgcgcacgccggccaagtcgaactcgttcgtgggcacggaggactacgtggcgccggagatcatcgccgggagcgggcacgacttcatcgtggactggtggggcctgggcgtggtcctctacgagatgctctacgggcgcacgccgttccggggccagaaccgcaaggagaccttctaccgcgtgctcaccaagcagccggagctggtgggcgagaagacgccgctgcgcaacctcatcgcccgcctcctggagaaggacccggcgaagcgcatcggcgcgcgcggcatcaaggcgcaccccttcttccacggcgtcgacctgggaccggcaatcctccgcgtggcgcgcccgcccttacatcccggcccttgccccagaacgaggacggcggcgaggtgctcgacgtcgagaaggtcgtgcacgagacgttcgcggccagcgacgtcgaggccccggcggcggccgccggcggggggcgacgaagaagaagccttcgccggagacggagacgggcgggggcgacgacggtgagcggaggatgatggatccgtcgaaagacggcgatttctccgtgtttttctgagttttttctctctagattttagcactttttccttcccagaaaaatgggcttggtcaggtttattttgttaatacgatatattttagtttctttgggatttggtggagggatgagtacataattaaggaggtgctcctgtgtttancggagtagagttgtacgtttttgcttggcttcttgtccacattttcggtggatactttgctttggcccgtgcatacgaggattattganacgatcgtgtacataatgaataatcaacagtttctattaggca

SEQ ID NO: 19567 - DNA, 824 bp, Triticum aestivum
  unsure (1)..(824): unsure at all n locations
  Clone ID: PAT_TA_19567
gctgggtaaacccatccgctccacgccaaactgtacaaagcgcgcggtggtccggcacaagtaaagaagctcaccgagtaaaccacaccaccgtccaccgagcacacaagcaagcaagcaagcgggcaggagaggagaggagacggcggtgcgcggcggcggccagcagcacgaacaagccgggtgcgacgatggctgcggcggcggggagcggcggcgtggtgaagcacctcgtcatcgtgcagttcaaggaggacgtgaccccggagcggctggccgggctcatccgcggctacgccggcctcgtcgacaaggtcccctccatgaaggccttccactggggaaccgatgtgagcatagagaacatgcatcaggggttcacacacgtcttcgagtccacctttgaaagcacagagggagtcaaggagtacgtttaccacccagcacacgtcgagtttgcaactgatttcttgggttcaacggagaaagtcctcataatcgacttcaagccggcagcggtcaactaatggcttcggccaagtgagacgccgaggacttctgttgccgcctgccttatcggtgctgcttctgtgtgtttgtgtttgaattgcatctggtattcacaagctatgtaccttgtgctaaataaatctgttcgacctgttgtatctgttgagaatgaacgctggatttggtgtaactgtgttctgacattttgtagcacttaataatcagtattatgtgtgaaaggttcttctttgtcgcaaaaaaaaaaaacaccacaccaacataaannaggaaaaaaaaaaaaacaaaggccccta

SEQ ID NO: 19568 - DNA, 891 bp, Triticum aestivum
  unsure (1)..(891): unsure at all n locations
  Clone ID: PAT_TA_19568
ggaaccctcgaggcggcgcgccggcccggcgccgacgaggaagcaagcgacgaggcgaggaaacggcacaaccaccctggagaggcggccggcaggataaacaagccgggaagcgacgatggctgcggcggcggctcccggggagcggccgcggcggcgtggtagaagcacctcgtcatcgtgcaggtcaaggcaggacgtgcccccggagcggctggaagggctcctccggcggcctacgccggcctcgtacgacaaggtcccctccaattgaaggcctaccaactcggggaaccgatgtgagcataggagaacatgcatgaaggggttcacacacgtctttagcagtccgccttttgagagcacagagggagtccaaggagtacgtttgccacccttctgcacgtcgagtttgaaactgatgtcttgggcttcaacggagaaagtcctcataatcgacttcatacccacagctggcaactaatggtttcggccaagtgagacacttagagcttctgttgccgcctgccttattggtgttgcttctgtgtgtttgtgttcgaatttcatctggcattcacaagctatgtaccttgtgctaaataaatctgttcggcctgttgtatctgttgagaatgaaggctggatttggtgcaactgtgttctgacattttgtagcacttaataatctgtatgataaattgatcgtatgtgaggcagtttcgtaaaaagaaagcagataattttctgcccctacttcggtgacggatgtggcataagcatgttctcattgccttgcttgcttcaatcgtggcccgcggttgattagcgtacgtccgggacccaaaatcccccctaanagnggnggtccnaataaaaaatcaactgggg

SEQ ID NO: 19569 - DNA, 626 bp, Triticum aestivum
  unsure (1)..(626): unsure at all n locations
  Clone ID: PAT_TA_19569
ccacgcgtccgatcccccacccgtgccgcatccgttggcatcaatggcgacgcctcgttaggtggcgcgtcgctcttccttaactgctcccgctcacacacgcgcatcgggttcagacggctctgcgtcgagttggtgcgtgcgctactcctcctccacccctccttccctgcaagctgctgcagctccgcttgtgactcgtgacgggaagaggggagataaaataataccccgccaaccgcggcgaggcgtcggccgagctacacctgtcgccgcaggaagctggaagacctccgtcgtttatatatccacgcctgccgctgccggggatgagcgagccgggcaacgagctggacgagctgctctggggataacgggaccggcgctccggcggggcggcgtcgcccttcccgcccttctcctgcangccccgccggcactaatgaaaggcgcanggagctcgccaaagcaccccgcgttcggcgacggcgattggcgcaggggcacgacgacgacccccggccgtggttgcaacattaccccatcatcggcgtggacgacggcggcggcggcgatacggccccgctgccccaggactacttctccaccttgtttcccgggttctc

SEQ ID NO: 19570 - DNA, 599 bp, Triticum aestivum
  unsure (1)..(599): unsure at all n locations
  Clone ID: PAT_TA_19570
gtcgtgggatcgattcccagctcgcgcgtactacaaggcaccgcgccccgtaaaaaattaatcccccgttcccctccccgagaaatcccttcatcgagcacgcgcgagcaaatccgtagcaagcatcaccgcatccgtgatggcagcgatgaacattgatctgggaggattggcaggcaggcctactacttcacaggcggatccttttcaaagtgctttgtatggagctggacctgaactcatccgaagtggactaggagcgtacagtgagaagtttttaggttcaagctccgactttatgcaaagcaatatcacccaaatatttgtccaatccaacaatattnactttcaaagtgaancaaccaagtatgtngaggaacaaagctgaagggtgtcctggttccttttcctgcatccggggcactggactaggataactgagccagtgggaggaaggctgtcatacaaacctccagttcaagacatcaatgctccagatctgtacatccctctaatggcttttgccacctacattgttgttgctagatatgccttgggtgttcttggaagggtactgcacacccaggacaacttttgat

SEQ ID NO: 19571 - DNA, 490 bp, Triticum aestivum
  Clone ID: PAT_TA_19571
gacccccccggggggcttggctccccccccgcgcccgctcccccccagctcactttccagcgcggttcggctcgctcgccagccagcctacggtctcctgcccgactgcctccctccctccccccctcgccaaaccgagctccgtcatcatgccggctccgctgttgcatggatccatggcgctcccccacccccgcgccgccgcctatgtatagtagccttccttgctagcccatcatcgatccactcatccatcctctcgtgtctctcagttcgtcgtaccatagtgaggggcagacaggatgcaggacctgttctcggtgccctcctgcttctcgtccggcgagaagcagctgccggacgcgccggcgtccgcggcgccggcgaccaggtccgggcagagcgccgggacgctggtgtaccgcgcggtgatctccgagcagagccggctggtcaccgtgacgtggtgtaggacctgctcgccacggat

SEQ ID NO: 19572 - DNA, 957 bp, Triticum aestivum
  Clone ID: PAT_TA_19572
ggtcgacccacgcgtccgttggcgaggaggaggaggtggtgtgctcaggcgcgctggttgcaaaagcggttgagtgtggactgcgatgtctgacgcttgagcgtggatggagctttgtcggggagagcatatacgcccagtccacgtttgctgccagtgaggagaggactgatctctgcgtgttgaatgtggaagtcagatctggactaaatgatgattatgagtttgttgtctcacctgatgcatttcggtttactacccgctcgagctcagatgttgctagttccagtgtgatagaaacgtttcaacagattaaggaagtaagtttggatggttgtaacctccagacagcttgtgcaattcttccaacattacaggaaggccatgtgattggttttagcgaattacctccttcagggcagatcttggacagctttacagagctttgctcagttaagcatggtgtggagacgaactacagttatcatgcagcagtcaaactgacacgcggagcttcctgtgagaagcaatggttgccttctccatttgtcctccaaggtccggggcttcagccttccccaaaatctgttagagcatcaaaggcaatgtcttccatgcggtcctttatagaatcgttgaaagcttggaattgctttggtcagagtcaactagtaattaaggaacaattagtagttaactgcacggcgactctgcctacttgggacaaagccacaagtaaactggcaatgcacactgcaagaaccgaaaattcagaggatcttcgtttagttcatccaagttctgtgaccaaagaccaatcattggctttagacttccggaccccaaaaccagctgtcttttcctcttcggctgccaaattctgcaataccaaagttgagatagctcagtctctggatgatgctggcactggcgatgacacacattccatcaagcatg

SEQ ID NO: 19573 - DNA, 712 bp, Triticum aestivum
  unsure (1)..(712): unsure at all n locations
  Clone ID: PAT_TA_19573
cacgcgtccgggaggaggaggcccagtgcgcatgctggtgaactggtgagagaaaaggggaaaggaaaaaaaggaaaaggagcagatttctgtatcctatcgccgattcccacgcgcccggccctcgcccccccacgctcccacgcgagcccgccgcttttcttccttccctccctccacattgcgacgccgccgcggccccgtgttggtacctgaaccctgcctttggtggtctccaataatccaagggaacgactgtggatgctttgatggtgtggtgggtgtgagatggattgccggaatccgctctggaggcgcaaatcgtcggagaggagccctggggagagtgggatcttcagtttggtgtcatcacattctgaccgttaatcccgtggccaggcctcaagcttgatttccactacgttggtttagaagattactattgcctagctcaacttctcaaaaagaggagctgggagctgggaggaatgactcatctggataccaaacctatctccattggtggttccccaaatcatagccaatcacctgaagctccctcgagaattagagacggtgaaacccatgacactgaagcaggaaaatcattgaatgagaagctaacatgcgcaaatgggccaaatgattcttccccccgcctcgtgaactaccaccgccannnntctttacaagtgtnnnngatgctgatatg

SEQ ID NO: 19574 - DNA, 1618 bp, Triticum aestivum
  unsure (1)..(1618): unsure at all n locations
  Clone ID: PAT_TA_19574
ggcacgaggaaccaaataggcacgcgcggctagggtttatccagccagccgccgccgccgccgccccgcccgaccgctccccgcggccggggcttaccctcctcccctcacccccaccgaggcgcccgggcgatggacgcggcggcgctcgacgacgtgatccggcggctcctggaggcgcgcggcggccggacggtgcgccccgcgcagctctccgacgcggagatccgccgcctctgcgccgccgccaaggacgtcttcctcagccagcccaacctcctcgagctcgaggcccccatcaaagtctgcggggacatccatggccaatattctgatcttcttcgattatttgagtatggtggtttcccaccggaggcgaactatttgtttctgggtgactatgttgatcgtggcaaacagagtattgaaacgatatgccttctccttgcttacaagattaagtacccggagaacttctttctccttaggggaaaccatgaatgtgcctctatcaacagaatctatggattctttgatgaatgcaagaggaggttcaatgttcgtctctggaaggtttttactgactgttttaactgccttcctgtggctgcacttattgatgacaagatcctgtgcatgcatgggggtttatcacctgatttaaagaacatggaccagatacgtaacattgcccgtcctgtggatattccggaccatggtctcctctgtgatctgctatggtcagaccctgataaagatgttgatggctggggtgagaatgacaggggcgtgtcatacactttcggagctgataaggttgcagagttccttgagaaacatgatctagatttggtctgcagggctcaccaggtggtggaggatggatatgaattctttgcaaagcgtcagctcgtaaccatattctctgcacccaactattgtggcgagttcgacaatgctggtgccatgatgagcatagatgattcactaacatgctcattccagatccttaaaccttctgataagaaagggaaagctggaaccggcaactcaaaacctggaacaccgcctaggaagataaagattaatattatttagtcagacccttccggtgcgaaatgagttattgtgatggagcacaccccccaaaacttgttatgaaggtgcgccgaacaacgtgttgaaaatgtcaacctgcatgctgttgttttttcgtggtctgatgcagatctgtcctgccattctggaaaagatcagagcaggaaacataactgggaattttgtgtggatttcttattccttttattaactctgctatgcgtggcaaaatgtttaagcacgggaggcgtcaggaacttcatcctgtggtggagattgccaatgctgaatgtagattctgttatgttatgtacgctgttttatctgtaaagcttgtctctgcaaatgacttgctagctttagtgaatgaatgtgttttgctgacgcttgatggtagagaatgactggtatttaatagcagtcccaagttcgccgagggttgcggtagggttaggtgctttgtcatttctatttaaacatgtggttgaggtttncncttactttgcgatgttgnatgttt

SEQ ID NO: 19575 - DNA, 461 bp, Triticum aestivum
  Clone ID: PAT_TA_19575
ggtactctcatgcacagcaataacatactgagaaagtgtttacagtcaacatccagccgttcctccctgtcagaaatcgacagtaaacaacaagcaacagctcagaaacgatgaacagaccatcatttcatagcttcctaagaatcagcggcacgccgctcccgggctccacggtcagcctgaacacgggtcgatgatcgtagctcggcgagggtgcaaactcaaacctggacagcagcagcgacagcacgaccttgaccttcaaccatggcgaggttctggccggcacacgtccggggacccacgccgaacggcatgtacatgtggtggggcttgcaggcgcgtgctatgcctccggcaaaccttcccggatcaaacttgtcgcagtcggcgccccatgccgaagggtcccggtgagccagcatgatcgagaccctgatgttggtgcctttcgggatgtc

SEQ ID NO: 19576 - DNA, 433 bp, Triticum aestivum
  Clone ID: PAT_TA_19576
ggtcgacccacgcgtccgcgcgcccacggcgccgtccaaggcggccttcttcttcgtcgccacggccatgctcggcctctacatcatcctctgagtcgcgcgccgaccccgcgagagaccgtggtccgtccagtcgcagtagagtagagcgctcgtcgtctcgttccgtttcgtgcctgtcgccgttcgaggttcgtttctgcgtgcagtccggtcgaagaagccggtgggttttgagtactagtggtagtagtagcagcagctatcgtttctgtccgctcgtacgtgtttgcgtggtcgcggagaacaattaattgggtgtttgcgagtcctctggttaagatgaaccactgatgctatgtgatcgatcgatcggtatgatctgcatggaaatggatcaagttttgcgttctaaaaaaaaaaaaaaaaaaaa

SEQ ID NO: 19577 - DNA, 690 bp, Triticum aestivum
  Clone ID: PAT_TA_19577
tcgacccacgcgtccgggattccagaaggaagctgctttgggaaggtccagccaaggtgatcgttctttattgcaggaaagatcgtcacagtctgccttggcatgtgagaaaggagctgacacacctctgatcaacaatcaaagattgattgttcggtttccaaaaccaagttgtagccctgctaggagcacaagtgggggctcttgtgaggagccatcagtttcagggagtagagcttcatctcctgttcacgcagataagcatgaacagaatgatcgtagggtgaaaatgaaggttgaaaattctcgggctcatttaggttctgatgctaatgctcagcctgagcgaagcaatgatactaaaagaattgcaggttccgaggaaggtgataaatcaccttgtggtatgctggatggtgactgtagcaggactgctgaagaatctgctaaggatacatgtgcatcacgacttgcatgctcggcaaatatggatgaaaaagacgtctgcttaggtgaaaccagagtgcggaactcgttcagccctttgaatgctttgattgaaatcaaatacgccggaggtagtcattccatgcaagctggagatgatacagcaatgaatcttcttgctagtgttgctggagaagtatctaaatctgaattgatgtcatctgcttcaccgacgaattcgtc

SEQ ID NO: 19578 - DNA, 556 bp, Triticum aestivum
  Clone ID: PAT_TA_19578
agccacctgagcgcgccacggctgagtcgtgcacccagcaagaaccatgctcccgtgatatcatcaccgtagtggccggcgccaaccatggcgttggggggcaacgcggtcgccggtcgccgtcgccacgtgctgctgttcccgctggcgtaccagggccatatcaacccgatgttccggctggccggcatcctccacggccgcggcttcgccgtcaccgtcttccacacccacttcaacgccccagacccatcgcgccacccggagtaccgcttcgtccccgtccccgacggcatgtccggcccagcacccgtcgctatcgaggacgtcgtctcccacatcctcgcgctcaacaccgcgtgcgaggcgcccttccgtgaccgcctggccgccgtcatggaagagtactccagggacgacgtggcgtgcatcgtcgtcgacactcacctgctgtccaggggggcggcggccccgccgcgcgccctgcccaccctcgtcctccgcactggcagcgccgcctgcctctcgtgcttcgtggcctaccctctcctcatca

SEQ ID NO: 19579 - DNA, 1205 bp, Triticum aestivum
  unsure (1)..(1205): unsure at all n locations
  Clone ID: PAT_TA_19579
ctcgagcttatgaatgttgagaaactcactagggaaaatgttgcaagtcacctacagaaatataggctttatctccgacggttaagtgctgtggcatcacaacaagctggcatcgttgctgccttgggaggcagagacccctttctgcgcatggatgcattcgaaggactccagggttatcaagctttcacctctcccgcagcgctatcgactttcagtgcacatggattgctaaatagtcctagaaacaaccagacagcggttgtgattcagggggtggccacttccaggtcaattccgactggaagtagcagttgcacaacaaatcctttgattggtgatgcagctaagtatcatcttagcctaccaggaaaccagcatgggaacttgggacaaggtttggcgacatctcttgggcaagcccaattacaacagaagtggatgaatgagggcagcggtgatctgtccaccatcctttctgggaatagccgggctaatggcatgcctcgcatgctcccaagtgtcacaagcagtccattactgcctccagatcttgtggagtgcacacaggccaaagtagccatccagccatcagttcgagctccctctgcaagtgtagaacttctcgaaggtgccattggagcctcttctggtccattggagtctcgtgtatcccagcagagcgctcttccttcatctggattttctgcaaacatgttgcctgtgcatggttcattcaacaataatggtgcttcattcagcagcaatggtgcaaccagattgggtgatgcattctcagcaagttttcgtccaacaaatgacctcacggtcgcaagaggtaccaaagtgggagctggctcctttggtggcacgatacatttgtctccagataccgagcagaagtacttgagctttggaagttcagatagtctacttgatccgaagcttgtatggagttcctctcagctgccaagcaatattggtgctcattatcattccatgagccaaaggtcgaataattgcagcattgacagcagccatggtggcagaatgtttggacagacaagtgcgagcgcctcgacagctgctccacaaactaagtttgacatcctcttctcaggagacacttcgatggcaaggatgcgtctgaatcangccctcaaaggctgcagagcgagctcagcttcagcacctgcagcttcgac

SEQ ID NO: 19580 - DNA, 1280 bp, Triticum aestivum
  Clone ID: PAT_TA_19580
tcgacccacgcgtccgtgcagctcgaggttttgtatgggaagggcaatggctggttcttcgcgattacggcggtgaaggaggcaattcttaggttggggtcttgtttggctgtccttgttggagatggtgttgctggaggcgctagtgaaaaaggatgtgagttgagagataccgggacatcccttatttttgtttcccaggttgctgctgccattgcagccttacatgagaggttgtccctggataagaagattagggctctgcaagcaccacgcccatccaaatatcagctgttacttgaatattcacaaatactgaagcaaggctgtgatgagcgttcaaagcgaccaaactacagagctgttctggattatgatggaattctaccacgtcaaatggataaccaggaatctggtaggtccaagacaagggaggagctgctagctgaagaacgggattacaagagaagaagaatgtcttaccgtgggaagaaaatgaagcgaaatccaacagagatattaagagacataccggtccggcacttcccggtcgtcccacgcgcccgtctgggggaacctcctggtgacattgcacaaaatatacttgagaccaattctaatggaggcgcttaccaaggaagctcttgtgataaggctattttgggttctcgattacgtagtcgtgagaactcaccacatactgcatcaaggagccatgacacaagggattcatatatgaacataagatatgaaaatagtggacaccgtcaccaaaatgtatctgagcatgagaaaggagggatcagagaatcaggaaatgcaatgaatcgaggctattctgaccggcatgattacacacataaaagaaacaccaatgatcataggaaatatggtaataagtataaaaagaacatcccagattaccattctgaatcaagtgatcgttcagcatggtccacacgaacaccaaaatcctcggaaagagaatatggcggcatgccaggagataaaagcaatgatagaaccagaactactcagaacagacatggatcaatacctgggaataaagaccagttcagtgatagatatgatccccaaagcagatattctgatgaggatcctcgtgaagcataccatgatgcgtgatctgaattactgaagaacagagtacattttcctgttgatctcagtatactgtgtaatacaggcatctgggttaataccgtcagctgtatcctttttctgtatccttatgcagaaaatgctttactatttctgct

SEQ ID NO: 19581 - DNA, 565 bp, Triticum aestivum
  Clone ID: PAT_TA_19581
ggtaccaagaatttggcacagtctgtccaggactctgtttagattggacggtccctctttactacctttaagtggcttcttttgctgatcgggtcgagagcccttgaatccggcatttaccgttgtattgtccggactcttttcattgttttgatgcttgtttttactgcatcacggctttctattgccatccctaatttcggatgtgccgggtcactggtgactctatgggccaaccagctgtcctctcccgtgcaaaagcgggtcataaggcttgttagggccgccattgtccttggcttttcttggccgaggtgtccggcgagccattcgtctcggatactatgcttgaaagccgctaaggcctcggcatccgggcaatcgacgatttgattcttcttagtgagaaatctgttccaaagcttacgggctgactctccgggttgttggattatgtgacttaaatcgtctgcatccggaggtcggacataggtcccttgaaaatttgccctgaaagcatcctcaagttcctcccaacttccaattgagttttcggtgaggcttt

SEQ ID NO: 19582 - DNA, 777 bp, Triticum aestivum
  Clone ID: PAT_TA_19582
agctgctccccacgtctccacacgacaccacccacccccacacccagctagggtttcgcttctccgatggcggcggcggcgggcggcgcgacgacgtcgacgaggcgcgggccgggcggcgggggccggccgatggacgacgagaacctgaccttcgagacctcggcgggggtggaggtcgtcggcagcttcgacgccatggggatccgggaggacctcctccgcggcatctacggctacggcttcgagaagccctccgccatccagcagcgggccgtcatccccatcatcaccggccgcgacgtcatcgcccaggcccagtccggcaccggcaagacctccatgatctccctctccgtctgccaggtcatcgagaccaacgtccacgaggtgcaggcgctgatactgtcgccaactagggaacttgcgacacaaacagagagggtgatgcaggctgttggtaacttcatgagcgtctctgtgcacgcctgtgttggtggcaaaagtatcggcgaggacattaggaagctcgagtctggagtgcatgttgtttcaggaaccccgggcagagtatgtgatatgatcaagagaaggaccttgcgcacaagagccatcaagctcctagtcctggacgaagccgatgagatgttgagcagaggtttcaaggatcagatatatgatgtctacagatatcttcccccagaacttcaggttggtttgatctctgcaactctgccccatgacatcttggagataactagcaagttcatgactgat

SEQ ID NO: 19583 - DNA, 818 bp, Triticum aestivum
  Clone ID: PAT_TA_19583
aagttcatgactgatccagtcaggatccttgtaaaacgtgatgagttgaccctagagggcatcaaacaattctttgttgctgttgagaaagaggaatggaagtttgatacactatgtgatctttatgatacactgaccatcacccaagctgtcattttctgcaacactaagagaaaggtggattggcttactgaaaggatgcgcaccaacaatttcacggtgtcagctatgcacggtgacatgcctcagaaggaaagggatgcgatcatgaatgagttcaggggtggcacgacccgtgttctgatcacaaccgatgtttgggctcgagggctggatgtccagcaggtctctcttgtcattaattacgatctccccaacaatcgtgagctttacatccatcgtattggtcgctctgggcgttttgggcgcaagggtgtggcgatcaactttgtgcgcaaggatgacatccgtatccttcgggacatcgagcagtactacagcacgcagatcgacgagatgcccatgaacgtcgctgatcttatctgagctctggaccggatcaatccctcccctctctttgtctcggtgcgatgtttggggatttggttgcgttgtgatgtttggatgtatttctggtgctgtaacttgagatttcttttgttgcttttgggaacatgggaagtgtatatattctttctcggattgaccaccagctcatgtaaaacactcttttgttgttacgctatcttctgattcggacgccatgacagacaaacactctgttgatttcgattttgatattattagattttgtttcg

SEQ ID NO: 19584 - DNA, 1700 bp, Triticum aestivum
  unsure (1)..(1700): unsure at all n locations
  Clone ID: PAT_TA_19584
cgcgtctcatcacgtatccagccgacaccattccgctgctcacccagctgaggcttcgcttctccaaagattccgcggtcgcgggtggggcggcgggggcgaggcgtgcgacgcggcgcggtcgacgtggcgcgggccggccggcgggggccggccttttgaccacgacgacctgggcggcggggtgggcgtactgcaaggactcgacggcagcgttttccccaaggcctcctgggagggcgccatgcctcgcacctacagacgccgctcgcatcagcgcttcgccccctcgccccgagccgtcatcgccatccacaccgtcgctgacgtcctcgcgctggccgttcagcgggactcgcaatccctctacgtatgctctctccgtatgacccgtcatctagacgtacatccacaaggtgcggtcgttggtgctgtcgccaactaggtgagtggatacacttactgcgagggtgatgcaggctgttgctgactgcatgtgcgtctctgtgcatgccgtgtgtttggtggcaaaagatatcggcgacggatatgatggaagctctagtctggagtgcctggtgcttcaggaaccccgggcagagtgtgtgagatgaagcagagaaggactttgcgcacaagagccatcaagctcctagtcctggacgaagccgatgagatgttgagcagaggtttcaatgatcagatatatgatgtctacagatatcttcccccagaacttcaggttgttttgatctctgcaactctgccccatgacatcttggagataactagcaagttcatgactgatccaagtcaggatccttgtaaaacgtgatgagttgaccctacagtgcatcaaacaattctttcgttgctgttgagcaaagaagaaatggtctttagatacaatatatgatctttatgatacactgacaatcacccaagcagtcatttcccggtaacactaatgagaggtgacgatccgctgactgaaagggatgcgctcatgagtgtgttcaggggtggcacgacccgtgttctgatcacaaccgatgtttgggctcgagggctggatgtccagcaggtctctcttgtcattaattacgatctccccaacaaccgtgagctttacatccatcgtattggtcgctctgggcgttttgggcgcaagggtgtggccatcaactttgtgcgcaaggacgacatccgtatccttcgggacatcgagcagtactacagcacgcagatcgacgagatgcccatgaacgtcgctgatcttatctggagctctggaccggagcgatccctccctctctctccctctttgtctcggtgcgatgtttggggatttggttgcgttgcgatgtttggctgtatttctggtgctgtaacttgagatttcttttgttgctttgggaacatgggaagtgtatatattctttctcggatggattgaccaccagctcgtgtaaaacactcttttgttgttccgcctatcttctgatttggacgccatgacagacacacactctgttcattttgattttgatattattagattttgtcgatttgtatattattagattttgtttcaaaaaaaaaaaaaattacactttgtatctgcgattacgtcgcccgcacgcgaacaaaagcaaaaaaacaaagggccggccgctcgcgtnctagaacctagtcngcga

SEQ ID NO: 19585 - DNA, 630 bp, Triticum aestivum
  Clone ID: PAT_TA_19585
ggtcgacccacgcgtccgcattaaaatacaatgtgaacaacaatacgggccatctatctaaacagcgacggggtaggctccacgggatttccacggggcaaggagcagcgacggggtaggctccaggcggcgcacacttcatggggaggcaaggaaccagaagttgatggggtcggatctggcggtggtaggtcgaaactcgatcccgaggccgagacggggaaggtcaaaaaatagagagacccgatggaggtggtcgaggcagaggactgccagtcggcgagctcgggctggagcccgaggcagcgctcccgtcgctacgtggtggagctgcgcacgatggggagcaggctggcgacagggattggttcttcagttcatttgctgcaggactgaatgttctatgggttggagcagagggtgttgagcaccatctgagattggggggctgctcgggtgcgccggctggcttgcctgctagcctggccgttgtcggccatcgcccccctcccggcctgcccttggccctgctgcgtcggcgccgccgcgtttgctggtgggctcctccacgctcgatcgcgttcaactgcctgccgtgcccctcgccactcgcgcatggttcaatggaat

SEQ ID NO: 19586 - DNA, 489 bp, Triticum aestivum
  Clone ID: PAT_TA_19586
ggaaaaagctaggttggcaagatattgctacttacaagcctcctgaagatgctttattcgcacaccctaggctattcagagcttgtgttccaccgggaatgcatcgtttcagagggaacatatgggattttgacagcaaaccaaaagttatgcagaccctcggataccctttaacgatgaatgatagaatcaaggagataactgaagcaagaaacatcgaacttggactcggtttacagctctgcttcttgcatccttcaaagcataagtttgaacacccgcggttttgttttgagcggctggaatatgtaggacagaagatacaggacatagcaatggctgaacgtttgttaatgaagcacttggacgcaccaaggaagtggttgcaagagaagcatagacgtctattaatgaacaaattctgcgggcggtatcttagagaaaaacgtcttcacaactttataatatactcagaggaggttcatgatc

SEQ ID NO: 19587 - DNA, 1265 bp, Triticum aestivum
  unsure (1)..(1265): unsure at all n locations
  Clone ID: PAT_TA_19587
cgccggcgactccatccagctaccgcaaccactcaagtacccacgaggcccagccccacagcgtctcagcaggtgccgcctccccgcccccatccccgccccccccccgccgccccggccttgtctgcggcggctgcaatggccgaccgcgtctaccccgccgccaagcccactccgccgcccccaatggccaacggaggcggcggcccggcggcgcccaagccgcagatgtaccagcgccccatctacaggccgcaggggcaggcgaagagcaggcgcgggcggtcctgccggtgcagcttgtgctgctgcttctgctgggcactgctggtggtcgtcctcctcgcgctagtcgccgcggccgcgggcggcgccttctacgtgctctaccggccgcaacgccccagcttcaccgtctcctctgtccgcctcagcacgttcaacctctcctcctccaccaccgcgcccgtcctcaccgactccatccagctcaccgtcaccgccaagaaccccaacaagaagctcgtctatttctacgacgacttctcattctcggccgccaccgccgccaacgcagtcccgctcggggacgccaccgtgcccgggttcgcgcatgatgccggcaacaccaccgttttcactgcgaccatcaccgccgctggtgtcaccgtagaccccagcggcgccggctctgaccttaagatgtccggcgctttctccgtcgctatagatgccgacacgcgggccggcgtcaaggtcggcagcctcaagaccaagaagatgggcatccaggtgcactgcgagggcatcaaggtgacgccacccagtccacctccgccagcgccgaagaaggtaaaggggaagaatggcaccgccctggcgcctgcgcctgcgttggacaacgccgagacgaccgcgatggtgagcaccgccgcgcactcgtgcaaggtcagagtccgtgtgaagatctggaagtggaccttctaggtataatgccaactttagggactgccatgcaaaacattcaggaaacatatatttttcactttatattggaaagtagagaccatgaatatcgtcggtgtaaattccctcaaagttgattctatttttgttcttgtttggaattttcttaaacatatttttggtgcatgtataacttggtgatttgttatttgtaagattacgattcgaataaatccaaattagtcactgcctgggttaaaaaaaaaaaannnnnnnnnnnnnnnnnnnnnnnnnnnnnn

SEQ ID NO: 19588 - DNA, 943 bp, Triticum aestivum
  unsure (1)..(943): unsure at all n locations
  Clone ID: PAT_TA_19588
accggtccggattttcggtcgaccccgcgtccgcggatagcttcttacgctaaaagcagcgccgagctgttaacaaatcttatcatccatggtcaatcaggccaatatacatgggagtgcctcttccgaacacctttaagcaattatgatgctgttatactcctccataaagagaagctctgccgtcctcaccatgttctttttcccgctgagattcctaacggttagtattaatatttgttgctaacctgatactcctccatattcagctcctgtgccgtcctctccatgctcttttccccccggacatccctgccggtaagttggtaatccagggcaaaccaagcaatgatttccacccttatatgccactcagtaaaagtgttgtgagaagcttgcatgacacaagagataaacttttggtgaattttgaccctaccgcctacttcttgcgagacttgaagtgtgcattccctgtgaccttcaaattgtggcacgattcgattggaggggacgcaattggtcttacatgggagagctcaaagaagcgtggcagagatgaggatgatgaagccatgctggatccaacgtctatactcaaggaggttggagatgtgggtaaagggttggtgaggagtgtacatcttctcaaaagcaccaaagcttgagtaagccttttgcgtgagggagtttgctgatgtgcaggagaggactcctggctgatttcctgccactggctagagaaaggaagacccagagccagtggacaacatgttctacagcaaagcaatgtataaagtcgtgatgatatcatgtggttgttgtaactccaattggaagatcaagtcaacaaaaatctgtatccaaattttgattctgagttccagaaaagtatagcgatgaagttctatttcctgctcatttcagnnnnnnnnnannnnnn

SEQ ID NO: 19589 - DNA, 1480 bp, Triticum aestivum
  unsure (1)..(1480): unsure at all n locations
  Clone ID: PAT_TA_19589
ttccctgtcgacccagcgtccggcccttgggtgngacgaatgatttccttctcatcttttgggtgttcgtttgaccaagtttgccaatcagggtcccgcctctcaccggggttccaactggatggtgccagtcgagaaaggagattagacaaaacggggctcgtgacgactacttgatggccgggaccagtcaaacccaaaccaccaccctcccctccccctcccgcatctcctggggtccgaagccggcgccgccgccgccgccctgctccgcccccccgcggcggcgcccttcctgccggacgccgacctccccctcgcgcccggcacgggtcctcgccgctctcgctcgctaacggcgtaccgccccttcccttcacgcatctccatggggtccgaagccaacggcggcgccgccgcgattgacctgctccgctcggcggcgcccttcctgccggacgccgacctcctcctgacgcccggcacggggctcgtcctcgtcgacctcgttaacggcttctgcaccgtcggcgccgggaacctcgcccccgtcacgccgaataagcagatcgagaagatggtggaggagtctaccaggcttgccaggtgttctgccagaggaactggccggtctttgcgttcctttgatacccaccatcccgataaacccgagccgccttttccgccgcactgtatcatcggttccggtgaagaaaactttgttccagctcttgggtgttgctggagaatgatccaaatgtgttcaatgaggcgcaaggactgcattgatggttatcttgcttcatttgagaaggatgggtccaatgttttcagcgagtgggtcgcaaagttccagatcaaaaccgttttggttgtaggaatatgcactgacttctgtgttttggactttgtgagttctactctggctgcaagaaacattggccgagtgcccccgttggaagatgttgtgatctattccgagggatgtgcgacatttgacctccctgtcgaagtagccaggagtatcaaaggagctttggcccatccacaggatcttatgcatcacatgggactttacatggccaaatcaaggggtgcgaagatagttgacggaattcttgaagaataagactagatcattcatcaggtctgagtcttgctggaaggaccgtgctatagttctatgtagtcctcctgtttatccactctatgtagaataatcagatgctgtatctgccccctgtgcacagacactgttctatgggccatgcatggttatctgtaattatccaagcagtaatgttaacaagcatttactttacagtaagcagaatagataccatttccaatcaaaaaaaaaaaaaaaactcgagacacctcggccgcgaccacgctaatcactagtgaattcttcncccgcgggncgccaatgggngggccggggagcattgtnaacnntccgggncncaaattccgccnt

SEQ ID NO: 19590 - DNA, 965 bp, Triticum aestivum
  Clone ID: PAT_TA_19590
gtgctcgtcgacaacgccgacgccttctcgaaccgcccagtccttcccttcttcgtggagctggcaaagaggcgcggtggccaacgcaacgagaacataagcaccgtgccccacggcccgcactggcgtgctctccggtgcaacatcaccgccgagaccctccacccgtcgcgccttgggcttgggcacctcgcgccgctgcagcgggaggccatccaggacctcgtcgcagccctgcagtccaccggcgccggggcaggcctccgagaccacctccgggccgccgtcttccgggtcatcgcgtgcctgtgctttggggacggagtcgacgagtgccatgtgcgtgccgtctgctcccaggtacatggcttacaggtcgccattggagaggtcaaccccttttctgccccctccttgctagccaagctcgcggagtggaggtaccagcgccaactcttggcctttcatgcccggatcaccgagctgtgcctccctctcatcgcggcacggcggcgacgaccacacgacgacgacctgtgtcgtccgtacgtcgacacactcatacaactccgcgtccccgacgacaagcacggcggccggcgggctcttagcgacgacgagatagtggacctcgtgttggagttcctcggcgcgggctcaggatcgttggtggtgtgcctcgaatggactctcgctcacctcgtagtccagccggaggtccagaaaaagctccgccatgaggtcgacggcgaggccgctgataggagccagctgatccgtggcatgccgtacctgcacgccgtgatccttgagagcctccgcatgcacccgccggcaccggtggccctgcgccacgtccaggccgacgcggctgccgctgcgacactcgtggggggaggtacaaccagcgccgtgactgtgcttttcctcctgggggacattgggaaggtacaggaaggcgtgga

SEQ ID NO: 19591 - DNA, 552 bp, Triticum aestivum
  Clone ID: PAT_TA_19591
ccacgcgtccggttgttgcggcggcggcgttcgtgcgccgggataccttgctgtgtctactcggccccgcgcccgcttcctctttttctcttctccagtgtgtgccaacgagagagatagttcagtagagagacagagaggtgagctagggcggccacggcaacaaaggctccgggggagctccccggtgatgctgttgctgtcgacggcgaggtaggtgagccggcagtgggccgggaactcgggcaacggtcgcgagagcgcgttggtgctgaggttcagcaccctgatgcccgggagcgcggccagcagctccggcgggatggtgcccgagagggagttgttgctcaggtccaggtgctcgaggacggacgcgccggcggtggcaggcgtcgggatctctcccggcgagcgcgttgccgccgaggtccagcttccgtagctggcgggaggagagcagctccaagggcacgtctcctgtcaggcggttgcgcgccaggaggagggtggccacgccggagcacacggcgagcgcggccgggacggggcccg

SEQ ID NO: 19592 - DNA, 796 bp, Triticum aestivum
  unsure (1)..(796): unsure at all n locations
  Clone ID: PAT_TA_19592
tcaggcaantcaaatcaggttatcntggatgcaacntgatntgtcgctattggcaaatctgtgccagcgccatggcaacncagaaggttgancttgcttgagtttgagattgtaacagaggagccttataagaactgctctttccgccgatctcctcccaccatgggaagcagttcaatgattttgtttgtgcttgtccaaatgcatttgctggccttaggcgcctgtggctgcgcaatatgcggccccgcgcccgggacattcccaacctcctcaccacatgcaagctcttggagtctttgcgtttaacccattgccactcagggatccattctgtgctgcaagtagagcatgctcaacttgttgagctcttggttgattatgggcagtttgagagagttgagctgatatgtctaccaaaactcaaacatggggcctatactaattggtcctcttgtgaagatcccatgtattttggttttgtgccacagctttcaaagctgagccttactaaaattggcgtccgttcagaaaagaatattgagttaagtcagctacttgctaatggtccttccataagcgaactacatctggattttagaagtgaaaagatttggattatcccagaatgcccgaaactgcttgcgcctgtgctcagcaaactacagcatgtgaatctggaccatcttcctgaaggatgtgatttagcttggacaatgtttatccttgaagctgctccctccctaaaagagctgtgcatcacagtatgggatcattggtgcataattttcactga

SEQ ID NO: 19593 - DNA, 835 bp, Triticum aestivum
  Clone ID: PAT_TA_19593
gcacgaggacctcctgccctgcccgttctcctctcctcccctccaccattcctctcccccccagcataaacacagctcagcaggccccatccccatcccattgtctctctccgtccccgggtcggggcttaaatccagcacggccattgcctcgtattattcccgaggactccttggttcttgctgcgtcgttccagggacagggtggcggcccccgcctccgtgccctgctcccggcccgctgcccgcgccccgccgtcccgtcagggtggtgttcgccggcggcgaggcaatggggagcggccgtgtctgctccgttgtcgcgtccgtcgtgttgctctggctgggcgtggccgctgcgcagggtgactctccttggaagacgcttagcggcaatgctccggcgatcatagccaagggtggattttcaggcctattccccgactcgagcgaattcgcttaccagttcgcgatgattgcgagctcgcccgatacaatcctgtactgtgatgtccggctgaccaaggatggccttggcgtctgcctgccggacattaagatggacaactgcaccaacattccagatttctaccctaagggtaagaagagctaccttgtcaatggcgtatcgacaacgggatggttctccgtggactacaacggcaccgagctctcgcaagtgtctttgaagcagtcaatcttctctcgcacgcccaggtttgacccaagcttcttcccattgctcgccgtcgaagacgtggcatccaagtttaagcctcctggaatgtggctcaatatccagcatgacggtttctacagccagttcaacatgagc

SEQ ID NO: 19594 - DNA, 363 bp, Triticum aestivum
  Clone ID: PAT_TA_19594
tcgacccacgcgtccggtcttcctatcacacaacccatgaaaacgcccgtctgcatcctgatctccacacgaaaccgcgcccgcctcccgcgttgccacctctcccgttcgagtgaccccacccccacctcggaggcacaggttaccgactccctgcgcgtcgccttcgcgtgcggcggcgcgggggggcacgtctatgccgcgttcgcgctcgccgaagaggtccaggcctcgctccctggctctcgctccctcttcctcggcgcccccgccccgtccctcgagtccgccaccgccgcgtcttcctcatacccattcgcccccctccctccttgcctcccccgcgcgctccttggcgggggg

SEQ ID NO: 19595 - DNA, 481 bp, Triticum aestivum
  Clone ID: PAT_TA_19595
cggtccggaatcgccccaccccacgccggcggtgggttaatcagccgacccctctgtttgctgctatattaaaaccctgagccagtgaggtgattgccccatttcccatggcgaatcctgcacgagttggtgcctattccatcctcctgccatctgcacctcaccaggccgtccgcctcccggcggctgctccaccatctgcgtcaaagtgtgggttgcagatgcaccatcatggaagaagcaagcctccgcgcgtcagcttcgcctgctcagcctccaaccttcctggcaccgaaccagcatatgtcctcacggcaatgttggcagaagaaactataggaccgcgcagtgatgtggaacgggatgctagaatacgaaagcatctcaaaaaccctgaactctcgccgtctgcgtatgacacggcatgggtggctatggtgccattgccggactccgatccgcaggctccatgcttccctca

SEQ ID NO: 19596 - DNA, 750 bp, Triticum aestivum
  Clone ID: PAT_TA_19596
cgaagagacaggaggatataagatatacacctgttcctctgagactagcaagcttcttgaggtctacccgcagcggcttctcttccccttggagccaaaaaaacaaggaaactactggatctggatgcccagtgaccctaaccaacagtacaaacgattacgttggcatctggattaaaccaataaatgggaaatttaaggaaacagagataatggagccccattcgactttggttgtgtatgcgacaatgaagatgcatgcacaacctcccaaagacaaggtcgagtttgaggtgctcatgattatcctacggtcaaagcaagaccatggaaaaatgaagtcattcattgttgacaagctgaatatggacagtggctttatggtgcatgttaagaaccttaaggcagaggtgtatcgggcaatgctgacagctatcacttgtgacccagcaagctgccagatcatatcaagatcaatagaggatacgaccttggtgacatccattgacgcgcaccccactaagccatggattgtgacgggtcatgagggagggaatttttccatttgggactaccataagaaggaaactgtgatgaatgtgcaggccaacgaggtgccacacatggttacacgcatgattcatggcatcactaaatacatcatagagacttctgttggacatgcggattattcagtcaaatgtacccctgaagggaaacgggatgtactgggggacagtcatggataca

SEQ ID NO: 19597 - DNA, 728 bp, Triticum aestivum
  unsure (1)..(728): unsure at all n locations
  Clone ID: PAT_TA_19597
tcgacccacgcgtccgcaagtctagtcactgcacaggcgacctactataaatagccacccacacgcgcgcgagaccccgcctcgcctcaagaacccccttctcatcaagaattaagctgcgttttgcgtcaggttgatcagaaaaaaggggctgacggcgacaaaggggggaagagggttttctcgttgggggaaatggcgcgcaatgcggcggacaaggcgacctccatcgacgcgcagctgcggatgctggcgcccaagaagctctcggaggacgacgagctggtggagtacgacgcgctcctcatcgagcgcttcctctgcatcctccagggcctccagggggacaagatcagggagacggtccaggaatgctatgagttagctgctgagtatgaacgcacacttgaccctaaacagctggatgagattgggaacctgttagcccggttggatcctgaagactccatcgtgacaaccaagtcattatcgcacatgcttatcctggcaaacttggctgaggaggtccagattgcgtaccgaaggagacagaaactgaaaagcggtgattttgctgatgaaaattctgcaacaactgaatcagacatagaggagaccctaaaaaggctagtttgtcagctcaacaaggcgccactggaagtatttgatgccctcattgttttnttccatnnactnggggggngnntncntcnccaaacngggggggt

SEQ ID NO: 19598 - DNA, 622 bp, Triticum aestivum
  Clone ID: PAT_TA_19598
ccacgcgtccgtccccttcttcccagctgcgccgctccactccactcccccccgcgccccccgccggcgaccggcgccgcagctcgccgctgcctgctagacggcggatccattaactggcacccagaatccgctccttttctgctcgattccgcccccggttggccgcccacaatcccgacctcgaaccctagccacgcaggcagcaatgcgctccaatcccgccacgcctgcgaatcccagcgggagcggaaagcgggggcactacaactccgccaacaagtcccgccggaagggcgacacggcctataggtgctcgccgcacctcatcccgccgatcatgaagcgtctcagcgacgggcagagaggctttgtcggaaagattgggtttgggagcctgctgtccatggcagacttcgagatggacagggccctcaccctgtggctgatcgacaggttcagctgcgacgccgaggcgctcgagttccacggcggcgtgtcggtcccggtgaggccgctcgtggcgcccctccgcggcctcccggccggcccctcccggggcctcgcgcgcctcctccgcgccggcgcgctccgcacgcgctaccgctgcctgaaagggaag

SEQ ID NO: 19599 - DNA, 794 bp, Triticum aestivum
  unsure (1)..(794): unsure at all n locations
  Clone ID: PAT_TA_19599
cgacccacgcgtccgtgcttatttaactttgtttgacagagctcactccttgtgtaaggtgctcacaacaacagtccctttcacccttgaactaaatctcaagtcacagttaaatagcagctgctagattgaatgtttttttttcgttcaccagcagctccttaaatgaaatcgaggtttcccgacccaccaaagcccctgtttatatatttattcaaaggcagacgatacgtgcaatcacctgacatcagccaacattgcccaaggctttcagtttgatagatttaactgaaatcaactgttttcgctcggctttccatcattttccggagttctccagcagcggcagccgcagcgtccgcagcctcacccaaacccatcttctgtagcgcattggcaaagccatcaacatctgttgcggtgattttatacggggtgtgactcgggccagggaaagaccgtgtctccacctcttgcttgtagtctgagagcgccttgttaatgacactgccgacgttgccgaattgcttgcagaatttcggtgtcaccttggcatggtgtggatgctgcatcatccctaacaagtcatggtacaccaagacctgcccactgcaggatggccccaccgatccgtggttggattcaaagctggagttcaacggtgcacggggctggaanaccaacaaacgngaanacancnctgaaccagngcggcncaaacttancacaacanggcttccgnggcaaccacagncacaaanccgnggagccaaggccagaaaatcacncaatng

SEQ ID NO: 19600 - DNA, 484 bp, Triticum aestivum
  unsure (1)..(484): unsure at all n locations
  Clone ID: PAT_TA_19600
gtcgaccccgcgtccgctagttcttcctcgcgagcgccgaaaaaggccggctagtcggagagcttgaggttgccgcagcacagctcgtccgccgccaaagatgttctcgccggcgatccggaaaccccacctccaccgcagggagaaggaggaggcgaccccttcaccccctcctcccgctcccgcccactccccttcccctggtggattcatcctctccgaccgccccgccaccggcaccccggccccatggaccacctcctccctcctcgccaggatttcgacatcaaagcaaacagacagggccggcgattctgaccagatccaaccagtgcgcgtagcanagtttccccaagtcgtgaggaatgcacaagccaaccttctgcagaggaatttcgccggcaagagcatgcttgtaggtggcattgacaaagagacatcccttgcangggtgangntgtggaaatgagcttgnggngggggg

SEQ ID NO: 19601 - DNA, 744 bp, Triticum aestivum
  unsure (1)..(744): unsure at all n locations
  Clone ID: PAT_TA_19601
cggacgcgtgggttttgacaatcttgactgcattgaaaagacagtttcagcccaagaagatctgagcatgaaggcgggcttgtataaacatgttgttgatcttaaagatctgattaaagttgagtggaagaaatatgacgttttgtcggggtttggtagcatacagaagttacaaacaattggagaacctgtagatgttctagagctctcccccctcgcgcccgagcttgtacttgatgcacatgtatggggatcgccgtctgcacatgatgcactcactcaccaagaaaaactgtactgcggcaactgatccacaagtgtcctaagaagtttcctgaaagcgtgttagaggattcaaaggctgagatttccagcacacaggagaatatggagaagtcactagaatattctcagtcaagttctcttatcacggatagtgggaagccattgctcagaagagaacatggtgacacaactgtgtcacattctgggttgccacatagtgaagtntccncagtctgtgaagcttgctagtttgctgggctcacattgnccgccccatgtgaagncanacatgggggggngntgatgactaacttganagacattgaaatnnantttccataattttttaaaaaatncttggatggctggnttgngggnacctttantgcccactgttgngaaagggtctntncaaaagttggnccatnaaaaaantttgnttgganaattnaaaagggt

SEQ ID NO: 19602 - DNA, 419 bp, Triticum aestivum
  unsure (1)..(419): unsure at all n locations
  Clone ID: PAT_TA_19602
tcgacccacgcgtccggctcccgcgtcccaccgccgctgctgactaccacggcgccgccgcctaccatgccgtcgcggccggccacgacggccagtacccgtactactcctacggcggtggcgccgacgccttgtgccgctgtggcaggccggcgacggcggccgtgcccaccgaggagggcttcttccacgacatcttcgtcgcccgtgcacgtcaggagcagtcgaggtctaggtccaagtccaccaagtcgtcgtcggtgatcagctccggccgctccgccttccggtcgccggccaccaagcagtttatcgcaaggctggatttgtttgtgttcgtgtcgagagatccgggcaagttctgggcgcaaaggctggatttgggggccgggcggtgtcaatctccngtccaattgttt

SEQ ID NO: 19603 - DNA, 552 bp, Triticum aestivum
  unsure (1)..(552): unsure at all n locations
  Clone ID: PAT_TA_19603
tcgacccacgcgtccgcgccccgccccacttccctccccaccttctccggctgcgccgcccaccacctcctctggccgctccgcccaccacctcctccggccgcgcccgacgacaccaccttctatgccggctgccaccctcttctttctcccgcaccataagcggtcatggtgggccgcgggatccggccgccctcggcccccggcgcggcctcagccaccggatacggccgccacgaccattggtgcggcaacaaaccacggatccggccgccaccgacccctcggcgtggaagccgtccgctcgcgcagcctggcgcctgatccggcgaggtccacaccggtgcctctataccgcgccgccgaggcccgggttgtcctctccctctccggcagggaggccccgtcgagcaactcccccgcttgccaccaagaggaggccggccaggaggcaggcgctagcggccccctgctgcccgcggcagatccgacgagccaacccacatcctcatctccctcgtggcggatccgacgagctctatcaccacgcnn

SEQ ID NO: 19604 - DNA, 607 bp, Triticum aestivum
  unsure (1)..(607): unsure at all n locations
  Clone ID: PAT_TA_19604
gggtcgaccgggcagctcattggaggtggaggacggggtggctgaactagcgggacgatgagatcgacgacggatcctcatccggtacggtggatgagggatgtcgaggtgttgctgtggacgacgtcgtcggggaagaggctccggctgggtggcggacggagcagggtgtggggtttcgtcgcgggttttcgcggcctcggtgtacgaatgggtgggcggatgggatggcagtggggaaccatggcttagagacgcgcttgtccgaaatgtggggtaagttacgaaagtacccccaccgatttgaggcggttctttcggttcaggggtaccacgggcatttcgcgtgtcgggatttcacaggaggtgggagttttcgcgcgcgttgtaatttcggaatagcaaggcgcgggttgagatggagggagttgtcggagcacaacgagacaaagatatatcttaaatatttcgggctaacaaggcgcggattgaagacgcgggagtttcgcatcatgatagacagagacgctagcttggattttcggcataacatttcgggagcaagcctaacatgtacccgtacanatcaatgcgccctacanatgtc

SEQ ID NO: 19605 - DNA, 638 bp, Triticum aestivum
  unsure (1)..(638): unsure at all n locations
  Clone ID: PAT_TA_19605
tcgacccacgcgtccgagcgaacaacatagcggcacgcaacacgccagccgcagcaaagcgccggtgccgcgccgcttccccaggacccaagtcacctgccatctcctccctccgccagcggcagcaacctcgccacgcgccgggcgcagcggcggcatggcgatgtctcgcgccgccgcggcggtcgggcggcgccggtgcgggccgcgcctgcccgcggcgaggtccatggcgtcgtggttcggccacgtggagccggccgccaaggaccccatcctcggcgtcaccgaggccttcctcgccgacccctcgccggacaaagtgaacgtcggcgtcggtgcgtaccgggacgacgacgggaagcccgtcgtgctccagtgcgtgcgcgaggcggagcggcgcatcgccgggagcaccaacatggagtaccttccgatgggaggaagcgtgaagatgattcaggagtctctgaagctggcatacggggaggattctgagttcatcaaggacaagaggatcgcggcagtgcaggccctctcgggggctcgtgcccctcgcctctttccagattccctcttccggatcacagtntaatactaccctaatgtcaancatcacacattgggggatgccaggt

SEQ ID NO: 19606 - DNA, 1385 bp, Triticum aestivum
  unsure (1)..(1385): unsure at all n locations
  Clone ID: PAT_TA_19606
cggncgcttcttttcccctgcgccgcacgaagcaatggcgacctcgccggcgctgctctcgcggcagtacgcgcgcccctcccctcctcctctcccccgccagcccctcgcgccttcgcccgtcgccgcggccttccctgcggtgcggctgcgcgtccgccgcgggccttccccagcccaagccaagttcggcaagttcgacgccgcggaagcccccacggaggccgggccgactgcgccggcgacatcggaggccgacggcgcggcggggcaggcggtgctggaggatgacagttgcctgccgtcggatctggagggcgcgatatggcagtcggggaaggccagcgccgatttcgtcaactccggcggcatgcgaggaattgcagagctgctgatccctcagctggagttcctcaaccaggaaggagcgcaggccgaggtctgggcgctgtcgaggatactcctcgacacactcgcggaagagaccggccaggtagttaaggccgtcttccctgacgctggagtggctgcccttctcaagcaccagtggaaagatgcaaagttcaagtgtgctagtcttagcgaccgaaagccagttgatactgatgacggagttgttgttatgattatccctgaccaccagatgcttgaatctgttgaacgcatcgcatctcaactcgctgatgatcccataagacctcttgtcatgtggaacccacgtcttgttagtggagatgttggagtgggatataatgttcggaatctacgcagaaatttcttaagtacttttaccactgtttactcgatgaggccgttgcctaccggtgcaatcttcagatgctatcctgaaaagtggaaagtgttttatgatgatccaaaaagacccaatcggtatttgctcgccagagaatcttcaagtcgtcctgatgcaacagatattgagataatatttggcgngcggcggcgccagcgagcaacctgaagaggagccttcgatgatgaccaatgtcatggccgcgtttagctccgtgagccggtttatgagggtcatctccaagtgaaaatcccaggcagctctctccacatttgaagccatcgttaagcacctccaaagaggatttgggtcaggcgcaaggccggatatggcggtgcttgggcaacttcatgcgtgnggcaggggctacacgctactgctgttcaggaatcagagaagttcaagaacaatggtttgcacgcacttggtcgttagcgaaggttacaaccgtgtcggcataatgtcacgcacatatgcntgcaattggtnttagttacgggtnaaagcattgtaatagccanatctttccnaanttatggnatcgaatanggggggccgtaccaatccccta

SEQ ID NO: 19607 - DNA, 801 bp, Triticum aestivum
  unsure (1)..(801): unsure at all n locations
  Clone ID: PAT_TA_19607
acgcgtccgcgacgagaggcggttcgccattctggaggcagggcagggcaggattgggctgctcaatattggtagaaacacattggacttgtactacaagacctggccaggcaaacgcaatgaagagtggcaacacgaaacgaaagatcacccattgcccgactatcactggcgcatcataggttctgatgaggagtacttgctcctgagagggatttcacttgattggcccgccgccgcctgcgccccctctgcgcgtccccttcccggggctcgccccctgctcctcctggctctcctcctcgggggcacgccgggcgcctggcacctctcggcgcgtccccacccggacggggccccaccgccgtcgctcttgccccgcggccgctcaactcgttacatatccttcgcccttgaatgtggagaagtggctacaaaactgtgagcagagcacattgaaggacacaaagttcgagcacattgaaggttacatatcctttgtcctgtgtattgccgctggagaagtggtgaatgagttggtgtggttgtctgacggcaagaagcgtgtcagtggaggccggaagtttgccgctggcggcagatggtgggaaagtcaggatgggcgccgcgaagggatgcccaaccttatgtgccaagttgggcgttatcggggcgccaacgatctttcctgagctgcgtccttgacccacagtttgccccacagtcctccgttcggtggggccggggtcctggcctaaggtcnattcnaaaaaatcctggcaacccaaaagcaatgttttn

SEQ ID NO: 19608 - DNA, 575 bp, Triticum aestivum
  Clone ID: PAT_TA_19608
gcgtccggaacaaagcctccctcattcagtcccccgcggccccaaaaagatagatttggattgaaggtgccaggcactgtttcgtcaaaatgattgttggaggtgactattttgaaggttcccatgatcacaatctcatgacaggatctttgacccatgattcttctctggctcctaaatgcaacgacaacacaaatattgagctacagagattcaaggtgcagtcgttttctgcagatatcctttctgattcgaccaatctttcttctgaagctgcaagagcaatcaaccacctccagcatcaactaggaattggtttggagcaggatatgccaccagtggaaactgcgacctgggatacttctatctgcaccattcaagaccaaataatcaaccatcagcttagcgaagatccacaaaacatattggtgcaacaacagattcaacagtatgatgctgcgctttatccaaacagtggttacacaccagcacctgatctcttaaaccttctccactgcactgtggctccagtgttccctccaacagcatcagtctttggtgatacagcactaagt

SEQ ID NO: 19609 - DNA, 768 bp, Triticum aestivum
  Clone ID: PAT_TA_19609
gttttttgacacaaaacacaacggaattctaggatttgaagaattcgcccgtgcgctatcagtatttcatccaagtgcccctcctgaagagaaaattgacttctctttccagctttatgatctgaagcaacagcgtggccgcggccgacgtgaggttaagcaaatggttgttgctacacttgctgaatcaggaatgaatctttcagatgaagtcatagagagcatcattgataagactttcgaggaggcagacacaaaacatgatgggaaaattgacaaagaagaatggcgcaatctagttctcagacatccctcattactgaagaacatgacactccaatatctcaaggacatcaccaccacatttccaagctttgtgttccattctcaggtcgacgatacatgaagtcctgagagtgttttcacttcgatggaatatcagaagacggtctcactgctttgttaagcttttccaatggccggctgatggttcggcggaagccatcgtagtgttcccaaagcatactgcatactgtattcgattattccgctggtttatttgtgttcataatgttttttttctttagcttagggtgggctggtagtagatcagaatgttcaaagtttctttcgtttttgtacaaaaaaaaacgctggtttgaccctttagttaactgtgtatgtattctgtgtggggaactttcctactgtatattatggattgaactgaacggagcagaaatgcctttgctgataaaaaaaaaaaaa

SEQ ID NO: 19610 - DNA, 556 bp, Triticum aestivum
  Clone ID: PAT_TA_19610
cacgcgtccggaacgtcaagtgtgtgaggtacgacatcgacggcgagtgccatgtcttgctggtcgcttgccgtgatatagctcgtggtgagaagctgtactacgactacaacgggcatctggtcgcgtgcccaacgcggcacgtcgtctaactcccccaatagttctgacctgcccagcatcaaggagtctgggcgattaatggcggcactttcagcattgccgctgaaatccagtaacttatatacagttcaattgccagaagaggtccccgatggcgaacaatatacatgctgatgttgttagtatctagtagtgacaacagtcttcattcagctgtggagagagacaagtgggatcttcgttttctttttctcctgacctcccaagatgccgtcgtcttattcatattcattgttgttgcggagttcctgctcgactagagtctttctcggggattcatgcccctttctataggagtaaatatctatctgcccctgtctctctctgtcgaatggttaagtagctgttgtgtcccaattagtggtacatttga

SEQ ID NO: 19611 - DNA, 693 bp, Triticum aestivum
  Clone ID: PAT_TA_19611
tcgatcttcacatcacattcttctactccaatcaacatggctccaggttcagccaccctcgttctcaaagcggccgctgtcgcttccatcctcgccatgatggtcctgccctccctgggacgctgtccgtcgctcggcccagaaccgccggtggcggctccggcaccggggccggggccggcgatgcggtgtgacgactgtggcccgcactgcatctcgacgtgcagagtctccgtccctccgaaatgcagcaagccctgcggcgctccgagctgcgacgagtgcaggtccgccgcgttcgagaagtgcagcagggccgactgcgacggcgaggcgacccggtcgtgctacgactcttgctccaacagctctgcgtgcgcggactgcaccagggctgccagcaagcagtgctcggcggactgcaacagccactgcgccgccacctgcttctgaagagaatcaggaaagggaacacgcgccgtctacccaatgtgtgcatctgtttcgtggttctatcgtttctagtcgtgtacgcatcaacgtgtggcataatgtgcggaggtcgtttgttgtcatcacggactaccttatgttcaatcactgtcttaacaaattactactactcggtattaatttttgatttggaataaaatatatccgattcttactgcaaaaaaaaaaaaaaaaaaaaaa

SEQ ID NO: 19612 - DNA, 1002 bp, Triticum aestivum
  Clone ID: PAT_TA_19612
ggtccggaatttccgggtcgacccacgcgtccgaaagccaaagcccccaccggagaagacacacaggcgcagagcaggagccagcccaccacagcgagaaccaccgcccctctttctccttctctctctctctctgccgggcccccggctgccccagcgcgcgcgcgcgcgggcggggcgcgcgccggcgcggaggggcgagaggatggagtccatggagcccatggacatcgactggaacagggtggtgtcgcgcttcgtgctcgacgagacctacgagggcatcgaggcgccgcactgggccgacctcgccgaccccgaggcccccaccgccgccgtcgacgacgacgcctggttctgccgcccccattgcaagcatcccaagacggccgacgacttcctccgggcacacccccagcccccaggccaagctgctgcgattcaatgtccgccatgatgcccttccccgagaagggacgcctacctcagggacgccaataacaatctgaagagacgaggctccgtcgccgccggcggcggcggcactgccgccttcgcctcgcccaccaagcccaagccgccgcccaagaagaggttccaggacgacgccgagaaccaggaccccgcgctgaccacgccgcccccggcggctgccaggccgccgttcggcgcgcagcggtgggccaagaacgccaaggaggccatcaagtccagcgcggagaagcggccggacgtcgctgagaaggaggcgctgctcggcaggaacccggcgccgaggcagctcaagagcactctctcggccaggaacctcttctccgggaaggacatacttggccagatatcggatttgtacaatgacctcaagcagcggatggccggcggtggcggcaaccagcagcctgtctcagagtcagaggccatggaggaaatgagcccaagaccaatgaacagcagtggtgtggtggagaaggtggattgtagcagcggcggcggtggtcgggt

SEQ ID NO: 19613 - DNA, 828 bp, Triticum aestivum
  unsure (1)..(828): unsure at all n locations
  Clone ID: PAT_TA_19613
gtcagtgtcctgagaggctgccggcggcacggnccagctgtccccgtcctcctggctcacccgccgtcaggttcccccactcccaatcccgaacgattccgcggctccgccgcagatggtgatcccgcgcctccgcgccatgccctcgtccggcaggcttaaggttctgttggcgccgccgcgcgtcgatacggcgttctgcggtgcctcggccaccccgcgtccggccggccgcccccgccgccgtcactgcgtgccccccccccccctccatcccctcgccgcctgagagaggnccccgcctgtgcatttcattagtctgatctgatgaacctccgtttggcggcaaggtggctcaacgctttcttcagcgcaaaaaaaaagatagcgagacgactctatggctggttgtatgcgcactgcattgacccagccagcggcccagcaacttgtctgaagaacggcggctccgtactctagacacgctaccatgacctgaccggcggccgagcaactcgcctgcagaatgtcaatgaaggttgactcgcggacatgcatgttcacacgttgtttgattggaacctttttgagggactaagatatttggcgttcaagtctcgggactgacctgtcaacatgtcaagatacctccaaacctctgaatacattgcatctaccaggccagtggcagagtagagtgtttgactaggcaacattatccaccacatggtatgaacccatgccttccacttgatgaacacaaagtatgcatggactgctaggtgaaggtcgaggtcgtagccgggctgggtgcgcgcgcgtacctcc

SEQ ID NO: 19614 - DNA, 637 bp, Triticum aestivum
  Clone ID: PAT_TA_19614
cttctgctgctatataacaacaagcacagcaccccattctactccccacgcgctcggcatcctacacttcgatcccatcaagttcaagtgtgtccaggtgttcttgcatagatacactgaagtgagtaatagcatccttagctacgtggatggctttagcgctcaaggcgtccctctcgccgtcttcctcgcctctgtcgagcccccagagaagccgcgccagggcggcagtggcagtggccacaccggggaggcctgtcgtcgccagggcactggccgcggcctcggtcgacccggcggtggtcatgccgacggcgaggaggcttgcggtcagggcccgcgcagcggcgaccttgcttgccccggcaccggccggtaagagcggcatgtcggtagcgaaggccatgtcccaggccagacacaagggcaagacggcgttcatcccgtacatcaccgctggcgatcccgacctggccacgacggcggaggcgctcaggctcctcgacaccctcggtgccgacgtcatagaggtgggcatgccgttctccgacccctacgccgacggccccgtcatccaggcgtccgctgcgcgggcgctctcggccggcgtgacaacggacgccgtgatgtcgatgct

SEQ ID NO: 19615 - DNA, 400 bp, Triticum aestivum
  Clone ID: PAT_TA_19615
ccacggcgtaccacttacatcgtcttcctcttcgcttcgcccatggccttccttgctgtgctcctcctagttgtacttgctctgcttgcggttgccgcgacgcagctgtgggactacgccgtcgtgcgcctcgtatggaggccgtacgccatgagcaagtggttcagagagcaggggatccatggaccctcctacagcttcttgaaaggctgcaacgaggacgtgaggagcatgaaggaggagactgaccgcctggtgctggacgtcggcgaccacaagtacctcccgcggatcgcgccccactacctcaaatggaggggtcaacatggagaaccatttctctactggcatgggccacagacccgaatctgcatatttgactacgaattggcaaggcaaa

SEQ ID NO: 19616 - DNA, 1771 bp, Triticum aestivum
  Clone ID: PAT_TA_19616
ttcggcacgagggtcacagagcgagcggatccgctcagcaagagaagctctccgcccatggccttctttgctgtgctcctcctcctcgttctgcttgctctgtttgcggttgccgccacgcagctgtgggactacgccgtcgtgcgcctcgtatggaggccgtacgccatgagcaagtggttcagagagcaagggatccatggaccctcctacagcttcttgaaaggctgcaacgaggacgtgaggagcatgaaggaggagactgaccgtctggtgctggacgttggcgaccacaagtacctcccgcggatcgccccacactacctcaaatggagggctctctacggagaaccatttctatactggcatgggccacaggcccgaatctgcatatttgactatgaattggcaaggcaaatcctttcaagcaagtctggacatttcgtgaagaacgatgcacaccctactctcttggctttggttggtaagggactcgggtttatggaaggcgcggattgggtgcgccatcgtaggataatcaaccctgttttcactattgataagctaaagatgatgacaaaaacaatgttggattttgccaaaagcatggccaaggagttggaagatcaagcatctcaaaacgacaatggagaaacaaaagtagatatcaataaatttttcagtgagctaacagttgataatatatcatatgccatctttggaagcagttacaaattaggaaatgaagtcttccaggcccaaactgagctgttggggatcactatggaaactttccttgacgtgccgataccaggattcaaatatcttcctactgaaaggaatcagcgcaaatggatgcttgaaagaaagcttaagagcctactcacacaaatcatacaaccacgattggcaactagtgaatatggaaatgatctgctcggtgtgatgcttgactcttgcatcgaaaccaagaaaggagggaagcaggaggatctcagcttgagcctggaggagatcatacatgagtgcaagctattcttcttcgctggtcatgaaaacacatctcttctcctcacatggtcggtgtatttgctcagcatataccctgaatggcaagataggctccgaaaagaggtctgtaaggaatttgggagggaatctcctaaccccaatgcgctcaacaaactgaaagagatgacaatggtgctcttcgagaccttgaggctctactcgcctgctctttttatgcaaaggaaaaccgtgaccgatatgacagtgggatcaataaaactgcccaaaggcatggcaattgtcatacctattccaattatgcatcgcgacaaggaggtttggggtgatgacgcagatgaattcaagccactgagatttaaggatgggatcacgcgtgcagcaaaggttccacacggcctgctagcattttcaatgggaccaaggtcttgcattggtcagaatttttctatgttggaagcgaagtcgacgcttgccctgatgctccagaagttctcattcacactttcccctgactatgtgcatgcgcccgttgatctgtttactctcaaacctaagtttggtcttcacgtacttgtgaggccgctggataagtgtaattagactagtattttatttgtaacattgccatacctcaaagaattgatgaacctgggttgtacttgatggtacacactgtatgaagtgaatgtagaccaaaataataaataaaacaaggaagtacagtaatattattactctc

SEQ ID NO: 19617 - DNA, 614 bp, Triticum aestivum
  unsure (1)..(614): unsure at all n locations
  Clone ID: PAT_TA_19617
gggcactgcggaacctctgagagagacgacccaactcagaattcgcaagcttcgcttgctcgccggagcagcacgcgcaccagatggccgcggcaatggaggtcgacgccggcggagagaagccgtcggagaaggagctcttcctcgccgcggagtccggggacgccagcgtcttcgcctccctcgcccccgccgacctcgccgcaagcactctccctccgcaacgaggacggccgctccctcgtccacgtcgccgcctcctccggccgccccgaggccgtcgccgcgcttgtggctgcggggggcgacgccgtggccagcgccgtgaacgggaaggacgaggaagnggtggggccgccgattcactcggttgggcancaacggnaacgnccanattatccaaatcctgctcggttanggtgcnaaatgttgatttgactaatgaagctgggccgaactggtcctcaatantctgctanttaaaggaaaggtttaanantgcttnaaaccttaatagctcaaccctgcaaaatngtnaaaaaaaaaagntaagtttngncggcacaaccctgcataaanctgccaagtaatnggaaatnctganccttttttna

SEQ ID NO: 19618 - DNA, 510 bp, Triticum aestivum
  Clone ID: PAT_TA_19618
cccacgcgtccgcccacgcgtccgcccacgcgtccgcccacgcgtccggcttgctgagggagctgcttaccttggaagagagaaaagtggtcgctcatccattaccatggcaacacggccgggccctttgaccgaatggccatggcactggatgggcagcttcaagtacctggtcttcgcacctgtggcgttgcaaactgcatacagggtggtcaccaaggggtggggggacatgaacctagcctacgccgccatcctaccagctctgcttctgaggatgctccacaatcagatctggattagcttgtctcgccaccagaccgcacgcaggaagcacatcatcgttgaccgcagtcttgaattcgagcaggtggaccgggagagatcctgggatgaccagatcatcctctctgggctgtacttctacttgggttatgcagccataccgagtaccagattcatgccaatgtgggaaacaaagggagccatcatcatggcgttgcttcacat

SEQ ID NO: 19619 - DNA, 1042 bp, Triticum aestivum
  Clone ID: PAT_TA_19619
tgcgggcgcgtcgacgcgcagaggacatcctgcacctgcgcgtcgcggacggcacctctgcccgactggcattctcaagggatgagaagcctcaggtaccggttcgtgatgtccgaggcgatccgcactgagcggagggccctcgccgaggggcggtgactcctaaacctcagtttccctcccatgtgacccgccaggcttccaaggagtttttctctgtggaggcgaggctcaggtagaacacgcagtagctacagctttatgcgaaagaggtgtccaggtaatcaagaatcaaaagaaagaatatgacatgctcaagttgcgagttccagagagcagtgttgccttatctgaaattctccagtgacgaaacaccgcagatgtgggcaggagttaagctagatgttaagcatcaaatcagggcaccaaaaggagcaacattcattcccacatcacagtttacccttaaaaggacacgccaggattgcacttacttgagcatccctgcaatgaagatcccagaggcaatgcagaacgtccacacctgtgagaattggcttccaagaagggtgatgagcgcatggcgtattgctggaatggtacacgcactagaaggttgggacatccacgagtgcggagatgatatgatggacctcgagaaggtctggtcggcagctattaagcacggattcactcctctgtcaaaagcttgattcttctggatcctggaagatatgttactcaataatgatgcgaatttgaggttcagtgttatggagtgtcgaataagcctgtggcttactagcttcagtgagcagggttcgcatatgtctggatagaaatccctgagcacggtatcaatagttaagtactgtaccttgtattgttagtgatctaaaagatcttatatcagtttacagagggagtacacgataaatgaattatcaactcacaggaactcgttaaagcatgtgccgcattatcagtgatattcaaagggggaaattcgaactaagaaaaaaaaaaaaaaaaaaggccccta

SEQ ID NO: 19620 - DNA, 1978 bp, Triticum aestivum
  Clone ID: PAT_TA_19620
gtggctgtgcgttccgggcaacaaacaaggcgccgcatagctctctagcctcatccttctttctttctttctttctattttgagggatttaggtgcgcaagccatcatgactttccgttgtaaacatacgagacataacagttggctgaatatctcataacaaaattatccgtacctattatgtggaaagaaaggaagcaacgtctcaacgcaccgcacaaaagaagtacagagagaagaaaatataagccaaacccaacatttagggccgtggctttcgcagccccggcccctcctttatttcgccagcaacgcccccatttctttggatcagcaggcttcctcaccgcttcagcacgtagcttgtggtatcacatggtaagagaataactcaaaaagcacgagctcgctccccaatttaactttaagtagatcacattctacacactctatgtagtatccaaaagtccgatacaaagtagtggatcctaccaatggcaggcaatatttaggcctcggatggccccccatagtagtggcctagttgttgctgctgttcgactggtgcctggggtcagagtagtcaagcgtctgtgacgtcctccgtggggctgagtttcgctggaacgtccctcggactcacgtctggcgcacgacgacgcgatggttcagcctcactgcttggcaactctcggcttctagaaacagcagctcgccttgaggacacgcctgaccgacccaaaaaagtcgatgtgcacaacagcgtttccttcggggcggcccatctgggcctaactggtgacttctgtttcgattaacggcccctacttattcctctatatggaagctgtcatcgtgtagggtaacctcctcacccacttctccttccctcttcgccggccggcagtctatatttacttgcgattggagccacccccgagctttgtcctgcggcagcggcaatagcgcgtggtggaacactcgtcatttgtgactgctggtatttaagaatggtccagtcaaaaacataatcaaactggaatccctctcgaataaaaagatctctgaacaatctcttcagatattgatagtctggactgtcttcaaaacgcagtgcgcggcagtaatggaagagtgactgtaattcagaagggtatccacgacacaaagcctcacttgaagtggcactcttccgttcgctgattttctcatacttctgtttcttcgtaccggcttttaaaccctgccatgggagacttcctctcaagaagtacatgagtacatatccaagagactccatgtcatcccttctgctttgttcaattccaagatgggtgcttacactcgcatatcgagctgtcccagtcaaatttttgttctcccggtatggaatgtgctggtgtgttgacgtgtccctgtatttctttgccagtccaaagtcaatcatatatacctgatttgctctctttccaaggcccatgagaaaattgtctggctttatatctcgatgcaagaaggactttgaatgtataaattcaactcggttgatcatttgatcagcaagcatcagaacagttttgagcgacagttttctgttgcaaaagctgaaaagatcttcaaggcttggccccaacacatccataacaagaacattgtagtcaccctcaacaccaaaccacttgacatttgaaatcccagttccgccctgcagtaccctgtacaactttgactcatacagcaactgaggatgctttgtcttcacattttcaagcttaatcgcgacctcctcgttggtctgcacgttagtaccgaggtagatctccccgaacgagccgctgccgagcttacggccgaggcggtacttgttacccacgcgcggctccatcggcggccgcgcacgcacacacgccaccgagccgccgcctaggttggggacatccagccacggaagaactgggccaggggaggaattgtgggg

SEQ ID NO: 19621 - DNA, 641 bp, Triticum aestivum
  Clone ID: PAT_TA_19621
ccacgcgtccggctgattctatagagcatgaaccaaattaaattttgtatatcaaagagtttgccatcaccccccatcctgttgctagtcctgagtcctgacccttcattcgacctattcttggatcatttaggctccctcatttcctactatcactagtacccaccattgcatcaaccttgagcaattctttcatctcttgcaactctgctctctgccaccatttccatacattcattctgctctgcgccgtagaaagacagacgcttctcagagaaaaaaataaagcccctgacatatttctagatgcatatgccattgttagagagggaggaggaagagataagaagaggcctgccgagcgccggcttcttcgttacgtgtacataagtcatattatagcaaacaaaaattggaggattggttattctgcgggggaacgaacggtcgcgccgtttttggcgccaggccagtttccatttgagttgagaaggatgttgatgtaatctggtaggaaggttgtcattttcatgtcctgtggagggccatgtggcgctgatgtgatacatatacatgctgacatttctttctttctttgtttctatgaataaaaatagcccgacaaaaaaaaaaaaaaaaaa

SEQ ID NO: 19622 - DNA, 1120 bp, Triticum aestivum
  Clone ID: PAT_TA_19622
gaattcggcacgagcttccgttgcctccgcttcgccttttcctgttccgtccaaataaaacgctcgagctaccaaaccctaggtagggctcctttcgatccgattcaagtcgatctcagttgggtgcgagattggactggagggggatgacgatacctagtgccgagggattcctcccggcggcgagctgcctgccgtgcacggcggaggaggaaagggcggccgtcgacgcactcacgcgggaggccgacgcgaatgtcaaagacggcgatctccgctatctcatctcacaaagctggtggaccaactggcaatcttatgtgggcttactcagttatggggagaatgacactgacattcctcttcaacctgcaagtagacctggagagattgataacagaaagcttgttttggaggaaactagcagtggcagtgaagatacagagctccaaagaaccttaagagaaggggaggactacactttggtgccacaagatgtctggagaaaactatatgactggtatgaagttgcaacggcaagaaatagaaaattttcattgtttcttccaacttccaggctgcactttgtagctgtctatccccttgacctatcacttcacgatgaaagagataactctgcgcggaccatcaaactaagtaggaaggccaaagctagtgagctttatagattggcttgctcacttttgtctgcggagcaggccaaggctcacatctgggatcattaccatgcgccgtgggtcgttgggttgtccccccgccacgtgcctccccaggcagctcatcttcggtgggctcttcagattctcttggaggttagtgcagatgatatctggacttccgatcattgtacaagatctaccagcaatgaattagcattacttccactggaacccaccacgtcctcattctcaattgctggaggccctaacttttcaaatggctattcgtctggaattggttccagtctttcacaggataatagccttaatcctttagtaaaggacatagaagatgggtatagtaatttcagcaatggaacaaaagatgacatccatgggattgactgggttacctaacctgggtaatacatgcttcatga

SEQ ID NO: 19623 - DNA, 666 bp, Triticum aestivum
  unsure (1)..(666): unsure at all n locations
  Clone ID: PAT_TA_19623
gtcgacccacgcgtccgggagcagtagcagcggcgcggcggtgagcctgagtcgcctcagcagcaacctcgagcgcctcctcctcgattctgaactcgactgcagcgacgccgacgtcgacgtggcggacggcgggccgcccatccccgtccaccgctgcatcctcgccgcgcgcagccccttcttccacgacctcttccgcgcccgcgggagccgcagtgatggggcagtcaccgcctccgcctccgcctccgccaccagtggcggagcgggaggggatgtgaccgggaggccgcagtacaagatggaggacctcgtcccaggtggccgtgtgggtcgcgaggccttcctggcgttcatggggtacctctacaccggcaggctccggcccgcgccgctggacgtggtgtcatgtgctgatcttgtgtgcccgcacgactcgtgcccgccggccatcaggttcgccgtcgagctcatgtacgcggcgtggaccttcaggatccccgagctcatgtcgctgttccagcgacggcttatgaactttgtcgacaagactctggctgaagacgtcctgcctatcttgcaagttgctttccactcggagcttactcaagtgcgtgaaaaatgtgnncnnnnnanngnnagnnnggatcttnnnnnnnnnnn

SEQ ID NO: 19624 - DNA, 821 bp, Triticum aestivum
  Clone ID: PAT_TA_19624
gagaaggctgagcttagtctccaattgcgaatctccatcaactcttttatcctgagcaagtaacgccgaaagagtcagcctccatccaggcaaggcatcactgtcatcaggggatatccaagggcagaatgtccggtgctgcttgataggatcaaactcattcatttggtcatacaggccttgtttttttcctgatggatgtacacctttttccatgttggtggacgattttgtgattgtgccaacctcagctggcttggacatgtttgcatgtgtctgtatagagttccgatcattagtaggttcttctctcgcggccgcgtcggctgaaaacttgggatctattccgtgttgatcaagtttcaagttcgtgctcgtcatacttctgcttgtggcaacacctgattctggttctccattgacaacttcttccatattaatatcctcagttgtatctgaaggtgaacacccttgaatttgatcagtgtttactcccaagtttgcaatctgcttttcagaattatcacctccatgatcgtgatgtgcccctttggccgatgtatcaacatcattggagattgtgttaatgccttccaacatatgaagcttatccatgcttcgtttgcgcttcatgggccctgaagcatgcaaagcaacagaaacaatctctctatcacttccggatgaaaatgattttccacgggagttcaagtcagctttgaagtgtcgactgacaacaggaaatgaaactcttggtcgaaaactctgtctagtcggcggaggaccaccagcaatggtaaaattaaaaccaacatttgcag

SEQ ID NO: 19625 - DNA, 528 bp, Triticum aestivum
  unsure (1)..(528): unsure at all n locations
  Clone ID: PAT_TA_19625
cattggttaaaggaggctagaggtattgtcatctcactggaagatggcacattgaagttcctcagcctacctagaattgccaatgatgttccagtcaccggaaggccatttgctgggactaaaacccagggtgtttctacttatcaattgtcagaatatttgatatggaatgtccatgtctcagaaattaccggttatgcagcttattgtgtggcagatggtactgctgtgcgcttccagcttacttcgagattctgggagaaggaacctgggaggaaccgtgtgccctatttcctttgtggttcgctagcagaggaggggacagccattaagattggtggaacattacaaagccctcctatgtcaaatgttcctctggttgcaaaaaagggcccaaaaccatgccaaaaagtacctaaacccacgatacacaaaaagacaagtactaacctcacaactcagacattngttcagaaccaagagagggcgagaaatggnctgataaagcaagaacctggttaactgatc

SEQ ID NO: 19626 - DNA, 664 bp, Triticum aestivum
  unsure (1)..(664): unsure at all n locations
  Clone ID: PAT_TA_19626
cgccggcccacgccgccgcgtccctccagccctcctcccctcctctcctcctcccctccgtccctccccctccccccccccgcggccccccgtcccccctccccccccctccccccccccccccccctcccctgaccgtgccccccgggccgcgctccgagccgccccccaccctgccgccgcctccctctcctgcaccgtggcgccccgatcgcgcccgcagccgcccccccgtccgctgctgctcgcctccgcagcggctcgtcgtgcccgggcctccgcccgccgcgcctgcgtccgctcccccccgtctgcggctccgcggctcgccgcccgcccggtccgcgcgggcgcggcctgccctccccccgttgatttgcaccaggggctctccgggctccggatcggcgtgggtcgtggccaggcctccgacgatgccctgctggcgggggttcgggagcagatctcgccggtggggcgcgggagctcggcttgaggttgtggtggctgcctcccggacggactgggttctccctccggacccagaccgcccttctctcgctgcgctcctgcgctgccttctgtgcttctctcatctccttcgtctcccgctcctccgcggcctcgcctcggcaccantgctgctatttttgantcataaaat

SEQ ID NO: 19627 - DNA, 512 bp, Triticum aestivum
  Clone ID: PAT_TA_19627
cccacgcgtccggccatgaagaccagctcctcgtcgcaggcgctcttcccggccgcctcgtcgctgtgcaccccgtacctcctcctcgtgcccctcggcctcctcgccgcggtggtcgtcatccccagcctcggctcctcccacgtccgctccgacggcctcggcgtgctctgccccagcctcggcaccgatggctactccgtcgcgtcgggagccgagaaggtcgtctccacggcggcggcgcgtcgggggccgaggttcccgctgccgcgtcggggtgctagccagacctacgcctgctgggcggggtgctgaccacgcccaagcgtacgcagcggcgggacatcgtgcgcctggcgcgcgcgcggccgcccccggcgcccgcggccgcgcgggcggccgggcgccccgtgctcggcgccctggacgcccccggcgcccggctctcctgctaactgcaccgagaacatgaacacgcaagaccacagtattcctccgtgcgcgggtttccg

SEQ ID NO: 19628 - DNA, 714 bp, Triticum aestivum
  unsure (1)..(714): unsure at all n locations
  Clone ID: PAT_TA_19628
tctcgtgtananaagttagcanatttctccccngtcgttcntncgatgaagtacngaagtcccgaaacgnccctgcttggcccgcccgcgtctcccgccgccggcgccccctagccccttcctccgttgctcttcacctttgagaggagtaggccctgatctaccaggaaccggaagttgtaatagcccatgtaaccgcacgcgctggcggtccagaacagcgcgcacggcacgccgagctccgcagcggcgtccaccgcgaagctcatgatgctgtccgcgacgacgcacgtcacccgcggcgtccccggtgcggtgttgttgaggccgccaagcaggctcttcaggtgggggaggcaggtcgtggtggtggagtggcagatggacgcctggtcctgggtggcgtctgggtcggacggcggcaggccgtcggggatggtggcgaagcggaagtccgggaggcccgcgacggcgccggcgccgcgggagcggacaaggcgccggtgtttgtgctcggtgtagacgaaggtgacgtggaagcccctggagtggaggaccttggccagcttcatcatcggggtggcgtgcccctgcgccgggtacggcacgcacacggcatcgcgctcctcttcggcgcgcatggcgtcgccggaatggcgccgatgcagatcgagactgtgttttttttctggtaggaaagaaattagcggacgc

SEQ ID NO: 19629 - DNA, 484 bp, Triticum aestivum
  Clone ID: PAT_TA_19629
cttgtaccgttatatgctccttaggaggaaggtggtcttgtcaaaggcaaaatccgcatgacttctgaatgtccgccaaattttttcatacgacgaggatgacaacttcagtctaaatcgagaagttgagtatgttggttgtgctagggtttcgcacatcattaaaggacacgagtagtgatgccaatcttacggatgctgaagtggtagcacagaggcagatgcatccgagtttcggtgtgatcttggtggcgcaggctgaagtcatcattcatggttctatgcagaagcttttccatttaatgtttagtttgtctcacataaggagcatttagcaatgaaagttgaagtttatagaatgaggaatatcattaataaagctcttctcatgatgtgttgatggtggtctaccattcgttagcttctctgatatgggcacatgaagatcggttagatattgatgcttaaagtttggctgattttc

SEQ ID NO: 19630 - DNA, 900 bp, Triticum aestivum
  Clone ID: PAT_TA_19630
tcgtgcacatccaatatctttgcttcttcctggaagctctgcaatggaggctaatgttggaccggtggtgcgccggctctacctctctgtctataattgggctgcgttctttggatgggcacaggtgttgtgctacgcaacattggcattgttggagaggaggcctgaggctatctacaccgcgatcgagcggccgctactggtcacacagactgccgctttaatggagatagttcattcacttgtagggcttgtgaagtctcctgtctccgcaacaattctacaacttattggaaggatgtttgttgcatggggtgtcttgtggagctttcccgagacgcgccctcatattcttgttacttccttgatcctagcatggtccattgctgaggtcatcagatatccttactatggtatgaaggagacatttggatttgcacatttctggctattatggcttaggtataacatgttcatcgtactctatcctatcggtatgctaagtgaagttggcctcatatacgtcacaatgccttacatgaaggcctccaataaatattgccttcaaatgcccaataaatggaatttctccttcaactaccactatgcatctgttcttctaatgggtatctattttccaggatttccacacttgtaccgttatatgctccttaggaggaaggtggtcttgtcaaaggcaaaatccgcatgatattactcacaagctttctagagtagctgtctcaggtgacttctgaatgcgtgagttgtgtgcttccacacatgatacttcccaccagcgtatatctactatttgtgtgacgttgttctcatgttttctatcgtttcccgatcaataaagttggggtggtgagcgttccccacctgagtgcaattact

SEQ ID NO: 19631 - DNA, 695 bp, Triticum aestivum
  Clone ID: PAT_TA_19631
ttgtcgtccctgttgatctcgcaagcagcaagccctctcttgcccgctgcacgaggtcaaagtttgttcatcacccgagctcattcagctacaagaggatgctgccatttctcatggagaacgacatctcctctcaggaaggagacagggccaagttccgaccccgcgcccgagagaaacaaattacatctgaccagaatgatgtccaggccagtggacagatccagcctgccactgtagaagtttctctggatgccagtgcagctgaagtgcagaaagccacacaaggagaagagctagcttcagttggagacccattgtcttcagagaagggtgcattagcatcagatgctgtcccagccggtggacagcgccagcctcctgtttcagaagacactcctgatgaaggaaatgtagctgaagttgaaagcaccgtggaagagaaggcgtcaaaatcagatgagaagcctgttcctatggattctgtagagccacctgttgtgaaggctgaaggaactcaggaggtgaaggattgctgtgacagtgccaaagaggaaaccaagattgtacctggtgatcttgcaagcagcaagccgtccattccccgctgcatgaggtcaaagtttgttccccatcgaagctcatttagttacaagaggatgctgccatttctcatgcagaatgaaacctcttct

SEQ ID NO: 19632 - DNA, 1107 bp, Triticum aestivum
  unsure (1)..(1107): unsure at all n locations
  Clone ID: PAT_TA_19632
cccacgcgtgcgcccacgcgtccgcccacgcgttcggtcgggaatggtgatcaccgcggccaggtcgtgtcagccgagaagatagccgcgacgagtgttttcctagcggagagagggccaagaatggcggcgctggccgccgccgccgcttttgccggcctcctcctcgcccttgcgcccgtggtcggggccgataccgacgctgccggcgtttcggctcttgggaacctctacacctcctggaacagcccggcccagctcgtcggttggtcggcggccggcggcggcgacccctgcggcgccgcctggatgggcgtctcctgctcgggctccgccatcacctcaatcaacctttctggtatgggattgaatggcactcttggctacctactgcccagtctagtggcattgacaacgatggacttgagtaacaacagcttgcatgatgtaattccgtatcagctgccaccaaatcttatccatctgaatttggccagaaataatttttccggccacatcccatactctatatccaacatcttatcacttggctacctcaatgtcagtcacaactctctgttccaggaaatcggcgaactatttgggggcctcaattcgctttctgtattggatggcccgctcagcctcttgtccggcgtccttccgggtgctttgggctccttctctcacctttctagcctcggggtgcccaatccgcagctatcggccacagtctgcgccctctgcatcctttgccgttccccacgctgtattgcattccccagcttcaccggcgtgatgcccggggaactcagctccatccccgccttgcccgcccgcggcaactcatttatcaatatgcctgcatctccaccacggattatcatgccaccgtctcagagtccggttgctcagccagatcgtcctcaagtaccgacaacttttccaaatggccctgaggatgatatccctatcgaaganngtgacaagaagcaaggccggcaaacaggtctgcttgtnnngttggctgttgggtcagtggctgctgcttcatgtatacttttcgcgctggtgttctgcnttcacagtgtccataaaagnannnat

SEQ ID NO: 19633 - DNA, 630 bp, Triticum aestivum
  unsure (1)..(630): unsure at all n locations
  Clone ID: PAT_TA_19633
ccacgcgtccgacctacccaacctcatgaagctcgagctcaacctcatggccatggccatggccacaagcttggctcctgcaaatcccctctcaacatcttggccatggcctcttggcctcctccggccaatcccctctcggcctcatggccttcctctgaagctcataagaggccgatttggatcataggctcgatggaaaagatttggttcatcaagaggggagtgaacatcaatcaagataaagttggaagcgatgaaacaaaacgcagcacgagcctcgtcattccggcaaacgcaccgcgtggtcgagccggaatcaaatcgaccacgaaccagagcgactgcgcagcccaccgcgcggtccaaccccgaacgcaatcgaccccgagccagagcgacccacgccacggcgcggtcggaccccgaaccagagcgaccagcaacccacggcgcggtccaaccccgaaccccatatataaccccccgcctcccgcaaccctagccacgcctcctgctccctccgatccaaaccctagcgccgccgccgccgccgcccccctccccttcctccgccgccgccgccgccgcccccctccccttcctccgccgccnnngcatcatgacggc

SEQ ID NO: 19634 - DNA, 691 bp, Triticum aestivum
  Clone ID: PAT_TA_19634
gacccccgcctccgtggggactgttccccgggtcctgcttctacgggtccgccctctgcgtcaggtaaattaccatggtacttatctaatgcgatttgtaaagttttaccaatctggaggatattcaataccaagatttatgatttggcataagtgagatgacatacaagtgagtttaagtcgtgagagtgaactagcaacggtttaattatcataccgtcggcaactgcacctcaactgcggaaaaagaaatcttgaagaaccaagaccaccaccagctggaagaaggtttcagtcaggtcctttacttctccggcctcttttgctctccggtgcatcgcagctaccaagaattccgagaccgcctaagtggtatgacatccagctgccgtccgctcatcaggtgcaggtgtcaaccgttgtatcgttatatgaccggcatgttccgtgtgcttaccccacgctgctactgtcagttcccctccctggtgctggctggcctcgagctcctgccctggttgccacggcttcgggctacacggccgcccccttcgggctccccgctcttgggcttccccgatgcgtagttgttcttataagatgttcgttatctaggtaaaacttgggaacatgtatggatggacaatactatatggatttggtcattttattgactaattatacagcgtat

SEQ ID NO: 19635 - DNA, 795 bp, Triticum aestivum
  Clone ID: PAT_TA_19635
gtgattccaaacctcctggccttactagtgaaaggatttttggaatttaagaaagttgagatccagtgtcaagaggacagtgaacttattgtgaaagttattatgtctgaggagcactgcaagagtgtgaagttttgggctactctacaaaagtcttgcatagcaattatggagttgattgactgggagaggagccggccagggagcgtatatgatattttttgctcatatggcatagactcagcatggaaatactttgttgaatccttaagatcaaaaactgatgatattggaaggaatattcgccgcgaacacttgctgggtcgtggcaaattgcctgtctgtaagtgggcagttccatgggactaagcagtcaaggtttgaagcaacaacggactcgattatcaatctcatctccattttctgaagctggtttttccaggcctgcacatacttttataaacgctccaaagcagccctcaggcgactctcgctgcgggaccgttggcgcgggggcctgcgcccgggaccctgcccccgggacatcggcgccttgccaggtccttcattcggcgcaggcgcatgcgcccgtaccgaacccgggcctctatggctccccaaatagccctgaagttcggcaagcgccgggcgaagctttcttgaatggtagcaccatatctgtggagcaagattttcttgttgctgcagttggtattgggacaacattattgatatgcgcacttgcttgcagaacatgctacgagagtaccaattaaatgaatgtgttggggagct

SEQ ID NO: 19636 - DNA, 461 bp, Triticum aestivum
  Clone ID: PAT_TA_19636
cggacgcgtgggcagaagcagagcagcaggcgatggccggcggtagcctggacctccccgtggcatgcgtggagagcgggttcttctacgtcaccaaccacgggatccaggacggcctgctggaggcgttgttcgccgagagcaagaggttcttcgagctgccgctggaggagaagatgctgctgcagaggaacagcagccaccggggctacaccccgccctacgccgagaagctggacgagtcgtccgaattccagggagacctcaaggagagtttctacattggggcggtcagggatgtagatatgccgaatgatcctaaccaatggcctcctaaagagcgctttccatcttggaaggatacaatgaagctgtaccatgaagctgcactggctgctggcaaaaggatactctctctaattgctctgagtctggacctagaagctgaattctttcagaag

SEQ ID NO: 19637 - DNA, 1211 bp, Triticum aestivum
  Clone ID: PAT_TA_19637
gcgtgaggagaagcagagcagcaggcgatggccggcggtagcctgaacctccccgtggttgacctcgcgccccccgacatcaaatccgccgtggatgccgtccggaaggcatgcgtggagagcgggttcttctacgtcaccaaccacgggatccaggacggcctgctggaggcgctgttcgccgagagcaagaagttcttcgagctgccgctggaggagaagatgttgctgcagaggaacagcgcccaccggggctacaccgcgccctacaccgagaagctcgacgcgtcgtccgaattccagggagacctcaaggagagtttctacattggggcggtcggggacgtagatatgccgaatgatcctaaccaatggcctcctaaagagcgatttccatcttggaaggatacaatgaagctgtaccatgcagctgcactggctgctggcaaaaggatactctctctaattgctctgagtctggacctagaagctgaattctttcagaacattggtgcagtcgactgctcttcagaagttattcggctattgcactacccaggtgaagtaaaagagtctgataatggaaattacgctgtcacattctggtttgatatcacttattgcaaaagcttctaccaccaggttgcagattcccagggagaaggataggcatccccagctctgggaagatgttcgtcatgttgatgggacccttattgttaacattggcgatttgctagaaaaggtggactaattgtgttttcagatctacacttcatcgggttgttgcagttggcagagagcgatattctgcggcttactttctggacccaagacccgatctagtggtgcagtgcttggaaagctgttgctgcgacgcatctcctccaaggtttccacctatcacggcgggtgactatttgaaagaacgattaagggccacatacaaataactaacgataaagtgccgtcttataaataacttaacgggatttcgtacgtttaattatcttgtaaaatcagttaggtcttcacagttgtattgcaagacggagtagtattgtctgcataattgcaatgcgtattatgactaaaaacgtagtggcagtacagttgtaacggttctagtgcgtgcttgactaatctgtatcgtcataatatggtctcacagaagtaaataaacggtgcataacctcctcaaaaaaaactcg

SEQ ID NO: 19638 - DNA, 1038 bp, Triticum aestivum
  Clone ID: PAT_TA_19638
cgaattcgcggccgcgtcgaccggccttcaaagttctcatttgaatatttgctactaccaccaagatctgcaccgacggccgctccgcccgggctcgcgccccgggttttgcagcggccgccgcgccccaccatttacaggaattattactcacctggctcagcaagcctgtattttggtggctggtcacttggcgtgaaaccaatggaagtagtattggacagcggaagctcgttcacctacttttcttcacagccatatcaagcacttgtcactgcacttaagggtgatctaagcaagacgctgaaagaggtgtctgacccctctctgcctctatgctggaaaggaaagaaaccattcaaatccgtgcttgatgtcaagaaggagttcaaatcattggttctgaactttgccaatggcaagaaggcgctcatggagatccctcctgagaactacctcatcgtcactaaatacgggaatgcatgtttgggcatccttaacggatcagaaattggactcaaggatctgaacattgttgggagatattacaatgcaggatcagatggtgatatatgacaatgagagagggcagattggatggatccgagcaccctgtgatagaatccccaagttcggatcttcccttctgtgatcatttcacacacctgaacatatatacccttaatcctcttcggtttaatcaaacactgggcaataccatccatgggatttgaccgaacgtagtgttgcccccccccccctacacacgggcatgcatgtttgggcatccctttcgcatcggtcattcgacgctgggatctgggcgtggctggggctatttccacccaggacctcatggcgagttgggccgttgcgtgggggcggattcggtgccgccgcgccccctctgttaggatccccaagttcggatcttcccttctgtgatcatttcacacacctgaacatatataaccttcctcaaatccatgaatggtattttcactgtttgaataaacagaaactagttctagatcgcga

SEQ ID NO: 19639 - DNA, 845 bp, Triticum aestivum
  unsure (1)..(845): unsure at all n locations
  Clone ID: PAT_TA_19639
tcgacccacgcgtccggttatgtccatcgactcaatcactcaaaaagcgatgtaaagcatgctaagttcagttcaaagtgtgaatatcccggggacaactgtgtgaactgcatgcacgatgactcagatatgggtggagttatgtttagcagcaaagcggacacaattgtggatgaatacaatcgtcttttagcaagccaacttgaaactcagcgagagtattacgaagctcttctatcagatgctaagaaagaaagggaacaccacatttctgttgccgtggataaaactataaatgataagcttcaagagctgcaacttaagcttgaaaatacaatgttggagaaaaagaaagttgctgaaatgaatgaaaaactcacgaagagcctcgaggttccgcgcccctctggattaggctgcgtccatagggagagagcacagttgaagctgaaggatgatatgattcttgacctggaagagcagataaaagacttcagatattccatttagctacaaaagtctattgcgaagagttcacatgctgatgatctcaaaggaggcatgctggtgccactggccatggaatcagattctggaaagggtaaaaggtcgtcaagaacaagcaagagaaggaattaatggcgactttgctagtatgaatgcatgaatcttcgccatttgttgtatatgccaagattctgcatgttaacttcctgactttggtggtgataagcgcnagggtcggtcctttcaaatggnagtttnctcactaatactaaatccagtccantcctgatncaactcagcgaagaaaaaaggtagcatcctgatccaaacctntaatn

SEQ ID NO: 19640 - DNA, 876 bp, Triticum aestivum
  Clone ID: PAT_TA_19640
agacatcatattggtgaaggtctttatcagggagctcagcaaagaaatggtttgccttcacgacacacctatctccatgtgtaccctttccaccgcgcaatggttccctccctgccctgctccttccgggcgccggttgactggattggctggccgtactgtggtcgacactcgccagtttctgtttctgttgcgggacttgccctctgccctcccccggcacgggctccgcgcctgtcccagctccccccccggctgacccaaccgtcggggtttgctagtcggcattcggggcttggtgcagctcgggaactgttcttgatcgacctggaggaacattgcatcctccacgtcctcccctatgcccgccatagcatggctgcggcactccaccccctctggggcgtggaccaccacgtccctgatagtcacgcggttgatattcaggtggcccaccccccggatgtccacgcccctgatagtcacgccgttgatattcaggtggagcaccacctggatgtccacggccctgagggccacgcggttgatattcaggtggagcaccacctggatgtccacggccctgagggccgcgcggttgatattcaggtggagcaccacctggatgtccacggccctgagggtcgcgcggttgatattcaggtggcccaccacctggatgtccacggccctgatagtcgcgcggttgatattcaggtggaccaccacctggatgtccgcggccctgatattcacgctgctgatattcgggtgggccacctggacggtgtgcagctggccctccctggccctgatactgtccaccacggcctaggtgttgcccaccaccacggccaccctgttgaggcacccaac

SEQ ID NO: 19641 - DNA, 712 bp, Triticum aestivum
  Clone ID: PAT_TA_19641
tcgacccacgcgtccgtttttttttaacaatgaacttcactgattttatatgcactcactcctactatttattacatacataatgtacaccatacgaacgccaattgcatcacctgtgtcttgctgtacactctgatcactagctcaaactaaaaacctataaactaaagaaatctagttcacccaaagcaaccaaacctattctaacggtcaatgtacatactccggactaacaaaatttcacttcagacacatctacactatgccggaacaagtttcgggtctagagcgccatgactacaggggacaaaatacagcagtgccatgccgtttgagattctgccatctttgcgactaggtacactacattgtccagaatctgtccgggtcagggctaaacaaggaatgatcttggatctccagatttgctatgtgccagttgaccaatccggcttgaagcgacttgacgacaaacaggacaactggcagtatccaccacccatcgtcctccctacccttgaagcttttggtgtttgatgcctgagctgaagacactgtcaaagaagatagcccggagtacatagcaccatagacgattgctacaataatgtttatgacagaagtagtattccaaagtgtaaaaatgcgggtgacagaagatctttttggtcctcggctgaaaagtgcattgaggccagcaagaaaaggggaa

SEQ ID NO: 19642 - DNA, 668 bp, Triticum aestivum
  unsure (1)..(668): unsure at all n locations
  Clone ID: PAT_TA_19642
taaaggagacgctacgcctgcacccaccgatcccgctcctcgtgccccgagagccgcaaaacgacgccgagatactcggccaccacgtcccggcgggcacgcgggtcgtccatcaacggtcgtgggcccggcggcccgggacccggcgggcgtgggaccccgcccgagggagttcgcgacctgaagaggatnttctcgacgggcgcggtggactaccaaggggcaggacttccagcttgataccgttccgttgcttgggcgggcgggggtgcccccggggtcggatntccccgcgccggaccgttgagatggcgctggcgagcttgatgtaccatttcgactgggagccggctggcggggcgtcgctggacatgcgcgaggtgaacgggctcgccgtgcggctcaagtccggcctgccgcttgtcgctaaaccgcggtttcgttagataaacttgttgctatgctggttgttactcctatgccccgtgaagatgcgggggcgtgtgtgcttcatcgcctaaccgtatcgtgctgggtgctccctattgtagtgtactgtagggtttcatggagaattgaggtatatgagagaattcaaactggaggcagaaggcaaaaggagcaaagagaaattagtcgtctccctctcgtgccgaattcggcacgag

SEQ ID NO: 19643 - DNA, 569 bp, Triticum aestivum
  Clone ID: PAT_TA_19643
gatggaaaaacaagacagtgatgttgccaagagagctcttactgaagctcaggaaagaaacgaggatttattgaagagaaatgaagacctccttaacaggaataatgatttggttaaaaaaattgaggagtcaggcaaagttataactcaccttcaggagtccctacaaagaattgaaggaaaagcagccaacttagaggctgataatcatgttctccgtcagcaagcagctgctactccaccttctactgccaaatctccaccctcacgttcaaagatcacaaggattcatagaagcccagagaatgggcatgttttgaacggtgaactaaggcaggctgagatgaggccatcagctggcatgccagaagcaacacccccagtaggcaatgctcccaactcgagtaatcaaaaagactttgaacacggagaaaaactgcaaagagtgcttaatcagaaacatcagtctctgcagccccagcagccccaagatgaccagcagtggttacttacttgcattccacaatatctcagattttctgggagcaagcctgttgccactcttctta

SEQ ID NO: 19644 - DNA, 761 bp, Triticum aestivum
  Clone ID: PAT_TA_19644
ctgccacctccacgggatcccgccggccgccgccgatggcgcccagcgccggcgatcttcaggaggaggacgtcccccccgcagcgtagccggggaggtggaggcttgcaggggcccaggagccggagcggaggccggggtggtgctgctccaacgccgccgcgaaacgatgaaggatccgtcgagccacgggtggcggcgttcgcgggcttgctggggcggaggcggcggagatgctggggccgtggaagacaacgcctcatcctcgatcttcatgccggtgggcaatgttgaggtcggggacggtggcgccgggttcgtcggtctccgccggcggtgcttggctcctgcttcacaacggagttgagccactgctcctcctcttcgttcggcgtcacctcccactccatcatgggcgggcacggggccatagccccggaggggccgagtgctcctcgtcttcgtcggcgggcgtcggcgttgggaggtccgggtaggcgagtggctcgtcgatgacctccggtttcggtggtggagtggccggcggtggagggcacggcccgtacccgtgcacggggcagaaatcgcgggcagggcaaggtccgtatctgtgcaccggacagaaggccacgcctgcatccatgccgttgccgaagaagatccctggcggtggcggggcctgagccgcgtcgaagaactcctcctcgcccaggaacggggctgcagcctcggcgggagcatagtccattggtggagtgacg

SEQ ID NO: 19645 - DNA, 826 bp, Triticum aestivum
  Clone ID: PAT_TA_19645
cttgcgaaccgtgcgtgcgtgctcgaggacgtggtgatcgcgagcgcgcgcgtccagactagtatggagcagaggagcctgctcgcgtcggcggtgggcatgggcgtgggcgtcgggctggggctcgcgtcggcgaggtgggcgaagccggcgcacgcggccgacggaggctcaggcgccggcgccggcgccgcggaggtggaggcggagctgcggcggctggtggtggacggccgcgacagcgaggtcaccttcgacgtgcgccccccccgcccctccggccgcagcgaccagaccaaggaggtgctcatcagcgcggccttcgtgcacctcaagcaggccgacctgtccaagcacattccggaacctctccgccgccagccgcgccatcctcctctccggccccaccgaggcttacctgcagtcgcttgccaaggctctgtcgcactactacaaggcccggctgctgctcctcgacgtcaccgacttctcgctccggatccagagcaagtatgggggctccagcaaggccttggttcagaaccagtccgcgtccgagacgacgtttgggcgggtgtccgatttcattggatctttcgcaatgtttccaaagaaggatgagcctagagaatcattgcgtcgtcagacaagcagtgcagattcgagagctagaggctctgatgttgctagcaatgaccctttactccggaaaaatgcttctatgccatctgatatgagcgacgtagcatcacaatgttctgtgcattcagctaggcgagccagtagctggtctttcgatgagaaagttctgatacagtcactttac

SEQ ID NO: 19646 - DNA, 856 bp, Triticum aestivum
  Clone ID: PAT_TA_19646
gtcgacccacgcgtccgggatgcaatcagagactggaacacaagcctccttgcagtgtattatcctttccaaattagtaggtgagcaccaatacatgccgaatttgattactaatctgtgaattttccagtcttcagtaataaaatgtgctgtcaaacagaggtaatttactgctggctcaggtccatcatgagtccagatgcttgctgatagcgagatacgctgggaggtaagtgcaatttcatccttgacgtttatcttcttcttctgaaacagagcaagtaaatgttcttccatatcactaagagagactttgttagtcatgggactgatggtccttaaaatcctcctcatatcttcattctccacaatttgccaagggttacccatgcaaagttatcaatctgggcgatatcttgataaggtgaatcttgaccaaacttgcttggtgcttatggcagttgcattagtcatagacgaggtcttctgtttcttcagccctgtaccatctggtgctggtagggatagatgatctgccaccacttgaaggggccgataggtgatgccactggagctgctagccctgcggagcttgctagagcattttgaaccatctggtgctggtagggatagatgatctgccaccatttgaatgggccgattggtgattccactggagctgctagccctgcgtagcttgctagagcattttgtaccatctggtgctggtagggatagatgatctgacaccacttgaatgggccgataggtgatgccactggagctgctagccctgcggagcttgctagagcattttgtgatttgagctttcctggcaggcgaagactcctctcgc

SEQ ID NO: 19647 - DNA, 1186 bp, Triticum aestivum
  Clone ID: PAT_TA_19647
cccaccgcctccttgcccacactgacgtacaccggcacacgtaaggcgcgaaaatggagcactacgggcagccccaccatggcacccacggggtggcggggtcccgccagccactgggcgggcacggcggcgccacctgcggccccacggggacgtaccgcgcggcagcccccgcgggcaccgggcagctcgcgccggccggggacgaccgccaacccgacggtgtcctgcgccgccccggcagctccagccctccctcgtccgagggcggaggccttcgggggaggaggaagaaggggaggaaggagggagtcgatgagaagatccccggccggccgcccacggaaggcaaccggcagcagcaaacgccggcgggcggcgagtacgccggcaccggcaacgccacgcacggcgggaaggccacgggcgagaaggagggtgtcatggataaggtcaatgattagcgccccagggaactgcaagagcttgtactgacatatgtgtgctccgcctgtgctgtgcttgtgttcgatcaaaactcagaatgactgcgtacttctgcatgcgttcgtagcacatatagaatgggcgccgatccgaggtgccggagtatgtatgttgtgtgtgtgacgtagtttgtggaccccgtgtacatgtatttgtactgaagtgctaaaaccccatcgtaataaagcgctcgtttatccagccgacaaaaaaaaaaaaaaaaaaaaaaaaaaaaaagcgccgcaaaaaaaaaaaaaaaaacagctcgtctgaggacgacggcgctggcgggaggaggaagaaagggatgaaggagaagatcaaggagaagctccccggcggagcccacaaagacgccaccgggcagcagcacacgccggcggccggcgagtacgccgggaccggcaccggcacgcacggcgcggaggccaccggcgagaagaagggcgtcatggacaagatcaaggagaagcttcccggcgggcagcactaagctaagatgggcagctagcgatcgacctgtgtctgtgttcgcctgttcggtcaaagctctgtcgcatgcatgcgtacttctacatgcgttcctacgggataaataatcggcgccgatcgaggtgccggagtatatatgttgtgtgtgtgacgtatttgtggaccccgtactgtgtacatgtatttg

SEQ ID NO: 19648 - DNA, 421 bp, Triticum aestivum
  unsure (1)..(421): unsure at all n locations
  Clone ID: PAT_TA_19648
cgcgtccgctccagctctcctgctctatggacgtgttcatgcaagcgcaggccgatgcggaagacaggattaaccatgggcagttgggtggtgttgctgcggcgcggcctgttgaatttgaatcccaggcttctatcagcatcgccgaggcccgagggggacatttgccgtgccggagaccaatgcagcggcggtaggatttgccgtgcgagatttgttgatgaagaacggctcgtgcaagtgtgttcggaggctacaagtggttggacacgcaggtattcgtacccaacctggctaattcttgctggtcatatgtggatgtgtaatcttaggcttatctagctagctgatttgtactaataattcaagtaatttggttaccttggcacttttcccaacggggggggggttgnttgttggg

SEQ ID NO: 19649 - DNA, 587 bp, Triticum aestivum
  unsure (1)..(587): unsure at all n locations
  Clone ID: PAT_TA_19649
ggttgtggggagacccaagggcggccctcccgtccgaaccatagtaccttgtgactttcactgttggatatgcacnagaaagaaaatataaacagagcagtgaagaagttttctgacaatttcgctatcctgttattccactatgatggtcgtgtgaccgaatgggacgaatttgagtggtcaaagcgagccatccatatcagtgtcagcaaacaaactaaatggtggtatgccaaaagattcttgcaccctgatattgtggcagcttacgagtacatattcatctgggatgaagaccttggggtggatcatttcaacgcagaggagtacatcaaacttgttaagaaaaatggtctggatatctcccagcccggcttagaacctgaccgaggactaacttggcagatgaccaaaagaagaggtgaccgagaggtccacaaaggagacggaggaaaggccaggctggtgtgctgaccctcatcttccaccttgtgctgcgtttgttgaaataatggctccagtcttctcaagggaggcatggccattgctatggcatatgattcacaatgatttggttcatggatggg

SEQ ID NO: 19650 - DNA, 850 bp, Triticum aestivum
  unsure (1)..(850): unsure at all n locations
  Clone ID: PAT_TA_19650
cattatagtaaaacagagagaattgcacagaaggctccatcttatgacaggtctcattgtgggtacaaggtcgcccccgcggccggtatccccgagggagacgctaatacctccgttacatgctggagttgtacgcatcgttaaggcagcaaggcgttngaaatgcctgttgatgccagatggtttcattgaagccaggcccaagaagcagatncatgagtgtccaggagagagcaagagggaagaaagaaaatagattcccaaaattaaggatggcaaaggctccccgccaagcagcatcaaatgtctcctacacagctctagcagttcaagtttttaataaggggacacttcctttgggtggggaacctgcgaagaaagcctcctcggcttccgtccttgctgtggaaggccgggtccttcagcacgccctcccccctgcgtcattcctgggtggtccagcggcgctctcacccacagggccccctcctcccgccaacgcacgacctcctaccaactccctggcctcgtgccctatccgtggcctgccaacctccgactcgctttctccttgtgccccaacgaagcctgcgccacgcttccctgacagcattaacaaaccctcgtccaggggcactccatttaacatgggcaactgggatagttcacaaacgaaccagcaggttatgccattaactcaaattcaacttgaggaagcaatgaaaccagcaaagtttgaacaaggaggttctggctttcctttggagtcaaataatgctctatctcctacagtaaccatggacatggcatacacatcatctgctagccctatcaattctcttttggctgg

SEQ ID NO: 19651 - DNA, 592 bp, Triticum aestivum
  Clone ID: PAT_TA_19651
gcaggagcttctctggtgctcgcggcgccggtggcggcggcgcgggccgcggcgccggcgggggcggctcgggcggtgacggcggcgccggtggcggccgctagtccggcgccggtggtggtcgcggcgccggtggcgccggcggcggcggctcctccagcgccggcggtccaccgccccgctccggccccgcccgccccggcggctcctccagcggcggcgcctccggctgggactggccgcctcccccccgctcctccccgcggtgccccctccgcacgtctcacctctgcccctctggctggcgctgcccgcccagctcccgcgcggctcggtggtgctcagcccggtgcctgctcggcctcttgccttgtcgtgggccgggtccatggtgcgcgcggccggctcggccgctttgccttggcggcggctggggtttggtgccctcactggggtaggttgcaaatgttttgctgggaaaatggggatttcacatggatgtggtggtgatgatgagactccacttggtgcttagacgttaaaacttgttggctatattatcttttaagatcgaccttgctatatgttttgc

SEQ ID NO: 19652 - DNA, 738 bp, Triticum aestivum
  unsure (1)..(738): unsure at all n locations
  Clone ID: PAT_TA_19652
ctcgtgccgaatgcggccccaggcgtcctcctcgctcctctaatactcccaaatcaccaccaaactagctagtccatcccattgctctcaacctccttccacatccccctctctcctcccttcttcctcctatccattggagatctccattggagagagctctacctggcctgcctgctgctcatgcactgcactgccgatcttgctaccactccaagcccaggttcatagccgactggctatatagcccgtagctccatatacccaccgatcgagatcgctgccatcgtcaagtcggctgagatttagagtggtgtttggtgcgaagattactccaagtcaattccttcccgtctctgccgatcctgcgaagctacgtacggcgagattgggatgcttgaggtggtcacgctgcaaagccctaatccgggccgtcttcaacctcggcgaccaccaccatgtcgatgtcgggttcccggaggccaccgtgggggaggacgacttcctgctggactacatcgacttcagcacgtgcgacatgcccctcttccacgtcgatgacggcgacgacatcctccccgacctcgaggtcgacccgaccgagctcctcgccgagttcgccgacgagccggcgacgacgacggtgctgagcccggcgggaanagccggcgccaaaacggttgcgaaanccaacatggggaacaagggaaanacggcgtttgaaaacggactaaccgg

SEQ ID NO: 19653 - DNA, 649 bp, Triticum aestivum
  unsure (1)..(649): unsure at all n locations
  Clone ID: PAT_TA_19653
cgaccccgcgtccgcatgaacttatccaatgccaccagtgtccattatttgcttcctatcctgaaagacacctggcatattttgataacgaccagtgatattattgccatgccgacatgtgtgcattatgatgctataaatttaaagataccattatggtgccgacatgtgtgcatttagtgtgagatgttttcaacttgatccggatccttatcaatgcatgccttagctgaactggcaagctactcagtatagtactagcactatttcttaatggaaatatgcatagcagcataggtagaagttattttgttttgactgtatgggtcgctatcctaatctctcttattctgagataatttcatttccctttaggttgtttattgactaattgttatcatgtttatagaaatatttacagttttgctaaaccacatttagatgtgccctgagtattgcacatccaagtcctatgtcattgattttacgcggagattcgtgccagcattgtctttccctttcgctttttcttttccttttagtatgtttgatgtgaggcacttggatgtgcaataaatagggtatatctagatctgctctatatttaaggnaatcaatttatgcatttctcttctgtcttctgcagggc

SEQ ID NO: 19654 - DNA, 1106 bp, Triticum aestivum
  Clone ID: PAT_TA_19654
caactcaaatcctcctctcctcccttccctccctcccattccgattccccaccgactccccaaaccccctcgtaaaccctacctcgccgcgcgacgacgccagcggcggtggcggagcgcccaccgcgtccccgcctccctcgccccgccgcagccggcaagggcaaggggaagatgaagggagacgatctgtcggaggaggacctcgagctcaaggcgcgtctcgaggattgcgtggagcgggcgcagagccgcgacccccgcctccggataggcgccatcgacaccctgaggaaagagattcgtgcggcgacaagctcaatgacgtctgccccgaaacaactcaaattcctccgcgcacactatggaactctcaagacttgctttgagagaatgcaggattctgaacagcagaagaaacatccggcccgcattctcccggtcgtcccccgcgcccggtctggtgaaggagaaagggaaagcctgaagtactgtatgatgggctctttagttgatgtatgttcatggggacatgaatacgtgagaaacttggcttttgaaattggaaaagaatggaagttcaatggctcatcaacgccaattgaatcaaaaataaatgtagtgctggaaattgtcaagtttcacatgaagcataatgctggaaactgaagctctggatcttttgctggaggttggataccttgagatgctttcagacgaaaaaaaggaagaataccttacgatgctacttcatcttgttgactctaccaactacaaaagggcatgcttgtatttgactagttgttctaaatacctttctacacccgaccatgaagccacacttggcactgcctatgacatgtacatgaagtttagggatcttgcaagtgctttgcggattgcacttttggtcgacgaccacaagtattgtggtcagaatgtgaagataaagatggtatttgaagaaactaaagatttctccctgaagcagcaattcgcatttatgatagcacgctatggtttaagcgtggagattgatgatgagatggttgcagatgaaaatgagaagaatgctttacaggaagtagtttgtaacaccaaactgg

SEQ ID NO: 19655 - DNA, 1782 bp, Triticum aestivum
  unsure (1)..(1782): unsure at all n locations
  Clone ID: PAT_TA_19655
ggcacgagccgacaccttctctcctcgcctctcctccgtccgacgggggcgagagggacaggggaagaaagcccaaaaccctagtcctcgtcgccggcggcgagatggccgtcaacgaggaaacgtccgtctacgtcggcggcctgccctacgacgccgacgaggatatgctccgcagctactttgggccctgcggcaccatcgtctccgtcaaggtgataaatgatcagagaatcaggggcaagtgttatgggtttgttacttacactcaacatagggctgctcagcgtgctatcttggagatggatggcaagcaaataggtaatcgtgctgtgagagtaaatgaagtgcgtacaagaggcaacacccgtgattttgggcgtgatggcttccgacgagatcctgtaagagatggaagggatgtatactgggaccgaagggatagggagaggagttatgatcgccaccgggatagagatccctaccatgacagggatagtgatagacctcgtgaccatgatagagacagatatgatgaacgtgggggatttgatcatgaaatggactattccatggatcgagatcatgaaggagatgagaggcgtgctagagacctttatcgaggagacattgatcgtccagtggagatgcgtatggattccgataacgacagagacaaggaaaattcaaaaggctatgatagtgaaagagataaagacgacaaggaacagccaccaaggaaaaggttcagccgtccaaagggtcgtgagagcagagatatatcaagttccagtgatgagcttcagaatgatgcaaaacatcagctggacaaggccattcagatgcatgaggaccttgaaaacgaggtttctcagattagagataaagttacaagcaaagatcaccacattgcagatttgcaaaagaaatctcagaaactagaggatgaattggctgctgcgcggaaagtttcttcagagcgacaattgactgtcacaaagctgtacaaaagttttcttcaacttcaagactacaatgacagggccaagaccgcagaagaggatctcaaggctctggttgattctgcgatggctgaggtggacatggctgaagacgctacaaccaaagacggctcagggtatgagaacggcatggcctgaatttgaaagccgaaaatgaaatcacttctcacggtgctgatctctgagaattacgacttactaccatgtagaaccgtaaccagtaagtagctcatgcaagtgaagtctaggaaaccatgttccttcgcacattgattagtgccgtacagaccttttttgtctggcttccccgtttgtaatgtaagctgcccgtagtatatcaaccaaccagcgcaattcccttcttctacttgcaatcattttggggtcacagataaaaaaaatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcnagcaaggtgcgtgtgcgtgtgcgtgtggtttgcttgctcgctctccatgctcgccca

SEQ ID NO: 19656 - DNA, 358 bp, Triticum aestivum
  Clone ID: PAT_TA_19656
acgccgatagcaatcatattcttctgctgcatatgcttcctgggttcatcagatctggaggatgtcatacagctgtggatccagatgcacctgtgagctcacactgcaagtgcgggaagatgtaccctgatctgacggagcacggcagtgccggcggccaggtaaccagcgtgggcagcctcagggtggcgcctgacaacacggcgaggcatgtcgaggtggccaccactcaatgcgcaaagggctgcacttgcaagcacaactgcaagtgcagccgctgcaacgagttacctgcatgcactgctgtcatgttgtgagagtatacctgactaacgagcgtgcgtctgatcttatggag

SEQ ID NO: 19657 - DNA, 703 bp, Triticum aestivum
  Clone ID: PAT_TA_19657
cagcttcgatcacgtgtccgcccccgcgtccgccaacacggacgtttataagaatatttctcccacagttttgggtgtagtgcaaggccttaatgtgacagtctttgcctatggatctactggaagtggcaaaacatatacaatggttggaagccggaatgatcctggtcttatggttcttagcttccgcacaatctttgatcaaataaaaaaaagatgatagttcagatacatttgaagtctcatgttcatatctggaagtatacaatgaggttatctatgatttgcttgagaaatcgtcgggtcacctggagcttcgtgaggatcccgagcatggcataatagtcgctggtttaagaagaattaaggtccattcagcagataagatccttgaactcttgaacataggcaacagcagacgcaagacagagagcacggaagcaaacgcaacttcttcgcgttcacacgctgtactggaaattactgtaagacgcaagcagaaaggaaaatatggtagtcaagttcttcgtggaaagcttgccttggttgatcttgcgggcagtgagagggctactgaaacgaacaattttggccaaaagcttagagatggagccaacattaatcggtcacttctagcgttagcgaattgtatcaatgccctcggcaagcaaaataagaaaggtctagcatatgttccatatcg

SEQ ID NO: 19658 - DNA, 518 bp, Triticum aestivum
  unsure (1)..(518): unsure at all n locations
  Clone ID: PAT_TA_19658
accagttcggcgcggaaccgaggtacgtccgggtcagcatgctcggcagggacgacgcctacgacatcttcatcaggcgcctcgcctcactcaaatgaccaggtcagcgtggaggcttagttcgtcatgccggtgctgaggctgagcatcgggcgaaatgaaaaagtagcggtaccggtttctgccgggtaggtggatgccgttggatgtttccgagatttgcacatctccgcgcccgagtcaacgtacattctacgctccgttatgtatcagtacatcttccgtaccgtatgagcacgattgtgtacacgcacgtacacaatgcgcgtctggcccacaaattcaattcgccagcagacattgatgtactcccacttcatccctaatcaatcttctccggctagtcctctcttgtgcgagtccgctgctgccagagttcttcaagatcgtggatcctgttcggagaaaatgagctagaatcctccnaaaaaaaaaaaaaaaaaaaaaaaaaaaaaaaa

SEQ ID NO: 19659 - DNA, 1470 bp, Triticum aestivum
  unsure (1)..(1470): unsure at all n locations
  Clone ID: PAT_TA_19659
ctactttgaccaaacttatagaaaaaagtatcaacacattcaatgccaaataaatattgttagattcattatgaaatgtattttcatggaatatatattcggtatggtagatgttcatattttttaatatatatttggtcaaactttgcaaagtttgacttgacctaatctaatacgtggagtaaaaaggactggcggagtgtccatgaataatgatggcggtttgttcttaataggaaacatacatataatatgttctctggcagcttgcagaatggattactactaatggtgctgtgtcattagagaccgctctgtcggcccccgcggccggtgaaaaaatgctcagaatgggtgaccgaccagggcgtcctggttatgatagaaagaagttgcttctttatgccataatttgtggctgtcgacggcaaattgacagattacttaaagatctgccaacacttttcaatactataggggatttcttgtggttcaagttgtcagctctacgggaatactccagtgcatcttcttctaatgttgcgaatgaaggcttggttccttatatgctggaggatttacaaaattatctgaacaaatttgagccatcgtattatacaaagagtggaaaagaccccttggtctatccctatattctgctcttaagcatccaatcacttccagcaattctttatttgtctaaagaagttggcgaggaangggtaccatgttgatgctgtgcatatttcaattactctagctgatcatggtattctcccctgagggagttggatcaggccagaagatgggtgtaatggatgcttgcgcagaagctgacagtattatacggcaatatggctctatttacttgcgcaatggcaaccttgatttggccttggagtattatgcacaggctgctgctgcaatgggtggaggccaggtggctgcgtgcggccaagggggggcggatcgacaacgtcaccgtgggtctggggccaagcgactgccctcagagatattacttcgggccggtggttttctacttctgctcggcccgccccgaatgggagttgacggagggcgaagggagggtttgatggattggagaagtaggcagcaattcttgcttgaagccgcccatcggtgtcaagaggcagggctctatgacaaatcagtggaaattcacaaaagagttggagcctttgccatggcacttcagacagtaaacaagtgtctatcggatgcagtatgtgccctggcacacaatatgttagatggcgaaagccgtgctgttgctctaattcaatctggcaatgaaattttggagacagccagatattcttctgaagccagtgttcaagacaaggatctcatttctgaccagcatattatactgaancagtttgaacccatccttcacatttttnagggctanncccgggcggnanaaatgtttnaccnctctggggg

SEQ ID NO: 19660 - DNA, 593 bp, Triticum aestivum
  unsure (1)..(593): unsure at all n locations
  Clone ID: PAT_TA_19660
gacccaacccgcccccccgccgctgcccgctcccctcttcctcggcctcgccgccagcttcgcgtggggcgtgtaccagtcgcggcaccggccgcggagcctcgccttcgtcatcgtcacctactacctcctcgccgtgctctactgctgcctcgggaagctgagcctcctgcgccgcgacgacccggcggcggcgcccgagcgccaagcgggtcaggctcgccgtgtgggtcgtctccgtggcgttcgccaaacgtcatcgcggcgcgcgtcccccgactcgatgccccgaagcgggggctccaagatccccgttctgggtgggccttcgcccgccggcaatccggcgtccccttcctacttcttcttcatccccgggggcgcccgccccgccgccgggcccccgcgcgagccgggnggggaaaggcggtngntncaacaaggttncccccggaacaaaaagggtcnganggngaaacctccaattcaantttggcaanngggtgggnttggaaanaantaatnaaannccattgncntcctttttttcttaaantnagnaaaccnttaatttttaaaaacttnaataattt

SEQ ID NO: 19661 - DNA, 1063 bp, Triticum aestivum
  Clone ID: PAT_TA_19661
tccacgctcagctcaactcagaaacagatggacaactacaccggcatccccggctccgacgtcctgcgcagccgcgccgacagccagctcgttgccgtcacgtacatcccgcgaggggagcaggtggacgaggccgtgcggcgggagatcctcaggcaccggtcgctgcgccaccccagcgtcgtccgcctcagggagctcgtcctcaccccgacgcacctcgctgtcgtctcggagcacgccccggacctccaccgacgggtccgggatgccggccgtttcagcgaggacgaggcgcgtttgctgttccggcaactggtatcaggagtcagctactgccactccatgcaagtgtgccatcgtgacctgaagctggagaacatcctgctggatggcagctgcgcggggcctcctcgcctcaagatatgcggccctggcgtttcaaagcgtcagtcgcagccgggagcgccaagagcgtctgaccaaacacgggtgtacatcgctcctgaggtttttcagcaaagggaatatgacggcaagatcgccgatgtgtggtcctgtggaatgacgctctacgccatgctagtcggtgcctaccccttccagtgtcctgacgacgagcctataaattttaggaagataattcagaggatacagagcgtggaatactctgttccagatgacctgcacatatcggccgagtgccgggacctcatctctaagatctttgttgctgacccagcggctagaatcacggttcccgagataagaaaccatccatggttcttgatgaatctcccggctgatgatagcacgatgagcaccgaggaggcagagcagccggtgcagagcatggatgagatcatgcagatcctagcactggcagaggcacctggcgatactggcgatgacatggaagaatttgtagattcagatccctgtattgacatcaccacatgctagtacgcctcatatatattttggaacaaattgcatatgttacaggtatcaaaactcaaaacatcatagcagcaggaaaactacatatatagatacaataact

SEQ ID NO: 19662 - DNA, 931 bp, Triticum aestivum
  unsure (1)..(931): unsure at all n locations
  Clone ID: PAT_TA_19662
atggccttgtgaggaccagatgatggcttgggggcaaaagctccaccaagcttgtcaagcatccagtgagacggggcattgagcctcttcagatgcttcttcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctacccgccgcgcgtcgcgcaggagaaggagcaggcggcggcggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccattcggccagaagggcatccctacctgaacactatgatggccgcacatccgctaccaagacctctcatcaaggcaatgacactatcaagctcgacctggagaccaacaaaattgttgacttcatcaagttcgacgtgggcagcgtggtcatggcgacgggcgggcgcaacactggcntttggnttttaaaaacggganaccatagggacttccacc

SEQ ID NO: 19663 - DNA, 492 bp, Triticum aestivum
  Clone ID: PAT_TA_19663
gaccccgcctccgggaatggcctccccgtcgtcccctagccgccggctcgccggatccctaatcctgcggccaggcgcggaggggtctctgatcccggggctcccggacgacgtcgcggccgtcatcctctgcctgctcacgttccccgaccagtcccgcctccgcgccacctcccgcgcgtggcggctcctcctctccgccgcgacgcttctcccgctccgccgcagcctccgcctgccttcccgccacctcgtatgccttttccccaccgacccatccctcgcctcccccatcctgctcgaccccgctgcccccaccgcctggtggcccctcccgccgatcccctgctcgccgcagctatacggcctcgccaatttcgccgcaatcgccgtcgggagccacctctacgtcctcggcggttctcacttcgacgcccggagttatccccttggccacccctcaccctccgccgccgcctaccgactcgacct

SEQ ID NO: 19664 - DNA, 706 bp, Triticum aestivum
  Clone ID: PAT_TA_19664
gcacgagatcaggtccatcttgcaaagatttggtacttgtccatcttacaaatagaagaaacgcggccggcttatcaggtccatcttgcaaagatgccttagatccaggaaagatgaacaaagatttggtttcattgcaagttttggacaacattcaagcttatcagttctctgctttttggatgctcaacatcttcaagttgtacttctccttcttcttcttcttcattggcttcaagttgtacttcttcttcttgaggaatcaaattcagatctggaagccaatttaaatctggttcttcttgttcttctggttcttcaagttcccaatcatcatcttgtcgaggactcatgttgagatcaacaccaaacatcatcgcagtggtggcgatgacacaacttgagctcactgtgacagggtgccatcaccaaaaggatgacaacaattgaggaaatggcaggaatggatgttctctaatgtgacaaaactggaactctcactctcaaccatcttaccgtcgacaaaaacctaatcgagtgaggaactctaaaacttgatggagcttgccgaagatctactggtgagaaggggagtagagctctggtaggaagatggggagcagagcaccggcagggagcagatcttcccctccctgaccgtgaaggaaagacctcgctatggaggagctcgtcatgtgaaggtgca

SEQ ID NO: 19665 - DNA, 659 bp, Triticum aestivum
  Clone ID: PAT_TA_19665
aattagtgtttttggcattaacagaaattttggactagtaattagtccaaaaaatactactaattctgcgacaaaaccactcattcctggtaaggcaagagaagccattgaaaagctactaaacatggtaaaaattttaggcattgggatagatattccccccagttcttcgagataaacaagacgcattctatctgttgcggttcctgccttgatacaaacggctgccccaataaatccatgggataatatttgtaaaatagctccattgagtccaatgttggttctcggcccctctcctctatttgtgcaacccatctgcgatgctgcggcttgcgctagccctccttggctaaacaggcacatgttaaacccgaggggggggccccggccaccttcttcgcccctaagccaaattattctgcgcagttgtatcctattgatctgatttagcagggcaacccttgcaacatctgtcccttgccttcacgctgcaccatgatcaatctcgtagccaatgcgcaggtacacatgacaaattaacttgcatcttcattaagtctgccacaaccagatcttaagattcctgtagctcttcatgatcccaactcataacaattaacccaaagataattgccacaactattggtttgcaaaaa

SEQ ID NO: 19666 - DNA, 413 bp, Triticum aestivum
  Clone ID: PAT_TA_19666
gcgtacaggcgtccgaaccaacacagacgaactcttatagagcacgcagatatgacacgcacgaagattgctctatcagcgtgcaatggcgaccaccaggatggcactgtcctgctgctgcttgggctgtaaggcgaggaacgacctgccatgctcaggactgttggcagaggcacgcgtgaccatgcgcacgaccgggggcaaggccaagacggtgtgctctagctgcccgtggtacgggtccaaccgcgtggtttacttagggccgatatccggcgacactacgagctacataaccggtgaggtctcgggcgactacggatgggacaccacaacgctgtcctgcgagcgatacactttcggcaagaactgctagctggacgtgattcactgtctgtgggacatgctgggcg

SEQ ID NO: 19667 - DNA, 238 bp, Triticum aestivum
  Clone ID: PAT_TA_19667
gcgcacacgcgtaccctcttcctcgctatgtcgcacacacacctcgacgctgtgactagatggagatcatatatgcctttggtgggaggggagacggcggtacgcttgaatgctaacgctgaggcaggccttacaaagcttgatggctaccttctgacgaggacttacatgtgtggataccagagcttacaaggatgactagtctgtgtatccagagttgtcaggtggtacaccatca

SEQ ID NO: 19668 - DNA, 618 bp, Triticum aestivum
  Clone ID: PAT_TA_19668
ggtcgacccacgcgtccgctgccaaatatctggaagtgctgacagagatgaacaaattggggaggctgctgatagcattgagcgggacttgattcttcttggtgctactgctgttgaagacaagctccagaaaggggtaccagaatgcattgacaagcttgcacagcccggggttaagatatgggtgttgacgggtgacaaaatggagacagctatcaatattggctttgcatgtagcctacttagacaaggaatgacacagataatcatcgccctggaagcacctgacatcattgcattggagaaaaacggagacaaagattccattgccaaggcatcaaagcgaagtgttatgggtcagatagaggatggaataaaacaagtcccaaccttggggcagtccagtacggaatcttttgcgctgataattgatggtaaatcattaacttatgctttggaagatgatgtcaagtttaagttcttggatcttgctgtcaagtgtgcatcagtcatatgttgtcgatcttcaccgaagcagaaagcattggttacaaggcttgttaacattcagataaagttaccttagcaattggtgatggggcaaatgatgttggcatg

SEQ ID NO: 19669 - DNA, 654 bp, Triticum aestivum
  Clone ID: PAT_TA_19669
gtcgacccacgcgtccgatcaaaaacaattcgaacagtctggtcagttctagaggattttccatatgtgacactctcctgaatgttgaatctcagcaatgttgtagaggagtaggccagtctaattaattagatttacatgtttgtaagtctcgatcctagaaacttgcaaacctacggttcaacaaaggctgcaatttactttttactgaaagggcgggtatctgttgctcgctccctcccgttgggcccagatgtgcctgagtgtgctgaggagcctcctccgggggttttgtcgccgcggtgcgccgccacccggtccccccacttgggacccggtggggctgtggctgctcctgatgttggtgcctccggcggtgtggtggtgtgtgcctgctgccccagcggcggcggcatcgcaagctgtgaaggcaagtgcctgcggtcatttcatgcaacaaaagatgctagtgaagactgcaaaacattgggctatactaggaatcagtttgatgcgatgaaagtttttctgtgcaagaattgtgaacatgaaagatatcaatgttttgcctgtcacaggttgagttcagcgaaaacaaatcctcctgaggtatttccttgtgcctcagcaagttgtgggcacttttatcatgct

SEQ ID NO: 19670 - DNA, 400 bp, Triticum aestivum
  Clone ID: PAT_TA_19670
ggacatgaggagcgcgaggaaggagaaggagggaggaaagaagagccaccatggttctttttgtccgatgttagactatgggctatctttttccataagccgtcttgcttattcattggggcttctaaactagttatgaaatagctaatttagaagtctcaacaaatctagagggcaacttatattttaagccggagagaggcatcttattttgtaagccactcaaaagaactagccctacaaataagatacacacatttacacacacacatatgctaaatgtcacttgtctgaagatgaatttggcactacttgattatgcgtagagcatcgacaacgcgacccgtcatggtgtcccatcggagatgtgcctggaacgagtcagagccaggcgagacat

SEQ ID NO: 19671 - DNA, 720 bp, Triticum aestivum
  Clone ID: PAT_TA_19671
gacgcctgcaggtaccggtccggaatatccgggtcgacccacgcgtccgaaatggtactgccacatttgatttttttttttaatttttgatgacgaccggacgagtccaagagataaagtgataaacccacgccggggcaaaaccggcccgcccgtccggattccaccaacaagaagacagctggcggctacgcgatcgactccgcccgccgccacattaaacaccagggagggtcgccacacacacccatgcacacaccatcgcagccgcattcgcagtcgcatcgcccctctctctcctcccacggcagcgcgaggcgcgaaagagtagggcgctaggcggggaggcggcggcggcctcggaccgatctctcggcaccagatggcgccggcgggaggcgcgggaggcgccgccgccgcggcgaagagggtgccgatgtaccggctgttcgcgttcgccgaccggcgggacgcggcgctgatggcggtcggcgccgcggcggccatggccaacggcgtcgcgatgcccttcctcgccttcctcgtcggcgacctcgtcgacgccttcggccccgcccaccgcgccgacctcgtccacgccgtctccaaggttgctgtcagatttgtgtatctagcattagcttctggagtagcaggttttcttcaggtgtcatgctggatggtgactggagaaagacaggctgcacgcatccgtgggct

SEQ ID NO: 19672 - DNA, 524 bp, Triticum aestivum
  Clone ID: PAT_TA_19672
gcacggccccctcccgtccgcccccgctcctcgccgcctcgcagccccgggcgccgctccccgctcgccgcgtccgtcggcgtggtcccggcgccgcgccggggacgacggcgcccgcgggcgcgccggccgcccccgcgcacgcggccccgccccgccgcagcgccgtcgccccccgccgctcaccgcgccccggcgctgcttcgcgccggtcaggcggctcctgcccccgctcctgcgccggcacaggatggcgctgctcacggcgcccgcggtcttcgcggccctcctgctcttctgggccgtgctcggcggcaccgacgccgactacctgctgtacaaggacgccaccaagcccgtgggaggaccgcgtcgcctgactctcctgggccaggaatgacgctcgccggagaagatcgggcagatgaacccagatcgggcgccgcgcggccgcccccgacgtgctccgggacaacttcatcggcagcctgctcagcggcggcggcagcgtgccgcgcaagggc

SEQ ID NO: 19673 - DNA, 638 bp, Triticum aestivum
  unsure (1)..(638): unsure at all n locations
  Clone ID: PAT_TA_19673
ggtcgacccacgcgtccggggtttccttgcgcgcctcgagccgccgaccccgtccctcttcctcttccgacgtaccagtccagatctcacggccgccctacaccgacgacaacggacatgcctccgcctccccggacaatcacagcccagggctcctcaacggtgccgagatggccaaaaggccgagctctgacttcttcagtcacttgttgccccgcgaccaggacatgctcaacctggccttccgcaaaggcatggaggaggctagcaagttcttgccgcccgacatcaccctgccgccaatcaacgaggggacagtggtgggaggcgggaatctttcagcctcaagaaaaagagggccgcactgccactggagccggatgtgggcaggcccagcaaattgatgatgccggagcaggaggaacgcaagatgtttgacgaaatgatgttccaggaacacgagatatgcatgaaggggactcacaacctgatcgccgcagcggacggcgagcccgggaagaacagccggaagaaggaccggtcgagaaaggccgtcgatgatagggagatgtggacctgcacacgctgctgctcaactgcgctcaggcgctgtncacggacaaccgccagagcgcctt

SEQ ID NO: 19674 - DNA, 975 bp, Triticum aestivum
  unsure (1)..(975): unsure at all n locations
  Clone ID: PAT_TA_19674
ggtcgacccacgcgtccgggatatttctgagaacaactttactggtgtgttaccaccttcaatgaaaaacctgtcatctttgactacattgcgcatacaagacaatcaactgtcagggacccttgacaacttgcaggatctccccatcaaagacctgaatgtagagaacaacttgttttctggaccagtacctccgaaactacagaacataccgatccccatcgccgaaaggatggtaatccatttaatacgactatagccccgtcagcatcaccgccttcagcgtcgccgccttcatcaataggaccagcaccaactccaacaccagcaggaccaaaacaagccccaactccaacaacaacgcctacagatctaagtccaacaagagcaccctcacctccatcgcccccttcaaaatcccctccgccctcaaactcttctgatggatcaactactcgagatagcacctcatcatctcagaaacataattcgtcaaaaaagctcaagattgccggatttgttcttcttgtagtagtgctattcatatctatagtcctgctggtaatcttttgtttgtccaagtaccaagagagacggtcaagatatgattataacagaagtcagctgggaagggtgcatcatagggttgaaccccaaattatgccggcttcagtgcaaaaaagggatgatactaaaaaagggccaggtgaggcccttgacaagagaagccgcgagtcaagtttggcagcagcagctctcccaaagaagcctgctgaaaaccgaaaggagcacataattaatttggatcgaacaagactcggaactttttgcagttgcaccccctgcacctccaacaccccctcctgaaaaaagttgttgtacagcccaagcccantggtactccaagaaaagagatatagccctccaacaagggacaaagtaccccaactttctgccanaacctantctgttgca

SEQ ID NO: 19675 - DNA, 597 bp, Triticum aestivum
  unsure (1)..(597): unsure at all n locations
  Clone ID: PAT_TA_19675
tcgacccacgcgtccgtcctgcagttcgtcgtccaggaaatcatgaaacccgaaggacacctggggtcagcggcatgcaagacggacgcgaccacaagtccgccgtgcggcgtcgactgccggaagcacggcctccaggtggtcgccaagctcgccgccgagctgaccagcaccaagaaggcggcgtcggtcgacatgacgggcctcagccggagcgtgtcggagctcggcgtcggcctcgggaaggtccacgacgtgctgcggctcaacggcatggcggcctcggccgagagcgcccggcggttccacaacgcgatgagcgcgttcctgcggcaggccgaggaggagatcgtcaggctccagggccaggagagcgtgtgcctgtcgtcggtgagggaggtggcggagtacttccacggcggcgacgaggcgggcgacggcgaggctcgcttgttcagggtcttcgcgggcgtccgggagttcgtggccatgctcgaccggatctgcagggaggccggggaggtccagggcgaccgcgtcggctcgacgccggtgagctgggtggctgctggcgcgccgcccatggggacgacgcnn

SEQ ID NO: 19676 - DNA, 565 bp, Triticum aestivum
  unsure (1)..(565): unsure at all n locations
  Clone ID: PAT_TA_19676
ccacgcgtcnnnaaaaaccgccccacgccccccggaacgcggtncgaacaggacagccagtccgccgcccatgttgcgcacggcgatccccgcggcggcgcggcggcgcatctcctttgccccggcaagattcgcgcacgagcttgcgcaggcgcaggcgcaggtccagtcggccgtccctggacgggacggccttgagccgtcgtgggtcccgctgtacaggaggatctcgaagctgtcccatggcaggcagccgggaatggcggcggcggagatgaccaaatatctccgcgagaggcgcccgctctcggagtaccagatcgtcgcctacatccggaagctccgcaagttcaagcgtcacgcgtgcgcgctcgagttgatggattggatggaagctcgtggagcaaagttgacgcatgggcatcaagcgctgcggcttgaccttgtttcaaaagttcacgggatacaggcagctgaagaatatttctggagccttccagatatattgaagtcannnnaagcttattcaagnnngcttaactgctatggtgaacacgggatnnnn

SEQ ID NO: 19677 - DNA, 545 bp, Triticum aestivum
  Clone ID: PAT_TA_19677
gtcgacccacccctcccccagccaggacccccgactgtggtttcacttcatccgctgctgtgtgctcgtacggtgcatcgtggcgtgctacatcgtcgcctggggcctcctcgcacacctgcgctccatcccccgtgggtccgtctggttccccctactgcgccccaggtgtgggttgatgctacgctcccaccggacgtccgcccagactcagcgggggcatgatggataagtctgtgtactagggtccttgtggggctgcagcacatggtccttgtggcagttaggaggataaagtcctggaccatcaaggactggctgttaggatagagttctgttcttgaccatcaaggactgtcagttagcatcttagactagcatcttagactagcatcttagactggcatcttggcagcatcttagcatatgccttggctggctagcagcctataaatatgtatccccaacccctcgggttggcatggcattgtgtgagaaataaaccaacgaaaattgtcccaactctcctagtgtcatccacaact

SEQ ID NO: 19678 - DNA, 764 bp, Triticum aestivum
  Clone ID: PAT_TA_19678
tcgacccccgcctccgccgccaccggccttctctcgctctcgcgttcaggtcctctcgatttcgccccgtccttctcctctgatccgaaggcgaattgcgtttgcttgtgaagaacaaagagcggtgctgaagctggggcatgctctaatagtcggagatggaagtagatacactgaaggatgaattcgatcgtgttgttaaaaagcagaaacttgcatcctcgagaactatagatttggtaaaccaaatcgagaaagaaattgagcaggctatcggtgctatccaagaaaatggcacagatagggatgctgcatcaaacctgaaccatgaaattcttactaatctgaagaatacgctgaaagagttggttccagtgaagcaacttgagagctgccagaaagaaatgaacactgcactcggcaagtgggtcaagaccaccgagaaattcttcatcaatgatatttcaaaagcttacaagaatgtcgacatggaaccgcatgtacttaatgagattattgcaaaccatctataccgggaggcattatttgacataggtgacaactttcttggagaggccagttgcttagcatctataaaactgaaacaactgtttcaggagatgtatgagatttttggtgcgctgcggactgagaaatctgagcctgctctgagttgggcaatgaaaaatcatgatgcactactgcaaaacgattcctgtctcgaacttaagcttcaccagttgcagtttgttgagatactcaag

SEQ ID NO: 19679 - DNA, 427 bp, Triticum aestivum
  Clone ID: PAT_TA_19679
atgaagtctcacgactgtcacgtgctgatgatgcagatacttccagttgcaatccgtgggatcatggatgcgcacgttcgtgaaacgctatttggcctatgcaactttttcgacgtcatctctcggaagtcggttggcgtgaggcaactcagaaggctacaggaagagatcgtggtgatactatgtgagcttgagatgtactttccgcccgcattctttgactttatggtgcatctactggtccatatcgtggaggatatcatccaactcgggccgacgttccttcacaacatgatgccgtttgagaggatgaatggtgtcatcaaaggatacgttcgcaacatgtcacgtccagagggaagcatagccacgggctttctaaccgaagagtgcatcctactacatggattatctatgcatcgagaac

SEQ ID NO: 19680 - DNA, 922 bp, Triticum aestivum
  unsure (1)..(922): unsure at all n locations
  Clone ID: PAT_TA_19680
aacttcaagatccggactaaagtagctaagagaacgaagaagaggaggaagaatggacttgtgtgagaagaaacgaagtaaccagggggccaactatggaagagaagatcatcttgtgctaaaagtaaaggaggagggccatattgcaaaaggtgcagatcagaggaggggaatcgaaatccctagcagcagcccgatccccttttgagcctggcatctccatctctctccccctcaccacttcttccatctccggccgcggcggtggccaggcccgcgtggcggcacgccaaccacccaccgccaccatccatcaccactactccccgcttcaccgcgccatcatcaccactgaacaccaccgcgcctccaccttcactgcgccatccatccaccatcaccagcgccacattgcgcgacccaccagacagccttgctgcacctccgtgcgagagtgcccctgctgccgtccttcgtccttcgcctgctgatactcttctttccccacgcctctgctcctcctcctttcaacactactgctgctcctctacttaaaactgctgctgctccctctcccacgtccctgctgctgcactccttctctgaactctctcttgcagttgttgctgtcctctatccatccccacgctgctgctcttcttctcccaatgaaatcctcctcctcctctctctctaagcaccttctgttgcactgctctccaacnccctgatgccattgccctccttcccttcctttctgcngcaacctgaaccaatatctctgatccaactggcgttattctanaatttagatggtagntttgaaagtcanatgnacatatggaccngaaagtagttatcaaaanagggtctgctaattgnctaggtgaatatacatgcatatcgttggtaatataatcan

SEQ ID NO: 19681 - DNA, 942 bp, Triticum aestivum
  unsure (1)..(942): unsure at all n locations
  Clone ID: PAT_TA_19681
ctcaagtggcggtggaagccgcggcggtgcgacatgccgcggttcagtgcccggagcgtgctggagtggctgagggggaagagggtcgtgtttgtgggggattcaatgagccgaacgcagtgggagtccttcatctgcatgctcatgacaggggtggacgatcccaagaaggtttatgaggtgaatggcagccagatctcgaagacgatccgatttttaggagtgagatttgagtcattcgacctcagtgtggagttctttcgatcggtgttccttgtgcagcagacccctgctcctcctctacatgtcacaaaaagggtccgcgcaattctcaagctcgataagatggatgatcttagcaggaaatgggcgaatgccgacatgcttattttcaattcagggcattggtggactcccagcaaattatttgacatgggttgttattttgaggctggaggcttgcttaaactgggaacatcagttaattctgctttcaaaatggcactggaaacatgggcttcatgggtcaaggaaaaagtggatttaaaacgaacacgtgtcttcttccggacatatgagccatctcattggagtggcttgaaccaaaaggtatgcgaagtaacagaaagacctacaaccgaggccataggagctgataggagtgaatttagggatatacttgctgatgttgttgcgaacatgagcgttcctgtcactatactgaatgtgactttgatgggggccttcaggagtgatgcgcatattgggtatttgggagtcatccttctaccatacttggattgcagccactggggtcctcccggagttccaaatgcttgggnatgagctaatatttctcaccttttggacggacggntgggcgaaaagctggctgggctgactaatccacattggncacccaacctttggntttccngggcc

SEQ ID NO: 19682 - DNA, 790 bp, Triticum aestivum
  Clone ID: PAT_TA_19682
gctttgtagtgaacggctaccctccagttgaggaatttaccccagtgcttgccaagatatatgcgaaactcaaagaagtgggggagaagtttgaagttgtagctgtatccttggacagtgatgaggaatcattcaataacagtttttcaagcatgccttggctcgccattccccatggcgacaagatgtgtcagaagcttgtcagttactttgagcttagtgatcttcctacactagtgctgattggtcctgatgggaagacactgagcagcaatattgcagacataatcaatgagcatggtttggatgcatgggaggggttccccttcaatgcagagaagctggaaattctagctgagaaggcaaaggctaaagcagcctcacagacattggagtcccttctggttactggtgacgtggactttgtcatcgggaaagatggagcaaaggttcctgtagcagaacttgttgggaagactgtcctcctctacttttcagctaaatggtgtgggccatgcagagccttcctgcctacacttgtggatgtctacaacaagatcaaggagaagaacagcgatttcgagatcgtcttcgtctctagcgacagggaccagagctcattcgacgacttcttctctggcatgccatggctcgccatccccttggaagacgaaaggaaggcgtacctgaaaaagagttcaagatccgtggaatcccttctctggtcgccattggccccgatggggaagacggtcaacacggacgcgaagactttgctgggcggtccatg

SEQ ID NO: 19683 - DNA, 3108 bp, Triticum aestivum
  Clone ID: PAT_TA_19683
cgtccgtaatccctctcccaaaacaaacggcataaaccacggcctcgacccgctccgtctccgctccccccactaccagtccactccccttcctccccctccgctccgccccctcaagcgaaggcaccggatggcggcgttccccccacccccggcggcggcctcggtgccatcctcgccggcggcgacagggactacctagtccgcacgtcgtctcgaccccaggccaaaccgcaaacaaacggcataaaccacggcctcgacccgctccgtctccgctccccccactcccagtccactccccctccgaaccaccccctcaagcgagggcacgtccacggcggcgtcctcccccacccccggcggcggcctcgggggcatcctcgccgccggcgacagggactacctcatccgcaactccggcgagcaggtgaagatcagacagcattgagggagacactgtagctttctatttctcggcctcatggtgcccgccatgccagcggtttacgccaaagcttattgaagcatacaaaagaacttacctcatatggcaagaatgctttgaggtgatctttgtttcaaggcgaccaagatgaggaagcattcaatgcctattttgcaaagatgccgtggttggcagttcctttctccggagctctgaaggccgtaaaagccttgatgagcggtttagaggtcaacggtattccacaccttggttttccttgatgcaacaactggtgaagttacttactgatgaaggagttgagtttgtgagtgaatatggttatagaagcttatccattttacaactgaagaggatcaatgaaattgaaggaacaagaaaaggctgctaaggataaccaaactattcatagtgtgccttgctacaccaaatcgtaactatgtaatttcaaacacggggggagaaggtacccatcgttgatcttgaggggaagtatgttggtatatgctttgtagtgaacggctatcctccagttgaggaatttacaccagtgcttgccaagatatatgcgaaactcaaagatagtgggggagaagtttgaagttgtagctgtatccttggacagtgatgaggaatcattcaataacagtttttcaagcatgccttggctcgccattccccatggcgacaagatgtgtcagaagcttgtcagttactttgagcttagtgatcttcctacactagtgctgattggtcctgatgggaagacactgagcagcaatattgcagacataattaatgagcatggtttggatgcatggcgaggggttccccttcaatgcagagaagctggaaattctagcagagaaggcaaaggctaaagcagcctcacagacattggtagtcccttctggttactggaatggagtagactttgtcatcgggaaagatggagcaaactgtcctcctctacttttcagctaaatggtgtgggccatgcagagccttcctgcctacacttgtggatgtttacaacaagatcaaggagaagaacacgtttcgtacaacaagacacaaggaggaagaacagcgatttcgagatcgtcttcgtctctagcgacagggaccagagctcattcgacgacttcttctgctggcatgccatggctcgccatccccttggaagacgaaaggaaggcgtacctgaaaaagaagttcaagatccgtggaatcccttctctggtcgccattgggccccgatgggaacgacggtcaacacggacgcgaaggacttcgctggcggtccatggcgccgacgcgtttccgttcaccgacgagaggatccaggagctggagaagaagatcgaggagatggcaaaggggtggcctgagaagctgaagcacgagctgcacgagcacgagctcgatgctgatccgccgccccaggccgtaacggctgccgacgggtgcgaagagatgggcacctccttggtcctacaactgcgcggagtgcgacttcgatctgcacaccaagtgcgcgctgggtgaaggagaagaagggagaggaagggtgaatgggcaggaggcatgctgctgccccagctggggtacgtgtgcgaggggagacgtctgcaggaaggcctaggtagcgttgtgttgtgtgtgttccttgccagctgaagcgtgtctgaatcatgtgctgtgtggtgtgatgataaataaatcttgcatccgatggtttggcttgggaagtatttgtcgtggtgacatttatgtgcaaaatcggtctaagtttatggtttcgattattaaaatgcttcagtgttctacacacaggcactgaagatggataacttcgacgccaagctgttatcaaacaggagcctctgcttgcttcgcatgggtgaagggcgaagggcttctgaggatgccgctgaatgcacaaagctgcgcccgaagtgggcaaaggcgcactaccggaaaggtgcagctctaatgttcatgaaggagtatgatgctgcgtattcctcactgtcgcgggctctggagttggacccggaaagcgaagagatcgagaaactattctgggaggcgatggagctgaagtgatcatcgtgcaactgcggagggaagctcaggcagaatgggagctctttcgtgtgtgtgtgtgttctcagacaaaatactggacttcaaattatggcgcctttctgtgcgtgattcatggaggaccgttgcagatgctttagatcaaaccatgttgctggctacttattttgagttctctgaaacatgcatcctgttagtatgtggaagtgtagcagcagtggatgatgaaattcctaactgtgctagagtgaaatattctctgaaacttgcatcctgttagtatattcagaccttactgtgttccgttatcttttgatagtggaatccgatctattaggatcgcatggaaaactttcagcccttcttgcggcatcccgtgggttgcatgccggccgcttggcgactagctggttgttctggggcagcggctcgtgaagcagcttgttgtacagggttaaccatgtgctgtgcgctgaaaaattaattttgcatccgttgattttgtctaagttaagttattcgctggagttgac

SEQ ID NO: 19684 - DNA, 903 bp, Triticum aestivum
  unsure (1)..(903): unsure at all n locations
  Clone ID: PAT_TA_19684
cgggaatggttcctgggggagtgtggcagcgaaggctcagacttctactgcacagcaggagtcctggggtaatgtgtctgcttcaccatcagataatgcgtggggtgctgctccggtttcccagggacctgataactcggatgcaaagcagccagattcttgggatggctggggttctgctgctccagtttcccagggagatagttcagatgcaaagcagccagattcttgggatggctggggttctgctcaagccgatgactcgagtactgataaatggaagaccaatgcttctggcaacaacaaaggctggaaagcagatggatgggaggccaaagaaaaccggagggaccaaagagacaatccaggcaggccccaaatgaggcctcctgttgagaggccaccaagaccacggtacgaactgccagctgaggcgaaaaaggttctacaagaaattgaacccattgtaacaatggtcagaaagatcttccgtgaatcaagtgatggcataaggcttcccctggaggatgaaaagtttatcatagaaaaagttctggagcaccaccctgaaaaggaaaagaaggtgtctggtgaaattgatcatataatggtcaacaagcaccacgttttccaggacagccggtgcttttacgtggtgtcatcagatgggacccaaacagacttctcatacatcaagtgcatggcaactacgtgaggaagaccacgaggacatccgantcatcgtgaatgcacttcaagaagcgcaaccgcatngaccacaacggtcnacggaggccggacancactaagcnggggtccaccggtcagngaggattgaaccnctcgcaagcccngnagaancactcgttggaatcccaaggggnanncatttcngggggggna

SEQ ID NO: 19685 - DNA, 1078 bp, Triticum aestivum
  unsure (1)..(1078): unsure at all n locations
  Clone ID: PAT_TA_19685
gcgtccgcacttcttttccccacgcaatccacgacacaaccatggcgagcgcggcgccggagctcgaccttcaggatctccgcctgcaggagctcatccgaggctccatgccggaccggccgccgtcctcgtcgtcctcccgcgtgccgccgctcagcgacgacgagatcggccggttcgactgcgcggtctgcatggagcccaagctggtgttcgaccggttccgcgccacgcccgcgtgcgcgcacgacttctgcgtcgcctgcgtcgtgtcccacatcgaggcccgcgtcgcggacggcgccgtgcccgtgccctgcccggcggccgggtccggctgccccgccgccatgcacccggaggcgtgcaagaagctgctcgacatggacgtgttcgacgcctggtgcatcgcgctatgcgagcgggccgtcgggccgggccgcgcgcgctgcccctaccgggactgcggtgagctcgtggtgctcgaagccggctgcggcgccgccgtcggcgcggtgcctgaggaggcgacctgccccggctgctcgcgcgccttctgcctgctgtgcgaggagccctgggacgagcgccacgacggcggccaagggtgcgcgctcgaccggctcgccgtggggcacaactggatgcgctgcccgagctgccgcgccatgatcgacaggatcgacgggtgcaagagcatgctgtgcaggtgtggctccgtcttctgctacggctgcggctcgtctccggcagaggggatgtgcagatgctatgcttcgcgacgggaggatctcataccactcgaggccggctttgaactcgtcggggccggaccaagcgcttgcctttcctcgactcgtggcaaggatgcagtcatgtgaattcttttcagtcggtgcttgttgattttctttttcttttgcgggctgacgattgttgaatcgatcgagttaattagctaccttaacagtgacaaaaaaatatcttatattacagtgacaaaaaacatcatgtattaagttacagagtgagtatttactactacgtactccctccgtnnnnnnntacttgtcatcaa

SEQ ID NO: 19686 - DNA, 587 bp, Triticum aestivum
  unsure (1)..(587): unsure at all n locations
  Clone ID: PAT_TA_19686
cgtccgggcagtgttatcctcagcagcagcagcaggaaaaaatggccgcgccgcagcaggtccgcgccgtgcccctggcgcgcgcgctccgcctccgcacgcgcgcctccgccgccgccccgccggagacgtcccgccgcgcgctcctcggcctcacggagcccgagctccgccagctcgccgttgacctcggacagcaaagctaccgggggaagcagctgcacgacctcgtctacaagaacagggcccagcaggtggaggagttcgcctacgtgccgaaggtgttccgggaggcgctggtcggcgcgggatggaacgtcggtcggtcgccggtgcaccacgccgtcacggccaccgatggcaccaccaagatacttctcaagttggaggacaacaggttggtggagacggtggggatccccgttgacgacaggggcacgcctaggctcaccgcctgtgtttcgtcacaggtcggctgccccctgcgttgctcgttctgtgccactgggaagggagggttcgcgaggaaccttaaggggcacgagattgtcgagcaggtnttgccatagaggaatttgttcaaacat

SEQ ID NO: 19687 - DNA, 703 bp, Triticum aestivum
  Clone ID: PAT_TA_19687
cgtccgcccacgcgtttccaaatctagggttgcttcgctcgctctcctccgctccgcccatggccgacccgccgcccccggacgcgcacccggagcaatcccccgccaccgagaagccccccgcggcgcctctgacacccgaacccgaggatgcggcggagcaggatgtcgagtcggaggtggatgaggagtacgtgagcgaccccgacgacgctctcccggagatgcgtcgccgggaggccagcgacgacgaggggtccgaggaaggtaggcggcctcccagggcgcggatcgaccccgaccacgacgacgacggccaaggtgccccggaggattacgagggcgaagtggaggaggacgaggacgaggaatactacgatgattgcgtccgcgaggaggacgtgggcgaggggctcgaggaggagtatgatggccacgcggtgccgcccaaggaggtcgccgccggccagggggaggcgggcgagaagcctggggaggagggagcggaggcggaggctgaggctgacggggaagagaagaaggagcaggagccgttcgcggtgcccacctccggcgcgttttacatgcatgatgaccggtttcaggaggacggccggggccgacgcaggcgaatgcttggtgggaggaagttatgggatgctaaagacgatcaagcatgggtgcctgacagattccaggagat

SEQ ID NO: 19688 - DNA, 357 bp, Triticum aestivum
  Clone ID: PAT_TA_19688
ttccatgcgtctgacacaacccgtaactgcttgcttcactttccttatcgcttgaggggacagataaccacagtctcataatacaagaaaaatggcgatcaccaatgtcacaaaatgccatatcattactatgcataagctgcccaagacgatctatgactactatgcatccggtgccgatgacgagtggtcgctccacgagaacacgtagggctttgccagtatcctgttgcgaccgcgccttctgatcgatgtatccaaaattgacatgacatcatctattctgggattgaagctctgaatgccgatcatgattatcgacactgtcatgctgaacatggctcatccagatggaga

SEQ ID NO: 19689 - DNA, 724 bp, Triticum aestivum
  Clone ID: PAT_TA_19689
tcgacccacgcgtccggcgctgcgcgaagaggaggactcgcagccgcctccaccctcctctgctgatccaatcagcgctgcgcgtgcgccccctccctcctctgctgcggctgctgcggcttagatctccctcttcaatctggagagataggaggattctgagaagcaaaccgagtgggactcctcgaatcaagtccgtgccttcatcagcaaaagaatccccgagtgcccaatccaatacagttcttcgcgtattcgaatcagattatgaagtccggcggtacacctgagaataatcggactgtcgccgaagctccgtatcttcctcctccggcattgggtctttttaagtcggccaagattgattttgcctatatggaggcctgtagcctagcctggacaatgagcttatggagtctagctatacacccagcatatctgtgctcgctagttctcacgagctttgcctaggctgctacgcctcactccaagttcactgaagaaatcaagcatcctccactgatcaagactatggagggcgcatcgcctgagctgcctcaggacatcttgatgacctcctgggccaccctcgagatccctgacctcatccgtgccgggtcggtctgctcctcatggcgctccacgtacttgaggctgcgcagccttgggcactacacgcgcccccagacgccgtgcctcctctacacatctgaatctgctggcg

SEQ ID NO: 19690 - DNA, 339 bp, Triticum aestivum
  unsure (1)..(339): unsure at all n locations
  Clone ID: PAT_TA_19690
attcctccctccctccctcccggcccccgctgctgctctcgcctctcgcacaggcacggcacagcgcacgctccccggcctatccgcccgccgcttgccgccgaccgcctccagtcccccaatcccctttctccgcggtggatttgttgcagcagcggccagcggtagatctctccacatcggccccgtccctgtcctctttctcccccctcccgtgcccaagccactcccgccccatctttcttcctcccaagcgaaatccttnacgggcaaagnntccgttccgagctccaanaacaattttaaaacgcccccggnaaaancnggggaacantcnca

SEQ ID NO: 19691 - DNA, 671 bp, Triticum aestivum
  Clone ID: PAT_TA_19691
ggtcagggagatgtcttatgatatcgaggatattattgatgacttcatgtgcaaaattggggagcgacccacgcgtccggggtttgtccacgacaccattcaacgcctcaaaacttcaagggcccgccatcagattgctggccagatcggggacatcaagaaacttgtgcgtgaaacaagtgagcggcgtgacagatacaagctcgatgtccccacatcgcgcagtgtggtagttgaccaacgcgttgtcgctctctctatgaagaatgcagctaaacttgttggcatggagggcccaaccaatgaggcttgtcagttggctgaaagacgaggagaagaagctgaaggttgtatcagttgttggttttggaggttcgggtaaaacaacactcgccaatcaggtataccataaagctggagggggaatttcagtgtggtgcatttgtgccggtgtctcaaaagccaaatatgccaaaacttctgcatagtttattagcccaacttgggtgtggacaatattatcatgactgtgagctaaatgttcttctcgaccaagtcagagaaaatctaaaaaataagaggtacttggttattatcgatgatctatgggatgtatcagcatggaatattattaaatgtgctttcccagaaaataatcttggtagtagatt

SEQ ID NO: 19692 - DNA, 592 bp, Triticum aestivum
  Clone ID: PAT_TA_19692
tttttatagctaaccttgaattgcgagtacaaaaaaaatacccatgcatgcgtacgtgcgagcaagaaaataaaaagacagactaattatttattcactcgatcgccatatatatatatatatatgtacgtacaattgtataaggtaaggtacgtagcgacttctcttttcctttgcatctttacttactcacatgcggtacgtatacacatatgcgatattactaatactatatatagatacagttgttcttgtttggactcccagccgtcgtgtctatgaacagaaaccttggatcttcttggcagccggcgcggcatcgtcgacggcgagcctcttgccaccgtcgcgctcggggtttagaccgaaatggatgtttggataatgtgcccagttctttgcggcagtgctgaaagcttccctgtggctaatgtcggggttgtttgctttgatccttcgtatctcttccttgatgaatctgttgtacgccgaaggaacacgctgcctcttctcaggaggacgtgcgtgcagcgtttgctcctgcagcagatcgttttgcgatgagaaccggacgcgtgggcggacgcgtggg

SEQ ID NO: 19693 - DNA, 762 bp, Triticum aestivum
  Clone ID: PAT_TA_19693
gccggccgggttgcggatcacgggcccgcacaacccccaaatcctcccgctccgcgtccgcggccatggagaccctcctctccccctccgcattgctcggcccgctccgggtctccaggaagccagcggcccccgccgccgtcccctgcagcaggcccgccgtctcctgctcgctcaagaagcaggcgcaggcgcaggcgggcgtcgcctggcgcggagacggcgacggcggcgtcgggagctgggcgtcgttcttgcaccacggcctcgccgccgcggcgctgtccctggccctcaccctgtcgcccgcgcccgcgccggccgcggcgtcggagttcgacgtgctcaacgacgggccgccggcagacacgtacgtggtggacgacgccggcgtgctcagccgcgtgaccaagtccgacgtgaagcgcctcgcccgcgacctcgaggcccgcaagaacatccggatcaacttcgtcaccgtccgcaagctcacgagcaaagccgacgcgttcgagtacgcggaccaagtgctggagaagtggtacccgacggtggaggacggcagcaacaaggggatcgtggtgctggtcaccagccagaaggagggcgccatcaccggcggcccggccttcgtgcaggccgtcggcgacgccatcctcgacgccaccgtctccgagaacctcccagtgctggcgacggacgagaagtacaacgaggccatcttctcgacggcgaagcggctggtggcggcgatcgacgggc

SEQ ID NO: 19694 - DNA, 1092 bp, Triticum aestivum
  Clone ID: PAT_TA_19694
cattcaggctcttgcagcgaggcctgggggtccaccattcctaagaatcactggtatagatgactcaaactctgcttatgcccgaggtggtagactggatatggttgggacaagattgcatagcatctctgcttcgtgtggcctgccctttgagttcaatgctgttcatgctgctagccatgaggtttatattcagcatcttgacataagacctggggaggctattgtagtggattttgcctatcagctgcaccatactcctgatgaaagcgtgagcgtggaaaatcaccgggacaggatcataagaatgatcaagagcctgtcccctagggtggtgactcttgttgagcaggagtcgaacacaaacacaagtgcattcttgccaaggtacttggagaccctcgactactatacggcaatgtttgagtcaatagatgttgctctaccaagggatgataagaggcggattagcacggagcaacactgtgtggcaagggatatcgtcaatttaatcgcgtgcgagggtgctgaaagggttgagaggcacgaggtgtttgggaaatggaaggcgaggtttgcaatggctggattcaggccgtacccgctgagttcggtggtgaacaacaccatcaaaacgctgctggatagctaccacagttgctacaggcttgaggagagggacggagtcctttaccttggttggaagggcagagtgttggtcgtgtcttctgcgtggtgctgacatgtcttgaggagaagctcatgtcatatggaacctgagcttatcaggtcggttcagttttctgtctgctcactggccatctaattcactggaacctgagcttgattgatttgtcctttctccagtttcagatggaacctgagcttatataagggctttgctgcttgtctgcaccaggagttgctgtgatgataccgcgacagccgtgacttagaagaaggcatagtgattaaataaataaatatgttcatagctaggaatttggtgtgttgtggtttgctcccgttgttctaggattgacatgcttgtaatatactgtactactaattagaggatgtttagagacgatt

SEQ ID NO: 19695 - DNA, 2359 bp, Triticum aestivum
  Clone ID: PAT_TA_19695
acgcccacgcgtacgcccacgcgtacgccccacctcccgctccgcgtccgcggccatggagaccctcctctccccgtccgcattgctcggcccgctccggggctccaggaagccagcggcccccgccgccgtcccgtgcagcaggtccgccgtctcctgctcgctcaagaagcagacgcagacgcaggcgggcgtcgcctggcgtggagacggcgaccgcggcctcggttaatgaccgatctaccctcctaccggttatgtacgtacctttgtataaggtactgtacgtagccatttgtctatacagacagatttaaatatacactcactcggtccgcattaacaacatctatatatgtacgtacaattgtataaggtaaggtacgtagcgacttcttctcttttcctttgcatctttacttactcacatgcggtacgtatacacatatgcgatattactaatactatatatagatacagttgttcttgtttggactcccaaccgtcgtgtctatgaacagaaaccttggatcttcttggcagccggcgcggcatcgtcgacggcgagcctcttgccaccgtcgcgctcggggtttagaccgaaatggatgtttgggtaatgtgcccagttctttgcggcagtgctgaaggcttccctgtggctaatgtcggggttgtttgccttgatccttcgtatctcttccttgatgaatctgttgtacgctgaaggaacacgctgcctcttctcaggaggacgtgcgtgcagcgtttgttcctgcagcagatcattttgcgatgagaacatcatcgtcggcatccggaatttggacgacgatgaagaagaagacgaaccaaactccgggctattgtagacgctgccgtgatcgcgaatgaagccgttgctgccattgggcttgctcaggctgctctcctggacctgtgctgcaggagggactggtgagtgcatctgccctctcaggctcaccgaaagtaggtttgtgcagtgcccacaccggactgtcacaatgttgagcatgctgttcccagggacactcaccgcgagtacggtgttgcagaagttgcagtggacgtagcagacttcttctgccggcgtgatctggcccgacgacgacattcctccttgattatcccctggcgccgccgcctcgctgcccccctagccgttcagactacggcgaggttcaccaggcggcagccaagaagaagaagcgttgccgtggagaaccgcaggctagctaggttacatgtgctactgctgcttctctctctttctctgtgtgtgtaggttagatcgatggagagagagagagatatgtatgggcagagaggaaggagaaattgagctgtctagctttcctctttccaggttttattgatgctatggctcagagagagagaggagaagagagagagagagagagagagagagagagggggtgggagagggggagagacccccggcccccgctcgaaccgcacgcgccggccgcggcgtcggagttcgacgtgctcaacgacgggccgccggccgacacgtacgtgtgtggacgacgccggcgtgctgagccgcgtgaccaagtccgacgtcaagcgcctcgcccgcgacctcgaggcccgcaagaacatccggatcaacttcgtcaccgtccgcaagctcaccgagcaaagccgacgcgttcgagtacgcggaccatgtgctggagaagtggtacccgacggtggaggacggcagcaacaaggggatcgtggtgctggtcaccagccagaaggagggcgccatcaccggcggcccggccttcgtgcaggccgtcggcgacgccatcctcgacgccaccgtctccgagaacctcccagtgctggcgacggacgagaagtacaacgaggccatcttctcgacggcgaagcggctggtggcggcgatcgacgggctgccggacccgggcgggccggcgttccaggagagcaagcgggagtccaacttcaagagcaaggaggagacggaggagaagcgcgggcagttcacgctcgtcgtcggcggcctgctcgtcatcgccttcgtcgtgcccatggcgcagtactatgcctacatctccaagaagtgatccattccagcgccgcgcagtgtacagtacagcacagtaatttttcgaatccccccggttttctgctcgaatttttagaagtgaacagagagagatcaatgcaagcgcacccgcgctcgtgtgcagtgtttgccgcctgtttggaactaggtaattttacagagcaaacagttcagttcccgcagtactcggacaaaaattccaccaagcgggggttataaatctctacatagctc

SEQ ID NO: 19696 - DNA, 584 bp, Triticum aestivum
  unsure (1)..(584): unsure at all n locations
  Clone ID: PAT_TA_19696
tcgacccacgcgtccggaaaaatgcatcgctcttgggatccaaacgaggcattgatacaagcaggatgcggcggcgccggcgccggcggtcgtcgttgatgcagccgaggcgtcgatccagtccagcggaggcgcggttggggatcaagcttgcgaggggatccggcgcgggagggacgcgaggcgctcgagcgacatcgatggtggcgatggggtaagatctgtggcacgtgttcggcagtcatgctcctctttcccttgccctgcgccaagggatggcaaagaggaggaggctacttcgtggatgggcaatggtgtatggtggctgtgctgatggtgcgcgtgaggggattgaggccacgagcgacggttccaggcctccagcacgaggcactgcctccgtaacctaatgcctccctccgtgtctccttgatcggcacaccacaccatcgtaggcctcccctcgcctctcccatccgctagcgcacaagcacaacggcaggcacctccggatcctatctcccttccctcgtccggacgntnnnngtccaaatnnnctgnnnnctgnnntnnnnnnnnanggg

SEQ ID NO: 19697 - DNA, 358 bp, Triticum aestivum
  Clone ID: PAT_TA_19697
gccacacctcccgcaacacagacagacagatcttgacatagcgcgcgcgagatggcaccctcgatgatcacctcgccgattgtggcgcctactagcgtgccctctgtatcccggcggggatgatccttggccgcaagctgcagcgacggcaagacgatcaaggacgacaagcccattgcacttggaggcaggttgacagtagacatctacaccaactgcatgacagtggccaagaagggcgtgtacgataccgtcgactagtaccgcgccaacaatgacgggtacaggccaatctacacgccagaggaacggcctgaatctggagaccggtacgccggctgaacgacccggcttgtta

SEQ ID NO: 19698 - DNA, 1046 bp, Triticum aestivum
  Clone ID: PAT_TA_19698
cgacccacgcgtccgcttcatctcgcctcaggtttgatgccgatcaccggcttggagaatgcaacgaattggaaatctgagagcgtaaaggggggtgaattggatggtgcctatgtgattgccaaccaacttgatctcattgaaaaacagcaagggcaaactcatgctaatataatccagatggagctccagtgtgcacaagatagggtgggcaagctagaagctgagcgtgtttcagctaagaagcagcttgaccgcttgttggagaaactgagggaggagaaagcaacctggcggaggagagaacacaagaaggcccaatccattcttgaggatatgaaggcagacctcgaccatgagatgccggtccggaggccccgggtcgaccctcgcgtccggcttgttgatgagttgaaggaggtcaaattggcagccaataatctgttggaggagtatgacaaggagaggaagacacgggaaatggccgaggaggtgtgcaacaaactggtgagggaggtcgaggaacaaaaatccgatattgaagtcttggagcgggactttgtgaaacggcgggaggaggtggatgaggacagaaagttgctacagatggccgaggtgtggcgggaagagcgggtgcagatgaaacttgtggatgcaaggctcactctggaagacaaatacggcgagctaagcaaattgcaacaggatgttgaggcctttgtcgcctctttgggttgtgccaagggagacagcagcattctagtacgagaagcagagaaaattataagggaaattagcttggtgagggacctggaggttcaattcaagtatgagccgcctgcagcatcggaggaaatattagccatattcaaggagctccgcccgagccaagagctcggacgatgcaaggtgcagaggtcttcactagatgaattagaaattcaacaagctagcggccaaatggctgacgtatgcctggagaacctaaccaatagaagcccttgtcaagacagtgaaatagaagatgagagcagctgggagactac

SEQ ID NO: 19699 - DNA, 772 bp, Triticum aestivum
  unsure (1)..(772): unsure at all n locations
  Clone ID: PAT_TA_19699
ccggtccggaatcccgggtcgacccacgcgtccgttggagcctcttgagggcgacgaaggaatcttggaggcttatgccaaatcatggacatctggtatcctggacaaggctgctcggagggattccatgtcgttcacactagcgaagcatcacttgtccggttttgttttccggcgcagtgcttccgtcaaagtgcgcaacaagatggtcaagtcgctcatccggtgctactcccagaagcagcaccacgaggctatgctccagagtctggttctgcaaggcatcccacgggtttcgccgtaacgccagtgaagttggccggggaattgaaatctttgagggatgccatgttgaggttgaacctctttcccctctttagcttgaggttccaaaaggcntgaagacatcgaatcggagggagcttatttagttaggctttaaaggttgaggcctctttttcctttttgattgatgaatgccaaaggcttgaagactaactggcttggccttggttctaggggcagcggtcttgagaatagctccaagggtgttttacttgggcggtagtgacgattgtaaaaatggcggtgtccattactacaagtggtgattatagaatcgcgatgaacaacgactggtgatgaacgctttgtaaggtgtgtgtgtgccctaaaaaaaaaggtgtatgtggtcatgcgcatgcttgtgggaaacaaactggactaaaaatatcaaccggcttcaaagaaaaaaaaaaaaaaaaaactcgac

SEQ ID NO: 19700 - DNA, 845 bp, Triticum aestivum
  Clone ID: PAT_TA_19700
tcgccagcatcccccgcatcggcggccgcaagaagtcctcccaggcctggaagaccggcagcaagatgggcgctagctacactctctatcgctgccgagctctgcttcgagctgctgctctttcaatttgagctgcgctagctaagctctttcaatccccgcctccggttttaaagaagggctaatgaaaaaagatgtgtgagggtatcagtcattctcatgccggcatgctgcacttttcagctagcaggtgcggagcgcgtcctggccccggtcatgtcccttcccgtgctgttttgtcgacgcccgctcggccggctcccgtcctgcggcgggctcgtcttcggcagcttcacctgtgcctggcgagcagtttagattgttcagtcataccatagtgtttaaaattttggacattctgaagattcaaataaaaatagacatgtgcacagtttacttgatcatgtcaagttacaggtgaaagtgaccctcttatgggaataatgaagtacagaaatgagatcgagttcaaagtaaggctggggtaaaattttcaaaggccatgatgtactccttcctgatattcatgctcctgatattcctactcctattcctactcaattttaccttaaatgagagtagcaattatttctgcccgttaattcatactcctactgatttggagtactgatgaaactaagtccaaacctgttctaaattgacagtacttgttcatcttttctattgacagtaccggtccaaacctgttctaaattgacagtacttgttcatcttttctattgacagtaccggtccaaacctgtattgatagtacatgttctact

SEQ ID NO: 19701 - DNA, 644 bp, Triticum aestivum
  unsure (1)..(644): unsure at all n locations
  Clone ID: PAT_TA_19701
cacgcgtccgggctccgagccactcgttcctttctttcatctcccctgtcttctacctcttctacctttgacgcagtcttccatccccaattctcgctcgcgcgtctcactctgtagcagcagcaaggccggcgaccaccagagcttccaccgtctgcgctactaccaccggcttctgcagggacacaccatcgccaccgctgccgttgcaaagaccacgacgctgtacccctacagatctcgtcggcggcaggcgctgcaacgtagcgtcgcttgtggtggtgaccgcgggggctgcaacctgcaattctcaccggcggcggcagatgctgcaacacatcgtccctcaacacccaccgctacaactgcagtagcccgccgacggcaggcgctacaaagcaacgagcgcgttgctgccatggagctgcaacggagcttcgacgggtgtcgtcggtgctgcgttgaagctttcgacagtgctacaatgaaacaatggcggcgcaatgcagcacgcgcgtcacggcgccggtgatgatatgcaacacttgtcgaagcttgacggcgttgctatgcaccactcgccggtgctatcagtgctgctatgcagcagcatgcccaccgttgcannnnntgccggtgctgcg

SEQ ID NO: 19702 - DNA, 615 bp, Triticum aestivum
  unsure (1)..(615): unsure at all n locations
  Clone ID: PAT_TA_19702
gtcgacccacgcgtccgggccgacatcctctacagatcctacactgccatggaggaggtgtttctgaatcacgtgaggaagcaatggctcgtcaaaccgcagatctcctcggttgggtcatgttgtttggttggcattatcaatgaaggggtcctctacatagcaaacactggtgattcatgtgttgtccccgggagggtcgaaagaggcgccaaagacattaaggcagttcagctgtcatctgagcataacgcgagctttctggctgtaagggatgagctaagacaggtacacccaaatgacccccggatcatggccctgaaacacaaagtttgatgcatgaagggcattattcaggtttccagaatgattggccacacctacctaaaaagttcggaatttaatcatgagccccttctggccctggttccatattcggaggcccttccataatcccattctttgtcccgaaccatcccttgaagacatagactgtgcaaaatatagttgtatatttgcatagatggacttgnagacttaacaataggaactgtgnnatngttcatgtcactcnaatgttatttcaggnctttngangacatgtctctaaacagg

SEQ ID NO: 19703 - DNA, 970 bp, Triticum aestivum
  unsure (1)..(970): unsure at all n locations
  Clone ID: PAT_TA_19703
ggcacgagccacaacacacaccgccgccctaggtgccctctccggccggccgcggcgctacgtgtccagcgaggctgccaccactctattcccctcttcctcccacccctccatcgttatccccacatggccgccattttcccacgcctaggtgggcttgtgtcggcgctgccatcacacaggtgccaacggcggtgctttttgttcttacgcaagcgcccggtgatgccacctctcacctctctctcatggctccaccgccccaacccagaccagctagatctatgtgggacaacgtcccttcactcccagtggtcaggtccaaggcacccatcccctgcttcctctgcttcgggtgattaggagcttggtggtaggtgccccagtctctccccactttaggataacaggagctagccatacatggcagaaacaacatcgggagttctgtctgtgggtgggtggggcgatttcgcctcccgccgatgtccataagtcatatgcatgcatcacatcgacttggtgcttctactatttactctctgaagaacctctatcacaagaattcttctatggggcgtctgaacaaaaggggcatcttcgtcattccgggcactaaggtaagtggaagcaagaattcttatatctgggtganggcattaattaaatcttggggcaanggaatnttcatcacttgnaatatataagcttaccacaattgggaccangcgcggtttatctttgaaccgnaagcttagaangggaaaaaaaaattttttccttgancctgggcattgtgnaaagggaagggaaaccaaaangggntggaanacttnncaccgggaaaccattgnaancccaacaaatttnaangnnnaaacttnanaagggtttttaaaaatnnnanttttnggnncnnannnggangggnnnnaanccntnngnnntntttttnancctngnnccnttt

SEQ ID NO: 19704 - DNA, 636 bp, Triticum aestivum
  Clone ID: PAT_TA_19704
taccggtccggaattccctgggtcgacccacgcgtccgcacagctggctgaatcggaccggcgagcacctggtgttcccgccggaggaatcggagttcaaaggcggcgcacaactcgtgcccgactcggctcgtgagatggcacctgatcttgattggggtaaaaatattcgcatagcattggacattggatgcaaaagtgctggattcggagttgctctactcgagaaggatgtgattacactatcattaggccttacaaatgaccagacagaccttgcacaagttgcccttgaacgcggcatccctgcaacaattggcagtctgggatcaagaagattaccctttcctagtggttcatttgatatcatccactgtagtgaatgcaacataccgtggcattctaatggtggaaagcttctcatagagatgaataggatccttcgcccaggaggatacttcgttatctcgagcagacacggggacctccagagtgaagaaggaatatcaagcttcaatggcttcagtttgctggaacgtaatagcttacaacagtgatgatgtcagcgagcttggagtaaagatatttcagcgaccagcctcaaatgatgagtatgacctgagaagcaaaaaaagg

SEQ ID NO: 19705 - DNA, 737 bp, Triticum aestivum
  Clone ID: PAT_TA_19705
tctctctcatccccgtccggctgccccggccggcccacccgtccgccgatgggtttcttcctctgatacatcattctatctccttgggtgatcttggaaagaaagaagccccttttttcaggctttccctttccagtgtggtgcgaagcgctttccggcgtatagcttacctttgcttgtgtgctgttcctgagtggaataaagccagagcgtgcattcttgtggcttgggatagggtaggattcttccttcttccacagccatgtgctgcatgcagctttgagctttggtaattgcttctaggctctagccaccccccagtcccagctttagccatcaagatccagcaccgatcagccccgagctgccttgtgctgcgggcttgccgtgcccccttgtagtgaggaattgtcccctagcttggctcactctttattcctcatattatctgtccttactctggcattagatcaaagatcaagaacacaactccctgtttccctaggagaaaaggaatcagggacaggctcaagcagcagcagattctcctcaaggtatcagggtgttctttcttgtgttctttttgtccatgtggtaacttctgtgccaacgtattcttcaatcttgttctgaagaagctatctgggagaagcccctatatttaattgggtccaagaggagctatagatgcaacaatcataagttcttctctcactacgaagcagatgaagcttctc

SEQ ID NO: 19706 - DNA, 1729 bp, Triticum aestivum
  Clone ID: PAT_TA_19706
ccagcccccttgcgcccgtctcctctggcgcgatcgcggccgcgggaccacccgcccccgaccccgccgccgtcaccgagggcggcgcgtccaggccctcggaagcgcgaagccactcgacgacggaaaggaagccagggagggcggatcggctctcagaggcttaggtgggcgcgccgacggcatctggctgagccgggggagtgggtgggtttgcccccggatctgcgtgctccgcgcggtcgcgatgccctactgcgtaccctgcctccccttgtgcttcgacggcgcatgccccgtcgtcgaccctcccgggatctgctcctccagttccgacacctagccctgccccactcccaggagcgcttccggcacgaggagtcctgataggacgcgctgatcgataaatctggcataagttcttggagcaccagattcggctgaaaatgatgcttttacatctgaacggtgcccgctcagggaacggattttgcatcgacgatattggagtcccaacactcgacacgtaacatttcatattaatggattccactgtaccccgctcactgatcgttgaatttgtttggatggagcggtttggagaccccctgttccacagacatgtagcattggcgagcgtctggggtctgattgctttgagacttgcagatgatgagatcattcccttcaattacgtcccctacgcttctgaactggaggagagctcaaaagttgtggaggacggatgccctgggtgtgccgtcagtttcagccctctgcacaagtcaatcaagcagcttgagaaggcgtccgcgaaaattcacatggagaagaaggtgctgcaagcagagaaatggggcctaaacacgagggaacgcacactgaaagtcagagagatgaacgaccgcttgatgatggcagagcgagccttcaccaacagagaagggctcgcggggagaccgtggtacaaacacatgatttatgcgtcgtcggaccaggacgactggggcaccaaggcgttccccggcatcgtctcggccatggccaacgcacagaagctcaacacgtcggagtcttggcggctgttgcagcatgagatttacaggggtgcaagggccgtgtccaaggcctctgcagtcctggatggaaggctaacatgatgccggagtagacatcagcacagcacaacacagcacggaatttaccggtgcaaataagtagggaaagggaaaaagaatcagcacttggctcaataatgattgacgaatcacccccttgttgattctctcttcagagtagcagcaataattttcgcaaaaacattggagagtagcgccaataagttagtgtgtcattttttcccctttcgccatcagagtgtagctcatcaaattggtcagcaaaaagtgtgtcgatgaatgaggccatggatctcgcagtttattggcgtggtgtcgcattagagatcctgattccgcaggatcagcctccacgcaacaacatttgacgaccgtgcagatttatggtttttctgcgtgaatctggcagctggttcgtccgttgctggccggtcattgtccgcgtacaagtagaatatgctggtaatcaacaccctgggcctgggaaatgataagaatacatcaagaaatagggtgcacgcgaaagattctatgagcacgacgtgtgcaggttcatccaataagagtggatcgtgcccctttatttattt

SEQ ID NO: 19707 - DNA, 1118 bp, Triticum aestivum
  unsure (1)..(1118): unsure at all n locations
  Clone ID: PAT_TA_19707
cgacccacgcgtccggatgttcacaaatggaatgaaagaaagcagcgctccaaatgtatttttcgaagatgcttctgctgaagcattttctctcctccttcagtttatgtacagtggggaacttaaagtggataaccggtatatcacacctgcattggttcagctcctcttattatcagatcagtttggcatcactgttcttcagtttgaatgctgtaaaagaattatggaattcctttcagaggattcgactgttctaccggaagaagcttattttaacgaatttaagggatatggcttgtgcacatttggtgaacttgctagctggctcggcatagactgacccctgaaagtttattgcaggacacagtatgttcagtattacaagcagtgtcatcaataccatcttgtaaactgcttgaagaaatgtgcaaacagaattttgcaacacactttgattattgcacaactgcttgcacggactttgtgctgttagatgaggcaacatttaaggatattcttcagccaggtgggatgactgtgtcctcggaagagaaggttctggatgccatcttaacatggtgtatggaggcttgtgaaactttttactggagttctgtagataagctattaagcacttcaacaccagagcagctctttggagagaggctcaccgccatcaatactttactaccatttgtgcggttccctttaatgccgccgtctctccttcagcggatggagaaaagtaacctagcaaagcacattcaactgttcagacagttggttgcagaagccattggagttctctaatgctggtccatggatgatgatgacaaacaaatgcgagagatttctacatagacgctcaagctatagagagcttcagtatattcctgatggtgataacaatggtgtgatctactatgctggggacgtcattccgggaacctcaatggttcaancctgttttaaccaaggtaagagagaggttgtgtttgtgagtatcaacatagaataacccgggtttcaagtgggtccaatctccgcgaccagaatancactgtgacggcaagcaacccaaatcgaggtacacggacccaaaggcccgggttcaa

SEQ ID NO: 19708 - DNA, 583 bp, Triticum aestivum
  Clone ID: PAT_TA_19708
actgctgcctggacacaccttaaaagcattaaagttgcattgaaaggagcagaaaatttgccccgcgcgtcccacccggcccgtgaaggtgaagcaattgcttggcacataaaggaaatgcttgaacagcagcaggatgtgttgggttcccatgttactgttgcaagagttgtcttccatgaaattacggaggatgctattaaaaacgccttaatgtctccaagatatattgatatggacttagttaatgcttaccttgcacgtcgttcccttgattatttgattgggtttggcatatcaccacttttatggaggaagttgcctggttgtcagtcagctggacgagtccaatctgcagctttggctcttgtatgtgatcgggagactgaaatagaacggtttagcccgcaggaatattggactgttgatactgaattcaaaacccagtgttcggattcttcaaaaggcctatgtcttacatcccggataaagcttctcaattcaaaagttggatcagctttctataagctctcaagaagaagcacgagcaatagaaaagagggtcgacgcggccgcgaattcg

SEQ ID NO: 19709 - DNA, 528 bp, Triticum aestivum
  Clone ID: PAT_TA_19709
caatctctctctctcttccagcgactcatgcctcccccgaccaggtgacgatggaaccctagtgttgcacctctgccaccccaccggcgccccctggccaaatccattcccccgcgacctccccaactccttgtccacctccttatcttagacgactgttctgttcaacaacaaccccggcggcatagggtttgggtggacctttggcggctgagatcacctgagccttgtcgtcatccctggcagctcagattcgatgtctgtaagtgcatgcaattaatatgtaattttcttggagaatgtctgccgattggagtgacgataacactatgatcttgactgagctctttgtccaacaagtgcatgctggcaatacgccagacaattacttgactcaaaatgattaagaggaagttgcataggatttcaaagtcagaacaggtctggagtaccccaggctccaactgaggaacaagtgggataagttgaagactggttatagcaattttataaaactcaagttgaagg

SEQ ID NO: 19710 - DNA, 436 bp, Triticum aestivum
  Clone ID: PAT_TA_19710
cggacccaattgcaaccacaagagcgatcgggtgttgcgagaattcttacttcaagagtcatagggagggacttatgtcaccgcagacagaaactaatgcaggtggtggatctacagctggtgttatagatcataagttgccttactacaccccacagtatgaaactaaggatactgatatgttggcagcattgcaagtaagtcctcagcctgtggttacatcccgtagaagcacgtgctgaactagctggcctatcttatactgctacatggacaactgcatggactgatggtcttaccagtctcgatcggttcaaaggacacatgctatgacatctgagcctgttgctgtggaagacagccaatggatctgggatgtagctcatacatgagacctatcagaagagggtaccgatactaacatgtagacttacat

SEQ ID NO: 19711 - DNA, 653 bp, Triticum aestivum
  Clone ID: PAT_TA_19711
accggtccggaatcccgggtcgacccacgcgtccgaattcccgcatcttggcatcatcaatgacttacttgaggaggaacaaagcaatgtgagcatggcagagcctcctatccatgaataccatccatttggcgtgccattttctccgggaggcaacttcgcagaggctgacatgacttcttcaagtagttctggccagttgaacttgaacggccattactatgacaggctgaatgctctacacaggctgggagaggggcaattttccacattgggtgcttataccaatggaatggcggactctttttcatccaagccttggctgtatagctatcctaatccaatggtgaatcctggagtgaacgggttttcgcagcagatgggggactacaacaattatgcaagtgggagagcgaatgaggaatacatgtatcgccgtgccaacggtcaatggtgatgcttgtattacaccaatttccataatgaatgctgcttgtaagttgtaacttgtaaccggacatggtgcaggttcaaggttcgctcaaccataacttctcattccaaaaggagagaagaaaaaaggatacatcatgtaaagtggttgcagtctagtcaattaactgctttgtccagaagtgctttaaaaaaaaaaa

SEQ ID NO: 19712 - DNA, 685 bp, Triticum aestivum
  unsure (1)..(685): unsure at all n locations
  Clone ID: PAT_TA_19712
ccnttcccttngtgcaatttgaggaacgtgngcctttgtatacccactgnaaagggtttctnaagggattagttggtacccagtttcccgtcagagtttaaacgacgccnttgacggggtaatangntcattttagggnngatggtaccngggccccccccccggggnaactagatcgttnttaaacggccngatgcgacgggcngccgtcgtccctccgtgggggcttcgggctgccccacccgcccggaggttatgttgcgctcctcccggcgatcaccgtcatcccatgatcgatcttcttcggcacaatgtacggccactgctggtgaacccaagacgggcccttcctcttggacggaatcggagtcctgccatcctcttgcctcctccttttaggcacaaaagggggataatgcgtcgacaagggaagctcggtgggagatgctgttcttcgaaggtgaccgacagtggttgagacgcggcgaggttttatgttttggacaagctcttttgcttcgtagtggtggtgttgttggtggttgtcctttggactcgcctggatgtgaaattttactacgctcgttattcgcagcgagtgatagtcatcttgtacttacaaattctctcttctatagagctatggtaatcaatttgcgtgtaaaaaaaaaaaaaaaaaaactcg

SEQ ID NO: 19713 - DNA, 653 bp, Triticum aestivum
  unsure (1)..(653): unsure at all n locations
  Clone ID: PAT_TA_19713
ccacgcgtccgactcaaccaagcagcaacgagacgcagagcaagcagcaacaagtagcttcgaccttcagcttctagcgcatggcggagatgggggtgcgtgacaacttgccctgctcgacttcatggagagagctcacacacaccagctggagggatgacgattacaggaggatggtgatggcgagcctgatcgaggcggtgtacctgctggagctggagaggcaggagcggagggacgcggcggaggtggcgcagcagtggtggaagcccttcagctaccgcctcgcgcacgagctggtggacgaacgcgacggctcccgtcttcggcgccatcttcgagtggggaggaccgccacctgctcgaccgcccggcggcgccagcgcccgaggaaaggccgaccggcgcgcccagcctcnggtgatncgcgttccggggcacgctgctgcgcccgcccaccctccggcgggacgtggaggacgagctgcgcctgctggcgtgcaacagcctccgcggctccgccaggctccacggcgcgctgcaggcgctcagggccaccatcgacaggttcggctccgagaacgtgtgcctctgcggacactccctcggcgccggcttcgcgcgccaggtcggcaggatgctcatggcgtcgc

SEQ ID NO: 19714 - DNA, 935 bp, Triticum aestivum
  Clone ID: PAT_TA_19714
gcgctccctccatggcgacccccgtcgcctcccctctcctcctcccctccccggccccaaccttcccgccccgccgcctcacctccatacgtcgcctcctcctcacctcccccccgcacgccggccgcccgcgcctccgcgacccgccgccggcgccggtggaggaggccgccgccgccaccgtggaggagtacgaggcgcctccgctcaggctcctcgacccgccgcaggaggaccggcccggcccgcccccgtcggcccccgccgccccggacttctaccggatcgggtacgcccggatgatgcgcgcctacggggtcgagttcctcgagggccccgacggcatgggcgtctacgcctcccgcgacgtcgacccgctccgccgagccagggtgataatggagattccattggagctcatgctgactataactaaaaatcatccttggatgttctttcctgacattatcccactaggacatcctatattcgacattatcgagtcaacaaatcccgagacagattgggatttaagattagcctgccttcttctctatgcatttgatgtagaaaacaacttttggcagttatacggtgattttttgcctagtggtgatgaatgcaccagcttgcttctggcaccgaaggaggatctaatggaactggaagacgaagatctgtcctcagagatgttaaaacgccagcagcgagcagttgatttttggcagaaacactggcacaaagcaatccctctcaagctaaagcggcttgcccctgaccacgaaagatttctctgggcattgagcattgttcagtctcgctctttcaacttgaatatgagaatgggagctttcattcaagatgcaaatgtcctagctccttatgccgatatgctaaatcactcacctgatgctaactgtttcctgcattggcgt

SEQ ID NO: 19715 - DNA, 751 bp, Triticum aestivum
  Clone ID: PAT_TA_19715
ccgccgcctcccgcgcccccgccagccccgcccgctgcccggccccgtgcgcccaccccccccgccgcccccgcccgctccacgccgcgctccaccgccccccccgccgccccgccccccccggcggccccctccgcctccggcggccgcggcccccgggccagctacggcgacagctccttctccgtcggctacctcagcaaggacaccgtctccttcggctccaacagcgtgcccaacttctactacgggtgcgggcaggacaacgagggcctcttcggccgctccgccggcctcatgggcctggcccgcaacaagctctcgctgctctaccagctcgcgcccaccctcggctactccttctcctactgcctcccgtcctcctcctcctccggctacctctccatcggctcctacaacccgggccagtactcctacacgcccatggtgtccagcacactcgacgactcgctctacttcatcaagctctccgggatgaccgtcgccgggaagccgctggccatctcctcctccgagtactccagcctgcccaccatcatcgactccggcacggtcatcacgcgcctgcccaccaccgtctacgactccctcagcaaggcggtggcgggggccatgaaggggaccaagcgcgcggacgcctactccatcctcgacacgtgcttcgtgggacaggcgtcgagcctgcgcgtcccggcggccagcatgggcttctccggcggcgcggcgctca

SEQ ID NO: 19716 - DNA, 635 bp, Triticum aestivum
  unsure (1)..(635): unsure at all n locations
  Clone ID: PAT_TA_19716
caaggtcaacntncttncactggntgccaccgttancntcgnactgatgngncngccagcattctgggngcggcatntangccgcnaaccnttngttatggagcngggttnttgtcctcccncctcnggaagatgtagtgaggccttccatccccaccccagttgtantnttgattctcgtaattgtgctggcgggagatccataggcgaggagatgttaccttnactgtccaagggcatgttgtttctcgtccctcgccgcccagtgagtgaagattctgaagaattggaaggaaaccctgaaagttgtcatagaagcctactctcctgttggtcctgtgcaagcttctgtcatggtcaggcctcagtactgcggcataagtaaacataaatgtgacctcgacggctctaaggtgaagataaccattgcttggtcacctattattagcagtgctttcaccaaaaaggctattctgtgagagggatatgttcgatggtgctcaagtatttgctcagctatgtaagatgtgaacttattgctgtatcgatctgctatgtaatgtgtttgactgtgtgtatcgactctgttttataagccaagtctagatggtgtatttctacttaataacacaaaa

SEQ ID NO: 19717 - DNA, 777 bp, Triticum aestivum
  Clone ID: PAT_TA_19717
agacgctgcgtgtgcacccgcccggcccgctgctctcctgggcccgcctcgccacctcggacattcacgttgacgggttcctcatccccgctggcaccacagccatggtgaacatgtgggccatcacccacgaccccgacgtgtgggccgagccggacgagttccgcccggagcgcttcgccgccggcgagttctccgtcatggggtcggacctccgcctggcgccgttcggggccgggcggaggagctgcccggggaagagcctggcgatggcgacggtggcgttctggctggcgacgctgctgcacgagctggagttccgccccgccccccccccgccgcccgcccgcccccgggcgcgggccctgaggctgtcgtgcgagatggcggccccgctggccgtgacgccgaggccgcgacgcccggcggcgtgatgacgcagcgcgcctacgtacgtgcgcgcgcgcgccgctagctgcctagaggcgttgtcgctaccggtcggctcgctggcctggtaccacgcacgcacgtacgcttatcctgatgagcaactagcaagtgatgaattacctagtagtagtagactttatatatggacgtgccaggtgacgaccgtgatgtttttgccttctttttgttcgttcccagttattatttcgttagccttttattattttctcttctgcaactgccctgtaagatactgctagctgatgtatatatattctactacctaccggtactaagaaacaaaaaaaaaaaaaaaaaaaaaaa

SEQ ID NO: 19718 - DNA, 1088 bp, Triticum aestivum
  unsure (1)..(1088): unsure at all n locations
  Clone ID: PAT_TA_19718
ggtcgacccacgcgtccgcatcgtctgctctgtgagttgtggcatcgatccatgggtaaccaccagaagctcctcaacttcctccggccggaccctgcggtggccgcatgctcgccgaggtccttctcctcctcctccgcctctgtgtcggacgatgacgggtacagctgctcgtcctacccgacgacggacggggacgcctcgccgtcgcgctacggcggctcctcgaccccgcccacgcccaagtcgccgtgggcgcacctcccgggcctcggcgccgggggtgccgttgcggaacctggagccacgggcctcatcgcgtcgctggtcaaggaggacggccacgtctactcgctggcggcgaccggggacgttctttacaccggaaccgactcccggaacgtgcgcgtgtggcgagaccagcgcgagctcgccgggttcaggaccgccagcggcctcgtcaaggccatcgtcgtcgcggacgacggccgcatcttcaccggccaccaggacggcaaggtgcgcgtgtggcgcgcccgcgcggacaaccccgccgtgcaccgccaggtgggctcgctcccgaagctcaaggactacctcaagagcgccgtcaaccccaccagctacgtcgagacgcagcgcaaggggcgccagcgcgcggtgtggcttcggcactccgacgccgtgtcctccctcagcctcgacgagggcgctgggctgctctactcggcctcgtgggacaggaccttcaaggtgtggcgcgtgtcggactccaagtgcctcgagtccgtcagcgcgcacgacgacgccatcaacaccgtggccgccgccgggttcgacgacgtcgtgttcaccggatcggccgacggcaccgtcaaggtgtggcggcgggagatggccgcgaagagcgacgccacgaagcatgtcctggagaaggtgctcggggagggcgagagcgcggtcaccgccatcgccgtgtcggccgnnnnccgcgtcgtgtacgtgggctcgtcggacgggctggtcacctactggtactgggtcgannnngnnnnnagatannncggcgtgctcnnnnnnnnnnngnt

SEQ ID NO: 19719 - DNA, 1725 bp, Triticum aestivum
  unsure (1)..(1725): unsure at all n locations
  Clone ID: PAT_TA_19719
ctcccccaccgctccccatgtcggcggcgtaggcggacacggcggagccggcggcggagtgcagaggcaagccagggtcgtaggcgctcgcgaggagatggcggcgccctcctcttcagccgggttcgggggcatgtcgtcggacaacgccaagggcctggccctcgcggtgtcgtccagcgccttcatcggcgccagctacatcgttaagaagatggggctcaggagggccgcagatgcgggcgtccgcgctggttatggagggtattcttacttagtggagccactttggtggataggcatgatttctatgattgttggcgaaatagctaattttgctgcttatgcatttgctcctgctattcttgtcactcctcttggagcactcacgtataatcatcagtgctgcacttgctcattccattctagaggggaaacagcaaacaggtgatatacgtgatggttttctgtgtgtagtcggatctatcacaattgcgcttgaagctccactacgagcgtgagattgattcatgttaagggattttttgggattttgcaactgagccagcttttttttcaaatgcggccttagcagtgttctaggcagtggttatttaatatatacatacctcactttttttcttgtcaataactcttgagttccttggcagtctgttctcttctaggatctctcaccgttatgagtgtaaaggctctcggaattgcattgaagttaacattctcaggagtgaaccaattattctatcctcagacctgggcttttgctctaattgttgctacctgcgtaagcacccagataaactatctgaacaaggcactggacacctttaatacagcagttgtttcaccaatatattacgtgatgtttacctcgctaacaattatagccagtgtgataatgttcaaggattgggatcggcaaaatccaacccagattgtcacggaaatgtgtggttttgtgaccatcctttctggaacatttctccttcacaagacgaaggacatgaatgacagtaccgggccgactttgtctacacgacgctcaaagcatgctagtcagactgcatttgccatcgaggttcttccactgaaatatcaagattgtgtggatgacgagaccttgccattatcacttcccaaggctgataatcactacctaatgcaagagcttcctcttagatacaaagacttgaatatcgcctgatggacattcctttgcccacatgtgctaggaacctcttagcaaagtttgccgtgcacagtttcaggcaggattggttgatgaggaactgaacttggaggttttatctcagctttgctgttggatagaatgaggttatggaaattacaagttgatagtattatccttgacaatttcaccttttataaggagaaacgagggatggtgtcaaacatgtggtcagtcaagggatggttactcgggaatacctaccagttctggaaaacaggatgaagtgtacttacatacagtggcatcatttattatactttttttcttttcatttttagacagtcaagcagttatgctgcaatttgggcttatctgatttctaggaagatgttatataggaaaaacaaccatttttttcctgtacctatatcataaattgctgcccaattaggtgccaantgttatctgtgttaatatcaaatcataatttttgggaaaanaaaaaaaaaaaa

SEQ ID NO: 19720 - DNA, 934 bp, Triticum aestivum
  Clone ID: PAT_TA_19720
gttcgtcctccgcgtcgaggacaccgacctcgagcgctccaccaagaagtccgaggaggccgtcctcagcgacctctcctggctcggcctcgactgggacgaaggcccggacattggtggcgatttcggcccttaccgccagtctgagcgcaatgctctgtacaaagagcatgcccagaagctaatggagtctggtgctgtttatcgctgcttctgctctagtgaggaacttgagaaaatgaaggtaactgcgaatcagatgaagattcctcctgtatacatggggaagtgggctactgcttcagatgcagaagttcaacaagagttagagaaaggcacaccttatacttaccgtttccgagtgccaaaggaaggttcactgaaaattaacgaccttattcgtggtgaggtcagttggaatctaaacacacttggcgattttgtgatcatgagaagcaatggccagccagtgtataacttttgtgtcactgttgatgatgctaccatgcgcatctcccatgttatcagagctgaggagcacctaccaaacacattacggcaagctctcatttataaagctcttggatttgcaatgcctttatttgctcatgtctcactcattctggctcctgataaaagtaaactgtctaaacgtcatggggcttacttccgtggggcagtataaagagatgggctatctgcctcaggcaatggtcaattatttggcactcttgggctggggtgatggtactgaaaatgagttcttcaccattgatgacttagttgagaagttcactatcaatcgcgtcaataaaaagtggagcaagtctttgacgcaacaaaattgaaatggatgaatggacagcatctaccgtcactttcttctgaattactcatcaaggacttcgaaagatcgatggaggagcacaggcat

SEQ ID NO: 19721 - DNA, 745 bp, Triticum aestivum
  unsure (1)..(745): unsure at all n locations
  Clone ID: PAT_TA_19721
ctcgtgccgacccacgcgtccggtgagccaaccctcgcctccgtgctccggccatgtcgatctcgtcggcgcgccagcgccggtccacggctgcgtcgccgctaaccgacgacgggtactccaaggaggccaaggagaggaggcggcgcaccgacggcgaggaggtggaggagggcatccggtggttcctcccgttcctggccctcgggctcctccggcacatgagcgcgtcctccaacctgatccacgactgcgacgaggtgtttaactactgggagcccctccacttcctcctctaccgctccggcttccagacctgggagtacagttccgaccatgctcttaggtcatatttgtaccttttcattcatggtcttgtagctggtcctgcttcatcaatctttggcggtgaacacaaggttcgtgtgttctacgctgtgagaatctttcttggacttctatcgactataacagaaactgttctggtagttgctctttcaagaagatatggaaagagacttgcttgctatgtccttgcaatgctatgcttagccagtggctgcttctttgctagtaccagtttcttgccaagttcgttctccatgtatgctcatacactttcatcggcactcttggttctcaattggatgcttgtgcagtctctgttgcagctgctggagtaattcttggctggcctttctcgattntgggtggttctccctgtcactgtttactcattactcag

SEQ ID NO: 19722 - DNA, 649 bp, Triticum aestivum
  Clone ID: PAT_TA_19722
ccacgcgtccggttgctagatacatcttgcgagaaaatgctttctcttatgataagggagttctcgctgaaattctagaaccaataatggggaagggtcttatacctgctgaccttgatacctggaagcaaaggagaaaagttataactcctgggttccatgccttattcatagaagctatggtgagagtatttaccaaatgttcagagagaaccatattgaaacttgaagcacttattgaaaaggcggaccatggtgacaaatctaccatagtgaaccttgaagaggaattctccaatttggctctcgacataattggcttgggagtgttcaattttgattttgactctgttaataaggaatctcctgtaatcatggcagtatatggtactctttttgaagctgagcatcgatccaccttttacatcccttactggaatcttcctttaactcaatggatagtgccaagacagcggaagttccgcagtgacctcaaggttatcaatgattgccttgatgatcttattaaaaatgcaaaagaaacaagacaggaagctgatgtggaaaaacttcagcagagagactactcatcgttgaaggatgccagcttgctgaggttccttgttgacatgcggggagctgatgttga

SEQ ID NO: 19723 - DNA, 765 bp, Triticum aestivum
  Clone ID: PAT_TA_19723
ccacgcggccgagcaaaccacatcctcttcccctcccctccccttccctgctcgcgctagttcactgcccgaatccaaagctcccggctgcccgcgtggggtgctgtcgttagttcgcgctcgccggagctgggatccggccgggttctgggcggaaggccggatttggggccggccggtttcacctcgttccattgttttcgccgccgccaagctgcccgtagccgtcctcgtgaaaagaaattgctggttcgttcgtagcagttcagagtctgaaaaatgcatcccaaggctcgcatccacgcggacccggcggctccggagctagaccggatcgactgcctgccggactcgctcgtcctgctcatcctcaacaagctggaggacgtgcactcgctcggccgctgcgccgccgtgtccaagcgcttcaacgacctggtcccgctcgtccacgacgtctacgtcaagatcgaccgcgtcgtcgccgtggacggcgaccccgacgacgccctcaacctgtcgtcccccaagccccggaacatcctctcccacttcctcaagctcatgctcttcacgatcgccaagccgttccacggcgcgcgcggccccggcggcgccggcggcaggccgctcttcccgcggctcgcgcaccactcgccggcgcaggtgctccggagcttcacgcacgtgcggaacctccacatcgagctcccttccggggatgtcggcaccgaggacggggtgctcctgaaatggcgggcagag

SEQ ID NO: 19724 - DNA, 588 bp, Triticum aestivum
  unsure (1)..(588): unsure at all n locations
  Clone ID: PAT_TA_19724
ccacgcgtccgctcatctcaactgcgaaacagaactcgccttcttcctctccccgatccccaattccccaacacctaaccctagcccaagagccgccggcgcgatgctccgctctcccggccactcccctcgccagctcaccccgtcgccctcccccgcctcgtccacccctcgccccgcctcccccaccccgtcctccgcctccgcctcggcgtccaccctcgccaccacctcctccaagcgacgccgcccggaggtgctcgacgaggacagctacgtcgtcgccatcgagcgcatcatcgagcgcgacttcttccccgacctcccgcgcctccgcgaccgcctcgactggctccaggccgtgcgctcccgggacccgctcctcctccgcgacgcccagctcaagatcctcgaccgccgccgccgtctccagcgcaacggggcccctccccaccccgacgcccgccacctccaacgcgctccgctcaccgtccttcctcgcgacccctgccgtcgccccctcaacggaagcggaccccgaggagggcgggcgcggccctgcggccgcgctctcgctcgannatttct

SEQ ID NO: 19725 - DNA, 609 bp, Triticum aestivum
  unsure (1)..(609): unsure at all n locations
  Clone ID: PAT_TA_19725
gaaaacccaatacgtccatacaagtcattagctccagaaccgtaccaatagttgcaaagcatctaaaggtttctatggcaataacgattacttaagatacaaggaaatcatcttccggttttcaatgccagctacagaatattttgcatcaactaataattgttagctcatacccacaaatttccattcaatttcctcgtatcacaaacaactgcagacttcagtgagaagcttcaacttcatgccctatgctcccatcatcaccaaccaaacaaggaggccaggccatgttataaggatgcgcacagccattaaatttcccctccacgagcaactcaagcaccaaggtgtccaatgacagggagaagaaccagcagtggagcgtgccggcaggggtcgtgcatgtcgtggacaagtagacgtatccaaacctgacctgcacaactttgaggtcaccctgcaactccagagcgaacccctgagtgatctcgtnnatttcttcactcaaaggtatcatgttatgcancacccanttatnaagtncataaccgnncacaccacngatncaaacatgcangaagaaaccanannnatanacnnngnntannt

SEQ ID NO: 19726 - DNA, 537 bp, Triticum aestivum
  Clone ID: PAT_TA_19726
gcctcgccgccgccgccgcgcaccgcacctgcccttccgccggcgaatccgcgcgtgccctagccggagaccaggtattggcccagatctgccggcagcgatgtcgggaaccgcggccccacggtacgcgccggacgaccctacggtgccgaagccgtggcgcgggctggtccacgcctccgccggctacctctactactggaatccggataccaacgtcacccagtacgagaagcccgtgccgccggaagctcagctcccgccgcccccgcctctcccgcctcctcctccgcgcgcccgcggccggggaccgtcggagaccgttcccgttctcgctcccgctcccgttctcggcacaccgcctcggcgtgaacaccggggaccgcgaccgcgaccgcgacaggcgccgtcacgacgagcacgcctccttcctcccggccgcgccccacccccctcccccgccggctgcccccttcatccctaccgccgcagctgatgatccatcagccgaagcataccgccgacctaattaaaaat

SEQ ID NO: 19727 - DNA, 1384 bp, Triticum aestivum
  unsure (1)..(1384): unsure at all n locations
  Clone ID: PAT_TA_19727
ttcggcacgaggctacacgccgcggcacgcgcggcagcgcagcgcatccccgtcttctccttgtcgtctaagccagcgaggggcggacgccgtcgccgtcgccgccgcgctctcctcctccgcctcctctgctgctgctgctcttcctcgagctgtcctccgcactgcaaggagatagaggggaggggcggggcatcttctgacatcagtaatggcggaccgggatagcgacagtgatgacaatgttaagtttgactgggnaaagtgatggtgaggctgagccttcatcggctccggctttcaggnaactcggatgctcctggcccatccacgctggattctaatgggcaggccaacgaggaagcgccgtctactgctttaattgaggaatatgtagcaatgggtttcccaaaagagatagtcgtgaagggcatgaaggagattgggcatagcgatgcagatgcattgctcgagctaattctcacatatcaggcactaggtgctgatgatgcagtgggtaactgctctacttctggctgcgctcctcagggtgttgaagaagaagaagatgatgatgatcttgattttgagaattgggatggcgacgatgacgatgttggtggtagagggaccaactgtgatgatcctggtgatgaggatttttctacaagagatgtcacagaaaagataagaagatcaactcattagtagacatgggctttcctgaagatgaaggcaaatanttgctattacgagatgcggtatactctttctgaaatttttgtctcgacagtcatgctttcacggagaaggcaacttatgctatacatttctgtttaaattttcctaggtgtggatgctgatctctgtgtattagttgattcgattagtgcatcactggttgcaggagatttcaattccagaaacatatctgaccatcaggttacggatagatgctttgattcgtttggagggagaaacccacgcgtccggatggaagagagcaagaaaaggaggatgcaatatgcacaaggcagtggatcctcctttgctggtagccatgatgagccaacgcgtatcccagatcctatggttggatttaatctgcccagtgacagaaaaccgtcaatgaccagaatgcttcctgaacaagctgtcggaccaccttttttctactttcagaatgtggcccgagctccaagaggtgcatggacgaccatttcaaaaaaattctacgacattcaaccagagtttgtggattccaagtatttttgtgcagcttcaagggaaagtgggtacatccataattttgccaattggggaaaaagagaaagctccntcctccctttccctnccaaaagaaccgttattccatggcaatccc

SEQ ID NO: 19728 - DNA, 542 bp, Triticum aestivum
  Clone ID: PAT_TA_19728
ccacgcgtccggcgcagtaaagaaggcctcacacacgcggcccaaccccgcactccacgctctctccatccccacacgcaacctctcctcttctcgtttctcctctgcctcaccgccgccgccactgcttccccttcacccctacctcacggaaaacggcggcgatgaggagggtcggcgcttggcgcatacccgcgcccccgaccgtggcagcgtcctcgcggggccaggcttcccgtccgcgccgcgacgccgccggcaaggaggcctgggctcggacagcctccgcggcgtcgagtgcgccggtgaggtgtctgggaaccgcgtggcggggaactggcgctgcttctggttgtgggttccggcgacgccaagccgtacatctgagccgccgcctccaatttgtttcctccatgtttcagctccaggtgtcacgtgtgtccttcatcggctatccctccttacggttgttgccgcgtccgcctgctgcgggtcctccgtgttcgtgactgttgtgtcggcgtcgaaagaatttctcctgc

SEQ ID NO: 19729 - DNA, 389 bp, Triticum aestivum
  unsure (1)..(389): unsure at all n locations
  Clone ID: PAT_TA_19729
cgcacgcacgcccgcccgcagttggtgcgtcctcctcctcgcgctccccttccccttccccttcacttcaaagacaccggccactcggagcgaacccgggcaggaatccggagagggaagcaaggtggagggagacttgcgcctcacaaaagtgagagcgagagcagcgggaggtggaggtggagtggaagcagggaccattagattcttgatgctcggcttgaagtttctgtagtgtgatcatgctttcccccagagtaaagcggccctgagcagcattaggtgacccgggcttggtgttgcggagaggggaagagagagcgggagagagggagggagatgacnagggggttcggaaggaggggacgagctgctgttcaagggcacca

SEQ ID NO: 19730 - DNA, 890 bp, Triticum aestivum
  unsure (1)..(890): unsure at all n locations
  Clone ID: PAT_TA_19730
ccacgcgtccgtgttttttcagttataagttggctagcctatgttgcaacagaaaaaatgctgacaaatacactgatatccaggggaaggtaggatcttaacggaattatgttcatatataaaatggactattcccagtaatacatttaataattccgcaggagtagatattgtgtgaaggaaataagttcctaagaaggaaagtaaatccccttgtgttattctcctcaggaagatataagcttaactatggcaatttttgcacacacctgtctgaacttagatactgcagagagcatgcaatctggttctcttttttgcgtgggcgcggcccaggtacttgcttatgaatgttcctgttgtttcaaacccataaacttaatattgtgctttcaggtttaggattcccactgagtaaaagtcaatcctacttaatgttgcaatatatgttcaacattaaggaaaatgcattttgtttgatctatgtatgctgtttgattagcacctgaaatcttgttaaagcatatccatttccttgccattttttcagactgtcgctcacgtttcacattgctttctttagttagctcaaataggaaaaaattcgcattctaatattacaatatatcttaacttcctgtcacacatggaaatctttcctccatagataacttggtttgatgcaatacgttcttacactaatcgtctaatatatcttgctatggattggagaatggcgagcccagcaatactagaaacgccatggtgttagagtataagcaggggcgtataggtgatgtaggcatatggatgtaggatcaccgcccacaggtgacgtaggtggcgatgatgaccaacttagncaggtacctgcccgggcggccgctcaa

SEQ ID NO: 19731 - DNA, 621 bp, Triticum aestivum
  Clone ID: PAT_TA_19731
gactcgtcccatggcactcctcgcgctccgcctcggccacagcggcctcctccccgccccgccgctccgccgccaccgccaacgccagcagcgccagcgcctcctcgtctcctgcagcgccgtgagcgacgggggcgcggcggtggtgtggttcaagcatgacctccgcctcgacgaccacccgggcctcgtcgccgcctgcgccgagccccgccgccgcgtcgtcccgctctacgtcttcgacagccgcatcctcgccggttactcagacacgaggctggaactgctactttttgctttgaaagaccttaagttggcgttgaagtctcaacggtctgatctgctcataggcttgggaaatgctgaagatgctgttctgaaactcgcaaatgaggtacaagcgggtgtcatttatacagaagaggaagttgaacagtgtgtgcgcagtgttctagccaatgttgaatcttctttgtctaatggatcgttcacacggggaaaccctcctgagatcaagttctggagtgccccgttgtatgactataagagtttgaggcaactgtcaacatcacgcaaccaatttttgaatgagaaattctcgacaactacagctctccctgc

SEQ ID NO: 19732 - DNA, 571 bp, Triticum aestivum
  Clone ID: PAT_TA_19732
tagatcaggttcagccctctctttgtgaacttatgtcggtaatgtttctttttgaactttgccatgatgtctgtacaatatctacatttctaacttccaaaaaaagaaatattaacatgtgtccttatctccgcctcgacctccatcttctggagtcatgaggcctcaagagctgcacaggagcagcagggatccggagccaccactccctcaacctcctcaccagcttctcgctgctcttcttcctcagtggcatatgcctcgtgtaagcctccaacagaatgagcacgaatatgatccggaacggcataaacgcaaatgctgcagccgcaacgagcatcgtggtcgcgactttgttcgtgctctgaggaaaagctgcgagcatgagggaccgaagcttgaggagaaaaatgtttccagcttggacatgtgcctccagctgtgagatggcttcctgtagagcaaggagttgttcaacggttcgtcgacgaggcggggttgtgacttcgaatgcttcgatgaaatgcctgttgccatggtgcttgttccatagcatgaaagcggtagaccc

SEQ ID NO: 19733 - DNA, 838 bp, Triticum aestivum
  Clone ID: PAT_TA_19733
cccgcgtccggtccaaggacaaagagaaaaaacataaaaagcacaaagacaaagataaggacagggagcataagaagcacaaacatcgacataaggatcggtctaaagacaaagacaaggacaaggataggaaaaaggataagcatcatgagaaggtcgctgcattttctctatgtttaaaacttcagtatctccaagtcttactcatcacttagctatactttatatgtccgcaaattgttcagaagaggaagcatgaggggacggaggattcggcagacgtgcataagcaccaaaaaagcaaggtgatgttcaattattatttgcttcctggtacaacaaatttccttgcagcacattttgttggtctgttaacatgacttacctatggcagcataagagttccaaaaccgatgagatgggtaatggacttagttagctacaggttttcttcttacttctgttgtcaatcaatgtcatattctgttagaaggaggctcaaaagatttccgtcaccagacccgctgcagatcaattggtacatgcttcttgaacttttatttgctgttgggtagatgcataaattgattattttgtattgcttttcttaattctttgtctttcggtgaaacatgaattcaaatgtttcacatttaagctgcatagtgagcttgtgtttttaagtcaacctacattttattttattatttggagcctaaatgatgaatattttaacctttggtgaattatttattactcattcaagagaataagatctgccttttgcctgactttgtaaatattagtctcatttgattttatctgcatcttttttttt

SEQ ID NO: 19734 - DNA, 733 bp, Triticum aestivum
  Clone ID: PAT_TA_19734
gtcgacccacgcgtccgaaaatctgacaaagacaaaaaacaaggtgatgggaaggaaaagaagaaaatggtagacaaagatgtgaaagagacaaagattgaagggcttgggaagcctctcaaagctcttaagcatccgaagaatgcggttgatgcttctggcaaggggtcctcatcagggaacaaaagtttgactgatgcaacaagctctggggaaagccagaaagtcaacccatcatctgttgaaccgcctcaaggagactgcatcacctccgagagtgaaatcttgctgaaggatgtattactggattccgcctttacaaggttgaaagattcagaaacaggactccaccagaagtcaccatctgagttgattgagatggctctgaagttctatgatgaagttgcgcttcctaagctggttgccgattttggttctttggaactttcacctgttgatggtaggaccttgacagatttcatgcataccaggggcctacagatgcgctccctaggacgagttgtcaaactttcagagaagctctcacacgtacagtccctttgtgtgcatgaaatgatagtgagagcattcaagcacattgtccgatctgtgattgcagctacttcagacatgcgacaattagcattaacaatacctgcagtgctgaacttacttcttggtgttcccgaatctgaattttctggaagttctcctgctgtgcatcccctagtgt

SEQ ID NO: 19735 - DNA, 519 bp, Triticum aestivum
  Clone ID: PAT_TA_19735
tcggcacctatgggtaatgcttcaggtggtgagcgtgctagatttgccggcaaggctgccaatgttatggttgactgtgcctgggattacattaatagagaaaatgtcctgcgagcacaccctgctacaggtatgcatgtctcgaaggctcccaggcaaggttttcatgtagagcaggaagattcaactttgacaaatggtcaaggcaaatttgttcctagcgaaaaggttatgcagctacggcaaaaaaataatgaagttcatgaaagatcatatatatcccaaggaggatgagttatacaaacatgcacaatcaacctcacggtggacaatccatcctgaagaagaaaatttgaaagcattagcaaaagaggagggattgtggaacttatttattccgcttgacagtgcagctagagcaagaaagctactacttgaggaccaatctcatgtttctgctggaagttcaaatgatcttttgctaggtgctggtctcacaaatcttgagtatggatattt

SEQ ID NO: 19736 - DNA, 584 bp, Triticum aestivum
  Clone ID: PAT_TA_19736
cccacgcgtccgacgagggtgtccagaaggctgctgctgctttgaagggatctgaccaccgtcgtgcaaccaatgttagtgctaggctagatgctcagcagaagaagctcaatctcccaatcctaccaaccacaaccattggatccttcccacagactgtagagctcaggagagttcgtcgtgagtacaaggccaaaaaggtctcagaggaggactacgttaaagccatcaaggaagagatcaagaaagttgttgacctccaagaggaacttgacatcgatgttcttgtccacggagagccagagagaaacgacatggttgagtactttggtgagcagttgtctggttttgccttcactgcaaacggatgggtccaatcttatggatctcgctgtgtgaagccaccagttatctatggtgatgtgagccgtcccaaggcaatgaccgtcttctggtccgcaatggctcagagcatgacctctcgcccaatgaagggtatgcttactggtcccgtcaccattctcaacttggtccttgtcaggaacgaccagcccaggcacgaaatcctgtaccagatcgctttg

SEQ ID NO: 19737 - DNA, 260 bp, Triticum aestivum
  Clone ID: PAT_TA_19737
ggtcgacccacgcgtccgatcaaacttggtcaaagaaagacaacacatatcaaagagcatatatgataagaattatgcagcaaagaaagcaaattgatctcagaagaatccatggatagatatgatcatagtgataattcatcatattgcaacaaacacacgaacagattacatcagattgatcacaatcatatagggcagctcatgtgatctttgtattgagaagccaaaaaaaaaaagaaaaaaagaaaaaaaaaaaa

SEQ ID NO: 19738 - DNA, 727 bp, Triticum aestivum
  Clone ID: PAT_TA_19738
gaattcggcacgagattggaagaagctgcaaaggcgagtttcaacgctggcaattgttccccggagcctgtgaagataagccagtaatggcaaatcaattttctgccttcatttcccgcaaagacagtgcaaaatattcgacagtgttgcatcctgggaaaccggatttgccaaagaattggatcctgggattggaatctgaatgggcagaaatctacttatcatgcactttaccctagggcctggactgtttatgatggagaacctgacccggatctcaagataatgtgccgtcagatttctccaattattccacacaattatcaacagagcagttatcctgttgcagtattcactttcacagtaactaattcaggaaccacagctgctgatgtgactttgctttttacatgggctaactctgttggtggaaaatctgaactcacaggataccattctaattctagtatgacagaaaaggatggcgtgcatggtgtactgttacaccacagaacagctgatggactgccaccagtaactttcgccatagctgcacaagagaaagagggtgttcatatctctgaatgcccttactttatgatgtccggtaactctgatgaattcacagcaaaagatatgtggaactcagtgaaagagcatggatcttttgatctgcttgatcctgtcaattcatcaacgtcctccaaaccaggaacatcaataggag

SEQ ID NO: 19739 - DNA, 643 bp, Triticum aestivum
  Clone ID: PAT_TA_19739
gcacgagggcagccgccgccgctgctcctctcgcttgcctcgccgcctacgctcctcctctggctcgcctcgctgccactgctcctcctctcggccaagctggtcctcgtcctctcttttctccttctcctcctctccacctcttcccctcttccttcctcgcgagcagcagcagcggagcagcaagtagcagcagtagggagcagcagcggcggaggagcagcagcagcggagtagcgtcggagtagcaacagcgagcagcaagtagcagaagtagggagcagcagcggcggcggcaagcagcagcatcaagataatcgattcttgccggaaggaacacacacacgggcgttgatggtggacatggtggagctgaaattttgaacaaaaagttcatttgccccagtggaagtgctttgatgttgtttgattgagcagccttcccaatcggcgcgacagcgcccgagccaccgcctcctttgcgtgctacaggcctccggtgcccctcgacatattctgctgtccagctccagcatcatcaagggaggaggagcggcacttgacggatggcgtgtcgtacaactacaactgccaacccattccatctgcggccctcaagtcgatcgtcaagcacctagatctg

SEQ ID NO: 19740 - DNA, 407 bp, Triticum aestivum
  Clone ID: PAT_TA_19740
gatgaatagccaattaaatgcatcagaaaacaatgcagccagcaaccatataagtgtgaattctggtagcgggtcgaagacaggagaaaacagcgacgaggaaagtgatgctcagagctctggaagcaaaagggagactgaaattcagattgttgagaaattaccggagattgtgacacataatggggcaagctcatccagagaactaaaaatacagaatgggccttttgatagaataaacacaaaggcacttgcattagagggtactgatgatgctccaagtggaaatgcatgtggcaccagtaagccgcaggtgttttcagctgagaagaatgtgcattccaagtatcttcatggcattacttctgcaaaggttgctggacagataatggacaacgccatgagga

SEQ ID NO: 19741 - DNA, 1296 bp, Triticum aestivum
  Clone ID: PAT_TA_19741
tttacgccctcatgtgtggaggcggcactcgatgaatagccgattaaatgcatcagaaaacaatgcagcctacaaccaaataagtgtgaattctggtagcgggtcgaagacaggagaaaacagcgacgaggaaagtgaggctcaggtgagcaactgagctggcttataccttttttgtctaactgaaatcaaaagctctggaagcaattgggagactgaaattctgattgttgagaaattaccggagattgtgacacataatggggcaagctcatccagagaactaaaaatacagaatgggccttttgatagaatgaacacaaaggcacttgcattaaagggtactgatgatgctccaagtggaaatgcatgtggcaccagtaagcagcaagtgttttcagctgagaagaatgtgtgttccaagtatcttcatggcattacttctgcaaaggttgctggacagataatggacaacgctatgaggattgctgatgcaagttcatgtcgtccaagtgatcctggcaaagatcttatggctactggccaaccaacaactagcaaaaaatgcaaatctccagtcacaaagaataacgctgtcaagcctgtcatggaaaatacccttcatgaaaattcaaagggtgctgcgatcggccatccccagtcttgcccctctcacttgctggatgtcaacttaggaaagcaacaacgttctgatggtcatgtgaaccaagaactgagggataaggataattttaatcactcaaattcttcagccttttcaaggtatggtaataaaagaatagagccatcagctaagcaactgtctcttccctctgtccacttaactcatcaagaatctgtttatgacaagaatgttcagtctagtggaactttgccctcacatgaacaccatacatgcaagattacaatgcaagctcaggctcctttggacagttgcacagtgggtcctgccatcccgtcttcaagcagtgcaagagaagatgctggcacaagcagttcctcccctagaaaggacaatttcggtcatcctccgtatggctttatacctgttccactttctgttggtgctgctataccgtaccagtacagtgcaattatgccgccgatatactacacacagcctccttttatgcaatgtgatccatctggcatcaaccagatgggaattcagcatgcatatcattctagttaccatcaaaatcttggggatccggccgagctggatggaccccggcggcttcaagaatcctcggcggtggcatcctgcagacaaat

SEQ ID NO: 19742 - DNA, 701 bp, Triticum aestivum
  Clone ID: PAT_TA_19742
gcgcgcccgccgcgcgcgcgcccgacctgcccctccccccggcgtcacccggcccacgcacgaccccggagagagttgggagcacggaggtggccgggaggaggatgaaggccaagggcggcgccgccgccggggagaggaggccggtgctgtcgaggaccatactgctcctctgcgcctgcagcttcggcctcggcatgctcttcaccgaccggttcggagcgatgccggacttgaagagcccggtggtggcgcagcggcggcgccaggaggaggagctgcaggtcgtttctgaagattttgccgccgagccgaaaccatctgacgacagggacgtcatgggggaagtggccaagactcatgaggccatacaatcgcggcgcagctcgctcgccccgcttcagagggagctggcagcgcggcgcagcaagcatgagctgcttgagagtgcggatgacgtcagccttcaaaggaaagaggcgtttgtggtgatcgggatcagacaccgcgttcagtagcaagaagcgccgggattctgtcggggagaggtggatgcctcttggtgagaaactcaagaaactggcagaggccatgggtgtcgtcggtcgttgcttgattcggcggcgggtttagattgtccgcaggtcctgtgtcgtgcgggcgttttgtattatatttattcaagtcgctgattgagtctt

SEQ ID NO: 19743 - DNA, 1208 bp, Triticum aestivum
  Clone ID: PAT_TA_19743
gcgagcggccgcacgggccggccaatcgacgaaaagggacttttactaaaaaaaattagataggataaggtactcgcgtgtccatggtcgtccgttctccgcccagcaagcgctgccccggcgccgccatgatggtcgcttccgtcgtgccctctccgctggctggtcctgcactcgcgaggccgggccgcacgcgtctccttccgccctgcgacctgccggccggctcctctttgcaatcggccagcggctgccgcgtcggtcccgcggcggcgcacggcgcccgcagcacatctcgttcgcagacggaggaggcgcagagggtgatgcttttgtcgtagaaggcgcgacgaatgtgaagttctcgatgagagctaactgttccgggccacacagagcctctgatcatcctcggcacagcactccaggttacagagacaagttcttcgtcaaggtatacgccgcagcattctatgtggatatctccatcggactcgataccgagcaatggagaaaaaaggttggcctcgagactttcgatgcctcctcgggttttgactccatttttaaagcaccggttgtgaaatctctgaatataactctagttagagacgttgatggcaacacctttgtgaaggctttggatggcgttattgctcgccggattcagaaacggaccgatgaggaagaatcttcactgtcggccttccggaacagctttctagggcgcaatctccaaaagggaacaaccatctatttaacttggttggaaccctcaagaatgctggtctcggtttcgaccgaccaaggtccatcccaagttgacgccgaggtcaaatcagctactgtcaattatgctctatacgatggcttcttcggcagctctcccgtatcccccactttgagatcttccactgctcagctgctagaagctatccttacaaagtgacgtgcagagcagggtcaatgtatggtccctgaagacaaagtgcagagtgatgaatgaatgctatagcagttttcttggatattgcatctcatatattcgaaatcggcggtgcttttccacatctaacttccgggttgcgttctctctccttaggcgggtgcctctggttgctctccttaatactttggatatctcaccagccgctgcaccccaacaaaaaaaaaaaaaaaaaaaaaaaaaaaaaaaaaaaaaaaaaaaa

SEQ ID NO: 19744 - DNA, 669 bp, Triticum aestivum
  unsure (1)..(669): unsure at all n locations
  Clone ID: PAT_TA_19744
ttagcgncaaggggagncantntctcangatgggaagtaaataactcctccntntggagaaagggcantcaacacggnggantcngttngtcttcnggaantatgtgtgactnccacacatttcaatcatncaacacacagttgaacggagatgcttcnttccctntggtctcacaatggagcgctcctttgtnttcgcgctgcggtgaagcccctgaggtcacgcccatggtagtaaccttttgttgctactgatccatgccctttgtacaacactaaccctccgggccggggcttccgggccgtcccgcgcgtccggccgccagagcatcatccctgagccgagcgcggcgcggtcgcccccgcggcgtccctggtttcaccggccggcttcggaaggtgttcgtttggtctcgaccttgaagtcagaaggccttcgcccgtgcctgtaaatgctgtagcctctctcgctctgcttgtgtatcagcttgctttttggtatggtagtttgttgttgggcttgtatgatgtctggtcgatgcagtgacaagattgacgagtgtgtgtgtgtgtgtgtgtgtgtgtgtgtggatctgatacatgtacctgcccgcgccgccgctcgttgaagagttttgacacatcaacttttaaaaaaaaaaaaaaaaa

SEQ ID NO: 19745 - DNA, 1085 bp, Triticum aestivum
  Clone ID: PAT_TA_19745
cccacgcgtcggccacgagttcggcggggcacagcgtttgggggtgagataatgagcagcagcagcagcagcttggcgtccaccatttctgcagcagccactgctgctcgtcctcgccatggcgcggtgaagcagcagctgagcacaagggtgaagccacacctgaagcatgctgcaggctgctgggagagcagtggcagcggcagcagcagggcggtggtggcgagggctgggcccgggccgctgacggagatcgagccggacctgcaggaggaccccatcgacaagtggcgcaccaacggcgtcctcccggaagactttgtgtatggagtgtatgacggccaccacacctatggatgaaggccaagaaaagaagggcttctgggagggatgtcttcctgagtggtaccaagaagctgagcctcctcagggactttccaagcactcatctcctgggcattccctcccgcagtcatcctcggaatggctttcgatgtgccgggggagtacctttacattggggcagctatctgtcatcgtcgtgttctgcgtcatcgagatggacaagccggacaaaccgcacaactttgagccggagatctacatgatggagaggtcacaagcgcgacaagctcatcgcggactacaactccatggacatctgggacttcaacgagaagtacggcgagctctgggacttcaccgtcaacagagatgaccttcatccaaccataggtgccattcaagaaatggtggtcgcgttggctagattcagaaatggaggccagttcagatgacatgtatgatagtgatataagcactctgtaaggaaatcagggatggcatagctccaagaaaaggatcttcaaataaagcatccttgtaaaaaatgcagagcaaattgtcagaaaacactatgctaataaggagggacaaatgtcgtaaatagtaaagaaataaaaagacacctgttgcgcaaaacaaaaaaaaaaaaaaaaaaaaaccgctgggtacaagtggcctttttttttggccaagttgaaaccctatgtcgaataacgaagaaaaaaaaaaaaaacccaaag

SEQ ID NO: 19746 - DNA, 535 bp, Triticum aestivum
  unsure (1)..(535): unsure at all n locations
  Clone ID: PAT_TA_19746
ctcgtcccggtcgccccacgcgtccggctacaagcgacaagcgccagcagcacagctcgactcaaccagccacacgccgtctcaccgatcatggagcccggccgcgagcctaccggcacgatcgtgttcgcctccgtcggggtcaccagcttcggcttcgacgtcttctccgtcgccgccccgcagactcccgagagcgcatccgccgcggggctggcggagcgccgccacacggacggcgtgtccgtcaacttcaacgcccagttcaaggacgacggcggcgaggaggtggcgttcgtgtccgagcgcaccggctcggcgggcctgttcctgtgccgccccgggtccgagcgcgccgtgccgctgccggcccgtggangggggagncctgttccacgaccgcccccacccgtgagcgggcggccgggctgtacttcggctccggcncaacgagnaaacccnggatgggttggttcaaggagccngggccggggggtgttcacnnacgggnccctttgtaangcaaggacacggg

SEQ ID NO: 19747 - DNA, 1132 bp, Triticum aestivum
  Clone ID: PAT_TA_19747
accggtccggaatttccgggtcgacccacgcgtccgcgccaccggcaccgcaccgccaccaccaccagagggagggtgagtgagagtgagtgacactgcactgcactgcactgcacggcgctgccctctcctctcgttgggtgggcgggcgaccgggaggcacgcagccggccagattgatcgttttcctcgatcgaccctcctagcggccagcgagcaatgccgcgccgcccgagggcttcccgcggcggcagcggcggcgaggaggtgaagatggaggacttcgtcgagtcgatgctgaacctgggcggcggcggcgagggcgaggagagcgaggagggggagcagctgccggcggcggacgccccgcagtacaagtccaagaacctggacgccgagcgccggaggagaggcaggctcaacgacaacatcctcaagcgctcggccctcgcgcccgacatcacaaagatgagcaaggagtccaccctggcggacgccatcggtcacatcaagaagctccagaaccaggtcctcgagctgcagagccagctcgccgactcgcccggcgaggcctgggagaagcaaggcagcgcctcctgctccgaatccttcgcccccaccgacaacatccattatcagggtcaggtggagctgatacctctagggtcttgtaagtacaacctcaagatcttctggaccaaaagggcaggcctcttcaccaaggtgctggaggcactctgcaactacaatgtgcaagtgcttagcctcaacaccatcacctactatggctatgcagagagtttcttctgcatcgaggttaagggtgagcaggatgttgtgatggtggagctaagggacctcctgtccagtattgtggaggttccaagcatttgaccattcgaggcccttgcaaacaataataactcacagaattcatacgaaagaaaccatatatgattctgtggaaatgcatcctcttttttagaaagaaagaactctagcgtggcgtggtctgtgtagggactagggagagcatacagagatacaatgttgaactgacaaaactgacgggaagaagtctgaattttgtgttgaacttgggaatcatttcataattcacctttgtattttc

SEQ ID NO: 19748 - DNA, 1234 bp, Triticum aestivum
  Clone ID: PAT_TA_19748
gagccggctcgcgctctctctctctcttcccctgagccctctgtcactccacgagtccgtccatgacaggcaaagccgctgcatcctagatgatccaggcgatgggctgaggcccaccgcagcagcaaccaagccctccttcctcctcgccggacaccaaccattcccgatcccggaatgcatcaagggcagcagcagcaaccgatccatgcaagccgcccaagaagtcgaggcgcgctggccggtcatggcgagccgcgtcggcaggcagcgatgagcgcggccagtccgtgtcgacggtggcgacgacgccgtcggggaggcgggcccggctgtcggcgcggcggcgggagagcatcaggctcctggacgtgctgccgggccagggcggcatcggcgagttcctgcggcaccccgccggcgtggagtccctgctcaacacccgggcgctgcagagcttcgcgccggtggagccggagtcggagtcgggcccggccggcgctttcaggtgcacgctgcaccccatgggcttcctcggcttccaggtcgccccggtcctggacctccgcgtcaccccgacccgcgacgactgcaccgtcgagatgctctcctgcaggtttgagggttcggactcgatcgagcagcagaatgagctcttttcagcggttatgacgaaccgaataacatggggagacaatggtgatcaggagccatgcttggacatcgatgtcaatctggaggtcacactggaggtgtacacgaagccattcagcttgctcccgctgtcggcagtggagaaaccaggcaacctgctgatgcaagggctgcttgacaggcttgtcccgatgctgggtgagcagctgctgagggactaccactcctgggttcagcagcaggcccagtcttcatcctcatgagcgagcgactgcccaaagtttgaaaaaaacactacctacctagcagattcctgggattcatggccggggcggctttcatcaaatccacctggcagcagcaccaagaaagaatcacgaggacgcggcatgggttaatttgtcgatgcttgcatgatataagaaagaatcgtttactgtacatcccatcctaacctttgagagaaatcattcgaatttcgaaaaggttgtgcctagctaacttttgacccatgtaccacacatctactagaaaactcgtgctgcacattagcatgatgttgaaggttctggttgttgtt

SEQ ID NO: 19749 - DNA, 2145 bp, Triticum aestivum
  Clone ID: PAT_TA_19749
ccacgcgtccggggagaggatcgtaccactaccaccctcgcggccgatcggcaatcatagtccagcgccaaagagtaaagaaggagagaaaccctccccgcctcctcctcctcctcgttccctttatcccccattactcacagcccccctgacaagacccaccacgggcggagctgagagagggaggagaagagtggaggcttcgcgggggagagatgcagcggcggcgggcgcagacgtgggcgggggtggggaagacggcgcaagcggcggcggcgcacgcagcgctcttctgcttcacgctcctcctcgccctcagggtcgacggccgcaccgactcctcctggtggattatattcatcccgctgtggctatttcatggagtggccgcccgtggaaggttttcaatgccagccccttcattgcctcatgggcgtcattgggctccttgtcattctgttgttgcagcaccattgctaatcgccttcgagctgctactttgcatatatcttgaaagcttaagagttaagaatcatccagctgttgatatgaagatcgtgttccttcctctgctgacttttgaagtgattattcttgttgacaattttagaatgtgtaaagctttaatgccaggggatgaagaaagcatgagcgacgaagctatttgggagacactttctcatttctgggtcgcaatctctatggtgtttcttatagctgcgacaaccttcacacttctcaagttatctggtgatgttggtgctttgggatggtgggatttatttataaattatgggattgcagagtgttttgcttttcttgtttgtacaagatggtttaatcccatgattcataggcctcctactcatggggaggctagctcatcatcatcagctattagatatcgtgattgggagagtggtcttgtcctcccatcactagaagaccatgaacaagagaggatttgtggtcttccagacataggaggtcatctcatgaaaataccgctggtggttttccaagttttgctttgtatgcggttggagggtacaccacctagcgctcgctacattccaatatttgctcttttctccccactatttattctacaaggagctggtgtccttttctcgataggaagattggtggagaaagttgttttgctattgcgtaatggaccagttagtccgaattaccttacagtatcatcaaaagtccgtgactgtttcgcttttcttcatcacgggtcaaggcttcttggttggtggtctattgatgaagggagcaaggaagagcaagctcggctgttttatactgaatctaacgggtacaatacattctctggttacccacctgaggtagtaaagaaaatgcccaagaaggatttagcagaagaggtttggagactccaggcagcgttgggagagcaatctgaaatcaccaagtctacccagcaggaatatgaaaggcttcaaaatgagaaggtactttgtaggatttgctacgagggagaaatatgcatggtcatacttccctgccggcacagaacgttatgcaagtcatgtgctgagaagtgcaaaagatgtccaatctgccgtaaccccatcgaggagcgcatggctgtatatgatgtttaaacctcgctaactaagctgaacattgcaaatctgtacatgtggcctgtgtgatgtgcatatgtgctccgatcacaactttaagctgattgaggtctgcacaactccagaaaagttcagcaatatggagaaaatatatcttgtctaaccaaaaggaaggaaaagatagctgctgagcattttcgggttccagttatgtattatcagtctgtaagtatgtcaccttggctcctttttgtgcctcatagatgttcccgtttgacttaggttgtgttcactgtaaataaaaatgtctcgttgtttgttttttgtgctccttgaccttgagaaaaaagagagtaaatgttaaggcctgtggaatggcatctcatggaacaaagtatctatttggtctattgtttgacccgctgaagtgtggcccctcatgtcgtaaagggcttacgcatttgtctggttgagaaaggaattgtttgcgattggactcaaaaaaaaaaaaaaaaaaaaactcgag

SEQ ID NO: 19750 - DNA, 732 bp, Triticum aestivum
  unsure (1)..(732): unsure at all n locations
  Clone ID: PAT_TA_19750
ccccgcgtccgcaccaacccgttcatccccggcggcgccccttcgctccccagcacatttccgcgagcagctggtgcgcgcgcggagcggaggccatggctatgtcaaaggccaaatccaccgccctctccgccgccngaaagtgccggaacatcctgggcgccagttgggaagcccacctcaacaccatcaaagcggatgccaagggaagcaagggggaggtttacacgtcgagggtgcactacatggtccaaaagggcctgccctacctcatcgtccccgagaacgacatgcacaacattaacatcataatcgactagcggggttctctctcggtgtccagtccagtcccaggtcgccttgccagcttgctcaagtcaaccaacaagttgcctccccgggttgctatgaccggcgatgtcctgcgcatgaaggagacaaagattccagttatagctgaaagctttaagaaagctattctgaaggaacataaagctgctagcgaagctacttatggggtttcaacggtattgtcttccgcaagtgctacttgtaggtcgcgcagcgaaggtctccttagcttactcaatgaagagagctcctacaatatcttgaagtttgaaattggctcgtgtgtcttcatagattcattggggagcagccataatattgagttggatacttttgaaccaccaaaagccgacctgctattgccattctctgcgaagctta

SEQ ID NO: 19751 - DNA, 1135 bp, Triticum aestivum
  Clone ID: PAT_TA_19751
cgcaccacccgctcccccccggtcccccccggcggcgcccccgcgcgggtccgcgagcagccgctgcgcgcgcggagctgaggccatggcgatggcgaaggccaaatccaccgccctctccgccgccgaaaagtgccggaacatcctgggcgccagttgggaagcccacctcaacaccatcaaagccgacgccaagggaagcaagggggaggtttacacgtccagagtgcactacatggtccaaaagggcatgccctacctgatcgtccccgagaacgacatgcacaacattaacattataatcgacgagcggggttctctctcggtgtccagtccagtccaatccagtcccaggtcgccttgccagtctgctcaaaagacccaacaagttgcctccatgggttgcgatgaccggcgaagtcctgcgcatgaaggagacaaatgtaccagttatgccttaaaaccttaataatgctggtacataaagctgctagcgaagctacttatggggtttcaacggtattgtcttccgcaagtgctacttctcgtgtgtcttcatagattcattggggagcagccataatatcgaattggatacttttgaaccaccaaaagccgacctgctattgccattctcttcgaggcttattgatggtatcaacaggagtgacccaaggcggagagcacttatacttttctgtttcgagtattttgatgtgactgccagagatgcactcttgctctccgttgatcaccatggatttgaggtgctcgccagggttcctgaaagagctaccgcacctgatgtccctcagcagtaccactggaaagagttcaggttcacattcaaggaagcagtcaaggatgttgaagacttctgccgcatgttggtcgagctagaagaagaagctctgcacagcgtaaagagctatagcggattaggttgaaggggatagtagctctttctctcaaaccaaagggcacaagattcagatcttcagttatgataatataaatcatctgaagaatataacctgaatccgtttttgtagatggtttgcattgtaaactgacatcattcgattgagaatcaacagttaggtttgtatgtcaccataaaaaaaaaaaaaaaaaa

SEQ ID NO: 19752 - DNA, 640 bp, Triticum aestivum
  Clone ID: PAT_TA_19752
cggcgcgcccctcgcgcccgatctgattgacctagagttggaggcgggagggcatgtccaacccaccggcgagcccctccggcgacggcgggagccgcattagcggcagccccgcggccggcggcagcagggaggagcggggcgcgttcctgcccatcgccgacatcaggcgcatcatgaggaaggccatcccgcccaacggggagatcgacgaggaggccgcgcaggcgctcgtccccgaggcgaggggcgacggatgcaagagggcgaggccggaggccatggccggcgacgacctgctgcccgagatggcgaagcaggggtttcaggcctacccgcacaagaacagagtggagctcccttgcacaatggaggcggggccaaacccattgcctgtatctgatgccagggattggtctgagctcccactcgatgcgctttctgcaatcttcatgaagcttgggaccattgagatcctgatgggtgccggactggtgtgccgctcatggttggtggcagccaagtcccctgagttgtggcgtttcgtggacatgacccgccacaagttggttttctccaaggggggaaacgtcatgtgccaaatggcaaaggtggctatagatcgctctgatggacggat

SEQ ID NO: 19753 - DNA, 496 bp, Triticum aestivum
  Clone ID: PAT_TA_19753
cacaaacaaacaccgagcggcgccgcgcgtgctcactcacccccacactaatagcgcagatctctcgcccggccctctcgatcacctgagtttcccgccggtatcgccgcattgatctgacggtggcggcggcagaggaggacgctagggctagagttttggcgtgatgcagcggtctgggcggggcctgcagcggtcgggctcgaagcgtgtgctcgaccccaccaacggcactggcggcggcggcgacgacgaccatgcggccaaacggccccgcgtgcccgcccttgcaagtgtcattgtggaagcactaaaagtcgacagtctgcagaagctttgttcatcgctggagcctattcttcgaagagttgtaagcgaagaggtagagcgtgctttggccaagttgggtcctgctagagttgaaagaagatcctctcccaaaagaatagaaggccctgatgggacaaatcttcagcttcaatttaaaagccaggtg

SEQ ID NO: 19754 - DNA, 1007 bp, Triticum aestivum
  Clone ID: PAT_TA_19754
cctcccgtccgcccctactatacgagcaggcgccgcgcggcgctcactcacccccacactaatagcgccgctcgcgcgcccgccgcgcggcgcccacccacccgcacatctctcccccggccctctcgatccacctgagtttcccgacggccccgccggtcgcgccggcgcggcggcacgcgaggcctcgagggctggcgtgttgccgcggtccggccggcgccgccggcgctccggcgcgcggcgtcggcgcgtcccctccaccccccctggcgcccgggccgacgacgaccatgcggccaaacggccccgcgtgcccgcccttgcaagtgtcattgtggaagcactaaaagtcgacagtctgcagaagctttgttcatcgctggagcctattcttcgaagagttgtaagcgaagaggtagagcgtgcggtggagcaggcgtggcccgatatggttccagcaagaacctgaaccaaaggtcctcatcccaaaaagaagacaaaggccctgattgggactaatcgccagctgcctcttagaagcaggttgtctctcccactctttactggtggaaaagtagatggcgagcagggggcagctatacatgttgtgctgctggataccaacactggattgtgttgtcacttcgggacctgaatcatgtgcaaagctggatgttcttgtgcttgagggtgacttcaataaagaggaagatgagggttggacagaagaggagtttgaaggccatattgtcaaggagcgcgaagggaaaagacctctcttgactggtgaccttcaggtgactcttaaagaaggtgttggaaccataggggagcttatcttcactgacaactccagctggataagaagcaggaaattcagacttgggctcagggttgcctctgttttttctgaaggtattcgtgttagggaggcgaagacagaagcttttactgttaaggatcatagaggggaattgtacaaaaaacactaccctcctgctttg

SEQ ID NO: 19755 - DNA, 677 bp, Triticum aestivum
  Clone ID: PAT_TA_19755
accggtccggaattcccgggtcgacccacgcgtccggccaatctaaagtatcctcaaaggcttcgtaggctccatatatttccaacaaataaagctgagaatatgcaacctgtagaccgttttgttgttgaggaatacatattggatgtgctgcttttcttcaatggatgtcgcaaagaatgtgcgttttatttggtcagccttcctgtgtcttttcggtatgaatacctgatggctgagaccatattttcgcagctactattgctgccgaatccacctttcaggccaatctactatacgttggttatcatcgatctttgcaaggctttgccagctgcatttccatctgtggtgggagcagcagtacacgctctttttgacagaataagtaacatggatacagagtgccgcaccagacttatcctatgggtttcacatcatttgtcaaattttcaattcatttggccttggcaggagtgggccaatgtgaagggcctaccaaagtgggctccacaacgtgtttttgtccaagaagtactagaaagggaaattcggttgtcctatttcgagaaaatcaagcacagtattgaagatgctgctgagttggaagggttgttacccccaaaagctggccctaatttcagatatcttacacatgaaagcaaagaaagcaccga

SEQ ID NO: 19756 - DNA, 751 bp, Triticum aestivum
  unsure (1)..(751): unsure at all n locations
  Clone ID: PAT_TA_19756
taccggtccggaattcccgggtcgacccacgcgtccggaacaaagcagaagaaaaagatgacagtggcatatttgaaggagaagcccgtggggcagggctctacaccatcaacaccaagttccagcagtggcatgcgatctgcagctgcgagactgcttggtaccgggaatgggagccggacacttagctttgcaggcagcaacggtgtcagcagggctgtttcagggagcagccgtgtgggtggcggcgttggtatgtcaacgggcgtcggtggatctcaagccgtggcgaattacgatggcaagggaacatacatcatcttcaataccgcagatacactgttcattagtgatctcaactcacatgacaaagatccagtaaagtccatccacttcagcaactcaaacccactttgtcatgcattcgactccggaggccaaagatggggcatgacctgattgctggggtatgggtccgggagatgtctattccaatgtccattngaggcaacagttgcaagatcctgggaaagaacctgttatgtcctcaacattttatcaaataaagacaaaagatgggaactgccaacagcacntacttgtgttgcatgggttccaaaacgtnaaggattttgtttgncaacaatgccgatggaacngtaggtgtntgacnaatccaaggtggaantcctactgggattccaactgtaggatcaaacaactgagattacatcaatcatanncatctacg

SEQ ID NO: 19757 - DNA, 1300 bp, Triticum aestivum
  unsure (1)..(1300): unsure at all n locations
  Clone ID: PAT_TA_19757
aaaagaaagaaatcgtcgtcggaagaggacaggagggggaagaaatccgaggggggaggagaaggggagaagcttggcggcgggagggcggcggcgatggacggcgagtggtggaggaagaagtgggtggcgtgggcggcggcggcggccatcttcgtggtgctcatgctcgtcacgcccgccatcccgcaggacgaggactaccacgacttcgccgaccagcgcgacctcttcctcgggatccctaacacattgaatgtgctctcaaatatccctttcctctttgttggtctcgctgggctcatcctgtgccactacaaaaactacttcaggctatgctcacagggggagctctggagttggacactcttctatgctggtgtcactgctgtcggtgttggttcatcctactaccatctctacccgaacgatgccaccttagtttgggacagattgcctatgacgattgctttcacgtctatcgtggccattttcatcattgaaagggttgatgatagggcaggaacaaagtcccttgcaccccttgttattgctggtgcactgagcatcctgtactggagtttctttgatgaccttccgccatataagcggccttcctgtgtcttccatccattggttctcctgccttggctataataattctcccacggtgtacacatgcaagctacttgttgtgggcagcagggttttaccttcttcccaaagttgaagaggcggcggacaagcctatatataggtggacacatgacattgttagcggacatactcttaaacatctatgtgctgcgatgttcctgttttcttggctctcatgttggcaaaggggacaattgaccctgacaggctaagcttactcccagatgtggaagatcagttggagagaacgcggttcccaagatggcaacactgtagacgtcaaatatgattatgctgcagtttcaactacgtctgaacaacagtagatatgtgtttttcatatgtactctactccctgaagtgtaaaaatagcatcgatctgaatatcaggagccccagcttgcacggttgtgtatcattgcctgctaatcaacgttcgtatgtggttgttcctgatcaaaacttcctgatcatatcctgtacatgaaggaaaacctatgtatatcgggtccctcatcaactctttgtgctctagtttttcggaacctcccaacggcatatacctcctcctgcaccntggaaagaccgtagcctatgtaactggacggggatctattgagactgcatcctgcttcggttgttg

SEQ ID NO: 19758 - DNA, 483 bp, Triticum aestivum
  unsure (1)..(483): unsure at all n locations
  Clone ID: PAT_TA_19758
gccacgcgtgagtcccttgattcattcatacactaccacacccacgactaccaacacacctagagcgagtttcctgcctgcccacgattctgcgatacaacaacaacaacatgtcggtgctggcggaggtcttccgggagcccaccctggccggggtggcgcgggagctggccaccctcgccgcgccgctctggcttgccgccctcgtcggcctgctcatcggctgggcctggcgcccgcgctgggcagccgcagtcgtcgacgtcgccggcaacaaccaccacgagcctgtcgccgcagcggcggcgcccgccaccgtcgccgaccacttcgccatcgtacctagagctaagccggcctctgtggcgcccgtgacggaggaagaggaattggcggtcagcaccccggacctcatgcacctncgcagggtcgttgaagagaaggacggcggccccgcctggacgcacatgatggaccgcacgc

SEQ ID NO: 19759 - DNA, 1082 bp, Triticum aestivum
  Clone ID: PAT_TA_19759
tgacttccggatcagcaacacctgggacgatatgcttcttgagcacgagacgctggaggagtgcacacagaccgggacgatggttgttcgctgggtcaggaagtttccattcttctgcagcgacagggagtacgttatcggacgcaggatatgggcatctggaaagacctactactgcgttaccaagagcgtgcctcgcccctctgttccaaggagcagcaaacctcgccgtgtggacctgtactactctagctggtgcatccgtccagttgaatcaagaaatggtgatggtgcaatgacggcatgcgaggtgctcctgtttcatcacgaagacatgggtatcccatggagcatcgcgaagctcggcgtgcagcagggtatgtggggctgtgtcaaacggatcgagcctggcctacgggcataccagaccgcaagggcctctggtgagcccatctcgaaatgcgctgcgatggcacacgccaatacaaagtttgtcgccgacgagctcaccgcttcagaagacaacgccgaggccggctcaaccagcaacaacgcccaagccgagaagcctaaagccactggcacgggcaacctacccaaggtcttcgtgatagacagcgtggtcgccctggcttgccccttcaacaaggggctactgaccaaggccctcgtgttcggaacggcgagaaggtttgcaggtccaggaagaagataggaaccaaacatcgacgatccatgacgcgcatttgttccgatgcacaaccgagcgagcgatgctacccggtattatttccggtcctgagacgctcgcgcttgcagatgaggacgaggacggcgtttgctcatgctagagagcatctgtaagcaggcttgtgtacatactgctgtagctgcagtctgtgaagctgagagctgattaggatatggaaccatgatgataatgagactgaattgtattggatgctgagacatggccatcatcatcattatgatgatgatgtactccaatgaataaggctcatattttggaggtgctataaaaacatagtgctttttgttggttggtcactaacaagaatttc

SEQ ID NO: 19760 - DNA, 1703 bp, Triticum aestivum
  Clone ID: PAT_TA_19760
gccgtccgtgagtccctctgattcatacgctaccacaccaagaactaccaacagaccacgagcgagcgagcttcttgcgcccgcccggatttatcatcttcctgcccacccaggattctgcgctacaacaacaagatgtcggtgctggctgacatgctggcggaggtcttccgcgagccgaccctggccggggtggcgcgggagctggcgaccctcgccgcgccgctctggctcgcggcacttgttgggctgctcatcggctgggcctggcgcccgcgctgggcagccgccgtcgccggcccccagcaaccggtgctggcggcagcagcggcagcgcaggcccctgcccagccatcgctgacgcaggccacggccgccgaccacttggccgtcgtacctagagctaaggcggcctccatggcgccggtggaggaagaattggcggtcagcgccccggacctgatgcacctccgcaggctcggcgaggaggaggacggcgaggccgcctggacgcacaggatgcaccgcacgctccccacactccgataccagccctggcaaggcgaaccccagaacggcccgccgcagtacccccgttaccgcagcatcgccgtcgccgaggacgcgtcgcccggggtcttctgcgggttcgtctggttccgggacctccggatcagcaacacctgggacgactggccccttgagcacgacacgctggaggagtgcacgaagacggggacgatggttgttcgctgggtcaggaagtttccgttcttctgcaggcgacagggagtatgttatcggtcgcaggatatgggcatctggaaagacctactactgcggcgtgcctcgcccctctcgtccatcgggccccagaccccgccgtgccgacctgtgcgaccctggctggcgcttccggctgcatccgtccagttgaatcaagaaacggagatcggcctatgacggcctcctgtttcatcatgttgcatcgggtatcccatggagcatcgcggagctgggtgtgcagcagggtatgtggggatgcgtcaaacggatcgagcctggcctgcgggcataccataccgggcggaccgccggcgggcccatctcgcactgcgcagcgatggcacacgccaacacaaagtttgtcgccaacgagctcaccgcttcagaaaacaacaccgaggccggttcgaccagcaacaacgcccaagccgagaagccgaagcactggacaggcaacctacccaaagtcttcgtgataggcagcgtggtcgcgctggcttgcaccttcgacaaggggctactgaccaaggccctcgtattcggaacggcgagaaggtttgcaggaccaggaagaagataggaaccaaacatcagtgcttatcatcgcgatgccatgcacattcttccgatgcacaaccgagcgacgctatccggcataattgttttcggtcctgagacgctcgcgcttgcagatgaggacgaggacggcgtttgctcatgctagaaagcatctgtaagcaggcttgtgtacatgctgctgtagctgcagtctgtgaagcttagagctgattaggatatagaagaaccatgatgataatgagactgaattgtattggatgctgagacatggccatcatcattatgatgatgtagtacaatgaataaggctcatattttggaggtgctataaaaataaa

SEQ ID NO: 19761 - DNA, 439 bp, Triticum aestivum
  Clone ID: PAT_TA_19761
gggtccacggcttagcttaaaggggttaaagcgaacaaaggacgcagagagtttttatactggttcggccccttgcagtgaaggtaaaggcctaatccagtcgttgtggaattgctagggtttcgatgaccagggagcgaatccgctatgcctggctctcgagttgttgtttgttgtccctaaaccgccgtcgggtggtccctttatatacacaggttgacgcccggtggtttacagaatcccgagggcggctcataaatgtgtccggctcggtttctacctttcttatcttacaacacaagttacatatgatgtggtggtttatgtctacaggccataacccgcctctgggccctgggccttcgtaaagcgccacactccttgtcttcatgggcttcaaatatgaataactcattatggggataacccggactctcct

SEQ ID NO: 19762 - DNA, 730 bp, Triticum aestivum
  unsure (1)..(730): unsure at all n locations
  Clone ID: PAT_TA_19762
accggtccggaatttccgggtcgacccacgcgtccgcgaccccgaattcctcccctcccagtcccaggccagaatccccaaatccggatcagccgcaaagcaaaacgttcgaaaccacgacgcagacgcccaagcccacgcccacgcccaaatctctctctctctactcgcatgcgcggacgcgcagctacccgcagcagcgagtcgccatgatcgtgcgcacctacggccgcagatcccgcaccttctccgacggcgccgccggcgccggcgccggcggaggcggaggggaccgcgggctctcgtcctcgcaggacgcgttcgccttcgacgccggggatggggacgacgagctcgcggcgctgggctcgtccgcgtcgcagcccttcccgccctcgcaggagtcctcctcgatgtgggacttcgacgaggacccgcccacgcagcccccgccgccccggctagaggggccgcgccggaaggggcgccgcgggaggcacgccgagcccgagcccgaggcggccaccgccacgctcatggaggccgaggagtacggggagatgatggagagcgtcgacgaggccaatttcgcgctcgacgggctgcggcccaccgcgcccaggcgggtgcgccgggccagcctgctcgcgctgctcgggatctgcgcgtccnncgcgcgccnnngcgtcctccgggctcagggattggtaaagcaaattatagatantnn

SEQ ID NO: 19763 - DNA, 612 bp, Triticum aestivum
  Clone ID: PAT_TA_19763
ggactcgtgggctgacgcgtgggcggacgcgtgggcggacgcgtgggttctaaaaaagagagtaccggtccggacatgcgaatcgaccctcccatccggatttgcataggaatttgcggcagccaagatcctctggaaatttgattggtgcagccgcaagaattatttgttgtcaattgtttggtgctcaaggatggtaggtggaggagaattcaagggcaccatggtgcaacagatggtgtgtggtggcacaagcaacgccaacattttcatgagtgggctgatgccttgtgccgtggaggagcaagaggaatccaccaacatgcctctcatgtcttcttctccttctatggcttgctcccatgatcatcagctcctttaccactcgtcaggtcaagttcctgatgttcgtgacagcgctgcaacttcccctgcaagttttcaaggtggacaggaggagagccagatgccagaatcatggagccagatgcttttaggaggattagttggagaccatgagtcagatctactgtcaaaaggattagaggagggtcctatggcggctcgggctggagccccagcttacagtttctatggccatggcggtggtga

SEQ ID NO: 19764 - DNA, 1036 bp, Triticum aestivum
  Clone ID: PAT_TA_19764
atgaggatcttgagcgctttgctgaatgattagacctatctttttgcgtatgcgattaactgatatgcttaaaatgaatccttatgccaagtacatgaaagatattgttacaaataaaagaaagataccggaagctgaaatttccaccatgcttgctaattatacttttaagggtggaatacctaagaaacttggagatcccggtgtacccactataccatgccccattaaaagaaactatgttaaaactgctttatgtgatcttggagccggtgttagtgtcatgcctctctctttatatcgtagacttgacttgaataagttgacacctactgaaatatctttgcaaatggctgataaatcaactgctatacctgtcggtatttgtgaggacgtgcctgttgtggttgcaaacgttactattttaacgtactttggtattcccgatattcccgaggacgatagtatgtctattattcttggaaggccttttctgaatactgcaggggctgttattgattgcaccaaaggcagtgtcacttttcatgtccatggtggcgagcggttgcctctcctttggtggaatcggcctcaagttcatagtatcaactctattggaaaaaatccatcgattatatttggaggttttgaatttcctcttcctactgtcaagaagaaatatgatattcttattattggggatgtgcatatccccgttgaggtaacttagtgttattcgaaatttctccggttccatgattattcggaatgagttcgttaacaagacttgatcaaccttgttagtggattccttttgatgagcatgagatggatgaaactagaaggcacaaccttctgtaccccacttttactttctgttatccatattaaataaagtaaaaatagtatttttctgtctatttcctgacttatccgtgcaatataaaaatatcccgaaaataaaagtcctcagaatgacatgccaatttaatatgattttttcgggaatatttgaggatttactgtgcaaaactac

SEQ ID NO: 19765 - DNA, 1059 bp, Triticum aestivum
  unsure (1)..(1059): unsure at all n locations
  Clone ID: PAT_TA_19765
accggtccggaatttccgggtcgacccacgcgtccgcgattgctcatttgctggatgagtatgtgcaatggaatttggtatggataaatatttgataccaaaaggacacaaccattctcatgtcaaaaggcattctgcatttcctcatttttacctcaagaaacaagcctaacttgtgatcttatattgtttgcagttttgtcacattgactccctttcgagtgatgtgatatctacatacacgggtcagtttaagaagattcaggacattccaattcggaggaagaaaccctatagcttgtttgtcgaagatccagttgagaggcctgataatgctgctagagcggttggtgagagggggctcctcctaattgctagtgccttcagtgatgctaagaacaagttagcttccctcgagcatactgaccggaacgacttactggcaatgttgtccacacctggtgtttgctcaaaacttggcggaagagtcatcgctaacaattatacaaatactccgcaaaggactcgacagcatctaatcaacgtgggagctaaggtatctaataatcaacgtcgccccagagccaaaggatttacaggaagcagaccagtcaagaatcctactcaggcaaacactgtccagaatcccactcaggtgaacactgtccaaaccccgccccaggtgagcactcataccccaaggccccaacccccagaactttaccctaatcatgcccctcatcggccatcctgacccccagggctttacccatcccgttatccctcggcggcttatacctcgggcccccacgcaacaggaccgggccgcagtcaagggccatccgcacgcgccctccacatggcggcccgtcggggccaccgggcccagcacatcatctcctacccgcggttacccagtcttccgcgcggcgtggccgtccgtctatcccgcacaaccgctcctcacacatgccgttccatccaccatcccgcctaccaggtccggctgcctcactcanccgcctgtccattcggccccttcaaaggcaagacatacaa

SEQ ID NO: 19766 - DNA, 1865 bp, Triticum aestivum
  Clone ID: PAT_TA_19766
gatcttcagtccttcgaaagatgaaaaggatcatgcctttctgttgcaattgctcttctggtttaagcaatcattcagatgggttaatgcaccagcttgtgacatctgtgaccgtgaaacatctgtggttggaatgggaaacccacttccctcagaaattgaattcggtgcctcccgtgttgagatctataggtgcaaccattgttcgagcatcacccgtttcccaaggtacaatgatccgcataagcttatacaaactaggaaaggacgctgtggagaatgggcgaattgcttcacattctactgtcgaggttttggatatgaagctcggttgattctggatttcactgatcgggtctggacagaatgtttgttaaacctttatgggagggctgccatgggctggggccttcacttagatccatgcgaaggggtctatccttggcccctgctgttgctcggggggtcggtcatctttcggcagccggctctgggggtctccattgacggtggacatgagcccacaccaccctacctcagaaggtggagtacatgagataacaatacgctgcaccagaacgtggcttgaggttctctctaggcggaccattacctccgaggatacagtttcagctattctgatgaatataactagaaagtgtcgcagtggattgtcaagtgatgaactcttagccttagaaaaccgtgacaggaaagagtccgaggaacttagtaaagctacctatcttgaagttaacaacagcatatctctacctggaaggcaaagtggttctgcggaatggagagcagcaaggtcagaattgggccaagcagactcactcagttgctcgtcgtgtcctattcggagatgtgtggatgctcatgtttcaaaaatacatgatgctctttcagctattctttctcatttttgtgataataacatccctaatgaaagaatcattgaagttttcgtcacattgaggagcttgatgcaaaatcttaaagatgccaacttcaaaagcaggagagtcacattagatcaaaaattgcagcaaatttttgagatacttccctctgctgaaagattgctttctgctatttctttaaaagcagagttacacactgttggagatccatccgtggctacagatggaaatctaatacatacgtccttagcattaccagtagcactagatgcagttgatgagatactaagtaactataagagcaatatcttttacacaaaaggtcatcaattcccaagaggcaatagactctgttcaggttcagtccttgcaagcagtgagcagctcccaattggaattgcaacagcagcctttgacggcattcgcttgtccaaatgggaagaacctgatggagccaaaggatgttggctaatgtacaaggtgcatggtggccaaacttgcgagttggagtcatatgatttgatgtcagctaatgatgctcctgagagggatccaatggactgggtccttgaagggagcacagaccaaggttctacctggaatactattgatgctcggagttctgtaatcttcggcagccgtttctgtaggaaatcatttactgttgacaagagatacaaagcaaatgtacttcggtttcggtttctacgtgggagagaatctagtgccaatccaaggtttcaaataggatccatcgatttctacggggaaacacacatggcctgatcgcaggtgttaatttgtgtgtacaaaacccaacaaaaccttgttgaatcatgcacctatcatggccagtactacatgcaaccaataattgtactcattatctgggacgattgtaaattccggttctactctggaagaggttcctttcctttc

SEQ ID NO: 19767 - DNA, 824 bp, Triticum aestivum
  unsure (1)..(824): unsure at all n locations
  Clone ID: PAT_TA_19767
aaatgcaggagcttaagccaataaatccacttcatacttctcatgttcgtcccctgccgctaccgggcccgagcttccgcgccggcccccgcgtcccgccacttgatctttgtgacacaataacttcaattccggatgcacttcccgttggttacccgggatcacatacaaatgtgttaacgcttccgaaccatcacggtgcaattagtcctgctcttccaacttcaaatgtgaacccaaggttatcaggttctcctggtatggtactaggaagcagtttgccgtcaccttcaacattgaatgccccgtctaggtatggtgtgcctagacctacctctttacagggcgacgaacaacaaagaattcagtatactcatatggtcaatgggcagaaatcttcagcagcctggagtttctgtccctgggtgtgttgcccgctggagttggatcgtgggtgttcgaatgatgcctggtgctaatggtatgggaatgatgactggacttgctcgatgtgcacctgttgcaaggccgggtttcccaaggattggttccccaggaatgcgaaatatggtttcatctggaaacatgctatccacaatggtcaaggcatgcaaaactcggtaaatcttcaccctggggctgtacctggccctggaaatacgatggtgaggccacgtgatccgtcgcagctgcggcggcctggcctggattccgcagcgctcaggcgaaggagggtgctgcnnttcccagggaananccgctntcatttangggncatatttnccatgcggacacttnncggtannntttctgtaannncccnn

SEQ ID NO: 19768 - DNA, 948 bp, Triticum aestivum
  unsure (1)..(948): unsure at all n locations
  Clone ID: PAT_TA_19768
accggtccggaatttccgggtcgacccacgcgtccgaaatccgtctcgccatcttcttccctgcgaaaaccccctccgccggcggcccgcatcgccgcgtccgccattcccaccctccacctccccctccctttccccgaacaaaccagaccccacttgcaccgtggcggcatcagcattctctcctccccaagtcaagtcttctcaaaaaaccccaatccaaccaccggccagggcggaaaccgtcgcactttatttatacccggtcacgcgctccaccacggcgaccccgacggctcccccctcccctccgcccgctcctagctctaagcgccgccggaagactgaccccgccgccggagccacggggaactcgccgctgcgcggcggcgggagaggccgctcgccggcctcctccgccccgcgccgctcttcgcctgggcttacagggccgcagggagggtttgacccgctcgaccccaacgcggatccgccggcccgggtcctgatgccgggtcaggtgaagcactgcaagacggcgctcaaggtgctcgacaaaacgctcaagaagccggccgcaatatttgacgactttagaggccttccggccataagaacatcgctccagttggctcagaagtttactgtgggctcgaagtcctgctaatagggaaaggaaccgctacactgatgtcttgccatttgatgaaacaaggataaagctacatcctctacaggaatcaagactccaagtaatgattacatcaatgcaagccttataaagtatgatgacaaagtnagcaagtaattcaccaagnncgctagngaataattcgaaganttgganatggcttaganacngnctgtatgcatgtataattgcatgtaatgtatanactcacnagaagggangggatatggagttacatantatgnncagcagtggan

SEQ ID NO: 19769 - DNA, 1148 bp, Triticum aestivum
  unsure (1)..(1148): unsure at all n locations
  Clone ID: PAT_TA_19769
cggcacgaggcggcggccgggccccgcgctccgaggccatgttccccatctacgtcatggggagctcgcgggcgcgggccgtgctcctcgacccctccgccgccggggaccccatatgggaggccgtcaaggccgaggccaggtccgaggcagagaaggagcctattttaagtagcttcttatatgcgagcgtattatctcacgactgtctggagcgggcgttgagctttgtccttgcaaacaggcttgaagatccaaccttgcttgcgactcagctaatcgacattttcaatgatgtcatgatgaatgacgtagatatacgccgttccattcgccttgatgctcaggccttcaaaggaagagatccttcctgtgcacaatatagctgggccctattatacctaaagggttaccattccttgcagtcctacaggatagctcatgtattatggaatcaagggcgtaaggttctggcgttggcgctgcaaagccgtatcagtgaggtttttgcagtggatatacacccagctgccaaaattggagaaggaatattgttggatcatggaacaggtctagtcattggtgaaactgctgttgttggcaactgggtttcattaatgcagggtgttacgcttggaggtactggaaaggaacacggagataggcaccccaagatcggtcagggagctcttcttggagctggtgctaccatccttggcaacataactgtaggcgaaggtgccatgattgccgctggttcccttgttttaaagcatgtaccgcctcacagtatggcggtaggaaatcctgcgaagtaattggctatacagagaaagaagatccttcgttgactatgaagcatgatgcaaggagaattantttgagcatgttccggtagtttcctgacagtagatcaacggaatgtcntgaaataaaaactgcaaggaggaatggaatttggcattcacatctgtggactacgcctggatanttgcgacgccgattgtgctccctgccagaacctctctgtaaatatcaggcaaccgcaaggtcccgaacncaaattattacagtcctaacgacataagtaaanttcgaaacgagntgnataaaaccgtanttcacgaacnaaccattacgngccacnt

SEQ ID NO: 19770 - DNA, 566 bp, Triticum aestivum
  Clone ID: PAT_TA_19770
gggtcgacccaccccgccccgcactccgcgcgtgcaagaacgtcccggcagcaccaactcccaactccccgcaaggcagtacatacacttccgagcgtgcacaaacagggccggccgatcgagcggttggagggggagcggatgaagagcgcccctaccatggaccctgaggccgcggctgccccgggcactccgccggagaccgcgccccggcggggagaggggaggaagcggctgccgtggcggatgacgctgagcctggcgtaccagagcctcggggtggtgtacggcgacctgagcacgtcgccgctgtacgtctacaaggcggcgttcgcggacgacatccagcactcggagaccaacgaggagatcctgggcgtgctctccttcgtcttctggacgctcaccctcgtgccgctcctcaagtacgtctgcgtcgtcctccgcgccgacgacaacggcgagggcggcaccttcgcgctctactccctcctctgtcgccacgcccgcgccgcgctcctcccgccgggccgcggcgccaagcccggggaccaggaccaattctc

SEQ ID NO: 19771 - DNA, 514 bp, Triticum aestivum
  Clone ID: PAT_TA_19771
accggtccggattcccgggtcgaccccgcgtccgaaacaatttcggtttaatggagggagcagtctaacaacgaaggagattagcgcgccgcgcaggcctccttctcttctcctctcctctcctctccattcccatcctccacccccccccccccctctccctctcccgctcgctcgaggatcccacgcgcgtcggagggatctgattgccgccgattctactggctctgcttgcccggcgctcgtcgattgtttgttcctccctgggcgctgtgatgttcttccctctgggtttggagaccgagaattgccccgcgcgggacggattcgcggcaatggcgaggcgttcctgagaatttggccgtccttggagcttcgggggaggagggattggcgtgtgcttcgcggcggggaattgcttgctctctctctctgccggacggacatggcgtcgagggacttcttgggcaggttcggcggggagaagggggcggcgtcggacaaggcggggggc

SEQ ID NO: 19772 - DNA, 1084 bp, Triticum aestivum
  unsure (1)..(1084): unsure at all n locations
  Clone ID: PAT_TA_19772
ccggtccggattcccgggtcgacccacgcgtccgaccacagcacctcgccgccgccgccgccgctgccgaggtcgacgacgacgatgtggcgttcgcgagctcgcgctctcctcctgctccgctcgtccgtccccagatcgccaccgccgcagcaaaatccacttcggagcctggcccgagccccacccccgccaccacgccttctctcccgcttcctctccgccgagaactgctctggtaaaaagctactcctcttgttcaagactgccgggaagaacaaccctgatgtcaagagctttggcaatcttgacatcgtcgcgagcaatgttgctgaatccgccgagattgacaagatggatgcgtacatgctctgggatttggtgaaggaaatgggcagtgtgccaggatcattgagcaccccactgctgaacaaagtgctagcaatgttctggaagcttgagaaatcgaaggcggcgctagaggtgcttgacaagttcagtgagtttggctgtactccggacggcgacagttattatctggcgattcaagcggctggaaagaagtccatggttggtgctgcatggggagcttgcgagaagatgattagctccgggtgcttccctgatgagaagaaggccggtgagattgtgaccttcttttgcaaggggaagaagttgacggaggcacattcagtatacctagcagccggcgcgaggaaggttcagattcctacgtcatccttggatttccttgttggtgctttggcgaagaatgacgagaccgtcagtttggctctggagctgctggaggaatacaaaggagagtctcttaagcatgcaggcaagtcctttgctgccgttatacatagtttgtgcaggatgaagaatgtgaaggatgcaaagaagctgttgatgaggatggtgaatcttggcccagctcctggtagtgcagtgttcaactttgtcatcacaggattgtctaaagagggagaaatggaggacgcaaaggatatgattaggggtgatggagagcccganggctgcgccctgatgtttatacatacagtgtgatcatgaatggcta

SEQ ID NO: 19773 - DNA, 1366 bp, Triticum aestivum
  unsure (1)..(1366): unsure at all n locations
  Clone ID: PAT_TA_19773
ccttctcctgcgccaccaccgtccagaccctgacccggaccctctccccgcgccgctccctcctcatccaccgccaccgcctccgctccctcgccgcctccccgcggctcccggaccgcgcccgcccccgcctccgccgccccgtctcggcctccgccgcgcccaacgggtcctcctccgggggggagcacgactacgacctcttcaccatcggcgccgggagcggcggcgtgcgggcctcgcgcttcgcctccaccctctacggcgcccgcgccgccatctgcgagatgcccttctccaccatctccgcggacgtcctgcctcgggggcacatgtgtgctccgtgggcctttggtggcaccggtgcggcgggtcgtctcccccgctgagttgggaccgcggggcgcccggtcgggaccctggttccccgcccccgaggcccacaacgccatttggggccgatccctcgcggccgagcttgcaaagctccatcgaacttgttatcaagaagcatagaaatggctgcaaagctcccacttctccttgtggtcgtattggtcgctctcctgctcgtctcccaggatgtagcgtctgcagcagaagaaaagatgtctacgcaacttccagacgggtatggtggatatgggcctggttacgatggtggctacgacaacaacggcggaggaggagccggtcaaaatggtggtggtggtggtggcagcggctatccttgaggtgaatattatggggtggcggtcaaaatggtgaatgtcgctctagaaaccaaatatatatggtttgtatccatatatcaaataaggagcgtcttcatctgctcgagcgttcacttgctagcattggccgatatgatagtattgcgagctagtaagtgtatgatcatttgtgtatgcatgacatatgctgacttttagatatggtggcaacagtcatgagtacatatgtatttgaacaataaccataaatggacctatttccagttaataaaagttcaataatgagaagtggaatatattgccccggactttgctggcatttttaatggcttaaaaagtgacgttcatgtgtttattccgctaccgaaagtttgaccccgtcggatgaggagtcanaattcnttgccngacanattcttaagggtacacattcatactgaacatatcctaagcttaccaaanaaatgatggttacaacnctgaagacaacaagaacatggnggttcaantaagtcnaacagctaaccaatcaaaacccgagggagagttggtaaatgcatccaagttctctcatgagtttgaagagtctcatggctttggatggacatatgatactgatccaaagcatgact

SEQ ID NO: 19774 - DNA, 1058 bp, Triticum aestivum
  unsure (1)..(1058): unsure at all n locations
  Clone ID: PAT_TA_19774
ccacgcgtccgcaagcacagactggttcagctttnnnagntcgtgttacatcaattgccggacctcaaaatatctcggcctacaaattaacctcggtgtgtgtagcaagtggtacctcttctgttgaagcaaaattggaatcatcagcagtaccatcagcaacttcatcatctggtgcaaagggccagctatatcatattgtgccacaatctgaaatatttctggatactgagagtaagaattccaaatacgatggcaatagcattttagggaagccaccgctgatgtatacacaggaaactctgccaccaaagtctccaacaactagtatatttactgaaacccgtccggcctgtccgggtcgtcccccgcggccggaaacttctgaagcaaattgttcagctcctttgcaaatgcaagatatgatgagagaagaacacacggtaaatgctggggtgacatgctccaagtctaaggcagaacaagttgacatgaccatgcatatgccaggtgcttcttctggatcgggcaatggtactgatgttagtaaattggtgaatgttcctacatgtgctgaatcgggcgatttgcatctctcattacacattggcaatgtttcaccatcagataaaaacaatggatcttcatcagatgtccaaattggaccatgttctctgaatgatagtatacaagacaatgagaatatttccatgattatggctattgcatccaattcaactagcgctctcaaagagattgaacgtggaagtattgattcagtggtgtcgaatcaatgctctgttgctgctgcttcaatggtgcaaacaaagaaacctgtcttggaagcagccaaacccaaaactacgcatggaagaagaaaaaagagaaaggaaatactccccaagtcttctgatagtgcagaagaggttgttcagagttcttcgacagttgataaggagatttgtacactagatgctgaaatgggcagttcggcaggtagtaatgataaccagaacaaaaatgatatttttgattgggaaggtgatatggaaatctct

SEQ ID NO: 19775 - DNA, 521 bp, Triticum aestivum
  Clone ID: PAT_TA_19775
ctcgccgtcgccgtcgccgtcgccgccgcacagcacagcagggacctcaccgccacgcgtccgggatgaggccggtgttctgcggcaacttcgactaccagacgcggcagtcggatctggagcgcctcttctcaaagtacggacccatccgccgcatcgacatgaaatccggctacgcctttgtctacttccaagacgagcgcgacgccgaggatgcaataaggcgcctcagcaacgccgagttcggccagaccagccgcaggctctccgtcgaatggtcaaggcaagaggagccggtccccaagaaccgcgacaggcctacaggggcagatgcaaagcccaccaggacgctctttggtatcaactttgaccccatccgcaccaaagtcgtcgacatcgagaggcatgtgagccctacggcaagattgcaaacattcgtatccgcaagaactttgctttcgtgcagtacgaggcgcaagaggacgccagcgtatccgtcaacaagaccgatcagagcacga

SEQ ID NO: 19776 - DNA, 1425 bp, Triticum aestivum
  Clone ID: PAT_TA_19776
gcggcacacggccaccacctcccctcctcccgcgcccgcgcccccgccgccgccgccccccccggcgccgcaccgcaccgcactgcgcggcggagcaggccggggttctgcggcaacttcggctacgacccgcggcagtcggccctggagcgccccttctccaagtacgggcccagccgccgcttcgacctgagttccggctacgccgttgtctacttccgagacgagcccgccgcctgaggaagcaacaaggcgccccagcagcgccgggtgcgaccaggccccccggcggctccccgttgggccgtaccagccgcaggctctccgtcgaatggtcaaggcaagaggagccggggcccatgaaccgcgacaggcctacaggggcggatgcaaagcccacccggtacgctctttgttatccactttcgaccccatccgcaccaaagtcgtcgatatcgagaggcattttgagccctacggcaagattgcaaacattcgtatccgcaagaactttgctttcgtgcagtacgaggcgcaggaggacgccagcgtagccgtcaacaaggaccgacaagagcacgatattggacagggttagtgacggttgaatacgccttccgggatgatgacaatgaacgggatgacagacatggcagtcccaggcgaggcggtgacagatacggcagcccgagacgagggggtgacagatatggcagtcccagacgaggcggtgacagatatggcagtccaaaaagagctgaccagggcaggcgtccctacgtgcgctcccctagccctaggtaccgaagtccagattacgatcgccgtccacgtaattctgggtatgatcgccgcgatggagcaccctatggtaggagccgaagccctgtgtatgatcattatgaaagaggcaggagccccggctatggtcgttattagggtggattgatttcgaaggatcacaaaggaaggaatcccagggaggaaggagggtgcatacgctcagaccctttttgtccgtgtgctagaagagcgagggaagtgaagggcaatgcgatgctatttttttcatatcaacaccaccttgtgtatttgagacgaatagttcatatcaggtgggatcaagatgttttaagcgattgttggtcgaactggcatggatgatgtacgcggttacgcctcttaatggcctcttgacggtgaaaccctctgcatttcccacctgacactttggagaagtagtttgtttgtttgtttgttgggttgttcgggccctggatcccggtgtgggactggtattggtattggtatcccttccggttgtggtctgcctgccggttgtctcgccctaaattgttgtaacgcccaaaatatggttgagtggcaatggtttttgttaaaaaaaaaaaaaaaaaaaaaaaaaaa

SEQ ID NO: 19777 - DNA, 633 bp, Triticum aestivum
  Clone ID: PAT_TA_19777
gcccgccccgccgtgccccgccggcccccgccgccccagcggcgccccggcccggggcgcgccccggccgtcgccccggccgaccgccccggcgacctactggcgtgcgcctcgcctgctccgtgtgggggggggcctgcggttcccgccgccgcggtccaccggtccgccggtgggcgcggtgcgcacgcacgccctcctcgccgtgggccgcctcggcccgtcgggccgaaagctccccctggcgtgccgcgcctcgctttggccgcttgctcttccaggtctgatctctttgcgggattggcaaatgtttcggacttgctgtacgaggcttcgccccctccgggtagagttcttgagccatttcggcggcggttgggtgcttgtggtcctggcgcggctgtcccagtgtgcagcagtgagcgctttgctgaatcatactctgattggtttgagaagattctgaggaacttgcagattggcgaaatatttgaacttaaagaaagaggcatcatcctttgctggaagagttgttgaaccattgctgctgcttttaaatgaaaatggtccagtggcggatgaagcgattgatttgctaaggacagttattaaattgtatccctcatctgtaaa

SEQ ID NO: 19778 - DNA, 385 bp, Triticum aestivum
  Clone ID: PAT_TA_19778
ggacgctagttcttcccttctctcccggacgctagttcttcgccatccacctccccaaggatcctcaccagcatggacccaacagcaccagcgtttaatcgggttgctgctccaacagttgagcatctcgaccagcgcgcactactaataagggataaattcagtgctgatggttggctttgtccgcgttgttatcaagtgaacaaccccatatacaatctactctacagggttccagctttcgagtgtactaatcccgagaagtgcaatgctaagtgccctgcgacagttgaattgagcattactgactgcataatgaataccgtcaggaccaattttctgattagaagtcaaggctataaccggaactgcacagcacatgcag

SEQ ID NO: 19779 - DNA, 426 bp, Triticum aestivum
  Clone ID: PAT_TA_19779
gatgagggtcaaattgctgctaacctcattaaacatgggccactggcaatcggcatcaatgctgcctacatgcagacatacattcggaggcgtgtcatgtccatacatctgtggcaggacccttgaccacggtgttctccttgttggctatggcgcagctggttttgcccccattcgcctgaaggacaagccatactggatcatcaagaactcgtggggcgagaactggggggagaacggatactacaagatatgcaggggttccaatgttcgcaacaagtgcggcgtccactccatggtctctaccgtgtccgcagtccgcacctcgaaggagtacactctgatcagctgtcttccctgattataatggtgatttcatatattgcacaactacaattcctgccaccaatatatgctccatctgtg

SEQ ID NO: 19780 - DNA, 662 bp, Triticum aestivum
  Clone ID: PAT_TA_19780
gagtggggggaggactggctggagttgcccgttcaagtacgtggtgttcaacggcgggtcgaggctgtgcgtcggcaagcggttcgcgtacacgcagatgaagactctggcggcggcggtgctggagacgttctcggtggaggtggcgcccgggcaggtggtgaagcccaagctcaacaccacgctgtacatgaagaacggcctcatggtgagcttcaggaggagggagcagcagcacgtccattgcaccaccgtagctgcgcaagaatgatggaaatctcatcatgccctgctttgaacagaagtaaacttaaaggaacggaatgtggtacagatctctgaaggttcggtttcaaccatgcaggcaaatgtgatcaagacgttcgagacgagtgtataattactgctacatatattgcctctactttttttagggaaatattacctctactttatacgtatttctctgctcccctctccacgtatgtgtgctccttgtgcttttcacgaattatcgcatccacatgcagcgttgtgcattccgtcaactcggttcggtaaatactgtttctcgttaaatatgttgctatacatgaatttggcaaatattgtattgatttggaattcgatttggccccgatttgctgtctaaaaaaaaaaaa

SEQ ID NO: 19781 - DNA, 445 bp, Triticum aestivum
  Clone ID: PAT_TA_19781
ggcacgcacaggcacagcactgcggcgtggcgagacctatccactcccctccatgcaccatcgcggctcactccttcccagccacactacccaccaccacgacaccaacgcgccacgctccacccgacgccgggggcaaagcaccccgaccagcgccgccaccatcctccggccgcacgcgcagcgcgaggccacgacccgccacggcgcggcgcgcccgttctaccatgcggtgacgcccgaagccgccacaccgagccgttctgattgcctcgccgccgcacgcacatgcagttccccccgtcgcccgcgcgccccatggccgcggccgtctcggcctccgtgcccgccgtgtcctgcctgcgactcgtcctccccggctttagcggcctcgttcacgcctccctactctcgagccgcggccgctcccgctggtggtgagcgt

SEQ ID NO: 19782 - DNA, 475 bp, Triticum aestivum
  unsure (1)..(475): unsure at all n locations
  Clone ID: PAT_TA_19782
ggaaaggtcatatacatgtcataagaaagggagtttatttaccgctccctcgatgtattgtttcctttgtttggagattgattaccatccgtgagttaaggtaaggtttacgtgattgagcgattttttgaaaatcaattatttgttttctaattaatgtaattgagtgaattaaggtaaggttaattaatttagatttgatctttagagattgttcgtgattgattctacattactaaataacttgcgccagtatggaaagttctgatctgtttagatttctttcgttgtgtgagatggtgacccgaaaataaacccgatgaagtgagggaaggggacgaaaaaatctacgaaaaaaaccaacgaaggggggggaggcgggtcccaaaaaaaccccataaaaggggggaaggggccccacctcngtctctatgnggtgtggatttttttggttannggaatanttgnttccngg

SEQ ID NO: 19783 - DNA, 1112 bp, Triticum aestivum
  unsure (1)..(1112): unsure at all n locations
  Clone ID: PAT_TA_19783
gatgaagatgagaaggtgggtgttagaagcagcaggaagcgtgcgttgcgtggagtcagtgacagtgagagtgaagatggcagtgagggtgttcctgtggtgaatcaaaaacctgtttcacctctagttacgacaggggttgagagtgaggatgacgatggtgaattatgtcagatggaggggcgttctactccggcaacaaggcgcttcgctcggttaactaaaggtcaatcaaagagaatgcgacctacacgtcgggaacttgagtttattgaacccaagaatcatgaagagagcgaggatgattcagaagaggatgataatatggaaaattttatagtagatgattcagattgttcagaaaattctgctgattctgttgaagaatcctctgctggaccagaagagtctgacaacgaggaaacttataaagagcttatggataggatacgcggcaaaaggaatgccaagaataaggattggaagattgagccagagatgctatcagcatttgatgaataccctgaacttcgcctgaaagctgtttgtgccctctatcgaatgcagacccaggaagaacaggcaggaaaagctattatcatgcacaacaaaaaaggatttaaccagatagacgcccgaaggggttctaacatagcgcagtttcttctggatggtgatgctgctgggccgcttaagaagactgcacaggacttggagaagtacgatcggcgtgctcttgagttctgtcacaagatggcttttcgttactcgaagcagttgtttgcaatatatcagaagaaggaggacccctactttccatgactctggtgtcagttatcacctacttcatatgttgacctttctgtgacccttgtgcctccccaatcagtcagtcagagtcttttgtatatatatgggtttagttttgtgtcttcttaagtagtccgtagttagggcatgctaaagttagtttatcgctaggatgcacgctgttaagtgaagcacgatgtactgacagggtnctatgttgtttagctgaactgcttgtgctnccctgtaatataccctgncatagtaaatctatctctatccttaaatgttacccaaggagg

SEQ ID NO: 19784 - DNA, 430 bp, Triticum aestivum
  unsure (1)..(430): unsure at all n locations
  Clone ID: PAT_TA_19784
gcacgaggttggctaagcctcgggccggatccgcctcgaggcttgcaggttatttctgaaaaaggaacgatcatactgctcggcaatcagggtgctgcaatatgctgattccaaacagaatcaagggacaggactttggtgtctttggtgatgcagcctattgctcaaacctaaagcactacgatgtactctacatgatttggcttgccaattttttttgggtcacaagcaagtgggtgggagccaaggatcaataagatgaggggaagccccaaatnggctcaaaacttttggataacaagggggccaaaatcaacacctaatacatgtttttcccttaaatttgagagaattgaaacattaaacaagcatatactccccccataacttnatanaaagaanttttccggaaaaaaaaaaannaaaaaaa

SEQ ID NO: 19785 - DNA, 492 bp, Triticum aestivum
  unsure (1)..(492): unsure at all n locations
  Clone ID: PAT_TA_19785
gagagagagagagagagaactagtctcgagtttttttttttttttttttttttacatacgaattgttcatcattttgaattttgctgcttctgtctggagcatttttcagagcaaatggcactgtagcagtgcaggtgctagtagnctactactactggtgaaaagattctgggcttatactcttggccatggcacccaggtcaggtgattgatgccactatttttctccttccttcctttgtcaagtgggatggccccgttgggggttcgggtttgtccgccgcccgctgtcgttgggcgcccgtcgctccgcgctggngggaaggagggcgtccgggtggcgcacgggctgggcgggggaatgggaacgcggccnggggccccccgccccaaccctccgggtttgaagcttgaacggaaggccgccgcctgggaaggctccccccaaaagcaataagcatgccgccgcccgggaatgctcctgggaaaag

SEQ ID NO: 19786 - DNA, 627 bp, Triticum aestivum
  unsure (1)..(627): unsure at all n locations
  Clone ID: PAT_TA_19786
cttcttcttcctcccccagcaggcacccctcttcttcgtctgaagaactcaccaaatagccaaggctccttcatcaccaacaggcaaatcaagttctccatggctccagcggctgcagcccaaccccccttcatgtgccacacagcccaagcagcagttcttcttcatgtcttctccttgagaaggggaagaagaacatcgttggacaccatggacaagagaaggagaaaccagcccaactggtggggagtggggagcagcacctaagaggaaggaagccatgggattcaacatcatctgcaagcaagatttggtttgcaggagcggagctcaggggggttcagcaccatctgtagaagtccgggggcgaagactgccgcgacggcctccgaggtgtccctggcccatttccccgaggggcggttcggtcctccggcgtcctcctgtgggcaagggggagggctactattatcatagcgaagaaagcgagtactttcacgccggagagagcttatacgtccaggagtatgggctggagacccttgatgctcatttacagagactcgcccttgatggcgactacggcggcgnnntgggcgnnngcctccatcaccatggcgacnnnnn

SEQ ID NO: 19787 - DNA, 904 bp, Triticum aestivum
  Clone ID: PAT_TA_19787
ctgactgacacccctttcctgcggctgcgggtgctccgatggcgacgccgtccgcgccagctgattgttctccgcccctcatgatcctcctcctcctcctcgtcttcctccccctcgccgtctcgtgtggcgatgacggcagcggcgggtacgacgtcgtgtcgctgacccagtcggggagcgctctgtcggcgcggctggagcttgtgcttgccggcgagacgccggcggacgcggcgctcggggctggtgcccaaaggctctgcctcactgcaagcctcgagacggacagccggctgcgcgtgcgcatcaccgacggcgaccgcccgcgatgggaggtgccgcaggacatcatcccgcgcccggcgccggaggacgacctccacaacgcgccgcccgcctcctcgacgccgctccaggggcagccgcgtcctctccgccgcgggctccgacctcgtcctcaccgtccacgcctccccgttccgcttcaccgtgtcccgccgctccaccggcgacgtgctcttcgacaccgcccccggcctcgtcttccgggacaagtacctggaggtgacgtcggcgctgccggcggggccgggcgtcgctgtacgggctgggcgagcagacgaagggctcgttccggctgcggcacaacgacaccttcacgctctggaacgccgacatcggctgcgggcccacgtgggacgtcaacctctacggctcgcaccccttctacatggacgtgcggccgccggggaccgcgcacggcgtgctcctgctcagcagcaacggcatggacgtgctctacggcgggtcctacctcacctacaaggtcattggcggcgtcctcgacttctacttcttcgccggcccctccccgctcgccgtcgtgtcgacgcggccgcga

SEQ ID NO: 19788 - DNA, 679 bp, Triticum aestivum
  unsure (1)..(679): unsure at all n locations
  Clone ID: PAT_TA_19788
gcacgaggcctcgtgccgaattcggcacgagggaggcgccaccataagagtgtgccatttgttccaaaaataaaaccataagagagttacatcctaccaattagctctccagagaatccgaacgggaggagctaataatatcctcgcagctaccgatctgtccgatcatggggacgaggcgtgccgccctctgcttccttctgctcctcgtgatcatcttacacggaaaccctacactcatttcggcggacgacgcggaggtgtgcaagtacaggaatccgtacgtgcccttctgccacggctggagctgcaaggcggagtgctggatcgaggccaaaatcttcaacgcccgtctacaggagtacaggtgcatcaggggcggcatcaagggcacctgctactgcctcttctgcgggaaccacatgaggttcctccacctccactgaaaacaaacatcccacgacgatcgtctcgatattcgcttctccaggcaggaattacccactagacaccgctcatcccttgtcgcttgtccccatctctcccagtccatttacagaccagctgctggtggtgtccccaccggcgtgatgtacctaggctcaaattggggattgaattctgttttttcntttcttttttaagcttcctagatngctactacnacctgtgttatttt

SEQ ID NO: 19789 - DNA, 613 bp, Triticum aestivum
  unsure (1)..(613): unsure at all n locations
  Clone ID: PAT_TA_19789
gcacgagggatcgatagatcggcccacccatagattcgccatgaccacctttctgctcttcctcatacttgccctcgccgccggcagcagcaaccacggaggagcagctgctgccgccgccggcgaccgacctgaccttatcgtcctgcacacccatggcagtagccccccaaacgcctccgtggcctttcagacccacgacgtctccttcgccggcttcgccaacgggggcggccactggcaggccttcccaggcctcggccacctgttcccgacgtccacgccgctcccgttcggcaagcaagctacgacgacctcatcggcggcctcgcgaacctgccgggcgtgccgctgggacggcaggccatgatcgaggccgcccgggtgctctccgcctacgacccgtccgcggcagcggtcgccgacgtcgagccagtcaagcgcgcgctggcaacgctcaagatgatgctaagcgagacacagcggctgcagcccatccacgagaccgtcngaggcgggtgggagagcgagtcccgcgtnncgcccgagcacctcccctacatcgaccactnggacannatgtcctacgagannatccgcgncaacngnnngn

SEQ ID NO: 19790 - DNA, 1149 bp, Triticum aestivum
  unsure (1)..(1149): unsure at all n locations
  Clone ID: PAT_TA_19790
cgggctccgggcaacgcccccctcccaccccacacgatgctgccgcgatcgccggcaagcctccacctccggtcgctccggtggccgcggggcttcagctcgtcctcagccccggccgcggtcgcgaaggaaggggctgacgggaagatcgtggcctcggtggtgttcgagcgcctccccgtcgtcatccccaagatccaccccgtcgtctacgccttccaagaattctcgttccgatggaggcagcagtacaggcggcagtaccctgacgatgtcctaggcaaggcggacgcgaggggcaagggtgattatcagatagactatgtgcctgctccaagaatcacagaagctgacaaagcaaatgacaggaagtcactacaacgagctctggataataagctctatcttctcctgtatggcaaaacttttggggctcctgatggcaaacctgtttggcattttccagaaaaagtttatgaaaatgaagactctttgcgtttgtgtgccgagtcagccctaaaatctgttctcggcgggctcgacaatacatattttgttggcaacgctccaatggctcacatggtaactgaacaaaaagaggattccactgtttcaccattcaagcggttcttcttcaagtcgcaagtgatcggcaccacgcatttggacatcaggaggtgcgaggaccacgcgtgggtgaccaaagctgagttgctggaatattttccggagcacaaggatctcttgaacaagatgatcattcacgtaagatagatgatagctttaatctgtcgggggcggcgacgaagcggaggccatctgaacatggagcgctgcttgtcctgtgtaccggtttccagccaccaccatctgggccgcaagcgtttgtcgaaagagtgaaaccccagaatttgttgtttgcatttttagacaaaaaaaaaatgcacgctagcttaagctttactacaggctcttctcccgtcacatgctatacctgctatttttttgggtgaaataattgatggggtgcaagtctgttgtccctatttcctgacgtttgtggccggtcaacttaaccaacgcaaaggcgcttgaattgaacgtgtaatgtctattttcaagtttccgcagttctgnctaanaaaaaaa

SEQ ID NO: 19791 - DNA, 1095 bp, Triticum aestivum
  Clone ID: PAT_TA_19791
cccacgcgtccgcggacgcgtgggcaaacctgcagcccctccccctaatctcattgcctgtttccacccacccaccggcttcaccttccgaatctcggacgcctccgcgccggtcgcagggcacgcgactcgagttgtttccgttccgtcggcgggggaagagatggcggcgaacctagaggacgtgccgtcggtggatctcatcaccgaggtgctccgccgcgccaagtgcagctccaagcccgacaagcgcatcatcctcatcggtccacctggctctggaaagggtacgcagtcgccccttattaaggatgaatattgcttgtgccatttagccactggtgatatgctgagggctgctgttgctgctaagactcctctggggatcaaggctaaagaagctatgaacaagggagagcttgtttcagatgacttggttgttgggattatcgatgaagccatgaagaaaccctcttgccagaaaggttttatccttgatggcttccctagaactgttgttcaagcacaaaagctcgatgacatgctggcaaagcaaggtgctaaagttgacaaggttttaaacttcgcaattgatgatgcaatattggaagaacgaattactggccgctggatacacccatcgagtggcagatcttaccatacaaagtttgctcctccgaagactcctggagttgatgatgttaccggagagcccttgattcaaaggaaagatgacacagctgcggttttaaagtcaaggcttgaggctttccatatgcaaaccgaacctgtgattgactactactccaacccacgcgtccgggcaaatcttcatgcggagaaaccaccaaaggaagtgaccgttgaggtgcagaaagccctttcatgaagcagcccattttcacattgaaaacggcatgtaccaaagcccttgcctgggttcctagaactaggaagtaataaactgataccggcaccgtatgattcacattttccgcctgcaatgtgcgtgattgcaccattttgttacagcttttgcaagctcatgattggtccgagcaatttaaccgtgcaaatgaacattcttttatacat

SEQ ID NO: 19792 - DNA, 1239 bp, Triticum aestivum
  Clone ID: PAT_TA_19792
gtggtccccacggccggaaggccagcgcgaggacttgtgcgccgcacgccaaacagcaggcacgcgagtcgagtcgttcccgttggtgcggccggcggaggaagagatggcgacgggcctcgaggaagtgcgtgcggggcagctcgagataggacttgtgcgccgcacgccaaacagcaggcacgcgagtcgagtcgttcccgttgttgcggccggcggaggaagagatggcgacgaacatcgaggacgtgccttcggtggagctcatgaccgagctgctccgccgcgccaagtgcagctccaagcccgacaagcgcatcatcctcgtcggtccacctggctctggaaagggaacacagtctccccttattaaggatgaatattgtttgtgccatttagccactggcgatatgctgagggctgctgtcgccgctaagactcctctgggtatcaaggctaaagaagctatggacaagggagagcttgtttcagatgacttggttgttgggattattgatgaagccatgaaaaaaccttcatgtcaaaaaggttttatccttgatggcttccctagaactgttgttcaagcacaaaagctcgatgaaatgctggcaaagcaaggtgctaaggttgacaaggttctaaattttgcaattgatgatgcaatattggaagaacgaattactggccgttggatacacccatcgagtggtagatcttaccatacaaaatttgctcctcctaagactccaggagttgatgatgtttcgggagaacccttaattcaaagaaaagatgacacagctgaggtcttgaagtcaaggcttgaagctttccacatacaaactgaacctgtgattgactactactccaagaatggcttagtggcaaatcttcatgcggagaaaccaccaaaggaagtgaccgccgaggtgcagaaagctctttcgtgaagggcctgtttcaccttgaaagtgacatgtaacaaaaccccggctgggtttcttacaagttttaaactcataccggcatcctatgtttctcattttctgtctgcatgtgcactattgcacaatttcattacagcttttgctagctcggaatttttctgaataattttgtttggaatgagaagtttttattagcggtacagagataattacagcaactcatccttagaaatatttcttataattaaggcaactcgtccttagaaatatttaaggccgcggccgctct

SEQ ID NO: 19793 - DNA, 1276 bp, Triticum aestivum
  unsure (1)..(1276): unsure at all n locations
  Clone ID: PAT_TA_19793
ggcctctggctacgatcgccttcgtgccgtcaaggccttcgacgacaccaaggccggtgtcaagggcctcgtcgatgcaggcgtcaccaccatcccctccatcttccaccactcactgcccatagagcacacagatcatgatcaccacttcaccatcccggtcatcgacctcgcggctgccacgtgtggtactactaccacaccatccatgcgaactgagctggttgcagcagtgaaggcggcggcagagacggtgggcttcttccaggtggtgaaccacggcgtgcccaaggcggtcatgtcggagatgctcgcggcagtgcggggcttccacgaggagccggtaggggccaaggcactctactacggccgggactttggtcggcctgtgaggtactggagcatcttcgacttgttccagtcacaggcggccaactggcgcgacaccttgatcatcgatacggcgccggagctgccgccgcccgaggagatcccacccacatgcaggagcattgcacccaagtatgccaagatgatggagcagctgggacgtaccctgcttgagctactatcagaagcgctgggccttcgcagtggccacctggaggaggacgcgtcatgcctggagaggctcgccggccactactacccgccctgcccggagccgcacctgaccctgggcaccacgcgccactctgacccttgcttcctcgacgccgtcggcggcctccaggtgctactcaaggaagactacgatggcggctgcaacagcaacaacaacaacaacaacaagtcgtctgcggtgtgggtggacgtgccggcggtggaaggcgcgctggtggtgaatgtcggcgacttcctgcagatcgtctccaacgacaggttcaagagcgtggagcaccgcgtggtggcccagagcgccgggcctcgcgtctccgtgggtctgcttcttccgaaggcaggacgcgcccacgtccaccaaagtgctagggccaatcgtcgctgacggcgaggcgcgcttcaggacccccacggtggccgggctgctcccgcgccacgggcccaagggcctcgcgcgcacctctgcgctccggccctcggggctctgcttcagtctgcgcaaatcttccttccgcttacggtcgccaagatatctacgtggctgagtgctaggtgctactacatattancattgggctacnttatccttttttggcatggaagaaangaattgcatcttcttctgaaaanaaagacnnanaaaaaaagggggggg

SEQ ID NO: 19794 - DNA, 1300 bp, Triticum aestivum
  unsure (1)..(1300): unsure at all n locations
  Clone ID: PAT_TA_19794
gtccggggccgggcggtaggccccttcttaggtatctgatagtgctggatttcgtcgtgagaatcatatggagaagacaaaagttctaatgacaccgaacgttttgagcttgggcaaccaacccccagttggtgaaggagcacccggccaaggcgggtcaaggtggaggtccgacgagtcgagtgaagacgaagacgaggcaagaactggcgggtacatggagagcggtgcttccctcattacccgaaggcgtccgagattttccagaagatgatgtatcctctcaactgtcttccgattctccagtctcccttcgaatgtaaccattaatttgtgttggcccgtgagtgagaatcggaaataatcttggccaatattgcagccgccatggccgcacgtgatatgcaagggatgctagaaaagtgaagacggtgcgtggcttgttgttatcggggatactaccgtaaaggcgcttgctttgagcgccaatctcgtggtacagacgatcctttcccgttgctctattcccccctcggggtcacactggtgagaatccatatttaaaggggacaagagaactcagctttatgaaaggagagccaggttttagagaaggaaccaaacctgctggtcatgattcaattcctatgtatttcaacttgggtgctggcgatacacctaagaaaacccatggaacaagtttggtgaggactgagcgtaacaaaaacactttctttcaaggaaaacattctgtcagaaagggagagtttgactttggtgtacgtgctgagaagcctttcatcttaagtgggactggggctggtcaaaatggccaaacaaaggtatctgatagtgctggatttcctcgtgagaatcatatggagaagacaaaacttctaatgacaccgaacattttgagcttgggcaagaaacccccggttggctgaaggagcagccgngccaaggcgggntcaatggtggaggtccgaccagtcaagtgaagacgaagacgaggcaagaactggcgggtacatggaaagtggcgcttcccttattacccgaaggcgaccgagattttccagaagatgatgcatcctctcaactgtatcccgattttccgttctccctttgagtgtaaacattaagttgtgttggccttgagtgagaaatcggaaataatcttggaaatattgcaccgccatggccgcagtgatatgcaagggagctagagaatgaagaggtgcgtgcttgttgtatggagatatagcgtaaggagctgctttgagcgcgaattttgtgg

SEQ ID NO: 19795 - DNA, 702 bp, Triticum aestivum
  unsure (1)..(702): unsure at all n locations
  Clone ID: PAT_TA_19795
ctgatccgtgcgccaggtaccggataggaagtttttcgaaatcaatcaaaccgcagatggcgagttcgtcggagaaggcgccttcccctgcagcggcggatctgccggagcgaggtaagattacggtggccggcggcaaaccaaaggggaagacgaggaggatgacgcaggaggagatcgacagctgcatccggtacaagggcgtgcgcatccccgtcgactccgtccgcagggcgagcaagctgaggctggccctcaccaacctcgacgacctcggcagcctcccggtgtccccggacgacctggacgactacgtcaccaacatgatccgggaggtgaacgcgatcgaggatgacttccagaaagagagagacgagatcgccaaggagtactacgcaaagggctacgtcgagcgcgaggtcagcgacgacgacgaagcaggagccagcaacgcccgtgtggagatgggctcgccctcgcccaggaccggaagcaccgtaaccgtaaggaagctcaactgaacgagcacattatcagactgtccctgatctcgatcggcagtgctttcgaataaatcgtcagtctggtaaacgatggattcaatagtatgagcgctcctatagcgcaataaaaaaaattcactatatcggcagcaatcattttttcttcatcatcctttttgaatcattggtctnnnnnnnn

SEQ ID NO: 19796 - DNA, 618 bp, Triticum aestivum
  unsure (1)..(618): unsure at all n locations
  Clone ID: PAT_TA_19796
gcctcatcttcctcgccgccgcccagatccggcgtccccggccccggtcccggtggcccgcagctcgcggcaggccgcccggtcggtctctcctcccaatcgaagctcggccccgccccaccccgccgggcagctcctccccgacgccctcctgcaggaagtattgccaaaagacaaaagggagacacggatcacgatggcgttacgacaggcactgggatggtctgacggggaggtgatgcggccagagtcgaagacctgctcccgcctgatgcgtcacaccgcggggcatcttctccgtcggtggcgccctcgcttcctgggttctctgtcgccttcactatggtccgaggataacggtccccngggagcccggaaggtgggcaatcctgtgggcccgatgcacaacgtggatcggctcncggngcgcccgtgggcccgccgctaccccgggaatggggctacacagcccaacaaacctgatacaatggtnattntctggaggcaagtctgagattancaagaatggnanctcattcactttcttanaagtattacatactacgcctgactgtttccaantatggtcgtaagcagacnagngctttnctgngtctn

SEQ ID NO: 19797 - DNA, 732 bp, Triticum aestivum
  unsure (1)..(732): unsure at all n locations
  Clone ID: PAT_TA_19797
caggcgtatcatgtttaagaatcattctttagccatataaaaggatgacatatatatgcaagggtaaatccgctaaatcaattcccaaagaattgaatgagcagatcaaatgcaacaattcagagcatatttgtagaggaagtaatggaaagacattgtattgcagttctgtaaccatttcctcaattctatggagatgaaaccagagcgtaaccaataatgaaacacatgaacatcataggtgaactaacctgataattcctaaggagtattccatcgaacaacctgagcaacctaaaaccaatggcacaggacaattcacttgatctggagtgtggccatctttgtgtaggacatgcttcgaccatggtgagnggagaggtccatgcggcaagtttgtctgctgggcggtggtcaacaagatggggacattgtcttctccacccggtgccatcagggtttgctggaaaagggatggtgcagaattcacccattggtggcactatcgtgccggcgaccacttgctgccctctttgtcggcggcctaaccttcacccttctcttcatcgcctcccatcacaaaattttccatcgacggcgaacttgatcccctcccctatcagtgtgattgctgctgctatccaaaagcccccgccggaaggcggngtatgttgaataaattaagtggtgaggatgagagcatggaagtgcatcanaatgantgcggatgtg

SEQ ID NO: 19798 - DNA, 676 bp, Triticum aestivum
  Clone ID: PAT_TA_19798
ggagagagagagacagagaactagtctcgagtttttttttttttttttgacaaaaccgaagtaacgtttattatttgcagtaaaacacaaacaactctgcgatttcccttcgggatgttcatcgacatgccaatcaacgaaacatccacggatacaacaaccaatctatggcacacatgagaaggtaaattaagcacaccaatgtacgtactacgtaggtaggagtaagtatgcatgcatgttttttttttttaatcaagctgtatgttggggacttcacgaagcatttggggccggccgcgcttgcggtccggccgctgtccgtgtggccggggggggtctcgcgccgcgggtcgatgggggggccgctcccgctgagccccctggccccgccggggctggcgccgacgtccagcgtgacgagcccccccatcatccggcgccccggctggctggccggctcggggttcgggagcctgggcccccccggcacgtcggcgcgctccttgaggtcggccagcgcgttcgtcgggcacgggttgcggctctggccgcggacgccggcgaccaggaggaggttgagcgccaggaagagcgccgggaaacaagcggtggacttggacgccattgcttctttgcagtgcgggagtggaagtgcacgtacgtacgtagtggt

SEQ ID NO: 19799 - DNA, 302 bp, Triticum aestivum
  Clone ID: PAT_TA_19799
cggacgcgtgggcaacaagtggctgcactttctccctatctccttgcataaaatggtggaccaggtactcaaacatatactgtgtaacacgacattcacaacactgtttcaaggaaaactgtcagcaccttatcctgacagtaatgttcaatctcttgggttgtgttctgtactgggagcagattccaaaaggatagtgacaatggtccgtgataccttcgagaaggaaggcctgacgatagttattgcttgtggccgagataccataccaaatgcatgctctgtaaggtggttagcttcca

SEQ ID NO: 19800 - DNA, 1366 bp, Triticum aestivum
  Clone ID: PAT_TA_19800
gccgcccccccctccctcccccgcgtccccctccggcgccggcgcgccgctcccagcatccaagcacggctttcctgtgaatcccccttctcccagctctctcagcgccgcccatggcttcctccacggccgctgcagccgccgtctcctctctctcaccgccgcccgtgggtgccgagaggccggttccccagggccgcctcctcttccgcgcctcccgcgcccgctccagccccctacggctcaaccccgcccgacaccacgggctctcgccggcgcctagagcggccaaggctgtggaggcagcgaaggctgaccctctaaatgtcatgatagcgggagctccagcgtccgggaagggcacgcagtgcgagctaatcaaggccaaatatggtctggtgcacatttcagctggagatttgttaagggcagaaatcgccacaggcactgacaatgggaagcaggccaaggagtttatggagaagggacagctggttcctgacgagatcgttgttaatatggtgaaggggcgtcttctgcaaccagatgctcaggaaaagggttggcttttggatggttacccgagaagttattcacaggcaatggcactggaaactcttggaatccggcctgacattttcattctattagatgttcccgatgaacttcttgttgaaagggtagttggcagacggctggatcctgaaactgggaaaatataccatctaaagtattctccacctgagaatgaagaaattgcatccaggcttacacaaagatttgatgatacagaagaaaaggttaagctgaggttgcagactcattatcaaaatatcgagtccttggtttcgatatatgaagatgttatagtcaaggtaaatggaaataccacggtggaagatgtattcggtgagatcgagaagctgctcacttccagccttgataagaaaacagaaatggtggctagctaactcataagcagagaaagctgcgcgaaccagacatgtggctgaagcatgattttattctattttttgaagacatgcaggtgacaaagcattgataggatgatatttagaaaagccctttgttattcatggatgtaaatgcgtcactgttttgtaatgatcttgactaggaatgcattgatatacagtgcaattggaaggattgccttgagtttgcacttttcaatctacattttggttgcacaacttcattgcctgtattttgttactctggagactgtcaggtatttctgatgctagctgaggattctttgtgtgacgattttgtaacattagaaaccagaaatctggctgcagaactatataagcaaagtgtatacccaatattcccaatacgt

SEQ ID NO: 19801 - DNA, 1200 bp, Triticum aestivum
  Clone ID: PAT_TA_19801
ttcggcacgaggaaggattgcttatggtgtagaggttatttatcaagaaattttttgtctgcgtcctggtgttgagcataagttttcttccctatcccataaatgcatattctacatcatgttctggaagataccatccagttcagatggtgcaaaataggcatttaccagaactaaaagaacagtaatcgcagctgtgtacttaaattaatttttagtgttgctatgatatctatgacacccactgtttgaagattagtctgttgttattgtcaccagctttaacttcagtcattgtgtattatcattttcgttttacttcgtactagtaatatttcttatgttctatgtgaactgatgtgactttattttaggatcatgctgctaagcgatatattgatcagaaaatcgagttagttagtgggacagaaacagatgattacttggatcagcttgacaaggctttgaaggtcgcccaaactagattccaggcccagcttattatttataatgctgggacagagcatcctggatggtgatccattgggcaacttgaaggtacttctctgatcaactcaatattttgacaaagatcagatccataagtaactccctgtgcagaatgtagctgcaacctgcataattttctagtggtatcatcccaaagattacagaacttaatcatgaacgcctattaacatgacttggtatagttcaataattctctacctaagttaggcatgttgtttgcaggtcgcccaaactagattccagccccagcttattatttataatgctgggacagacatcctggatggtgatccattgggcaacttgaagataagccctgaaggtgtggtgatcagagatgagaaggtgttcagatttgcaaaagatcagaacattccacttgtcatgatgacatcaggaggctacatgaagtcgagcgcacgtgtaatcgcagattctattaccaatctctcacagaaggacttgatacagctaggtagccagccagactaaaagaggagcctctgccacccacaagcgttcaaactgaagggcacatccacatccactggatgtatagtgtgtaagaagaggtttacagttctgtcatattagcatgtactataaatcacaaaaagtcttgtcaccttgtacatactggcataaggcctatgttttcaagaagattac

SEQ ID NO: 19802 - DNA, 531 bp, Triticum aestivum
  Clone ID: PAT_TA_19802
gaactagagctcgtcttctcaccggccaacaatgccctgactgaccaggtggctggaatccggcgatcattgccttccgcgttccaacaaccgaatgccatccatgagaacaatggatggaacccagttcttactggtggacgtaaaagggtactgcaagttctccaaccgcaagcaactttggagtccagcaatcactgatttgtttgactgaggagcacttccagaagtacatgtggtgttatctgaagcttgctggaagatatacttctttcttccttcttcttcttcttcttcttcttctttaagttttttagcattaaccctttttgaagacgtaaataaagtagctgcatggtccagttttgcttagtcagtgtacatgtatcaagatgcaaatttctgtacatgatgtaccaatgtatctagtatcttgttaaccatggttccacttgaccaaaacttgacagatctctgaagaagcagtgacttcacatgtaaaaaaaaaaaaaaaaaaaaaaaaaaaaaaaa

SEQ ID NO: 19803 - DNA, 618 bp, Triticum aestivum
  unsure (1)..(618): unsure at all n locations
  Clone ID: PAT_TA_19803
gcacccggatctcttctctcagcgcgacaagcaagcaccgcgattaccaccgcagcgagcgaatcgagtcgcattgcacgcagcgagcgaacccacccactgttcaatccagcttcttcccgcccaacccaacccaatcttgtgcgattttccggtgacagccatggcggacgtgcagatgggcggcggcgcggcggagacggagacgttcgcgttccaggcggagatcaaccagctgctctcgctcatcatcaacaccttctactccaacaaggagatcttcctccgcgagctcatctccaactcatctgatgcgcttgacaaagattccggttcgagagcctgaccgacaaggagcaagctcgacgcgcaaccgggaggctcttcaatccggactccgtccccggacaagggcaaaaaagaagctctccaatcatcgacaagttggggttcgggaatgaccaaagtctaaaacctttgtggaaaaactccgggggcgatcgcgcngctccngggaatnaaaggantttaatggaggnccttcaaggggggggggggggcctttaacaatgattnggcaattttgggggttngggttttaacngggccnaacncgtt

SEQ ID NO: 19804 - DNA, 657 bp, Triticum aestivum
  unsure (1)..(657): unsure at all n locations
  Clone ID: PAT_TA_19804
cgcgattcccaacgcgttctagcaatcaagcgatttccctcagatctcgagttcttagctccgatttcatcttggagttcccgtttccccgttcgagtttagagaggagatggcgaagggaggagaggggccggcgatcggcatcgacctgggcaccacctactcgtgcgtcggcgtgtggcagcacgaccgggtggagatcatcgcgaatgaccagggcaaccgcaccacgccctcctacgtcggcttcaccgacaccgagcgcctcatcggcgacgccgccaagaaccaaggtcgccatgaaccccaccaacaccgtcttcgatgccaagcgggctgatcggcaggcggttcaccgacccgtcggtgcagagccgacatgaaagctgtggccgttcaaggtcatcccaggccctgctgacaagccgatgatcgtcgtccaggtcaagggcgaggagaagcggttcgccgccgacccgatctcctcgatggtgctcatcaagatgacccagatcggcgaggcctacctcggcaccaccatcaagaacgccgtcgtcacggtgccggcctacttcaacgactcgcagcggctgcccaccanngacgccggggtcatcgccgncctcaacgtgatgcgcatcatcaacgagcccactg

SEQ ID NO: 19805 - DNA, 629 bp, Triticum aestivum
  unsure (1)..(629): unsure at all n locations
  Clone ID: PAT_TA_19805
ggtccaccgatccgccggaaccgattcatagactttttcttggaaaccgtcgtcgatggagtcccgggccattagtcccggcgagacggcgctgccgtacgcgtacgcgccgctggccccgtccgacgtcgcggaggagcgccncggcggcngctgcggcggggtgaggtggcgcgcgtgcgtcgccgtgctggccgcctcggccctggtggtgctggtcgtggccagccccctggccccggctcccagggtggaccgggcccggggccggcggcgggcgcccgggtctgccgccgctggnggagaccgcccggagccgcggccgggacgccggcgngtncngagaanactccggcgctgcggacnanatggtggggctcctctncgccggcggcnacncngacggttccctggagcaacgcatntgcatggancgnacnggcttccattccagcccgagangactggtaacgatnccaaggccctttnnancgcggatgtacactcttcacatttaaccgggaggggcnttngggaatccctgggcacncctgtccngactaacatggncactccgnccnanggccgacagngnaaaataaggttcgncggngcantnctccgcgttc

SEQ ID NO: 19806 - DNA, 661 bp, Triticum aestivum
  unsure (1)..(661): unsure at all n locations
  Clone ID: PAT_TA_19806
gggcaaggctgtaatatttggctggctcagccccgcccccgcggccgccgctcgcagacgcagggccggaatggcgcatatccacgtcgagtccatgcagaccgccgtcccgacgcgcgtcgcgctggagcgcgggcggacgctgcccatcgccgtgaccgggccgcccatcgcggccgcggagctgcagcaccggttccgcgcggtgctctactaccgcgaccggctggagggcgaggcgattggcgcagctggagcaggccgcgtgggtgcaggagtcgctcagcgaaggcgctggccgaccaacccgaagatggccgggccgctgttggcggcggcacgccggcggcggccaaagggccgttgggactgggaacgtgaagctcctgcgacgcccggcgttgcggcttgctcatggcgtccgatggacaccaaccttgaaccgcgttcctgggggcggtgggccgcgccccccaggagcccgcgctgccccgcgcggcgcacgtcgtggccagggccccggaggggccctcccctcccctcatgcaggtgtcccccttccagcgcggcggcttcgcccccggcgcctgctgcagcctgctccacaccgacccgctgtcnnncatcaacttcctcaagtcgtgggcgcgcacgcatgcnn

SEQ ID NO: 19807 - DNA, 906 bp, Triticum aestivum
  Clone ID: PAT_TA_19807
tttaaaacccgggccagtaatttgattttgggggcccctaaaaaaaaatttaacgttgcaagcacggggaaggaaactttgatcctttaaaaaggcccccccctttttttttttttttttttttttttttttttttttttttttttttttttttttttttttttttttttttttttttttttttttttttttttttttttttttttttcatcaaaactgcaatacattgtattaactgtatcatgaacacagaggattattacatgtccatactccgtcatactcgtacgcataaaaagctggaggctaggttttttccaccctccagccatacacaggagagttgcacatcaatatattgcgtaggactcgtagtcgtaccacgatcatattcatacaccataccaagccagtccgactctaattaagtccagctcccctccgacggaaatcaatcacgcggcgatctttgagcaccgcgctttggccggcgcgagccgctcctccccgtgctccgaggggccgttgctcccgccgacgcaccgcttccccttctcggcaccggcgtgcgccgaggagccagtggtgtccccggcgccgtagcggccggctgtcacattgttgcggtggtgaggcgccatggcagcgactgcggccgtctccttctcctcctcggctatcgtgtccagcaccgtcaacgggagcccgcgccggcggcgcctgatgatcgacggcgccacctcgacggtgatccgggcgacgacctgggccttggccatgactagcagcgtgagcgtgcaactcacaaattctcaaaacttaacctgcagcttgcatgggtagcttgcacttcagtgttccacacagcaacccaaaaatgtacgggcatgtgtgttctatggtact

SEQ ID NO: 19808 - DNA, 639 bp, Triticum aestivum
  unsure (1)..(639): unsure at all n locations
  Clone ID: PAT_TA_19808
gcaaagctctggttaagacagagagttggtgccctgagcttgagtgagagatggcagcagcagcacccgcagagacgatgaacaagtccgccgccggcgccgaggttcccgaggcgttcacatcggtgttccagccggggaagcttgcggtcgaggcgattcaggtggatgagaatgcggcgccgacaccaccgatcccggtgctgatcgtcgcacccaaggatgcaggaacctaccccgtggccatgctcttgcacggcttcttcctccataaccacttctacgaacaccttctccggcacgtcgcatcccacggcttcatcattgtcgcgccccagttcagcatcagtatcataccttcgggtgacgcagaggacatcgccgcggcagccaaggtggcagactggctccccgacggcctcccgtccgtgctgcccaaaggcgtcgagccgggagctctcgaagctcgccctgggccggcacagccgaggagggncacacggctttctccctggccttggggcacgccaangaccaagctaaccttctccgcgctcatcggactcaacccgtcgccggnacggggaagtctccancntcagcccaagatctcacctacaaccgtcctcctcggatggg

SEQ ID NO: 19809 - DNA, 368 bp, Triticum aestivum
  unsure (1)..(368): unsure at all n locations
  Clone ID: PAT_TA_19809
cggctgccctgcccacttggccaagctaagctagcccatgctcttctcatttccctctctgcttcttcggccacgctcccggctcacttgctgagcgaccggccgcggccggtaaataccaagtgccatcctatgtggttcccaaggaggccatttctccgctgggcgctccgccgtgtggcatgctctcctggtcctgggcctggggaagcggcagctccggcgctcagctgctacccgcgcatcttcagcttcggcgaccccctccccgacaccggcaactacgtgcgtctgacgggcgaagaanccgagcccgtacggagcgccgccgtacgggaagacgttctttgggcgtccgaccgggccga

SEQ ID NO: 19810 - DNA, 431 bp, Triticum aestivum
  Clone ID: PAT_TA_19810
gacttgtgtcatgaactcgtaatgcaggaagcaagaaggcgttgagagcttggcggcatgtcaggcatgtcggcggctgtcactgcaactgtatcggccgtctgtgcgaccgtggcggtgttcataacgatggccgtgatcaggcgatgccgccacgtgaggaagaaaatgcacaagaagatcgtgacgaggatcatggaggagataagtaggaggaaccgggcccggcgagcagccccggagtgcggcgccggggcggacgacgtgggttcctccacgagatcctcagcgagaagccgatgaggttctcctcggagcagctggcgtcgtgcaccggggactactccaccgagctcgcaccgggaactaccggggtgagctacaagggggagctcctggggtggtctacaagggggagctttccaacgggc

SEQ ID NO: 19811 - DNA, 359 bp, Triticum aestivum
  Clone ID: PAT_TA_19811
tagcgtggtcgcggccgaggtgaggagatcagggaggctccaaagaacgactcaagcgaggggcagtaaagccggctttgcgacgccccgcaagctactagctagtgtttgctactgtcaatgacgttgcaatgtgctctggatcgtgtcatagttgtgttatggttgttgttgcaagatttggggctccccatatgtgatgttgccagggaaggttgtggtcggtgcttgtagcgtagcaggcggtggctgcctcctggtctggcttgggagggagccccatagactggtggtggccgttcgtattttcgttctgccttaatattgcttcttaaacgtgagtggttctgaaaaaaaaa

SEQ ID NO: 19812 - DNA, 623 bp, Triticum aestivum
  Clone ID: PAT_TA_19812
ttcggcatggcctggacgctcgtcaacctcggccacttcgcgattacataccacttcttccactggaagaagggaactccattcgctgatgaccaggggatgtataataggttgacttggtgggagcaaatggacaacggaactagcaaactttgttgttttgcaactgaatgaacgcaacttcagtttgtatgtcacccagcttgctgctgcggtggctgtcgatgccagcgagcctgcaacatctgtgatgagctgcaggacctggacacctaagcgggctccgcatccaagtcctggccgtcctccgcagcaaggagctgggccaagggagcaaacaacaccactggttccttcaaggatgtgtgctgctggtcgagtcttgtggagaagcaaggcgaatcgggcattgtctcaattgttccgctgtggagttcgaggccttggaaatttcaagttcgaagcggcgtgtagccctacgcagcaatgatttgttctgtttgactgtaataaactaaatattatagtactgtaatagtaggcatatctggggttgttatagactatgcacagattgtaataaactatgtacatgagctccaggcctatgaaattctccattt

SEQ ID NO: 19813 - DNA, 616 bp, Triticum aestivum
  Clone ID: PAT_TA_19813
gattcacattaataaaggttcccaaacgtcaccatcgaacatcttacgaatgataaaggagcatatttcaggtagcatatcctaacaggactggtgatattaaaaaactaggatagcaagagcagtatggcaacacggcagatccaccgagcttaatcgatctcctggagcgaggcgccggtggccgtggcacccccagcggcggcggcgacgtcctcggccgtgaacttgcccttggccttgtcagcaagcgcggccgcgagccttgcggtcgaggagggccttgcggtccttgtcgagcttgagcttggtgacgatcaccttgctggggtggatgccaacgttcaccgtggatccattgaccttctccctggtgatccgctccacgtggatgacccagcggcggcggtagacctgcaccacctttccctcgcggcccttgaaggtgccgcgcacgacctgcacctcgtcatccttgcggacggaggacggcgccgtgaagtgcgccttgcggcacttccggcgggagctcgtgacgcgggggttgcgcttcatggcggcggcgtggggtgggctctctcccttacctgggagcggcggcggctagggttttgcc

SEQ ID NO: 19814 - DNA, 833 bp, Triticum aestivum
  Clone ID: PAT_TA_19814
ctccctcgctccgatctggtggagccgccgcccccaacctctctctccgactttgatccgccgccgcctccaaccgctcccaccccactcctcttcccctcctcctcgggcagcctagtcgtcgtcgcgaccgaggaccagagatgcgggcggggagctcgaggcggaggagcagcagcagcggcggcgacggcgagtcagggcaaggccagcagcgatggggttcatctccttcgtcgggagggtgctcttcgcctccgtcttcctcctctccgcctaccaagaaggaggaagcaaacttgcccggcaagaagggacccctcaagctggacgaatgggtgctgtgccggctttagaacaagaagaacaactgggagaaggtcaaggtggagcaggacatggttgtggaggcatggcctggacgctcgtcaacctcggccacttcatgattacataccacttcttccactggaagaagggaactccattcgctgatgatcaggggatgtataatagatgacttggtgggagcaaatggacaacggcaagcagcttactcacaacagaaaatttcttgttgtggttcatgtagtcttgtatgtgttatcctgtttcaattttattaatactacttttgggagcttacttggcaaggaacaacatggcaggatgtatgcacaaagaatgattttggctagtcagaaatactacacttattcattaattatgcaaagaacacttgtttgtaacatctaggtctaacttgcatatttacgccattatacacgtgtaaggattgggcattgctctatgctcattcacgccattataca

SEQ ID NO: 19815 - DNA, 610 bp, Triticum aestivum
  Clone ID: PAT_TA_19815
cataataacaaaaccgatataattaaaaaacgagccggctcgagccggccgggccggggttctcggtcgccaaggaaacgagccatcaacaaaagagaaggctccaggtcccaggaggaggtatcacaaccagccgcctttctcttctcttctcttctcttccaacaccgcggcacgaccgcgcgagggccggggttttctgggaggtggtgcagcgagcgagcgcggggaggagaatgatgacggcaatggtgaaggccgagtcgacgacgacggcggcggcggcggaggggagcagcgggcggcagggacgcggaggcggagctcaacctgccgccgggcttccgcttccaccccacggacgacgagctcgtcgtgcactacctctgcaggaaggtggccggccagccgcagcccgtgcccatcatcgccgaggtcgatctctacaagttcaacccctgggatctgcccgagagggcgctgttcgggagcagggagtggtacttcttcacgccgcgcgaccgcaagtaccccaacggctcgcgccccaaccgctccgccggcaccggctactggaaggccacgggcgccgacaagcccgtggcgccca

SEQ ID NO: 19816 - DNA, 597 bp, Triticum aestivum
  Clone ID: PAT_TA_19816
ggttttttttttttttttttttttttttttttttttttaaaatccaaggcacagacccataaagatgcacattaaaggtttgaaaacgctcatccacgacatcatacgaataataaagcagtcttcagatagcatatcctaacagaactggtgatggtaataaaactaggatatcaagagcagtatggcaaccggcagatcccaagcttaatcgatctcctggagcgaggcaccggtggccgtggcgcccccagcggcggcggcgacgtcctccgccgtgaactttcccttggccttgtcagcagcgcggccgcgagccttgcggtcgaggagggccttgcggtccttgtcgagcttgagcttggtgacgatcaccttgctggggtggatgccgacgttatatttgtggcggagctcggaggagagggccgcggacatgagcacgcggcggacggaggacggcgccgtgaagtgcgccttgcggcactttccggcgggagctcgtgacgcgggggttgcgcttcatggcggcagcggggggtgggctctctcccttacctggggcgtcggcggcggctagggttctggggcgggagc

SEQ ID NO: 19817 - DNA, 479 bp, Triticum aestivum
  Clone ID: PAT_TA_19817
cctcctcaaatcaaatctcaccgccgcatccctcaattctcctccgattatcgtcgtcgtttgactagatctgcggcgacacacgcagacgcagatttggcattcagaaaaaattgaaattgtkaactgtgaagatgacggcaccagcsgastttcccgtgrggagaatgtgtacgtccgcatcatcggattcgacaacatgcgccargtgcagttcgtyacktcattgccttcaagccaccgggctgcgaggagtccggcaaggcctaaacagctcactcaccacgggccacatataaagtgccattgcagtgttgtcaactctgacattkctttgggttttccttctccatttgtctttcttacttgttcctaagaatatgtgtatrtgcatgttcatgtaacaacatggctcgagagacgtgckcgtatgtgaatacaatcggtggctatgtatatwcacatgcacataatatatt

SEQ ID NO: 19818 - DNA, 523 bp, Triticum aestivum
  Clone ID: PAT_TA_19818
accgggcatggttcaaatcctcgtacgtatcgcgttagaggatgcagtcattagggcatgcatgtatcttctgcagctccaatcctagagggcatacgaccttctttgctgcatacatactgtcgggcaattcgttatcctttggaagcttcttcttcaatattttcagtagcttctcaaatcctttgtcaggcacagcattctctgatttccactgcagcaattccagtacggtcccgagctttgtgttgccatcttcgcaattggggtacaacccttttttgtgatcctctaacatgtgatcgaccttcagcttctccttttgactttcgcattgcgtccttgcatcgacaatgacccggcggagatcatcatcatcgggcacatcgtctggttcctcatgatcttcagcagcttcccccgttgcagcatcattgggcacatcgtctggttcctcttgatcttcagcagcttcccccgttgcagcatcaccgtattcagggggcacatagttgttatcgtc

SEQ ID NO: 19819 - DNA, 648 bp, Triticum aestivum
  Clone ID: PAT_TA_19819
ccacgcgtccggcgacgacgagaccagcggcgacagacgcagacgcagatttggcattcagaaaaaatcaaaatcgtgaactgtgaagatgacggcaccagcagagctttcccgtgaggagaatgtgtacatggctaagctcgccgagcaggctgagaggtacgaggagatggttgagttcatggagaaggtggccaagactgtcgactccgaggagctcactgtggaggagcgcaacctcctctctgttgcatacaagaatgtgattggagcccgccgtgcctcatggcgcatcatctcctccattgagcagaaggaggagagccgtggcaatgaggaccgggtcacgctcatcaaggaataccgtggcaagatcgaaactgagcttagcaagatctgtgatggcatcctcaagctgctcgaaacccaccttgtcccgtcctccactgcccctgagtccaaggtcttctatcttaagatgaagggtgactactacaggtatcttgcggaattcaagagtgggcctgagaggaaggatgctgctgagaataccatggtggcatacaaggctgctcaggatattgctttggctgagctggctccaactcatccgattaggcttgggctggcactaaacttctcggtgtt

SEQ ID NO: 19820 - DNA, 550 bp, Triticum aestivum
  Clone ID: PAT_TA_19820
gaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgcccgcgcctcatggcgcatcatctcctccatcgagcagaaaggaaggagggcccgaggcaatgaggaccgagtaacactcatcaaggattatccgtggcaagattgagactgagctgaccaagatctgtgatggatcctcaagctgcttgagaccatcttgtgccgtcttccactggccccgatccaaggtcttctatctcaagatgaagggtgattactacagataccttgctgagttcaagactggagctgagagaaaggacgccgctgagaaacatgggga

SEQ ID NO: 19821 - DNA, 892 bp, Triticum aestivum
  Clone ID: PAT_TA_19821
ccatctttgaaccttcctcctcctccgcgctgacctaccctcaccctcccctcccctcccctcccctccccggcgacaaaccaggccctcctacatagcggcaatccattccggcctctcagcccgcagcagcacccccgccgcagctcccgcgacgccgagccggacggacgggaggaaccaccgccccgcagcacgcgcgcgccggtagggcgagggaggggatcgatggcgaagctgtacgtgcaggcggtgcccccgccggatctgaacaagaacaccgagtgggttcatgtacccgggggtctggaccacctacatcttcatcctcttcgtctcctggctcctcatcctctccatcttcggctgcacccccggcatggcctggacgctcgtcaacctcggccacttcgcgattacataccacttcttccactggaagaagggaactccatttgctgatgaccaggggatgtataatagattgacttggtgggagcaaatggacaacggcaagcagcttactcgcaacagaaaatttcttgttgtggttcctgtagtcctgtacttgatcgcttcgcacaccacagactatcaacatcctatgctctttttgaacaccattgcagtcacagtactggttgtcgcgaaactaccgaacatgcacaaggtccggatttttggaataaatgctgagaactaaacagcgtcatctgtcaccagacatttacctatatatatgcttttcagaacggtctgtatgttccctctagtgctttagttgggctcatcagagtaccagtgtttaaaagttgttagcagatgggccttggtcgttgtatagagaaatgctcagaggctggaaatgtcgctgctgtacatctgatgtgca

SEQ ID NO: 19822 - DNA, 588 bp, Triticum aestivum
  unsure (1)..(588): unsure at all n locations
  Clone ID: PAT_TA_19822
atcaacggccccccacgcacgcacacatcaagcgcagctgatcccccagttgatcgatccgtcagctagctagccatggccatggccgggaggaaggtgacgacgagcagcgccagcgtcgccgcagcgctggtggcgctgctggtccgtggcggcggcgtccgggcgcggccgggattcatgtctgcaacgtggacacggggagcatgctgaacaactgcaggtcctactgctccggttgggcagcaacgaaggccagccccagcgggcgccttctgcggcgccggtgcgcggcgccaactttcaagtgcctctgcaattacaagggttccctgcccaaaggacatcgacgccaaccgcgccatgcaattccccgccaatngcggtacgggccggctcctggctatcaccaactacaaacacttgctacaatttcatccttcctaggatgtactactngtttatctgatgttcctgcagcttgttttggcaatcatctatacttggtacccctccgctttctaataagtgcgtgntcaaaacatttgcanaataaataatccgcncaaagggggccgtncaattccc

SEQ ID NO: 19823 - DNA, 1300 bp, Triticum aestivum
  Clone ID: PAT_TA_19823
gtacttggtcgccaaggaaacgagccatcaacaaaagagaaggctccaggtcccaggaggcggtatcacaacctgcagccgcctttctcttctcttcttcttctcttccagcaccgggcgggcgcggccggggttttcttttctccaaggtggtggagcgggcgagcgaacgcgaggagggggaggatgatgacggcaatggtgaaggccgagccgacggcggcggaggggagcagcgggcggagggacgcggaggcggagctcaacctgccgccgggcttccgcttccaccccacggacgacgagctcgtcgtgcactacctctgcaggaaggtggcgggccagccgcagcccgtgcccatcatcgccgaggtcgatctctacaagttcaacccctgggatctgcccgagagggcgctgttcgggagcagggagtggtacttcttcacgccacgcgaccgcaagtaccccaacggctcgcgccccaaccgctccgccggcaccggctactggaaggccaccggcgccgacaagcccgtggcgcccaaggagagcggcggcaggacggtcggcatcaagaaggcgctcgtcttctactccggcagggcgcccaggggcgtcaagaccgactggatcatgcacgagtaccgcatcgccgaagccgaccgcgcacccggcaagaagggatccctcaagctggacgaatgggtgctgtgccggctgtacaacaagaagaacaactgggagaaggtcaaggtggagcaggacatggctgtggaggccgggccaaacggggaggtcatggacgcgctggcgaccgacgccatgtccgacagcttccagacgcacgactcctcggagatcgacagcgcctccggcctgcagcagcgcgtcttcacggacatggcgcaggggcagccgagaggcggcacggtgacggtgaaggaggacagcgactggttcaccggcctgagcatggacgacctgcagacttgctatatgaacatggggcagatggtgaacccggcgacgatgcctgggcaggacggcagcggctacctacagtcgatgagctcaccgcagatgatgaggccgatgtggcaaacaatcttgccaccattctgagatggaaccagaaagatatggtgtaaattattggaaatagaagtgattagacaaatatacttactttgttgaactagaaagagatagagatttcccaggcatgattctgaagatgtggtggtaggcttgtagcagtatttattctttggtttcgatctataaatttggtattctg

SEQ ID NO: 19824 - DNA, 1003 bp, Triticum aestivum
  Clone ID: PAT_TA_19824
cgcgagcggccgctcgcgatctagaactactttgaaccttcctcctcctccgcgctgacctaccctcaccccaccctcccctcccctccccggcaacaaaccaggcccctcctacatagcggcgatccattccggcctctcagcccgcagcagcacgcaggccgcagctcccgcgacgccgagccggacggagccaccgccccgcagcacgcgcgcgccggtagggcgagggaggggaggggatcgatggcgaagctgtacgtgcaggcggtgcccccgccggatctgaacaagaacactgagtggttcatgtacccgggggtctggaccacctacatcttcatcctcttcgtctcctggctcctcatcctctccatcttcggctgcacccccggcatggcctggacgctcgtcaacctcggccacttcgcgattacataccacttcttccactggaagaagggaactccatttgctgatgatcaggggatgtataatcgattgacctggtgggagcaaatggacaacggcaagcagcttactcgcaacagaaaatttcttgttgtggttcctgtagtcctgtacttgatcgcttcgcacaccacagactatcaacatcctatgctctttttgaacaccattgcagtcacagtactggttgttgcgaaactaccgaacatgcacaaggtccggatttttggaatcaatgccggtaactaagcggcagcgtcccagggtagacagcactcaatatcatgtttcatttgaatggctggatggtgttgcacctagttctgaattcgctcgtcagagtaccagtgtgtagtgtttgagagctgttagtagatgacatgtgatcattgtacagagaaacggctaaaaggcctggaaaatgatgctgttttgcaactttgcccgacacgttttgtagactttttaagctgctatatgttttgttgcaagtatttgtcacttgatacatgtacagtttccccgggcctgt

SEQ ID NO: 19825 - DNA, 1381 bp, Triticum aestivum
  Clone ID: PAT_TA_19825
ttctcccttccaccaccaccgccgcctcctcgctcccgaggaatgccagggcctcgccggcgccgatcctcgctctccgctcgctcgcctccaggtccaagcacgcgcgcgctatcatggcggtggcgtcgagccagcccgccgcacccagcaagtacccgaagatggccgcccccaccaccggcccggttcccgccgacgagctgctcggcgtcatccaggccgccgccaaggcaggcgccgaggttgtaatggaagctgttaataagccgcgtaatatccaatacaagggggttgcagacttggtgacagacacagataaactgagtgaatcagtcattcttgaagtcgtcaccaagaacttcaaagaccacctcatacttggggaggaaggtggccttattggagattctttgtcagagtatctctggtgcattgatcctttagatggaacaacaaactttgcacatggttaccccagcttttctgtatccattggcgttctattccgaggcaagcctgctgctgccactgtggtggaattttgtggtgggcctatgtgctggaacactcgtacgatttctgcatcttctggaaaaggtgcttattgtaatgggcaaaagattcatgtcagtccaacagaaaaggtggaacaatctcttctggttactgggtttggatatgaacatgatgatgcatggctgaccaatataaatttgttcaaggaatttactgatgttagcaggggagtacgaaggctaggctctgctgctgctgatatgtcccatgttggtctaggcattaccgaagcctactgggaatatcggcttaagccgtgggacatggctgctggtgttctgatagttgaagaagctggtggggtagtgacacgcatggatggtggagagtttacagtctttgatcgttctgttcttgtttccaatggcactgttcatgatcagcttttggagcggatccggcctgctactgaagcccttaagaagaaaggaattgatttctccaggtggttcaagcctgacaattaccctactgacttttgaatcacgcagcccttcagctacttggttctctgtcaagcgaccatgcacttacactgacaatacatttcaaggccctccgaccaaacggatcgaaaattaaagccaaactttactgaaggggtagagctcgaatgagatcctcactggattcctttttgctttgatgatagaatgtatcagaaagaaatgtttgcagagggtgttgtatcgtatgcatggtttctgccagttgtacttgggaaagatataacttccaattttgttaatcatggataatagcaaggcttccaacaagccaaaaaaaaaaaaaaaaaaaaaaa

SEQ ID NO: 19826 - DNA, 644 bp, Triticum aestivum
  Clone ID: PAT_TA_19826
gccggccgggctccaaacacccagacaatcaaccccccccacgcacgcacacatcaagcgcagctgatcccccagttgatcgatccgtcagctagctagccatggccatggccgggaggaaggtgacgacgagcagcgccagcgtcgccgcagcgctggtggcgctgctggtcgtggcggcggcgtcgggcgcggccgggattcatgtgtgcaacgtggacacggggagcatgctgaacaactgcaggtcctactgctcggtgggcagcaacgaggccagccccagcggcgcgtgctgcggcgcggtgcgcggcgccaacttcaagtgcctctgcaagtacaagggcttcctgcccaaggacatcgacgccaaccgcgccatgcagatccccgccaagtgcggctacgggccggcctcctgctagtcacccactaccaacagcttgctaccaactttcactcgttcgtaggagtgtacgtacgtaggttgatctgatgtgcgtgcatgctttgtgttggccatgcatgctactacctttgtatcctcttccgcttttcctaagtcatgttgctgtgtgtccacaactatgtggcagaaataaaacttatttcccgcgcaaaaaaaaaaaaaaaaaaggccccta

SEQ ID NO: 19827 - DNA, 498 bp, Triticum aestivum
  Clone ID: PAT_TA_19827
gcgcggtgggcagcaacgaggccagccccagcggcgcgtgctgcggcgcggtgcgcggcgccaacttcaagtgcctctgcaagtacaagggcctgctgcccaagggcatcgacgccaaccgcgccatgcagatccccgccaagtgcggctacggggcggcctcctgctagtcacgcactatccagctcgattcacgccggccgacgcggtccgccgccggtcggccggttgcacgagtaaatcgtaacgtcgtatttcgatgtcaactttcactccgttcgtaggagtacgtacgttctgggtcggctcgctgatccgatcgtacgtgcgtgctttgtgttggccatgcatgctactcctacctttgtatcctcttccgcttttcgtaagtcatgttgctgtgtgtccacaacgatgtggcaagaaataaaacttatttcccgcgtctaaaaaaaaaaaaaaaaactcgagactagacctgcccgggcggccgctcga

SEQ ID NO: 19828 - DNA, 694 bp, Triticum aestivum
  Clone ID: PAT_TA_19828
ctgcaggcgactgcccccaacacacgcacacatcaagcgcagctgatccaccagtcgatcgatccgacagctagctagccatggccgccgggaggagggtgatgagcaacgccggcgtcgctgccgcgctggtggcgctgctggtcgtggcggcggcggcgggcgcggccgggtaccatgtctgcgacgtggacacggacagcatggtgagcaactgcaggtcctactgcacggtgggcagcacggaggccagtcccagcggcgcgtgctgcggcgcggtgcacggcggcgacttccactgcctctgcaagtacaaggacgtgctgcccaagaacatcgacgcgaaccgcgccatgcagatccccggcaagtgcggctacggggcgacctcctgctagtcagtcacgcactaccagcagctcgattggcgccggccgacgcggtccgccggccgccggttgcactaagtagatcctacgtaaggtgttaactttcactcgttcgtaggagtaaagttctggtcgtctggccgatccgatcgtgctcctgcgtgccgtgcacgctttgtgttgggcgatgcatgctacctttgtatcctcttctgcttttcgtaagtcatgtcgctgtgtgtctacaaccatgtcgcagaaataaaacttgtttcccgtgttagctatcttctaaaaaaaaaaaa

SEQ ID NO: 19829 - DNA, 1362 bp, Triticum aestivum
  Clone ID: PAT_TA_19829
cgtccgcccacgcgtccgaaggaaacgagccatcgactaaagagaagggctccaggtcccaggaggcggtatcacaaccagccgcctttctcttcccttccaacaccgcggcaccaccgcgcgagggctgggcttttctccaaggtggtggagcgagcgagcgagcgagcgaacgcgaggaggaggaggatgatgacggcaatggtgaaggctgagccgacgggggcggcggcgggggcggaggggagcagcgggcggagggacgcggaggcggagctcaacctgccgccgggcttccggttccaccccacggacgacgagctcgtcgtgcactacctctgcaggaaggtggccggccagccgcagcccgtgcccatcatcgccgaggtcgatctctacaagttcaacccctgggatctgcccgagagggcgctgttcgggagcagggagtggtacttcttcacgccgcgcgaccgcaagtaccccaacggctcgcgccccaaccgctccgccggcaccggctactggaaggccacgggcgccgacaagccggtggcgcccagggagagcggcggcaggacggtcggcatcaagaaagcgctcgtcttctactccggcagggcgcccaggggcgtcaagaccgactggatcatgcacgagtaccgcatcgccgaagccgaccgcgcacccggcaagaagggatccctcaagctggacgaatgggtgctgtgccggctgtacaacaagaagaacaactgggagaagctcaaggtggagcaggacatggctgtggaggccgggccgaacggggaggtcatggacgcgctggcgaccgacgccatgtccgacagcttccagacgcacgactcctccgagatcgacagcgcctccggcctgcagcagcatggtttcatggacatggcgcagcagcaggcgaggatggtgacggtgaaggaggacagcgactggttcaccggcctgagtatggacgacctgcagacttgttatatgaacatggggcagatggtgaacccaacaacgatgcctgggcagaacggcagcggctacctgcagccgatgagctcgccgcagatgatgaggccgatgtggcaaacaatcttgccaccattctgagatggaataagatatggtgtaaattattggaaatagaagtgattagacaaatacttactttgttgaactagaaagaggtagaaatttcccaggcatgattctgaagatgtggtggtaagcttgtagcagtatttattctttggtttcgatctataaatttggtattctgaacaaacatgtggttttattctcataataatatcaagcctaaacaccaaaaaaaaaaaa

SEQ ID NO: 19830 - DNA, 1071 bp, Triticum aestivum
  Clone ID: PAT_TA_19830
tcggcacgaggggaaatctctgatgttaagaagcaactcgaagatgctcgctcaagaggcatcgacgttagggctttggtggttatcaatccaggaaatcctactggacaggtacttgctgaggaaaaccaatatgacatagtgaagttctgcaaaaatgagggtcttgttcttctggctgatgaggtataccaagagaacatctacgctgacaacaagaaattccactctttcaagaagatagtgagatccttgggatacggcgaggatgatctccctctagtatcatatcaatctgtttctaagggatattatggtgagtgtggtaaaagaggtggttacatggagattactggcttcagtgctccagtaagagagcagatctacaaaatagcatcagtgaacctatgttccaatatcaccggccagatccttgctagtcttgtcatgaacccaccaaaggctagtgatgaatcatatgcttcatacaaggcagaaaaggatgggatccttgcatcgttagctcgtcgtgcgaaggcattggagattgcattcagtaaacttgagggaattacttgcaacaaggctgaaggagcaatgtacctgttccctcaaatctgtctgccacagaaggcgattgaggctgctaaagctgctaacaaggcacctgatgcattctatgctcttcgtctccttgagtcgaccggaatcgtcgttgtccctggatctggatttggccaggttcctggcacatggcacttcaggtgcacgatccttccgcaggaggagaagatcccggcgatcatctcccgcttcacggtgttccatgagacgttcatggcagagtaccgtgactaaactggtgtaacatgtgtgggattacatgcaagcctcgtggattttccctaggcgtttttgcccccgttgacagcagtatcatgtagacgagacaaaataaagcaaatccatggcttgtgtgtgtgatatactatatcagattctgaaacagattaccagtctgatgcgtttgatggtaaattggcaacggaaatttttttcccccaaaaaaaa

SEQ ID NO: 19831 - DNA, 567 bp, Triticum aestivum
  Clone ID: PAT_TA_19831
ttgcttacagccaccagcacagtgcacaacctcaagaaactacaccaacaaaccggaccaagctagaaagaataatatggcgtccaagtctagcatcacccacctcctcttggccgccgtcctggtctccgtcttcgccgccgccgcagccacaggcccgtattgctacccggggatgggtcttccgagcaacccgcttgaaggctgccgggagtatgtcgcacagcaaacttgtggcgtcggcatcgtcgggtcgccggtatccaccggagccggggaacaccccgagggatcggtgctgcaaggagctttacgacgcctcgcaagcattgccgggtgcgaagcggtgcgctacttcatagggcggacgtctgattccaattccggcgtgctcaaaggaccttccccgggatgccccaagggagccccaagagggacttcgccaaggtgctccgttacgccggggcactgcaacgtgatgacgttcacaacacccatactgcctccgtttgggcatataaagatggtagtccgtctccaagaatgaataacatgttcatcatgggg

SEQ ID NO: 19832 - DNA, 823 bp, Triticum aestivum
  Clone ID: PAT_TA_19832
gcacgaggcgactgccccccacacacgcacacatcaagcagcagctgatccaccagtcgatcgatccgacagctagctagccatggccgccgggaggaaggtgacgatgagcagcgccggcgtggccgcccgcgctggtggcgctgctggtcgtggcggccggcgtcgggcgcggccgggctcagggtctgcagcgtggacagggacagcgtccgtcaacaactgcaagtcctactgcacggtgggcagcacggaggccagccccagcggcgcgtgctgcaacgcggtgcgcggcggcaacttcaagtgcctctgccagttcaggaacgcgctggtccccggacatccgacggcaaccgcgccatgcagatccccgccaagtgcggctacggggcgggcctcctgctagtcaccgtcacgcactatgcagcccgatacgcgccggccgccgcggtccgccgccgggtcgccggttgcaccagtagatcgtaacgtggtgttttgctgtcaactttcagtcgttcgtaggagtacgtacgttctggtcggctggctgatccgaacgcgctcctgcgtgcgtgcatgcatgctttgtgttggccatgcatgctagtacctttgtatcctcttctgcttttcgtaagtgatgttgctgtgtgtctacaaccatgtcgcagaaataaacttgtttcccgtgttagttaacttttagtccttctctatatgtctgtagattttttttttctggatcatctatcaataattccaataagttctgtgaaacttttaaataaatactccctctgtttctaaaaaaaaaaaa

SEQ ID NO: 19833 - DNA, 503 bp, Triticum aestivum
  unsure (1)..(503): unsure at all n locations
  Clone ID: PAT_TA_19833
ccgaggtctagtctcgagtttttttttttttttttttttttttttttttttttaaaccaataataatgccattatttctgggcaaaagcaaacgccgcctcacctgcccgggcggccgtcgagccggcccgcccggggcaggtcggctacggggccggccctcctgctagtcacccactagccaacagcttgctaccaactttcactcgttcgtaggagtgtacgtacgtaggttgatctgatgtgcgtgcatgctttgtgttgggcaatgcatgctactacctttgtatcctcttccgcttttcctaaagtcatgttgctgtgtgtccacaactatgtggcagaaataaaacttatttcccgcgtcaaaaaaaaaaaaacctcggccgcgaccacgcctaatcgaaattcccccgcgggccgccaagggcgggcgggggagcatgcgaacgttcggggcccaaattccccccaaaagtggagtcngtaattacaaattcact

SEQ ID NO: 19834 - DNA, 664 bp, Triticum aestivum
  Clone ID: PAT_TA_19834
agtcggtattgcttacaaccactagtgcagtgcacaactcaagaaactacaccaacaaaccggacaaggctagaaagaataacatggcgtccaagtctagcatctcccccctcctcttggccaccgtcctggtctccgtcttcgccgccgccacagccacaggtccatattgctacgccgggatgggcccttccgatcaacccgcttgaaggctgccgggagtatgtcgcacaagcaaacctgtggcatcaagcatatccgggtcggcggtgtccaccgcagccggggaacaccccaagggattcggtgctgcaaggagctttacgacgcctcgcaagcattgcccggtgcgaaggcaatgcgctacttcataaggcggaggtctgatcccaattccaagcgtggctcaaaggacctccccgggatgcccccaagggagccccagagggacttcgccaaggtgctccgtttacgcccgggggcactgcaacgtgatgaacgtcacaacgccccatactgccttggtttgacatataagaagatagaacccggccatgaagaataacacgctcgtcccggatggtgggatgcaaatgccattggagccccgggtcaaaattgtttaaaaaaaagaaaattgggggttaaaatcaccaaatttggg

SEQ ID NO: 19835 - DNA, 621 bp, Triticum aestivum
  Clone ID: PAT_TA_19835
acaatcaagtgctacacacacacacacattcatcaccagtcgatcgatccgacagctagctagccatggccgccgggaggaaggtgacgatgagcagcgccggcgtggccgccgcgctggtggcgctgctggtcgtggcggcggcgtcgggcgcgaccgggtaccatgtctgcaacgtggacacggacagcctggtcaacaactgcaagtcctactgcacggcgggcagctcggaggccagtcccagcggcgcgtgctgcggcgcggtgcgcggcggtgacttccactgcctctgccagtacaagggcgtgctgcccaagaacatcgacgccaaccgcgccatgcagatccccggcaagtgcggctacggggcggtctcctgctagtcagtcacgcactaccagcagctcgattggcgccggtcgccggttgcactagtagatcgtacgtaaggtgttaactttcactcgttcgtaggagtaagttctggtcggctggctgatccgatggtgctcctgcgtgcgtgcacgctttgtgttgtatcctcttttgcttttcgtaagtcatgtcgcagaaataaaacttgtttcccgtgttagctaaaaaaaaaaaaaaaaaaaa

SEQ ID NO: 19836 - DNA, 741 bp, Triticum aestivum
  Clone ID: PAT_TA_19836
ctggtgccgaattcggcacgagctcgtgccgaattcggcacgagccacacacacgcacacatcaagcgcagcgcagctcgatcgatccggcagctaggtagccatggccgggaggaaggtgatgagaaacgccggcgtcgcggccgcgctggtggcgctgctggtcgtggcggcggcgtcgggcgcggccgggattcatgtctgcaacgtggacaccgggagcatggtgaacaactgcaggtcctactgcacggtgggcagcaacgaggccagtcccagcggcgcgtgctgcggcgcggtgcgcggcgccaacttcaagtgcctctgcaagtacaagggcctgctgtctaaggacatcgacgccaaccgcgtcatgcagatcccagccaagtgcggctacggggcggcctcctgctagtcacgcattatgcagctcgattccgcgccggccgacgcgggtccgccgccggtcgccggttgcacgagtaaatcgtaacgtcgtattttgatgtcaactttcactcgttcgtaggagtaagtacgttctagtcggctcggtgatcctatcgtgcgtgcgtgctttgtgttggccatgcatgctacctttgtatcctcttccgcttttcgtaagtcatgttgctgtgtgtccacaactatgtggcagaaataaaacttgtttcccgcgtctctctataaaaaaaaaaaaaaaaaactcgagactaagttctctctctcacctgc

SEQ ID NO: 19837 - DNA, 906 bp, Triticum aestivum
  Clone ID: PAT_TA_19837
ggctgatgaggtataccaagagaacatctacgctgacaacaagaaattccactctttcaagaagatagtgagatccttgggatacggcgaggaggatctccctctagtatcatatcaatctgtttctaagggatattatggtgagtgtggtaaaagaggtggttacatggagattactggcttcagtgctccagtaagagagcagatctacaaaatagcatcagtgaacctatgttccaatatcaccggccagatccttgctagtcttgtcatgaacccaccaaaggcaagtgatgaatcatatgcttcatacaaggcagaaaaagatgggatccttgcatcattagctcgtcgtgcgaaggcattggagattgcattcagtaaacttgagggaattacttgcaacaaggctgaaggagcaatgtacctgttccctcaaatctgtctaccacagaaggcgattgaggccgctaaagctgctaacaaagcacctgatgcattctatgctcttcgtctccttgagtcaactggaatcgttgttgtccctggatctggatttggacaggttcctggcacatggcacttcaggtgcacgatccttccgcaggaggagaagatcccggcgatcatctcccgcttcacggtgttccatgagacgttcatggcagagtaccgtgactaaactggtgtaacatgtgttggattacatgcaagcctcatggattttccctaggcgtttttgcccccgttgagagcagtatcctgtagatgagacaaaataaaggaaatccatggcttgtgtgtgtgtgatactatatcagattgtgaaacagattaccagtctgatgcctttgatggcaaattggcaactgagatttcttttccaccaaaaaaaaaaaaaaaaaa

SEQ ID NO: 19838 - DNA, 846 bp, Triticum aestivum
  Clone ID: PAT_TA_19838
ctagtctcgagtttttttttttttttttttttgatcagattgtactaccttcatgtcaaaatataagacgtttttacaatgaggtactagtatttcattttaaaactgaaatgtttattaaaatcgtattattccagataatcaactgcccccccacacacgcacacatcaagcgcagctgacccaccagtcgatcgatccggcagctagctagccatggccatggccgggaggaaggtgacgacgagcaacgccggcgtcgcggccgcgctggtggcgctgctggtcgtggcggcggcgtcgggcgcggccgggtaccatgtctgcaacgtggacacggacagcctggtgaacaactgcaggtcctactgcgcggtgggcagcaacgaggccagccccagcggcgcgtgctgcggcgcggtgcgcggcgccaacttcaagtgcctctgcaagtacaagggcctgctgcccaagggcatcgacgccaaccgcgccatgcagatccccgccaagtgcggctacggggcggcctcctgctagtcacgcactatccagctcgattcacgccggccgacgcggtccgccgccggtcgccggttgcacgagtaaatcgtaacgtcgtatttcgatgtcaactttcactcgttcgtaggagtacgtacgttctggtcggctcgctgatccgatcgtacgtgcgtgctttgtgttggccatgcatgctactcctacctttgtatcctcttccgcttttcgtaagtcatgttgctgtgtgtccacaacgatgtggcagaaataaaacttatttcccgcgtctttctcggaaaaaaaaaaaaaaaaagggcccta

SEQ ID NO: 19839 - DNA, 1378 bp, Triticum aestivum
  Clone ID: PAT_TA_19839
cgtccgcgcagacgcaggtacccagccgctcctgccgtttcctccccaaatcaaatctcgcctccccgtctctcaattctcctccgattatcgtcgtcgttcgactagatcttcactgatttggcattcagaaaaaatttaaatcgtgaactgtgaagatgacggcaccagcggagctttcccgtgaggagaatgtgtacatggctaagctcgctgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatctgtgatggcatcctcaagctgctcgaaacccaccttgtcccgtcttccactgcccctgagtccaaggtcttttatcttaagatgaagggtgactactacaggtatcttgccgaattcaagagtgggcctgagaggaaggatgctgctgagaataccatggtggcatacaaggctgctcaggatattgctttggctgagctggctccaactcatccgattaggcttgggctggcactaaacttctcggtgttctattatgagatcctcaactcgcctgatcgtgcttgcaatctcgcaaaacaggcattcgatgaggccatttcggagctggacaccttgagcgaagaatcctacaaggacagcaccttgatcatgcaactccttcgtgataacttgaccctctggacttccgacatcacggaggacaccgcggaggaggagatcagggaggctccgaagcatgactccagcgaggggcagtaaagccggctttgcgatgccccgcaagctactagctagtgtttgctactgtcaatgaccgttgcaatgtgctctggatcgtgtggtagatgtgttatggttattattgcaagatttggggctccccatatgttatgttgccagggaaggttgtggtcgccgcttgtagcgtagcaggcggggactgcctccttggtctggcctggggggagccccatacagtggtggtggtggccgttcgtattttcgttctgccttaatattgcttcttatcgtgagtgatcctgcgtctgtgtctggccctgttctgtttcagttttttggttgtttttcgtggggtgtactcgcactgaatctggctttgtggctggcttattgggaaatgggattgtccgggttgttgctccggataaacgctgaaaaaaaaaaaa

SEQ ID NO: 19840 - DNA, 1119 bp, Triticum aestivum
  Clone ID: PAT_TA_19840
gctggggtttggaaatctctgatgttaagaagcaactcgaagatgctcgctcaagaggcattgacgttagggctttggtggttatcaatccaggaaatcctactggacaggtacttgctgaggaaaaccaatatgacatagtgaagttctgcaaaaatgagggtcttgttcttctggctgacgaggtataccaagagaacatctacgctgacaacaagaaattccactctttcaagaagatagtgagatccttgggatacggcgaggaggatctccctctagtatcatatcaatctgtttctaagggatattatggtgagtgtggtaaaagaggtggttacatggagattactggcttcagtgctccagtaagagagcagatctacaaaatagcatcagtgaacctatgttccaatatcaccggccagatccttgctagtcttgtcatgaacccaccaaaggctagtgatgaatcatatgcttcatacaaggcagagaaagatggaatccttgcatcgttagctcgtcgtgcgaaggcattggaggttgcattcagtaaacttgagggaattacttgcaacaaggctgaaggagcaatgtacctgttccctcaaatctgtctgccacagaaggcgattgaggctgctaaagctgctaacaaagcacctgatgcattctatgctcttcgtctccttgagtcgacaggaatcgtcgttgtccctggatctggatttggccaggttcctggcacatggcacttcaggtgcacgatccttccgcaggaggagaagatcccggcaatcatctcccgcttcacggtgttccatgagacgttcatggcagagtaccgtgactaaactggtgtaacatgtgtgggattacatgcaagcctcatggattttccctaggcgtttttgcccgcgttgacagcagtatcctgtagatgagacaaaataaagcaaatccatggcttgtgtgtgtgatactatatcagattaccagtctgatgcctttgatggcaaattggcaactgagaatttttatttcaaaaaaaaaaaaaaacaaaaaaaaaaaaaaaaaaagaaaaaaaaaaaaaaaaaaaaaaaaaaaaagcggccg

SEQ ID NO: 19841 - DNA, 1245 bp, Triticum aestivum
  Clone ID: PAT_TA_19841
acgcagtacccagccgtttcctcctcaaatcaaatctcaccgccgcatccctcattctcctccgattatcgtcgtcgtttgactagatcttcgcagatttggcattcagaaaaaattgaaattgtgaactgtgaagatgacggcaccagcggagctttcccgtgaggagaatgtgtacatggctaagctcgccgagcaggctgagaggtacgaggagatggttgagttcatggagaaggtggccaagaccgtcgactccgaggaactcactgtggaggagcgcaacctgctctctgttgcatacaagaatgtgattggagcccgccgtgcctcatggcgcatcatctcctccattgagcagaaggaggagagccgtggcaacgaggaccgggtcacgctcatcaaggagtaccgtggcaagatcgagactgagcttagcaagatctgtgatggcatcctcaagctgctcgaaacccaccttgtcccgtcttccactgcccctgagtccaaggtcttctatcttaagatgaagggtgactactacagatatcttgccgaattcaagagtgggcctgagaggaaggatgctgctgagaataccatggtggcatacaaggctgctcaggatattgctttggctgagctggctccaactcatccgattaggcttgggctggcactgaacttctcggtgttctattatgagatcctcaactcgcctgatcgtgcttgcaatctcgcaaagcaggcattcgatgaggccatttcggagctggacaccctgagcgaagaatcctacaaggacagcaccttgatcatgcaactccttcgtgataacttgaccctctggacttctgacatcacggaggacaccgcggaggaggagatcagggaggctccaaagaacgactcgagcgaggggcagtaaagccggctttgcgacgccccgcaagctcctagctagtgtttgctactgtcaatgacattgcaatgtggtctggatatgtcgtagccgtgttatggttgttgtcgcaagatttgaggctcccccgtatgtgatgttgccggggaaggttgctgtcgccgcttgtagcgtagcaggcggtggctgcctcctggtctggctcgggagggagccccatagactggtggtggtggtggccgttcgtactttcgttctgccttaatattgcttcttatcgtgagtggtcccgcgtcagtgtcttgcctgttctgtttcggttc

SEQ ID NO: 19842 - DNA, 1021 bp, Triticum aestivum
  Clone ID: PAT_TA_19842
ttttttttttttttttttttttttcacatataacgaagactttatatcaaaatccaacgcacagccacatgatagattcacattaataaaggttcccaaacgtcaccatcgaacatcttacgaatgataaaggagcatatttcaggtagcatatcctaacaggactggtgatattaaaaaactaggatagcaagagcagtatggcaaccggcagatccaccgagcttaatcgatctcctggagcgaggcgccggtggccgtggcacccccagcggcggcggcgacgtcctcggccgtgaacttgcccttggccttgtcagcagcgcggccgcgagccttgcggtcgaggagggccttgcggtccttgtcgagcttgagcttggtgacgatcaccttgctggggtggatgccaacgttcaccgtggatccattgaccttctccctggtgatccgctccacgtggatgacccagcggcggcggtagacctgcaccacctttccctcgcggcccttgaaggtgccgcgcacgacctgcacctcgtcatccttgcggatggggatggaccggacattgtatttgtggcggagctcagaggagagggccgcggacatgagcacgcggcggacggaggacggcgccgtgaagtgcgccttgcggcacttccggcgggagctcgtgacgcgggggttgcgcttcatggcggcggcgtggggtgggctctctcccttacctggggcggcggcggcgacgtcctcggccgtgaacttgcccttggccttgtcagcagcgcggccgcgagccttgcggtcgaggagggccttgcggtccttgtcgagcttgagcttggtgacgatcaccttgctggggtggatgccaacgttcaccgtggatccattgaccttctccctggtgatccgctccacgtggatgacccagcggcggcggtagacctgcaccacctttccctcgcggcccttgaaggtgccgcgcacgacctgcacctcgtcatccttgcggatg

SEQ ID NO: 19843 - DNA, 799 bp, Triticum aestivum
  Clone ID: PAT_TA_19843
tcggcacgaggcacaactcaagaaactacaccaacaaaccggacaaggctagaaagaataacatggcgtccaagtctagcatctcccccctcctcttggccaccgtcctggtctccgtcttcgccgccgccacagccacaggtccatattgctacgccgggatgggccttccgatcaacccgcttgaaggctgccgggagtatgtcgcacagcaaacctgtggcatcagcatatccgggtcggcggtgtccaccgagccggggaacaccccaagggatcggtgctgcaaggagctttacgacgcctcgcagcattgccggtgcgaggcagtgcgctacttcatagggcggaggtctgatcccaattccagcgtgctcaaggacctccccggatgccccagggagccccagagggacttcgccaaggtgctcgttacgccggggcactgcaacgtgatgaccgttcacaacgccccatactgcctcggtttggacatataaagatagatagatccgtcgcccatgaatgaataagcatgctccgtccgtggatgtgtggcatgcatatatgcatatgtgagctcccgttgctcaacatttgctttactaataaagagaatcattttgtggttcttaaaaaaaagcacatggttaccccagcttttctgtatccattggcgttctattccgaggcaagcctgctgctgccactgtggtggaattttgtggtgggcctatgtgctggaacactcgtacaatttctgcatcttctggaaaaggtgcttattgtaatgggcaaa

SEQ ID NO: 19844 - DNA, 796 bp, Triticum aestivum
  Clone ID: PAT_TA_19844
tgattccgccagctcgaaattaaccctcactaaagggaacaaaagctggagctccaccgcggtggcggccgctctagaactagtggatcccccgggctgcaggaattcggcacgagggcacagtgcacaacctcaagaaactacaccaacaaaccggaccaagctagaaagaataatatggcgtccaagtctagcatcacccacctcctcttggccgccgtcctggtctccgtcttcgccgccgccgcagccacaggcccgtattgctacccggggatgggtcttccgagcaacccgcttgaaggctgccgggagtatgtcgcacagcaaacttgtggcgtcgggcatccgtcgggtcgccggtatccaccgagccggggaacaccccgaggggatcggtgctgcaaggagctttacgacgcctcgcaagcattgcccggtgcgaggcggtgccgctacttcatagggcggacgtctgatcccaatttccggcgtgcctcaagggaccttcccgggattgccccaggggaagccccaagaggggacttcgccaaaggtggctccgttacgccgaggggcactgcaacgtgatgaccgttcacaacaccccatactgcctcggtttggacatataaagatggatagatccgtctctcatgaatgaataagcatgttccatccatggcatgtgtggcatgcatatatatatgaacaagaataaagggaatcattttgtgattcttaaattttcaaaataaaaaataaagtatccataacttcaatcacttctctactc

SEQ ID NO: 19845 - DNA, 3350 bp, Triticum aestivum
  Clone ID: PAT_TA_19845
ttttttttttttttttttttttaaacatataatgaagtcttcatatcaaaatccaaggcacagacccataaagatgcacattaaaggtttgaaaacgctcatccacgacatcatacgaataataaagcagtcttcagatagcatatcctaacagaactggtgatggtaataaaactaggatatcaagagcagtatggcaaccggcagatcccaagcttaatcgatctcctggagcgaggcaccggtggccgtggcgcccccagcggcggcggcgccgtcctccgccgtgaactttcccttggccttgtcagcagcgcggccgcgagccttgcggtcgaggagggccttgcggtccttgtcgagcttgagcttggtgacgatcaccttgctggggtggatgccgacgttcaccgtggatccattgaccttctccctggtgatccgctccacgtggatgacccagcggcggcggtagacctgcaccacctttccctcgcggcccttgtaggtgccgcgcacgacctgcacctcgtcgtccttgcggatcgggatggagcggacgttatatttgtggcggagctcggaggagagggccgcggacatgagcacgcggcggacggaggacggcgccgtgaagtgcgccttgcggcacttccggcgggagctcgtgacgcgggggttgcgcttcatggcggcagcggggggtgggctctctcccttacctggggcgtcggcggcggctagggttctgggctctggacttccgacatcacggaggacaccgcggaggaggagatcagggaggctccgaagcatgactccagcgaggggcagtaaaaccggctttgcgatgccccgcaagctactagctagtgtttgctactgtcaatgaccgttgcaatgtgctttggatcgtgtggtaaatgtgttatggttattattgcaagatttggggctccccatatgttatgttgccagggaaggttgtggtcgccgcttgtagcgtagcaggcggggactgcctccttggtttggcctggggggagccccatacagtggtggtggtggccgttcgctcgtgccgaattcggcacgaggcaaagctaccatcgttaagttgttactagccgaagccctcagcatctgcacttgtcaattcatttctaaatggatagtaatacaaaatgtgtatgtttcctaaataatttctggggcttcagagtggtagctgggtggtttagggcatctgagcaccacattgcacagttagatctgcacaatttcagaacttcgagcagaaagaatgtgggagaagtatggaggtgtgtggactttgacacctatttgcaactgtcaacttgggaaaatagtccttcaaagctgcctgacagcttcgctgcagccccttctaccctttgataatcctttccaataagactaacaaccaacggccccgttctcgaaatccgatgagaccctatgtacacatcagaaaactccaagcatagctttgcaaccaccggagcaattttgacatctgggagtaaagtgctgagatgttttgatacaaaaggtttcgtcctcagtaaaccactctcttgggtatccagaagacaattccactccatgtccagttcatccacattagttgcagaaagaatgatcacattcttgcatttgatcagtggcaacgggagcatcttgtgatgtaataattcggtaataccttctggcaacaaagccatctcatttcgatcaccaatgtaactgttccctatggttgctagatgctcctcaaactcttcatcagggcctccataaatgaaaagctaacgttagttggtgcaaggaaatgacatgttatcgagattcatgaaacagccattggcatataacaacaattcatagatatgcagtttctacatttgatggtgctgggacaaaatgatttcttgctatagtaatagtgcaaccctgtcggtcaacacacaatattttcttagctaaataacaaacaaaatcaagaaatcacacccaagcgcaagaacagcaggaatttatacacacaaaacaatcaagcatgaattaataatataattagtcatttagcagcacagaaatgttaatgaacgcaccaggcgaactccaaatgcttttgcaacaccagccaatgaaatatctgaatgtagaggcccaagtcccccaaaaataaataccacgtcgtcagtagatttacaccgttcgacttcctcggcaacagaatcaatttcattgtgaacaaccgtgacatgagaaactcgccagccaatttcatgaagcttcttgcacaaggctgcgccaaatttatcctcaactgtgccaaacaatatttcatcaccaactacaataactgaagccgaacgtgagatcatttgctctccctcagcattgttcatgccattgcttgcaacagaattagtttccgttttgttgctagtcttcttcgctctcccagctctttcaagtcttccatctgatagcatgtatgccggtctaaagctgttcccagtagatgaatcactaagaagtgcatttggaacagtatcatatatgctcccaatggatgtatacccctcatcataaaggctgcagtatttgaccttacaggttaagaggaaagaccaaacatccctgtatgaccaatccaagataggattcaccctcataaaaggaggccagccaggcgaactaggagagaattgttcttgaccgaccgcatttggatctccaattctagtgccaatgaaaatggctttagtagacttctctttcaataggccttctagaccagatttgaaatctgatcggatagtttccagtggcaaaccataagttgagactgtttcataagtgaatgagttgatttcagggaaagcacaaggggtctcgaaatagattgtacgcagcggacagttttgaacagtattgatttgagcttcgtccccagaacttgttttgtgaagatagtatccttgcccgtattaaatgcaagagtacggttgaatccttcccgccattaaagctgaaggcaatctccccaaacgggtagagcgcgaaggctcgctggacgacgtagacggcgttgtcgtacttggtgcgcagccgggagtcgctgctcgcccggaccgccgcgtcgatctccatccccggtgaggcgacttggggcggaagaagaagagattgggaggagagcagttgtggacttgagaggaggcgtgactcgtcggcgttggacgagggaggagggatgggaagcgagggaggcctcgtgtggatatttcattcgggtgctgcggacgcgtgggtcgacc

SEQ ID NO: 19846 - DNA, 913 bp, Triticum aestivum
  unsure (1)..(913): unsure at all n locations
  Clone ID: PAT_TA_19846
cacagccaccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctccgcccgcaacggcgtcaagttcggcgaggccgtgtggttcaaggccggctccaaaattttcaacgagggcggcctcgactacctcggccaaacccagcctcgttcacccgcatagcatcgttcccagctgggcctgccaggtcacgctcatgggccccgtccagggctacccggccgccccgccgccccctcggcgagaccgtccacccgctctacccccgcgcagcttcgacccccggggcctcgccgatgaccccgaggctttcgcggagctcaaggggaaggggctcaaccgcccccgccccgccttgcctgccggttcggcggctgcctgctggccgtcgggcccggaaggcccccgacacttcctgccctcaccttggcctcccgtngccccttcgcgccgcttggctccacgttgtcccgatgtgtctgctaggctgtccacatccgtggtaaaactacgacttccgtcttcta

SEQ ID NO: 19847 - DNA, 691 bp, Triticum aestivum
  unsure (1)..(691): unsure at all n locations
  Clone ID: PAT_TA_19847
ctcgtgccgaattcggcacgaggcgaagtcgatccccacttccttctcgcgttgcctcgtgccgaataaaagaagctcctatcggaggagcagcggtctcgcgcggtcaactagctacgctccaattcttttgagatataataatagtaatggacaaggagcaacagcgccatgacgagctcgaggcgccgctgcttcccggcgacggcgggaaggccgccgccgcggccggaagcgcttacgcgctcgtctgctccctcgtcgcctccgccatctccgtcatctacggttacaatcgaggtgtgatgagcggggcgcaaaagttcgtgcaggacgacctggggatcagcgacgcgcagatcgaggtgctcatcggggccaacaagcatctactccctcgtcggctcgctggcccgcgggtttgggcgtgcgactgcgccgggcgccgcccgcactatgggcgctctccgctgccatgttcttcgccggctcggcgatcaacaacgtcggcgggaggatacgcggtgctgatggccggacagctcgtcgccggggtcgcgtggggggtttcggcctccgtccgtccccgccccgttctaanatccnccnaaaattggcgcccgggngggggtccccgttgggttcctcctcctccaatccccgaanatttnccngnaaacgncggggcanc

SEQ ID NO: 19848 - DNA, 624 bp, Triticum aestivum
  Clone ID: PAT_TA_19848
gccggccgggcttcagacaacaatcatcctcctccaccattttttccgtagaaaaagaaagaaccgccttggaagcactcagaacgcaaagccaatcaaaccagctgctgggttggtttcctccatccatcccgctcaacatggctcctcaggtgtggatggttggggaggacggcgaggacctcaagaaccacggggagctcctgcctctctccaagctccaagagattggtgtgttatactggcatttggacccaaagaagcctgaaagcgaagaagagctagcgaagatccgcaaagacagaggatacaactacatggactatcttgacatacgccctggaaagttggcaaactttgaggagaagctcaagaacttcttcacagagcacatgcatgccgacgaagagatccggtactgcttggaaggcggcgggtactttgatgtgcgcgacaaggatgacaagtgggttcggatctggataaaagaagggggcatgatcgtgctgccggctggaatttatcatcggttcaccctcgacgccgccaaccatgtgaagctcatgaggctcttcctgggagaaccagtgtggacggcgcacaaccggcctcaggaggaccatc

SEQ ID NO: 19849 - DNA, 954 bp, Triticum aestivum
  Clone ID: PAT_TA_19849
ttcgagcggccgcccgggcaggttggaactggaagcactcagagcacaagccaatcaaacgagctgctgggttggtttcctccattcgttccgttcaacatggctcttcaggtatggatggttggggaggacggcgaggacctcgacaaccacaaggagctcctgccgctgggttggttttcaccgattggtccgttctacatggctcttcaggcgtggatagttggggagtacggcggggatcgcaagaaccacagggagctcctgcctctctccaagctccaagagattggtgtgttatattggcatttggacccaaagaagtctgaaagcgaagaagagctagcgaagatccgcaaggacagaggatacaactacatggattatctcgatatatgccctggaaagttggcaaactttgaggagaagctcaagaacttcttcacagagcacatgcatgccgacgaagagatccgctactgcttggaaggcggcgggtactttgatgtgcgcgacaaggatgacaagtgggttcggatctggataaaagaaggggatatgatcgtgctgccggctggaatttatcatcggttcaccctcgacgccgccaaccatgtgaagctcatgaggctcttcctgggagaaccagtgtggaccgcgcacaaccggcctcaggaggaccatccggtgcggcaagagtatgtcaagaggctcacggacgacaatgctggtcttgctctggcagcacactgaagtttgtttgtgattcctcagctatgtattataaacacccatggacatatacatacacttggatgaaactgtgctgtaatcttgaaaccagatagatatgctacctacgtacctgttaatattcactaggtaattgcctgtgctatactgccatatcaaattattgactgtttaaacccagttttgattttaatcctctgt

SEQ ID NO: 19850 - DNA, 888 bp, Triticum aestivum
  Clone ID: PAT_TA_19850
aaattctcctatctttggcaccacttttctgttgcattgtggtcttccttggttctccctgtccttttttctccattcacccttcaatccggatagctcagttagaaaggctaggtcagagcatctctgtgcctccaaagccgccctggattcgcaattattgaggcgcctccactataaaaaggcaaccatccacaagaagtaagaacacagcgagcaagcaagcaaagcacacaacaaggacaagacagcagctgagaaccctagtactgaaccaaaagccttcacaggggcttactgcgaatgaacacccagaggaagcctggagactggaactgcaactcgtgccagcacctcaacttcagccgccgtgacttctgtcagcgctgccgtgccacgcgctcggatctgcagctcggagacggccgctgtataggtggtgtgctgacctccctggacgttcgcccaggtgactggtactgcaattgcggctaccacaacttcgccagccgctccagctgcctcaagtgtggcaccattgtgagggacttccccgcaggccagggtggcactggcgctgctgagagcggtggagttcgtgctgggtggaaaactggtgactggatatgcacaaggcctggctgtaatgtgcacaactttgcaagcagaattgagtgctatcattgcaatgcacctagggaagcaggcaccgggaagtgaggaccaatcatgccgaccgagatcgataggcgtgacgagatggcttaggacgagaccaaccattgtcacactcgcaagctccgatcctggtcactgtaacccacactgcagttcaggcgcttatccttcgccacctgctttacgactccccccgtcgcctgggcccaa

SEQ ID NO: 19851 - DNA, 973 bp, Triticum aestivum
  unsure (1)..(973): unsure at all n locations
  Clone ID: PAT_TA_19851
ttttttttttttggcgggaaaaccgtcaattttgtagaggattgacccaggttacatccaatttcgtactaaaaagcagagcattccatggtcactcctccatactctgcatccccatttgagtcgcattctagtcagcttttctttcccactctctttagaagcagcagaaacgaaccagtcgacacacttgaaccaaccatgcttgcatgctcacctacctctacctggaataacatcacaaagtacacttagtagttaagcaacaaaacctaatactactattggacgggaacaagcagacacacagactataagacgcacgtcgaggcagacagacatcgcagaagaagcagggcttgacagagctgagcagagcgagagagagacagacagacacatagacagagcaatggggttcggcgtggtgtccctcctcaacgcggtgttccgccgggccttcacctcggccggcctccggcccagctccgtcgccgtcgacgccgacaccacgctccacttctgggcgcacccctccctcctctcctcccccgacgccgagtccaagcagcgggggcggcggccggtggtggtgctgatccacggcttcggcccggacccgacgtggcagtgggcgtcgcaggtgggcccgctgtccaagcacttcgacctcatcgtgcccacgctgctcttcttcggcgcctccaacaagcggggccccgggccgctccgacgccgttccangccgccgncatcgccaagctcctccgccaaggaacaactcgcccgccgggggaatgggcgggtggttgaactngtgggcaacaactaacggngggctggtggggtaacaacctggcgngggcgctgcaacnanggaagcggaccctggaccgtngggaaagtggcggtntncaactcggacctggcnaagggccccaaggaaaaccgggcgntgggggcnaanggnggt

SEQ ID NO: 19852 - DNA, 731 bp, Triticum aestivum
  Clone ID: PAT_TA_19852
tcggcagaggagagaccgatacccgccgaccccacgcgtccgcgcagaggagccacccaccccaccagtccgccaccatggccgcccggagcgctctcctcgccgccggccccgcagcactggtcgccgtcgcggccgtcttcctcctgcccgaccccgcttcccgcctcccatgggcgcagcggggatgcttcgccgacctgattctggccaacgccaccatctacaccgccgaccccgcccgccccttcgccggcgccatggccgtccgcgccggccgcgtgctccgcgtcggcacctacgactccctcaaggaattcaagggccgagacacgtatgagctgaatctcagtggcaatgtgctgctcccgggattcatcgactcccatgtgcacctaatctatggtggcctgcaattggcgagggtcccgcttcgaggggttagaagcaaagatgagttcatcagcagggtgaagggagccgtcagagataaacatcctggcgagtgggtacgacggaggaggttggaacaatgaatttttttggggtggtgaaatccccactggctgcttggttagacgatatatctcctgataatccagtctggctctcacgcatggatggtcacatgggattggccaattcactagctatgaagattgctgggattgacaaaaactcaaatgacccagttggtggaactattgtaagaacaacggaaagagagccca

SEQ ID NO: 19853 - DNA, 774 bp, Triticum aestivum
  Clone ID: PAT_TA_19853
ccacattccgcgccatcgctcgcacccgcagggcgccagacgggcgcgaggcgcgcccggccacataccacacctcctccacagcgcgccgcgcggccatggagcgtcgccggagccgcccgccgtcggtggccgccgccggagtcctccttctctgcctggcgacgctggtggtggtcggcgcgctgctgcccgctgcctgggccgcgtcggcggacggctgcccggccggcggcgagcgggcgagcaagcagcaggggagaagtcgtggtggtcatcatcaccggaagcatgcggcggaggaggagctgtgggtgttcggcgactcgtacgcggacacgggcaacctggggaacctggggcgggagctcacccacgcctggtacgacccatacggcaagaccttcccgcgccgccccgccggccgcttctccgacggccgcgtcctcaccgacttcgtcgcttcggcgctgggcatgcgtacgccggtggcctacaaggcgcggcggcgggcgtcgcgggagaccctcgcgcgcggcatgaacttcgccgtcggcggcgcgggcgtgctcgacaccggcaacttccagcgcaacatcagcgcccagatcgacctcttccaggccatgcaccacagccaacagcagcggggctgcgccaagcggacggcgctcgtcgtcgtctccggcaacgactacgcctacgccgccgacaaggacaacggcaccagcgcggcgatcgcgtacatcccgacggtggtgcgggagcttcggg

SEQ ID NO: 19854 - DNA, 932 bp, Triticum aestivum
  unsure (1)..(932): unsure at all n locations
  Clone ID: PAT_TA_19854
gcttatcttcaatatcttgctgacatggaagagcagaatgttgcagtaaactcaaagattgtatcttcaagccagcaaaatagctgttccagagaaggaaaggacatttatgaagattatagtactgcagatggcgtatattttgtgaatgctcttgctaatgaggactacatagaaatgaaagatctattaagctcagatggctctgcatcgacttccgaattttcaagtagacggtctgaagagtactttgactctgatgcattactgagagagctcttgaatgaccaaaacacaactagagaaatacatcaggactgcaaccataacatagccggacctactaaatctgattgcgtggttatcagtccaccagaacaagggttggttcacaaccatgataatggtgccatggtggctggaacatcactggaaaaggcagcgtcagattctgaaagagatcaacattccgagcgatcagtgtctggatcaccatcctcctggcgtcttcctgttcctcaaaaccagccatgtcgaacaaagccattcaaatagttctagcagctcgcatgggaacaccacgtctccccagagaagccgattctatcccgtaaacttgggaaagattaggaaagaagtactgctgcttgggatcatccaatcccccgcatataacattcanccattttgttcaagatgggacataggaaatcaagtttccncctgagcgtgttacataggtatacaagcaaggnatccggcctggcccgtcacctgaaaaacggtgaaatnttcggcaaacangnacttcnaacacanngaaacctcatnaggtggggacagtctaaacganattccgtgacnattnaggnctaacctttgttaaaanccttgtacatnctactttcntaagngtcaatngttccccccnc

SEQ ID NO: 19855 - DNA, 269 bp, Triticum aestivum
  unsure (1)..(269): unsure at all n locations
  Clone ID: PAT_TA_19855
gagcgtaaaccaccacgagcacaacaatgagatccctggtctcggtgtccgcggccgcgctggtcctggccgccgtcctcgccgccgcgccgcggctcgcggggggcacggacgagtgcggcgccacccccccggagcaggaggccctgaagctgatgccgtgcatagcggcggggaaggacccggactcccagccctcggaccgctgctgcgcggcggtgcaggagatcgggggagagcacccccctcttctcttctgcttntctttt

SEQ ID NO: 19856 - DNA, 1206 bp, Triticum aestivum
  Clone ID: PAT_TA_19856
gccggcaagcaatccgcgcgcccccattgttctcctctccctctctctctcccccccccctcccgctccgtttctgctccgacggcatggtcgcgcccgcacccgccaagaggagacgcggcggcggtggcggaggcggggagaagaaggatctgttccacgtcgtccacaaggtgcccgccggcgacagcccctacgtccgggccaagcacctccagctcgtggagaaggacgcggaggcgtcggtcgtgtggttctggaaggcgatcaactccggggacagggtggacagcgcgctcaaggacatggccgtggtgatgaagcagcaggaccgcgctgaggaggcgatagaggccatcagatccttcaggcacctctgctccaggcaggcccaggagtccctcgacaacctgctcattgacctctacaagaaatgtggaaaagtcgacgagcagatagagctgctgaaacagaagctcaagatgatatgcctcggcgaggccttcaacgggaagatcaccaagacggcacgatcccatggcaagaagttccaggtctcgatccagcaggagatgtcacgcattctgggtaaccttggctgggcttacatgcagcagaacaactatgaagccgctgaattggtttatcgaaaggcccagactatcgtacctgatgccaacagggcgtgcaacctcgggctgtgcctgattaagcagggcagacatgaggaggcagtgcaagtactcgaggacgtcctacttcgcagaatctcagggttggatgacgacaaggcggttgcccgagccgagcagctcctccgtgagctcggtccgacaacacatgtttcatcgccctttgatattggcttgagtttcaccgaagagatcatggagagactagaccttgtgatgaatgactggacaccgttcaggtcgaggcggctgcccgtattcgaggagttagatgcattcaggggccaaatggcttgttgatttgttactaagtcagttttttaacttttaacgtgcatttgtgtgtggtaaataaaagtttatgtgcatgtatgtaggaggttttgtggatgttacaggtgtgaatgagagatttgatagattgtagatatcataagcagctagggtttatggaaagcgttccccttcggaaaaatgtggtttcagtttttaaagcagttggtctttgccccgg

SEQ ID NO: 19857 - DNA, 1315 bp, Triticum aestivum
  Clone ID: PAT_TA_19857
gccgcccgcgcctcgcccccccccccccccccccgccgcctgccccggcagcccgtccctggcccccatggcggccgcggaggtctactcgccgaccgcggcggcggcggcgcagcaccagcagcgcgggaaggcggcgacgcaggcgtggcaggcggtcgtcggctggatcggcttcctcctccaggtcctgctccagatcctccgcggcacgccctcctgcgcccagctcctctccttcgtcggcttccgctacccgctcctctcatccgcctcggccgcccccgaccagccgtcgccggaggtggccttcatgccgctccgctccgagatcccggccgacgccgcccccgtcccggcgcccccgcccgagcccctccaacgcctcacggtagtgcttgacttggacgagactttagtttctgcgtacgaatcatctggtcttcctcctattgtacgcacccaagctgttgaagctggattacattgctttgacatggagtgcatatcaactgataaggatgttgaaggaaaacaaaaggtgaatcatgttactgtctttgaacgtcctggtctgcatgagttcttgcagaaaactagtgaattcgcagatcttatcctctttacagcgggtttggaaggttatgcaagacctttagtggacataatagatgctcacaataggttcaaactccgtctctatcgtccatcaactgttactacggaatacagagagcatgtgaaagatctttcttgcctgtcaaaagatttcagtagaatcgtcattgtcgacaacaatccgttcagcttcatagtgcagcctttgaatggaataccttgtgttccattttcagctggtcaacactcagacgatcaactgatggaggttatcttcccgctcctgaagcatctctctgtccagagggatgtgaggccagccctgtacgaaaggtttcatatgccagaatggttccaccgcccgggcaggtctcgaactgatcaggcctcctaagaattgtttaggtggaggagaagaatcaagtgcctgccacgccatatgtcccttagggggagagcacttgtacattattatttatattcatttttagattctcttccctgatataagatcatgtcattgttcatacagaattgccatgtctggaggtaaaaggaaatgtaatctagcagaatgtcacatttgtattggtgtcaacatcaattgttgtatatcacctttgttgtaaaaaaaacctcggccgcgaccacgcttctcacgcgcggttccaggtctataaaaaaaaaaaaaaaaaaa

SEQ ID NO: 19858 - DNA, 590 bp, Triticum aestivum
  Clone ID: PAT_TA_19858
cggacgcgtgggcggacgcgtgggctttgcctgcagccggttgggaaagatcgtatcttggagcaagcaagaacggggaggagaggaggggagggaggacgccgtcgaccggagcttgcttgctagctaggtgctccgttggttaatggagctggcggcgccatgtagcttcagctgctcctcctacacccactgctccatcggcatcacgccggcgcgggccctccgcgccggcgccggcgcctggaggctccgcgccggggcgcaccatggcggcggggacggcgtcgagccggggcggccggccggtcgccttgccgctgatgggcctcccgtcgtcgacgtgccggccgtcgtcggcgccgcggacgggttcggaggggcgcgcgacgcggagctggccatgtgggagaagctgggcgccgtggtgaggctcagctacggcatcggcatctacgcgggcatggcgctggcggggcgggcgatctgcgacatggccgacatcgactcctccggcgggttccacccctcgctgacggcgctggtggaggggctcggctacgcgtcgccgcccatcatggcgctgctct

SEQ ID NO: 19859 - DNA, 552 bp, Triticum aestivum
  unsure (1)..(552): unsure at all n locations
  Clone ID: PAT_TA_19859
gcacgaggcgcaaagctcccgtctttcccccgcacgccacgcaaaacccagccagaccctccgcccccgcccccgcctccgcctcccccgaatcccctcctccgtcggccgccctcccgtacggcccccccgacctgacggacagcatggcggcggactgaagcgcgctcgcggctccgtcggccggcgctctcgggctgcattgggccaagatccgcccggatctgggcgtctccagctccagagaacagagcagtagatcacaacatcaccagaagccatggcgtcgttataagctgggtgttggaggtcgcaagcgctcatgaacctcatgcccaaaggacggggcaaaggttctgccaagcgcctgcgttcgaagcttaccttttgatnggtcagcggttccccgcgacnggccaggtgaagggcctgaaccccctctggcccccccgcctcgacttcaacgtctctgatccaacaaatcttcccgagctcgctcttgaagcatatgtctacaacatccacaagtctgtcgnannntccaggtcattc

SEQ ID NO: 19860 - DNA, 572 bp, Triticum aestivum
  unsure (1)..(572): unsure at all n locations
  Clone ID: PAT_TA_19860
cgcaagtggagaggcgccgtcgtccatcacagcactcccccctccgccccaaaacctctcgcgcccgcgcgagatttcgggcccgcgttggtctaggccaccgcacctggggtttccgcgcgatgctctcgctgcgtagcgacgcgcgccacctggcggcgccggtggtgcgcggcggggacgacgtatggctcggggtcagcggcggcgcggggccggctcccgaggggccagcgccagcggcggctttcctgctgccccccgtgtccttggacgcgagggccaagcagctcgtcggggttaatgaagaggaccacctggctcttgcacatcagagctacaaatcaggaaaatatagtcaggcactggagcatggaaatgctgtttacgagaagaatccacgtcgaactgataatctacttctcctcggggctatttatttccagcttcgtgattatgatctttgcatcgcaaagaatgaagaggctcttgccattgacccacaatttgcagagtgttatggcaacatggcaaatgcctggaaggagnnnnncgacattgatcnnnncatt

SEQ ID NO: 19861 - DNA, 567 bp, Triticum aestivum
  unsure (1)..(567): unsure at all n locations
  Clone ID: PAT_TA_19861
ggtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggatcccccaggaaggaaggaatggaaaggaaggatgttatgacnaaaaatgtttcaatctacaaaagctcaagcatctgctcttgaagctcaatgcagcccccaattgcaaaggtttgggttgtttgcaaaccccaagcaaaacaaccaaattgctcccaaccctgaaaggaggttttgctcncaactttatcccntgaaaaaaaaaantcanttgttttgacccccccaaaaca

SEQ ID NO: 19862 - DNA, 1266 bp, Triticum aestivum
  Clone ID: PAT_TA_19862
gagaagaaatggcagcgggccccacgccatccacagccgcgtccttccggccgcccctgccgcctccgccgccgtgcttcgactaccggtccgcgtcgctcgccgatacgcgtgccagcgccgccaccgcggaccccgcgctggctgggttggtcgagtccggtgcactggtacgcgtcccgcggcggcggttcgggccggtgccggcgtggcggccgccggatttcgctgagcccgaggacgtgtggatcctcgggacctcgcacctctccgcggagtctgccgacgaggtcgagcgcgtgctccgtgccgtccaccccgacaacgtcgtcgtcgaactctgccggagcagagccgggatcatgtacgcttccgacgacgcctccggcgagccgctgttgaaatccaacatgttctcgctcggcggcgccaagttcttcggagccgtcaaccggagcatcaacctgggtggacagagtgctcttgctctgcgtttgctcctggctgttttttcgtccaagatttcttctggcgcgaaccggccgtttggggaggagttccgagcagctaggagggtgtctgaagatattggcgctcagctcgttcttggggatcgccctattgaaataactcttgaacgagctttgaaatccctcagctgggatgaaaagactaaactcgtaatctcattattccgtggaatcacttcaaccaccgatatgccgcaggatgagaaagctgcggttagcccgtacgagttgtacgagaagcttagcagctcatatccttcgctgctgcagcctctcatacatgagcgcgacatgtacatggcttggtccctaaagaggagcaaggccgtgaacaagagcaagacggtggttggggtcatcgggaaggggcatatgaacggcgtggtgtacgcgctgatctctgaccagggggacctgaggttccgcgacctcgtcggcagggaatcgtcggagacctgggctagctccgtcgtcaagggcctggtcagggatacggtgatagggctcgccctctgggcgctgtacgaactgctgcaggctgccgccctacatataacgctgtagctgaagtccatttttactggcaaagactgacatctgtaaccgtgcacgctctttgcaacgtccatgcagcttgatgatattgtaaagtcaagtgaagtactccccctgtaaacttttataagacgtttaagggatttccgacagccccaaaaaaaaaaaaaaaaaaaaaaaa

SEQ ID NO: 19863 - DNA, 586 bp, Triticum aestivum
  unsure (1)..(586): unsure at all n locations
  Clone ID: PAT_TA_19863
cgccgccagccctggcgcggacaggcggcatccgcatctcaaagccaggcagctcaggcagcggcacggccatggccacaggaggagctacttttacttgctcgccgcggattcctcgcccaagtaccagccgggccagtcctgccggaagatccggagaaaggagcccagggttgcaggctgaaggtggggatggcaagggcaatgctgccgagggtctggaggagggccaggcaaaatctgattgcaccgatgagcaacatgatttggatggtgaggtgggccaagacgggcgaggttcttgtggtggcagtgagtatgagaagggtggggagatggagagagtccttgagaatcaggctgcgctgattgggcagtacgaggcacaaaaaaatgctcagagggagtgggaaaaaaaattcaatgggagccgaagattcaacttccngtacgtgcacacttactttcantcgagtatcaacaacgaaattattagatacaatacttatggtgcctagtacttccttcccgttaagataagttttgcacnattgaaccnttttgaaaanattaanccnttccattt

SEQ ID NO: 19864 - DNA, 2191 bp, Triticum aestivum
  unsure (1)..(2191): unsure at all n locations
  Clone ID: PAT_TA_19864
gcacgaggatcaaatggaatttctaatgggatttcacgagtcatgtccgttggcagcaatgaagctgctccaagaagaggaatggttcttccattctcccctctatctatgtgttttgatgatgtgaactactatgtcgacatgcctgcagaaatgaaacagcaaggagtgactgatgataggctccaattgttacgtgatgttactggatcatttagacctggagtgctaacagcactcatgggagtcagtggagcaggaaagaccactcttatggatgttttagctggaagaaagactggtggttacattgaaggagatatcagaatttctggttatccgaagaaccaagcaacatttgcaaggatttctggcggctcggggcaaaatgatatccattcacctcaggtcacgatcagggaatctctgatatactccgccttcctgcgtcttcctgaaaagatcggagatcaagatatcactgatgaaatcaagattcaatttgttgatgaagttatggagttagtggagctcgacaatctgaaggatgctttagttggactgccaggaatttcaggtctttcaacagagcaaagaaagaggttaggcgcgtgggtggagcttgtcgcaaatccatcgatcatcttcatggatgaaccgacatcaggtcttgatgcaagagcagcagcaattgtcatgagaacagtgaggaacactgttgacactggacggacagtggtttgcacaatccaccagccaagcattgacatctttgaagcttttgatgagttactattactgaaaagaggaggccaggtaatatactctgggaaactgggtcgcaactcacagaaaatgactgaatacttcgaggcgattcctggagtgcctaaaatcaaagataagtacaaccctgcaacgtggatgcttgaggtcagttcagttgctgcagaagtacgcctgagtatggattttgctgactactacaggacttcagatctgtacaagcaaaacaaggtattggtgagccagctaagtcgaccagaaccaggaacatcagatctgtattttcctacagaatactcgcaatccattatagggcagttcaaagcctgcctctggaagcattggctgacctattggcgcagcccagattacaaccttgtcagattttccttcactttgttcacagccttgctgctgggctccatcttttggaagattggcaccaatatgggggatgccaatactcttagaatggtcattggagcaatgtacacagcagtgatgtttgtcggcatcaacaactgtgcaaccgttcaaccaattgtttcaatcgagagaacagttttctaccgagagagggctgctgggatgtactctgcactgccatatgccattgctcaggttgtcatggagataccttatgtcttcgtccaaacctcgtattacaccctcatcgtatacgccatgatgagcttccagtggacagctgtcaagttcttctggttcttcttcgtctcctacttttccttcctctacttcacctactacgggatgatgactgtatcaatctcaccaaaccatgaggttgcaggcatcttcgccgcagctttctattccctattcaaccttttctcttggcttcttcatcccaagaccgaaaatccccaaatggtggatctggtactactgggatttgcccattgngcatggacagtgtatgggctcatagtgacacaatacggagacatggaagacatcatcaccgtcccaggccaacctaaccagacaatcagctactacataactcatcattttgggataccacaggagcttcatggcggtcgttgcaccgggtgcttgtgctccttgcagtggtcctccgctttcatgtatgctctctgcctcaagaagttgaacttccaaacacggtcggggcagaaggccaacggacaaatccgcaggaatatggtcgattttcttgaacaactcttcttttgncttcantttnggtcaattanaatgccagtgtaaaacagngtatttttggatccttaatnncaaatgcatgagggtcacagccttcagcttggagtcattgattgcaatttgaanacgtcgatacanattgtcatggctanaataatggngtttacttcaagggggccggtacaatccctaatganng

SEQ ID NO: 19865 - DNA, 592 bp, Triticum aestivum
  unsure (1)..(592): unsure at all n locations
  Clone ID: PAT_TA_19865
gcctccacccccggcctcccttccaccctctctttctctcccccgcgactcccctcgccgccgccgtctccggctccggccgcgattccggcgagttccggcggcacgcagcacaccgccgagaccccctcgctccggcgcttcctcccatccggcagattcgctagctcgatcgcaaccccagcctcgtggctagggttgggttgcgggcggggccttcttcctcgccggccggctcgagttggccatatccacggngcccgtcctcctccacgacctcaaagccctcaggatacgtaggcggctcccaagccatgggaatgggatgggttccatgggaactaagcccgacccccatgggaaaggggaaatgaaagggccaccaaaaagcaagctccctccgggtcttcccccaacatgggaaggnaatccatgggaaagccgccgcccgccggcctccgtccgccgcctgaccccccgggaanaatcctgnncggtncccgtttctgggtnttcctggccatnaaaccaanttacccctgaagctaccgnaaacnccanaaatngcnctcnttgattggaattaannaag

SEQ ID NO: 19866 - DNA, 596 bp, Triticum aestivum
  unsure (1)..(596): unsure at all n locations
  Clone ID: PAT_TA_19866
ggcccgacggaattcacccaccgtctccctcatttctttacccaccatttaccttattaccgcacaaagatctcgcccgccgccttcgattccgtcccaaaaatccgagctttcagcgggagcagggctggtggggcgggggtcggccatggacgcgatgccgccggagggcattgtgaaggaggaggaggtgctgctgcacgaggagcgcacgcacccggcggccgcgccgccgcagcatcggcaggacggggcgctgccgcggccgatggagggggctgcacgaggcccgggccgcccccgttcctcaccaagacgtccgagctgctggagggcccggccacggaccaagtcgttgtcctcggggcccccccccgaaacaccggcctcctcctggggccccgcccgcccgcccccgctcgcccttgctcccgccgcctctttaaagcactccaaacttctccaagctttcgtcccgccaactcaaaaanctnatgggttcaaaaaaaggttattcctgaanaaaattgggaagttttgaaaattaaaggtttccntaaggggtcaaaaggaattcttctcaaaaaacattaaaa

SEQ ID NO: 19867 - DNA, 563 bp, Triticum aestivum
  Clone ID: PAT_TA_19867
taccggtccggaatttcgggtcgacccacgcgtccggaagaaaaatctctcggcgattctccggccaccgtcctctccccggcggcgtctcacccgatggcgtccggcttccatttccctttgctgccaccggcgaagatcgcggagcagctggtcgagttcgatgtcgcccccttagctaacctccgcgccgagcacatcgccagcccgcagcccgacctgctcccgtgcgtcctcgaccgcttcttcgactacgtcgtcggcggccccggggacggcgaggacgagcagctagggttcagcgagctggaggcgctggacaacccggagcaccacgaggaggccatccggctgctgcgcctctacaacaagtcgcaaaccttcctcgagtccatccactacagggacttgacgctcgccgacttcacccacccgacgccgcgccgggtcgtcgaggtcctcagcgccctcatcaacttcctcctctacaggcacgacaagacggaactcctgcagtccatcgtcagcgagtcctccgactaccacgagcgcggcctggagct

SEQ ID NO: 19868 - DNA, 1322 bp, Triticum aestivum
  Clone ID: PAT_TA_19868
gcacgcgccaaagaggagcttgcacaggtaaaacatcttgaaaaatctcaagggtgaacgaagtttcttggcgggcatgcagggcacgagagacatgtctgccaagggcggcaaggccctggtccagtcggacgcggggaagtatgtggcgtggtcgggcgtcgaccagccggagctcgctgcagaggggctcgggtgtggcttgctcctgctcaggccgctctccttcgcgctgccacactacgccgactgccacaagttcggctacgtcctccgaggctccggggtcgccggtgtcctcccggtcgccaccggggacgcctcccccgcggccagggagagggtcgtgcgcctcgaggccggcgacgtcatagccacgcgcactggggaggtctcgtggtggtacaacgacagcgacggcgatgcgggcgacctctcaatcgtgttcatgggcgacacggagcgcgctgtcagcccgggggacatgtcctacttctttctcgccggcggcaacagcgtcctaggcggcttcgacgcgggcctcctcgccggggcatggcctggcgtgaccaaggagcaggccgccgccgtgttccggagccagccagccgtcctcctcaccgggctgagcaagaagctgcccggcgtccgcccgcgcgaggacgacaggaaacggctcgtcgtgaacgccggccaagtcgctgcaggaaccctgaagacgctcaccgcggccgacatggcggcgctgggcggcctggggatcagcgtggttctcggccggctcgagcccggcgccgcgcgcgcgccgtgggtgctacgcgagggtgcggcgcagttggtgtacgtggcacgcgggagcgcgcgcgtccaggtgtcttcttccgcgggcggcgagacgctgctgctggacgaggaggtcgccgcggggagcgtgttcgtcgtaccgcggttcaccgtgacgctcatctccgccggcgccgacggcgcacagtgggtctccctcatcaagagcgccaggcccgcggtggagcacctgaccgggggtggctcggtgctcggcggcctgactgcgcaggtggtgcaggcgtcgctgagcgtggcgccggagctggtggagctgctcggaggccgcagcgccgagccgtcgcactgagcggtcggtgcacgcgttcgcgccgcggcgtccgttcactttccgtggcgtgtgtgtcccgtatgctccgttgacgtgcaccacacgattgtatttttatacgctgttacgtctctatacgtgcttacttacgtgaatgagcaaaataattctgtgcattgttgtactc

SEQ ID NO: 19869 - DNA, 582 bp, Triticum aestivum
  unsure (1)..(582): unsure at all n locations
  Clone ID: PAT_TA_19869
atcatcttcgcgggcatccagatcctgctgtcgcagctccccaacttccacaagctctggtggctctccatcgtcgccgccgtcatgtccctcgcctactcctccatcggtctcggcctctccatcgcaaagatcgcaggtggggtgcacgccaagacgtcgctgactggggccgccgtgggggtggacgtcatccgggcctgagaaggtctggaggacgttccagtcgctgggggacatcgccttcgcctactcctactccaacgtgctcatcgagatccaggacacgctgcggtcgagccccggcggagaacgcggtgatgaagaaggcgtccttgatgcggcgtgtccaccaccaccgcgttctacatgctgtgtggggtgctgggctacgcggcgttcggcaacaacgccccgggcaacttcctcacggggcttcggcttctaacgagcccttctggctcgtcgacatcggggaaacgtttggcatccgtcgtgcacctcgttggggcctancaaggtcttctgccaaccccatctacaattttntccnaagggcttgggccccctccccggttggnc

SEQ ID NO: 19870 - DNA, 617 bp, Triticum aestivum
  unsure (1)..(617): unsure at all n locations
  Clone ID: PAT_TA_19870
cctcgtgcccctccatcacctgggtagcaacacagtcttcatggcggcggtcaagatcgccgtcctcctggccgcgacgacggcgctcttcgccgccgcggcaggggcggcggacccccagcccccgcagctcgcaacggaagcccagtgctggccgtgctactcctcctgcatgcagacgtgcgacgcccacggcggcacccccgcccccgatgtcgtcaactctaccgacggtagtgcagttgttgcacactccaccgtcggcgctccagctgtcatccacaaaaccgacgatggttcagccgcccccgttgctgacggctatgacgacaaaggcggtaacaaaggtggcngcgggggatgactaacgaanaaatacttcngagtgcaagaagaaattgcatcgtcggttgcntanaaggacctggccgnccggtgtgctacaaagaatnngngttctcccaanacctngncctcaaccctgccanccaatntttaaaccgaagggggatttgctttcnaaaancattgcggggattaaaatngntttccannaaacaaccccnttatcccgggggcnaaaacccggggntncaaaaaactnccnaaggnccant

SEQ ID NO: 19871 - DNA, 557 bp, Triticum aestivum
  unsure (1)..(557): unsure at all n locations
  Clone ID: PAT_TA_19871
gtgttagtcgtacaattcgccgggagcaagaccaaattcaacaaggcaataaaacaaagcgtggagcacctaaagaacatccaatattcccagagcatacgaggagatcgctgtcgaagggtctgcactcactggatatgtcgtggaataagatcacaaatgtcgaggggctctgggaactgatgaacctacgcgtgctcaacctcatctacaactggatttcatgcaccggactgggtacatacttggagataacatgatggtaagaaggcaagaagtaggtacatgtatgagtgggtttctggagtctcaaggggcacatatgaagtatccacacgaaagcatgttgggtacctgagggcttgtatcagtgcccagcatgacggcgaaactattctctgaaaaaattgctaattgaatcctctgttcaatgggggctacattccttctaaaacttctgtnggcggttatcaacacgatttttaaatccacgggggtntnttgcgncacaatnttancaccttttncnaaattnattgtgnaatnccttaagggaa

SEQ ID NO: 19872 - DNA, 557 bp, Triticum aestivum
  unsure (1)..(557): unsure at all n locations
  Clone ID: PAT_TA_19872
caccgcctccgcctcctcttccgccaccgccaccgccaccgccaccaccaccagcaaaaccctacagcacggacccggccgagccatatggctagcttcggcgtcgacacgcgtccccccgcggcgggggagggagcgtctctccttcctctcccggagcctgcgggaggacctgcgcctcatccgcgcgcgggccggggagcttgagaccttcctcagcgcgccggtcccggagcccgacctcttcgcgcgcctccgcaaggcctacaacaccacctcctcctccgcctccgcctcggggatcgggaggacgcgcctggacctgtcggcgatagggaaggcgttcgaggctgaggtcgggagggggtggggggccaaaaccgggtggangtgggaggacnaacgacgcccccgtngtgggaagccatacngggccgtcaaagggcgcnccctnaanggaacctcgaccgcaancgnccaaggaaccaangtcaagcgaacctnnccccacaatgggcaangccccaaccctgaaaatccnattanntttngcaatc

SEQ ID NO: 19873 - DNA, 1198 bp, Triticum aestivum
  unsure (1)..(1198): unsure at all n locations
  Clone ID: PAT_TA_19873
nnagngncgtaanccctgttaaaacccncctaaaggtancaaaagctggagctnnnncgcggtggcggccgntctagaactagtggatcccccgggctgnntgaattcggcacgagcgatgtttcacgccaacgnggnattactgagagctgcgacttatggtctagctttctgcagtcgatttccacacggacgctttcaagaaatgtgcaaaattttacgcgttctaaatgctgttcgtgaccctgagattggaatgccgcttaccgtgaagcagtacaaactgcttactgcaactgtgctcattggacgtctaattaatgctaatcagcatcttttggcacttcgcatctctgagtaccttaacctaaatccggaggttgtgattatgcattgggcatgtgagaagagaacagcctcagctgcaattccagatgtagttcttcttgaaggtttgcttggcaagctcaggttatgcaaaggcatatcgtatgctgcagtggcagctcatgcagataacagcggccggcgaaagttggctgccatgctcgttgaccacgagtcccagtcctcgaagcagattcctttgttgctaagcatcgatgaacaagacaaagcattacagaagtcaattgagagcggtgatactgatcttgtgtaccttgtgcttttccatatctggcagaagatatcctgtagaaaaagagcgcccccttgggattttttttggggtgtaatcaacgcaaaggcctttgggctagagaatttggtcaatagcaatatgccagacaactcctaagcaatgaaaacttttgaagggacnttctttcctatcaaccgggggactgcatcccagcgggcgctcggtcgtcccggtgtcttgggaaggggggccgagtccaatgggcgagcagggggccctcctggcatggcnccccggggccgccctcntccccaagcccccaagcttttggcgggtcccccttgaccctcgtcctgaaacccttttttngcttaaacactcacaaattnctaagggnccncattaactnaaantttccccnaacnagcntttttggggggtcnaanggccnnnntccantaaaacttnttttnaaggggaaannnccactnnnncannnngaannngnttnnggnntcnnnaaaanggnccnnngtnaaannnnnnntttnannn

SEQ ID NO: 19874 - DNA, 520 bp, Triticum aestivum
  Clone ID: PAT_TA_19874
agagggaacatcatcaagcccaggcggtcgcgaccggctgcggtgaggggtacttgtgccggtggccgcagcactgcttggcgccgcctccgttgccggcggttcgccaggcgaccccggctgtgtggtcgtggtgaaacgcgcgtggctgtacgaccacgaccgacggaattgatatgttcctctttgccgatgcgtgtcgcgtcgatttgtgtttgtggtgtccagttcgtcgaaatcagagcacgatcattcttttttttctgatggaaagaccttcctgcccagctttattaaaattcagataatgctgaaacttctcacagtgagaagtaacatacaatagtaacttgccgatgttactagtctatgttactacctacatagtgggtagtaacatataagtactattatgaaaaagttcatttattaggttatagactcattatgccttgaaatgtgtgatgttacagtaactacctaagttaccataaaccccgccctcccggccgcgaattcg

SEQ ID NO: 19875 - DNA, 689 bp, Triticum aestivum
  unsure (1)..(689): unsure at all n locations
  Clone ID: PAT_TA_19875
gaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctggtgaccaagatcgacaggcgatctggtaaggagctggaggcgctgcccaagttcctgaagaacggtgacgctggtatcgtcaagatgattcccaccaagcccatggttgtggagaccttccgccacctaccctcctcttggccgcttccgctgtgcgtgacatgagacaaacggttgctgttgggtgtcaatcaaagggcgttggagaaagaaggacccaccgggcgccaaggttaccaaagctgccatcaaagaagaaataagcgtgctacctagcagatgtttttcgttcacggcattcttttgttgcttcaaaccctcatcccagcgatactgatctgtcttcctttaattaccgattccatccctcgtccggtaaccctgtgccctgagacgatgttgtgaatccaagggggggccggcaccatncncctanatgatcnataccncccantgcgtcgttaaactcngacnggaaactgggtacaactaacnctgagaaaacccttccactg

SEQ ID NO: 19876 - DNA, 491 bp, Triticum aestivum
  unsure (1)..(491): unsure at all n locations
  Clone ID: PAT_TA_19876
tgttcaacgacatgagcggcaaccacgtcggcgtcgacgtcaacggcctcaactccgtcgacgccgacaacgccggctactacgacgacggcaccggcgccttcaggaacatcagcctggtggaccgcaagcccatgcaggtgtgggtggacttcgacggccggaccatgcaggtcaacgtcaccatggcgcccctgcaggtggcccggcccaagaagcccctgctctccgccaccgtcaacctctcctccgtcatcgacgacactgcctacgtcgggttctcctcgtccagcggcatcctcttctgccgccactacgtgctcgggtggagcttcaagatgaacggcgccgccccggcgcttaacatctcctcgctgccgtcgatgccggtcacgttccccaagccgcggtccaaggttctggagatcgtgctcccgatcgcgtncgcgctgctcgtntttccgcgtgcggcggcgtcttcgtgtacatgc

SEQ ID NO: 19877 - DNA, 2294 bp, Triticum aestivum
  Clone ID: PAT_TA_19877
cccggccgctgcccacgctcgtcagcctcccccccagcggcttcctggcctgcagcgccaccgccctggcggcccgctcgaggtcgagggggtcccccgggcggcccggctccggccccagggcttacaaagccgtggcagagtatggtcttaatcagcgcataggcccaatatcactagctacattgtcaaatggtgggctagatgattctggaggctctccatttggaagggaccagggccatctggttgatcttgtccaaggggaagtaaaagcacttctacagtcagcacctggcgctgctctgcctgggtggcgtgcttttccggcagtttaattgcagtagttcttcagcgactgccaataagcttttctcagcaatcaacaggccagctgaggaatcgaaagaatttgaacttctggtggggcaaaagtttcagaaactgccgatatagttcctgtccctcatctggctggaggcccctagcctcaggagtataaattggagttttagacttaattaatttaacctagcgccaaccgctaaaattctgtaaatccagagggatttaatgaaagtccacatgcccaagtgatgctgtatatatatatggtcgcgggtgcccgtgactcgcgccttgcccaagctgtggctgggcgagcgctagcccctctcattagtggttcggccagcggattgctgccgctgctcgtcagcgtgggagcagcgcgtgtgccgggacgtgctcctgtaaaaaaacattcttctccctccattctttcttttcttgcgattgatgccgtggcaaaaagtcgtgatggccggtaccgaatcgtgggcaacgatgagcgtgagcagacactaaatcaactgctcacggaaatggatggttttgataccaactcagctgtcattgtacttggagcaacaaacagggcagatgttttggatcctgcccttcggcgcccagggagatttgaccgtgtagtcacggttgaagctcccgataaatttggaagagaatctatcctgaaagttcatgcgaacagaaaagagcttccgcttggtaaagatgtagatctcagcggcattgctgcaatgacaactggttttacaggggcagaccttgctaatttagtgaatgaagctgctttgttggctggaagatcaaataaagaaatagtggaaaagatcgatttcatcagcgcggttgagcgctctatagctggcatagagaaaaaacatgtaaagctgaagggcaatgaaaaggctgttgttgcacggcatgaagttggtcatgcagttgtgggaactgctgtagcaaatctgttgccaggccagccacgtgtggagaaattgagtatactgccgaggtcaggaggtgcattaggctttacatacactcctcccacgacagaagatagatatttgctctttgttgatgaactgcggggacgtctggtaacgcttctgggtgggcgggcagcagaggaaatagttctagcaggacgggtttctactggggcacttgatgacatcaggcgtgcaactgacatggcttacaaagccgtggcagagtatggtcttaatcagcgcataggtccaatatcactagctacattgtcaaatggtgggctagatgattccggaggctccccatttggaagggaccagggtcatctggttgatcttgtccaaggggaagtaaaagcacttctacaatcagcacttgaagttgctctttcagttatccgtgctaatccagcagttttggaaggacttggagcatatttagaagagaatgaaaaggttgaaggggaggaactacaagagtggcttaagtctgtcgttgccccagaagaattgacctcttttatcacaggaaagcaagaacatgttcttcagctggaagtaggcctctagcatcaggagtataaattggagtcttagacttgattaatttaacctagcgccaaccgctaaaactctgtaaatccagagggattcagtgaaaaaaaaagtcctcatgcccaagatgctgtatatatatacggtcgcggttgcccttgactcgaggaattccagaagtgattatcgagttctaacctccacaatattgtaagtccatctgtttgctcctctacaatgttgttatagggattaggcaggtggtgcacatgtaaaagaacattctcttttcttcatacattcttttttttcagccctcccagtgaaagattcatgttacattatcatgtcatcaaatattaatagaaaataattcaaaaaaaa

SEQ ID NO: 19878 - DNA, 519 bp, Triticum aestivum
  unsure (1)..(519): unsure at all n locations
  Clone ID: PAT_TA_19878
ggcccggctcccccggctcgctcgagaacgccgcgcacaccgccgtgcacatctgggtgggcggggacatgggggtgctcggcacggcggggcgcgaccccgtcttctactcgcaccacgccaacgtcgaccgcatgtggcacctatggaccaccacgctcggcaaccaggacttcctcggcgccggcgccggcaccgaggacgactggcgcgacaccagcttcgtcttctacgacgagaagcgccggcccgtgcgcatcagcgtccgncgacgtcctncgacgccggccggcctcggggtcacgtacgaggagaaggagacgctggagtggcggggacaaagcgggcccaaagcccggcgaccgggataagacaagaccgggcccgcccnaagngtccccggcggccctctcctttcccggtggntnctaaagaaagggcccggaaanggaattactttacnggttggaaaaaggcccgganggaaggcccggggcccnnccggggggaancaacaaa

SEQ ID NO: 19879 - DNA, 736 bp, Triticum aestivum
  unsure (1)..(736): unsure at all n locations
  Clone ID: PAT_TA_19879
gggggntcgatgnggtctgcacccaaatcagaaggtttggccacccttaacaatatcctcatcggatataacttggggaaggcgaaggcgtaccccctactatataagctcagccacccacgccccaaacaaatcacaaccaaccttcctcaagtcgtttcttcccccgagcaatcgagttgtgttcccggcgatcgatcgatccatcttgctgagcatcatggtttccgccgacgtggcccgcaacatcgtcggcatcatcggcaatgtcatctccttcggcctcttcctctcccctgtgccgacgttctggcggatctgcaaggccaaggacgtggaggagttcaagccggacccctacctggcgacgctcatgaactgcctgctctggttcttctacgggctccccatcgtccaccccaacagcaccctcgtcctcaccaatcaacggcatcggcctcgtcatcgagggcgcctacatcatcatcttcatcatctacgcggccaagaacacaagggggaagatgctccgcgtgcccgccctcccggcgggcttccgggctgcgggggcccccggggggcccggcggcgccccctcccggggcccgcgccccatggtcgtagccgccccctgcgtctccgtcggcttctccttctgngttaattttncgggctccaatcaatgttntngnccttccccccgccncaacaancnaatgggttaaatttttnaagg

SEQ ID NO: 19880 - DNA, 527 bp, Triticum aestivum
  Clone ID: PAT_TA_19880
tcggggcaccgcttgaaatgctgacctgagctgcacccccgtcgtccccaggttgagcgctcatcgtttctaagcacgccgtgtgcgtgactgttcgttctttgcgtacaaggagaggcagcaagagggtcgcttcggtccagccatgttttacctcgtgatatcgatcccggcgatcctcctgttgctcgtcctggcgctggggtgctacatgctcggccggaaccgcggctgggccgaggcggccgcaccgcagcagttcgcgccaccggcgccgcccaagtagcagcaagcgaggaaatcttcgtcagtaacgctatatgtatgccggtttattcccctggtttgctttcagcactgctgtattttctttcttacttttgtccttagatgttccaagtgtgttctttatccttgcaacgagtggcaatagtccagccaaggatgtttccccctgtaatcagtaaaaatgggtgaagtgctcctcttcttgatgcaaatgtattgcttgaccttgatgcaacttc

SEQ ID NO: 19881 - DNA, 724 bp, Triticum aestivum
  Clone ID: PAT_TA_19881
tttgcggtctcatctcagcgcctcaacttgttgtacaatcgcactgcctacaacctcgtccttccaattgttaccacaaccacactcggagccagcgccctaaaaaaagttgcaccatggcttaccgctgcgctcggcattgtgccccaacctagtgttatttgtcctatccatatactctttgtcgttgttctactgatcatcatggctaccgtctacctttcactccatcgtagagctgtataccttgttgactatgcttgctttcggccaagctccaacttaagattaacaaaggcaacattcctcgagcatgcgcgtctctcacctttgttcgatgattctacagttaacttcattgctactattcttgagcgctcgggcatgagcgatcatacatgtgccccacctgtgcatcattatatacatccgtattgtgggcttgatgaagcacgcgccgaagtagagttggtcgtcttctctgtcatcgatgaccttatggctaagacacacatcaactgcggtgcgattggtgctcttatcacgaactgcggtgcatttagcccggtaccatccatggctgacatgattgtgaacagatacaagttgcgaggtgatcttcgtgtcatcaacctctctgggatggcgtgctctgcagcggtgacctcagtggggctcgcaagcaacatgttgcaggtcatgccttgggggtcgcatgtgttgg

SEQ ID NO: 19882 - DNA, 512 bp, Triticum aestivum
  unsure (1)..(512): unsure at all n locations
  Clone ID: PAT_TA_19882
caaaccccacacggcagccgcgagcccacgttcccccccaccctggatcgcctgccttcctccacacacaaccctagcccgccggccaccaaccatggagatctcagccgccacggccacggccggctcttccccgccagccaagccggtgctcctccgcccccacgccacctcctccgctaccaccaccatcagccgccgcgcctccgcctccgcctctaccaccgtccgccgccgtcgcgcgcgcacccgccgttccaagaccatctccggcgcgggcggcgatgacggggagggccctttcggacccggaagtggcgggagcggcggcggcggcggcggcggcgggtggaacatggtttcgggtccggatctggtcaaggctgggactcatcggagcccgactcccacgcccgccgattggcggcggagtggcgctcggcgtgattacagctcattgctcatnggctctcaaatgcaccagtttgccgtncgagntcccgggtctcncn

SEQ ID NO: 19883 - DNA, 559 bp, Triticum aestivum
  unsure (1)..(559): unsure at all n locations
  Clone ID: PAT_TA_19883
ctcgtgccgaattcggcacgaggaaccaaccctagccgcaccaacgacccacgagccaagatccgtagtcgccgttgaccgaagatggcgatggcggctctccgatgcgccgccgngaaggaggctcgccggtggcggccgccttctaccgccggcgctcagccggcctcgccccgccgctcccggcttgggccgcccgaatctcacgctcacgcaggccttctcatcgcacgggaaagaagaagccgggagggaggtcctggagcagatccaggagaagaaggagaggctctacgacctcatcctgcgccacggctataagcgcaacgacggctccatgtgctactcaaacgtccagctcatgcaccatctctccgcgcacatcaaacctaggccccaaagcatcgcctggcgttaccttcggaatgtgcatagcctctatattctctggatgtgcttcagccctgggcataagcgcctacgcaatctgggaacatctacaaagcggggggcatcagcttggccgctgctcagcgccgacgtgagttagccgacaacg

SEQ ID NO: 19884 - DNA, 518 bp, Triticum aestivum
  unsure (1)..(518): unsure at all n locations
  Clone ID: PAT_TA_19884
ggccgacgggttattccaccttttgccgacacatgggacatccagcatccaggtcgtgtcatgcaagaaaatagagtggtagttgaagccatgatatgtgcatcttgggttaaactgtaaatagaatcttactactcttgagcaactccaaaagcggccaccgaagatctttattggatttgtttttcatcaccagcacgtcaaggtgaaagatgtgcaggttccgtgggtcctctttgttttcactgacatgtgggaccgcatgtgagcaaacagacgatgggctccgcgcatccgctggctggctgagaagagagatagaggagggctgagcacggactccaggaaatttgttctgcgtaaccaacacctcgatattcgcgggtgggcgtgtgccataactagcatcatgtctatcagtacggcacacgccacccacacgagtacatccgacacaatttcctgggatnccntgctacaagcaactctctcctnctttttctnacnacgccggtgtg

SEQ ID NO: 19885 - DNA, 996 bp, Triticum aestivum
  Clone ID: PAT_TA_19885
aacaaaagaaaaagattcacatttatagtggcgctgaaacagcaatatcgtcaatatggcataattacaagggtagtgagacgaaccagtgtctattatgtatgatcaattaatcatatctctacaagaaattgaaattattccaccttccggtagaaaatataaagatatagtcatataggtggtacattagagataaaagatgaagaagctgggagtctcaaacatgattatttaccataaaccctttatcctaatcatgtgctttgttgccaggaaaatgattatttgctctgacaaatcttttcaatttctctgctggaaactcccggaactggctcatctattcactgttacacatttttttacagcataaaaaatttagggacaacggctggacctctcaaaacagcaactgtatctcacaaagcactcacataaagtatttcagaatcttggtcaagattaatgtatagaagactgatagcaaagcaccaactggaattgtgactacccaggagaccacaatttcacgcacagtctctgctctgactctgttgagacctcttgcaaatcccacacccatcactgcaccaacaagtgtatgtgtagcagatattggcaacccaagcttagatgcaaacaagaccacagaagcggcagcaaactctgctgcgaacccccttgtgggtgttaattcggtgattttcttgccaattgttgctatgactctataaccccacattgtaagccctgcgacaattccaaaaccaccccaagcaaggacttcagtcggtatgactatctcagcgctgcttgctacgccttgaagaagagacaaagctgcggccagaggccctatggcattggagacatcattgcctccatgagcgaatgacatgaagcatgctgacaggacctgcatgtagccaaatacgccgtatacaatctgcaattgagctcctctagggccagcgacgtcaaatccaccttgct

SEQ ID NO: 19886 - DNA, 579 bp, Triticum aestivum
  unsure (1)..(579): unsure at all n locations
  Clone ID: PAT_TA_19886
gcacgagggaactgacaaataatctgctgatgcttcctctggttatgctggtccttatcatatcaaagacagtggcagatgctttgaacgcctccctcgggcatctgcctgtgtcatgggaggcctgtccttgccttggccgccatcctgcaccctgcttgcccctactgtcggttggtgatcttccacccggccctccccagacattctaccgctgggcgctgggtggccgctccgtggcttccgtgacggcggccgctctcaatggttgcccggtcgggccggcgcccccattcgcaccttctcccctccgctccggtccaggtccgcgggcgcacccgcttcgtcctctggcgtggagtcaggccgtctgtagttccccacctccggcgcccgctgcgtcgttgctggtcgcacctgaggtgtctgcttcccgcggctcgaaaaagtataagagctttagccaaggacatggtctcaaccacagtgtaaggggatgtgtttgtgaaaggatgcaatctacaaacatttccagttcttctgcatcattaattcctcaantcgtcatgcttcctgaac

SEQ ID NO: 19887 - DNA, 772 bp, Triticum aestivum
  unsure (1)..(772): unsure at all n locations
  Clone ID: PAT_TA_19887
gnnnnagcaattttaaacctgaggacgaattcagaccggtgcggacactgattgtcttcacggacaagggagctccttccttgccttggagtgacattcgtcaggcaaacagcacactcagaaagttcaagcatgtcaaggtactggatttgacggatacagtcataactcaggtgcctgatagtgtgggtgagctcacacatctgcggtacctaggtgttcctaacactgtgaaccaccctcctgctcaaattcccgagctactactgttctacatcaaccatgaagcaaccaagagggcacccatgatgcagtctgcgcccctgcccaatcctggtgccggcggcgccggcaaggcgcccctgcccaatcctggtggcggcggcgccggcaaggcgcccctgcacaatcctggtgctggcggcgccggcagggcgcccctgcccaatcctggtggtggcggcgccggcagggcgcccctgcacaatcctggtggtggcggcgccggcaaggcgcccctgcacaatcctggtggtggcggcgccggcaaggcgcccctgcccaatcctggtgggggcggcgccggcaaggcgcccctgcacaatcctggtgggtggcggcgtcggcaaggcgcccctgcacatcctggtggtggccgttccggcaangcgcccctgcacatcctggtggtggcgcatcgcaaagcgccctgnaaatcctggtggtggcncccggcaaggngccctgcaaatcctgtggtggcgnctcngaa

SEQ ID NO: 19888 - DNA, 1292 bp, Triticum aestivum
  Clone ID: PAT_TA_19888
ccggccccccccccccccactgaaatccaggacaggcaagggagctgctaggctctagctgcttacttagccttggtcgggagcaacgaatcgagccagatttcatgccttcctagctcgcccccgcagacacacatcgcccgccgcgcccctgcctgagtcagctttcacgttgctggttgggagggtgagaggttcaggggcaagagatcaggggtctcgggggcgggtcgcggcaaggtagtgctgcagcggatcgaggaacaagatcagccgccaggtgacgttcgccaagcgccgcaacggcctgctcaagaaggcttacgagctctccctcctctgcgacgccgaggtcgcgctcgtcctcttctcccacgccggccgcctctaccagttctcctcctcctccaacatgtttaagaccctcgagaggtaccagaggtacatttttgcttcccaagatgctgtcgcgccgaccagcggggacatgctcgcctcccatctggcggccgtgccgccgaccgctggggtgcaggtcttccatctcgcgcatagggagctcctggctggggttgtggctccactgcgctcacccagggctcgcctaggcgaggatttggctccactgagtacaatcgagcttgaacagcttgagggtcaagtaggcaagaccttgaggctgcgaacggcaggaaaggctccagtactgctggctgggatgcgcgacctgaagcgaaaggagcagatattgcaggatgcgaagatgaccctgaaaggaaagctgggcgagatccagctggaggcgacgcctgatcccccgcagcagccgcaccagcagcagatgccgcagggcgtccggggcgtgccgccccacacgcctccgcagccacagcacttcttccacgccctagagcgctatcctcccctgccgccggtgtttcgtggcctcgatgggaaccagccgccgcctgcacggatggcatagctacgcacccgcattggtctgtctaccgttccagtcgatcaacaagatgcaccgcttggcatgagcgattatctatctcaaaaacaatcaacaacaagatgcgttgcctgcctatgtgtcctgcatctccaataggctcctatatatatcaactcggctgtttttgtgtttccttttcaagtgcttgtggatttattttaagtaatgtgtacagggtttgtcttatttgttattagcaagtgtttgggatttgatttacagtagcgtaataaaccttcctttcccgatacatgtaggcaggctcacg

SEQ ID NO: 19889 - DNA, 490 bp, Triticum aestivum
  unsure (1)..(490): unsure at all n locations
  Clone ID: PAT_TA_19889
gcacgagggctccacccgcgtggataagctcgcaccgctcgtgctctgctctccctcccagacacacacacacacactgcacactacacacgctctctctctctctctctgcttggcgatcttctgtaccgagctcgcgaggaggaaagccgccgccgcatcgatctctctcgaccatggccgcgcgagcactgaccgccgccggccgccgggtggccggccggaccggggcgacgcctcttctcgcctcccgcaggaacggcgccagcatgaaccactcctcggccaccgcgcggcgggaggaggagccgtacaaggacgtccgcgcccccgctgcggcgatgacgggggcgcaggtggaggcggcgctcaaccgcaagaacgtcgaggtgctccagggcgaggagcacgtcgccacggtgctgcccgacgaggccatcggcggcgcgctggacggcggcgaggacgcggcgtgggtgcccgaccaggn

SEQ ID NO: 19890 - DNA, 663 bp, Triticum aestivum
  unsure (1)..(663): unsure at all n locations
  Clone ID: PAT_TA_19890
cgaacccatcgctacagcggtgcnnnntcgcctcacccacccacatcaccaccgccgaaaaagaagatccnnnnngaaacggcgaccgaggaaggatgccgtctgcgcgggcgggggtcttgctcctcgcgggcctttgtctatggtggtcggcgaccggcgcgctggcgggcggcggcaacggcacggtgtgcctgtgcacgggcccgcagtgcgtgccgccctgccccgtcccggggacgccgccgacgacgtcgcccacgcagttccccttctgcccgcagcggccgccggcggtcgggcccttcccctgggagcagcagccgccggcgtcgccgaggtcggggtcggggttccctcaggacgcgggcttcctcgcggcagcagcggccagccccgctaggaatccggcggcgtggctggcggtggccgccttgtgctctgctttcctgctgctcctgcactagtaaccctctatctggctagctcatccacccctgtagatcgacggatgttgtctgaatactgagcggctgctgtgctgatgtctgaatctatatgtatgtaattctaggtcttgagttcaattctaaaggcaatcaacgaacggtcggtgggggtccgcgtgggttcctcgacgcggccgcgaattcggnaaaataa

SEQ ID NO: 19891 - DNA, 749 bp, Triticum aestivum
  Clone ID: PAT_TA_19891
gcacgaggcaagaagaaccgcttccaagtcggcgacgtcctggatttcaagtacgcggccaaggactcggtgctgctggtgaaccacgacgactacaagatgtgcagcacggtgacccccctgacccggttcgcggacggcgacaccaggttcaagttcgaccggacgggcttcttcttcttcgtcagcggcgtgccggggcactgcgaggcgggccagcggatgatcgccagcgtcgtcgggcactccacgctggccgccgctccggccaaaccgcccgccgtcggcgtcgtcggcggccacgcgcccggccccagccccagccccaaccaggcggtctcggccccggagtccccgtcgtacgggtccagttctggcggatccacctcgacgaccggtttcggacccagcccgtcgaccgagcccagtggcgcgtccaggcgggcgctctccactgtcacagggcttgtcgccagtgtcgtcgccatgatcgcgttggcgtgatcttacttggaagaggttaatgtaggctatcgatcgttaggtctgtgtcatcggtgtagggattaatgttagtctcgagatctataggtaatggtagggaggaacatctgttcaagtcaaaaaaaaaaaggggaggaacatctgttatcgagtcttaggtgaattactcaggcgagaccttggtgtcatgtaatccattcgatccagtcaaataaaatggaaataaatttcgccttaaaaaaaaa

SEQ ID NO: 19892 - DNA, 671 bp, Triticum aestivum
  unsure (1)..(671): unsure at all n locations
  Clone ID: PAT_TA_19892
ntgtntccccattaatgacnagtntttgcnttgacntatnaaatgtcgntagngtgggtcaaacatatcatcattntgcagtggtcaccgactctattcctgatcaaatatcaggaattttctttggttggaccaagtcagaaacttctggagtctttaaagcggtggtcagcactgggtgggatctttcaccgggaaaatttgaaagagtgatgcacatatgctttcttgattctcattacaaggccaaaacagaggatcacttggagcttttattaattggctacatccggaagctccaaagctcggaaaatatatctcaagcaatgaacataactgatgaagaccaggccactgcaagagatgcactagacctcccagctttctctgaatatgcaaagacaaggggtgcattggacctcccagccttacctgaatatgcagagccacgaaacggacttcttcttgcctgacgcctgacgtgccactacaagctatctgatattattgacaaaaattgcgggtatcgcttatttcccttataaagacatgtagggattgctgggagagttgtaagagctgccgggaacgaagcttgcactacattcatgaaggtggaatctctcgatattctcaatttcttggtatcttttgacagactcacatcagaa

SEQ ID NO: 19893 - DNA, 629 bp, Triticum aestivum
  Clone ID: PAT_TA_19893
gcccgagcaaaaccggcagccggtcgccacgatgttccgacgcgccaagaccacgacgatagccacaccaccctccgatggcgaggtgcgggtgcataaggtcgagaagattgagcttgtccgcaatctcgtgaccaagccgtcgatctactacggcgccaacccgatggcagcatcgaccatgaggcgaggtgcagccggtcacggcacggccgccaacaccggtaaggctactgggcgcctcgaggccgggggtcgtgtccatagaggatattaacaagaggtctgaggcttacatccgggagaggaagaggctcttccagggcctgaagtagctccagatatatggagatgatcttgcactactattgatcacgtctacatatacacaccgactaatggatgtatgcatgtgtggaatttcccctcgatggatatgtaagatgtgctaatgtaaacgtgttgtcgtgtgatatcgatccacttgttgcaattaattgtgtgtcctcttaggaagtgtggagtcaagtcctcttagaaagtgtgtagttaaatctttactaccgatgtataaataaacgattattaagtgcagatatataaacaaaatataactcaaaaaaaaaaaa

SEQ ID NO: 19894 - DNA, 1545 bp, Triticum aestivum
  Clone ID: PAT_TA_19894
ccgccgttgcggctaccatggggaacgaaccgctccattcttctggcggcagcggcagcggcaacttctcttccagctcggagatgggatatggctcttccaagagctccatgtccgcggccagcccctcgtcgtccacccccgggtccagctcggcgtgcgcttgggcgcccgtcacagccaccgccagctccctgagcctgcctaccgccgtgcgtgtgggtgataacacgagaactggaacatctccgtcgcctgtggtggcagtgagcagtggagagccggtgatcggcctgaagcttggcaagagaacttacttcgaggatgtctgtggagggcagaatgtcaagagctcgccatcgggtgctgcgagcgcgccaaacaaatctcctgctttgggcaagaaggcaaaggcggaacaacagaagccacataactcgtactgtcaggttgaaggctgcaaagtcgacctctcttctgttaaagattaccatcgaaagcacagagtctgtgaacttcactctaaggctccgaaagttgttgtcgctggtctggagcgacgcttttgccaacagtgcagccggtttcatgctttagctgagtttgaccagaaaaagcgaagctgccgtaggcgtctcaatgatcataattcccgcaggcggaagccacagccagaagcaatttctttcagttcatcaaggatgtctacgatgttttatgatgcaaggcaacagccaaatttcctatttggtcaggctccttatgttcaaatgagaagctgtggaagttcttcatgggatgacccaggaggcttcaaagttacacacacaaaagctccttggttaaaaccaacaactgctgcaggtgttcatgggatacatttatctagtcagcagatgtcggacaatattatgccacatggtgcacatcatggtttcgatgggttcatggcattcaagggaacttgtacaaagttccctaatcaaggtgtccaagcttctgctgttgcttccgactccagtggagccccggatcttcagcatgctctctctcttctgtcaagcaacccagtgggtgctgccaacctccagccaagtccccagatgcactctggggtggcagccattgccggcgcccccaaccccgcgatgcacgcgctgggatcatcgacggggctctggctagacggcagccagcccctcgatgatcacccgcggttccaggtcttcgagcgcttgggggaccatgacagcgagctccagctcccaaagccttcctacgaccatgcctcgcacttcgaccggatgcactgatgatggctccggtccactgggtgcgtgattttgtcacgcgatcaacgccgtttcttcggcctgaaaatcgtaatgctgaatttactttgctttgacgccgttgcctgtctagaggcctatggttttggcaatgcctagaataaaggcgcacacgaacagacttaggatcaaatcgacccagttgtgttgccatggagaaagattttatccatcattagccatttgtctgaat

SEQ ID NO: 19895 - DNA, 638 bp, Triticum aestivum
  Clone ID: PAT_TA_19895
cactgaacttttctgttatttaattgcatcctggctgcgctaacagataaccaagcatctatgcttttctgttacgatcatatcaaaaatctgaaagaaaaacaaaaaataaacagaggagagaaagagggaagggaacaggacaagtgaaaacaacataacaagtctgatgatatctattttccccagatgtatcagttcatgctacagatggagatggacagcctaataatataccgataaaacatggcttacagtttcgacgagccctacaattcagtagtagaaattattttctgaaccgaagaaaaccagggaccattgcctggcctgctctctcccatgaacaaccgaataaccttcctcccagcaaccagagatccttggagactcctcagcctcaacagcacgggtagatggtgacggagcgccgcttcggcggggtgcagaggagcatgaacaccagggcgatgacggccgcgacgaggagccccaggaagctgaaccccgcctcctcctccgactcgctgctgcagcacaccttccccatgctagcctgagcagagaggttgcttcccggtgctgcctacgctggtggtcagtggtgggcggacgcgtgggcggacgcgtggctcgcc

SEQ ID NO: 19896 - DNA, 690 bp, Triticum aestivum
  Clone ID: PAT_TA_19896
acgcctagcggctgccgccgccgttattgtcgggtccacccagccaaaagaaaaaaccacaccaacgaacttggcctccatccaaaaatatggcgtccaagtccaactacaatctcctcttcgcggccctcctagtcttcatctttgccgccgttgccgccgtcggcaatgaagattgcaccccatggacgagtactctgatcactccactcccaagctgccgtaactatgtggaagaacaagcatgtcgtatcgaaatgcccgggccgccgtacctcgccaagcaggagtgctgtgagcagcttgcaaacattccgcagcagtgccgatgccaggcgctgcgctacttcatggggccgaagtctcgcccggatcagagcggcctcatggaactccccggatgccctagggaggtgcagatgaacttcgtcccaatactcgtcactccggggtactgcaacttgacgaccgttcacaacaccccatactgcctcggtatggaggagtctcagtggagctagagacaattctctcgctcatgaataaataagcatgttgcgaccatacatgtgtgacatgcatatatacatataggacgagctccgcgcgctcatcatgtgtggtgctatctgctatatatatggataataagaataaagggaatcattttcgcttcttaaaaaaaaaaaa

SEQ ID NO: 19897 - DNA, 2236 bp, Triticum aestivum
  Clone ID: PAT_TA_19897
gttgttaggcgagagggacggagggcgtgctccctccctccaatcttcttctcttcttttctctttctctttctcttgtgctgtgtgccaagccatacccatacatacatccacccaacccaccaccaatcactgccagcagcgacgacggagtgagggaagcaagcacggaaggagcgctcggatggcgatgggagcggctgtgcgggaggcggcggcggacggcgtcgtgaccttcctctgggtgctctgcgtctcgacgctcggcgcctccacggccgccgtcaccacctacctcagcctgcacgaggggatccactacgccctcctcgtcaccgtctccatcctcgccctcctcctcttcgccttcaacctcctctgcgacgccctcggcggcgccagcttcaaccccaccggcgtcgccgccttctacgccgcgggcctcaccagcccctcgctcttctccatcgcgctccgcctaccagcgcaggccgccggagccgtgggcggagctctggccatctccgagctgatgccggagcagtacaagcacatgctcggcggaccctcgctcaaggtggatccccacaccggcgccgtcgctgaaggggtgctcaccttcgccatgtgacaaaacaaacctataccaacgaactgggcctgtcaaaacaaatatggcgtccaagtccaactgcgttcccctcttggccgccgtcctagtctcaatctatccctccgacccaacggggcccgacaaagaaagcgacaaaacaaacctataccaacgaactgggcctgtcaaaacaaatatggcgtccaagtccaactgcgttctcctcttggccgccgtcctagtctccatctttgccgccgttgccgccatcggcaatgaagattgcaccccatggatgagtactctgatcactccactcccaagctgccgtgactatgtggaacaacaagcatgtcgcatcgaaacgcccgggtcgccgtacctcgccaagcagcagtgctgtggggagcttgcaaacattccgcagcagtgccgatgccaggcgctgcgctacttcatggggccgaagtctcgtccggatcagagcggcctcatggaactccccggatgccctagggaggtgcagatggacttcgtgaggatactcgtcacgccggggtactgcaacttgacgaccgttcacaacactccgtactgcctcgctatggaggagtctcagtggagctagagacaattctctcgctcatgaataaataagcatgttgcgaccatacatgtgtgacatgcatatatgcatataggacgagctccgcgcgctcatcatgtgtggtgctatgtgctacatatatggataagaataaagggaatcattttcgcttcatgcccgggaccgccgtacctcgccaagcaggagtgctgtgagcagcttgcaaacattccgcagcagtgccgatgccaggcgctgcgctacttcatggggccgaagtctcgcccggatcagagcggcctcatggaactccccggatgccctagggaggtgcagatgaacttcgtcccaatactcgtcactccggggtactgcaacttgacgaccgttcacaacaccccatactgcctcggtatggaggagtctcagtggagctagagacaattctctcgctcatgaataaataagcatgttgcgaccatacatgtgtgacatgcatatatacatataggacgagctccgcgcgctcatcatgtgtggtgctatctgctatatatatggataataagaataaagggaatcattttcgcttcttaaaaaaaaaaaaaaaaaaaaaatacagccatgctctccgtctccaccgtcagcctcgtcctcaccggcgccgcatacaccggcccctccatgaaccctgccaatgcctttggttgggcgtatgttaacaatctgcacaacacctgggagcagctgtacgtgtactggatatgccccttcgtcggtgccattctcgctgcgtggaccttcagggccgtgttcccgccaccagtccctaagcccaagaccaagaaagcatgatgaactcaagcacaaactttgacttagcaattgggggacctgaagaagcgaacatggtttgatagggaataatttgaaactgtatttaatcacctcaatgttacaccgatgtttaacttaaaagtgatcatttatcagtcattcatgttaccgtgtgaaaa

SEQ ID NO: 19898 - DNA, 732 bp, Triticum aestivum
  Clone ID: PAT_TA_19898
gccggccgggctccggaattccatatccgccacccaccttcccctgcacacaactctccaccgtagcccccaatccccacccatcttcccggagcagcgatggcccccaaggcggagaagaagccggcggcgaagaagcccgcggaggaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccctggggagctcgccaagcacgccgtctccgagggcaccaaggcagtcaccaagttcacctcctcttagattccattgcctgtatctaaatagctgttcgccctggttatcaccaagtagaagtagtgctagtgcttgatgggagttgctgaatgtttgccgatgcttcgttcgctgtaagaacagaattatgaatctatggtgccgcttttgccaaaaaaaaaaaaaagggcccta

SEQ ID NO: 19899 - DNA, 872 bp, Triticum aestivum
  Clone ID: PAT_TA_19899
gccggccgagggcgagcttattccatatccgccacccaccttcccctgcacacaactctccaccgtagcccccaatccccacccatcttcccggagcagcgatggcccccaaggcggagaagaagccggcggcgaagaagcccgcggaggaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctctgtccgcctcgtcctccccggggagctcgccaagcacgccgtctccgagggcaccaaggccgtcaccaagttcacctcctcttagattccgttgcctgtatctagtaccagatgtggttgttcactctggttatcgccaagtagaagtagtgctagtgctggatgggagttgctgaatgcttaccgatgcttcgttcgctgtaagaacagaattatgaaccttatggtgccgcttttgcaagctgagatttagcagcgttgcttatgatctgactgttgtttgcttttctgctcttctgaaccgaactgtgccactggactgaacatctgtattgttaatggtaggtttcagttctctgaaacttattggattggttgcaaaaaaaaaaaa

SEQ ID NO: 19900 - DNA, 926 bp, Triticum aestivum
  Clone ID: PAT_TA_19900
cggacgcgtgggcggacgcatgggttctcatgcaccctcgcccttctcctccgctctcctttcccttccatcgcttcgatcaacagaaggggaggaaaacatagccaagcttctaagctcgccaggaaaagagcttagcttccattgatcccaaagggcttctggcatttggtgcctgtgctttttctcctcttcttttcctaatcccaaggaggggagaggaggacgaggctaaacaaaaagctcaggcgccgctttggctaatggcctagctagctgctcagggcggcgcagctggagtgctggacggacggccggcctaggggtggataagagcctgagactttgctaccagcctttcctcgcctccttgtctcctctttgagccgctcctttggcggtgtcctctgcttggttccattccatggtgggcatggagggcaccggctgtggcgctttgctcagagagctccagcaaatctgggcagaggtaggggaaagcgagggtgagaagagcaaggtcttgtcagagatagagagggagtgcttggaggtgtaccgcaggaaggtggacgatgccaatcggaccagggtccagctgcaccaatctgtggccaccaaggaagctgaggttgcattgctaatggctactctaggggagcacaagctgtatctcaagaaagacaagggctacctgtcgctcaaggaacaactcgccactgtcgtccctgtactcgacgacctgaaatgcaagaaagaagaaaggatcaagcaatactacgatattcgatcacagattgagaagatacactccgagttaagtgagcgtagtgataaggctgatcatgtcaacagtccagctgatgatgaacatgatttatcgacgaggatgttaaatagctaccaagcgcaacttagtgctcttc

SEQ ID NO: 19901 - DNA, 836 bp, Triticum aestivum
  Clone ID: PAT_TA_19901
aaaaaaaaacactctggtcgccggttcgacgccgccgccggctccgcctcttccgcccgcgcgcgcggcgccgcccccccacgccacctcgccctcccccccctgcttgccccccacccaggcccgcttcgccgccccccgtctccagtccagctccgccggcgatggcggccgagcagccgtcggagaagaagaagccgccgccggagaagaaggccccgctccccaaggtggtcacgctcaacaaggccctcaagctggcccagacatgggtggacggaatgagtgcgctggagccggatgaactgaatgataaagattttgagggtcggccttcagggcttggccttggagctaaagtggcgccgaatgcgaagcgggcagctcccactatccggtggagaggaggttgctcgggaaggtgaatgcgcagaagaggaagtcagcggaggaagagaaaataaatactcaggaggtgaatgaggcgagtgatgatgatagcggtgagcctcaaggtagaaccagtgcttgtagcaagaagagggaattgccttccgttacttcaatgccattagggaagaaggccaagtgacagtttgtatgcatggaaccatctgaatattcatacatggcttgatgttctagtcagatttttacaaacccctaggcgattcggtttccccggcctgcacccgcctggggctactggttatttgtcgggctcagcggcgccgcattttctgaaggccctgtggcgtccctctgtgggtggttccagcctggtccccctgaaaaaaaaaaaaaaaaaaaaaaaaaaaaaaaaaaaaaaaaaaaac

SEQ ID NO: 19902 - DNA, 713 bp, Triticum aestivum
  Clone ID: PAT_TA_19902
actatgcaaaatttagggaaatggttcatcttgcaattgatggcatctggcaggtcttcaagcttcagcattcaacgccaagaaatgatttctgtcgtatagcagcaaaaaatgggatacttctcaggctagttaatactcttcatagcttgaatgaagcaacacgatttgcttccatctcagggtcaggtgctccaggacagaatggttccacccccccgtctaaaatctggtcagctagatgtgccgatgctagaaagttctaaagtaaggctggatcattaccattcatctggctccatgcagtcgttacaagcagatgctgataagcaccatatcttattggatccttcagcatctcccaggttcaatgatatatctgccgctggtcacatggagagaaatgataatgacctggtaaggccacagcggcttagtgtttctggaggaaggtcatcaacagacagatctcccaagcatatagaattagtatcaaatggacatagtagtggtcagaatgatcaaatccggcctctactgagtttattggagaaaggacctccctcgcgtcctgtatccggtctgcgtgatgttgcccgccgcccgccccgccccgcggcccttgtctgtttttcgcccctgtgtcgtcccgcccgcgagaggaaaacaaacggtgaacttgacttgctaatggcagaatttgctgaggtctc

SEQ ID NO: 19903 - DNA, 653 bp, Triticum aestivum
  unsure (1)..(653): unsure at all n locations
  Clone ID: PAT_TA_19903
gaattcggcacgagggggaatgaatcatttcaagctcgtagatattcggaagctgtggaacagtattcagcggctttggcatacaatagtgattcacggcccttttcagctgtctgcttttgcaaccgtgcagctgcatatcaagcacttggtcaacttactgatgcaattgcagattgttcactagccatggttctcgatgcaaattatcccaaggcaatttccaggcgggctaccttatatgagatgataagggattatggacaatctgctaatgatttacggaagctaatctcacttcttcaaaagcaagccaataagcctggagtatcaccaaaagttttcaacaagcatagtgacctgaagcaggcgcgtgctcgacttctatctgcggaggatgaagcaagaaaagatactcccttgaatttttatttaatcttgggagttgaaccgtcctgttctccagcagatgttaagaaggcctaccgaaaagctgcattgagacaccacccggataaggccactcaattgcttgtaagaaatgagaatgccgatgatgggttttggaaggatgtcgcanaggaggtttatgcagatgccgaccatctgttcaaaacgattggagaggcatataatattctttcagatcctga

SEQ ID NO: 19904 - DNA, 484 bp, Triticum aestivum
  Clone ID: PAT_TA_19904
acgcgtgcgacacacatcttgggcagtcttcattcctctcctctccaactcgtcgcagccgcaaatcgcaaggacagcaggagctaacccgacgaggccacgcgaccaccacccaccggtctagcgcctcctcgtcgtcgccgttgcttcccgccctttccctcggttccgcctgaaatcgcgatgacgaagaagcagcgcagggaggctggcgccaggcggcagcagcaggcccgccagcggctgcggccgtcgccgctgctgcaagcgcgcgacgagcgctccgtctcatgcaccaccttcaacatcctcgcgccgatctacaagcgcatggattctgagaatggcagggagagccagaacagggccaactggtttagcaggaatgagaaaatcatcgaccgcctcctcggcgatcgctcctccatcatctgcctccaggaggtgtggttgggggaatgatgagctagtaaacatgtacgag

SEQ ID NO: 19905 - DNA, 643 bp, Triticum aestivum
  unsure (1)..(643): unsure at all n locations
  Clone ID: PAT_TA_19905
cctgcactgagccagccaccgcaaggaggaagaagaagagggggagagagggggtaagaagaaggtttcggttcggacgagatggcgccggcgccgctgcccctgctcgtcgccgccttctccctgctcttcgcggcggcgactccgatcagggacgtcgccgacgcctgctcctcgcaagtgcaggctgcagatttcgagcacctgaacagcaccgccatgcacctcccgctgcaccactcgcgggggccctgctcgccggtgtccgtcccgtcggacctcccgttctcggcggtgctcacccacgacgacgcccgcatcgcgttcctcgccgcgcgcctcgccatggcgccgtcgtcgttctcggcgcgccccgcggtcacggagggtccgctttaccgggcgctaccgggcgaacgacgacgtcgacggcgtcgcggcctccctggcgtccgtgccgctcacgccgggcacgtcgtacggctatgggcaactacgtgaacccgcaatggggcctcgggcaccccggccaaagccgttacatcaatggtggtcggacaccggcgtcctccctcaacctggctccagtgcctccccctgccgggttttcntgcaaacgccaattccgggcccggttttcnac

SEQ ID NO: 19906 - DNA, 376 bp, Triticum aestivum
  Clone ID: PAT_TA_19906
ctgctctcgctgggcgtcaccggcgccggctacgcggcctaccgcttctacgacgcgcaccagaagcagctcgtccgggtggagcagcgcgccgcggaggagcgcgccgccgacgagatcatcaagaatcacttggaagcccattttgagaaggtgcagaggatctccgatacaaccacgctgccgtttgctatgcactacctacgttcgcgggtaatggacgagctggatatttcgcacctgaccgagaggctgctgcaagggaagggcgagctgacgccagaggacaagtacgagacctgcgagaagatcaaaattctgagtttcacaatgacagtgtcttcaatgtgggccatgacattgctgagcttatatg

SEQ ID NO: 19907 - DNA, 679 bp, Triticum aestivum
  unsure (1)..(679): unsure at all n locations
  Clone ID: PAT_TA_19907
gcacgaggcttctcttctccccctcgccgccgcgccctcctcccctgctcccccccgccggcgcccccacctcccctgcccccccgcgcctctgctcccctcctgcgcccgcgaccgatggagcagttccatcacggccaccacgtgcggctgcgcagccgcgtgctcggcacgtacctgcacgccgacgaggacggacatggcgtctccctccgcctccgccgggcgtcgatgaacgcggcttgggcggtgcaccggcacccgcccccagaggcgtttgtgccgttcctgctcctccacagcgccgcctacggtcgctacctcgccgccacggacgtgccggcgccgcccggccaccacgggcgccgcgtcgagcagcgcgactacgaccatccggaggtggagccactcggattgatttggctccccgccctgtcggcggccggagacaaagtcttcctccgcaacttcaacggcggctgcctccgcgccaacgggaggtaccgcccctggaacaacggcgccagtgtcgacgacgtcgacgtcaacgacatcggcaacctcagcacgatgatgcactnnntcgtggaggacatccccgccagggagatcatgcctctccttccacgcccggcttggcttaccctccccgccgtcatatcgccgtcgcgggtgatcg

SEQ ID NO: 19908 - DNA, 654 bp, Triticum aestivum
  unsure (1)..(654): unsure at all n locations
  Clone ID: PAT_TA_19908
gcacgaggaaaccatccgtccaccgaccaagtttaaagatacttatccaacatgtataggggacgtatcggtttcagatatgtaccgatatgggtgcgatgctccagtcacgtatcagtgtttttgagataaccactggatgatcagcttttgaacaaaaaaattacgacttggtccatgggttaagtttctaagccggacccggtcattccttttttttttttgaaccgggcataacccctttccattataagcataagggacataaaaccatccgtccaccgaccaagtttaaaggaaacaaagaaaggggaaagtgagttcaacgcatcgccaggaaacccactggaagtgcccttcatcgaaacacttgatatggggtgaaaacccgatgacacctaacaataaactatccaaaaggcagggaaagttcaaatgagtctaggagaagctcacaagcaagcataggctaccaaggacccggtcattcctgccagggttatgcatccccgcatcttcctcccatcgtgattgtgcatggttctagtgaatataatattttcctctgccaacatgcatttttgaccccgatgattcttattgatcagtggnnnnnngcattcatatccatgaatcgtnnnnnntacctnnann

SEQ ID NO: 19909 - DNA, 427 bp, Triticum aestivum
  unsure (1)..(427): unsure at all n locations
  Clone ID: PAT_TA_19909
ccgcgcggccgtttggcgcgcccctggcgtggcggcggcgctccacccccgccccggccgggtgccgccgggagataacccaagcccccccccccccgccggccatccccccgccgccccggcggcagccgcggcagcagcgaggccggacccggatcggccgccccccccggcgagcagcggccgcccccggcgggaccccgcggcgccagcgaggcggtcctcccgccgccacgcccgcagctccccctcccccgcgcccgcatcgtcctcccgcgcggagctggatcggtctcccgagctgcgcgggctgactgtgccgaacaccgtgtgctggcctcctctatcgtggagtggggggcccctccaccgtgcatttgcagggccctccgatgtgcatgaacagggaactatgatgnnnntgttc

SEQ ID NO: 19910 - DNA, 470 bp, Triticum aestivum
  unsure (1)..(470): unsure at all n locations
  Clone ID: PAT_TA_19910
agcagatcttcaccgtctgggaccgctggctggcggagcggttcccggagagtgacttcgcgtgccggacctacgccgtgaggctcgtgccgggcctgccgcgctacgggctgaacctgcagcggctctgcttccggacggcgtacgtggcgagcacctccgcccgggcccggctcgtcccctacttcaacgaggtgctgggcctgctcggcgcgctcatcttctggccgctcatcatctacctccccgtccagatgtactgcgtgcagcgcccgggtccgggcatggaccccgacgtgggtcgcgctccaggccttcagcgtcgcctgcttcgccgtcgggaccttcgcattcgtcggcgccgcaagncttcttccaaaanagtccgntatcctaggcacgcccgaacatgttgtnttntanagtctttaatccaattcaatncttcgcttttgaacaaaaaaaaaaaa

SEQ ID NO: 19911 - DNA, 608 bp, Triticum aestivum
  unsure (1)..(608): unsure at all n locations
  Clone ID: PAT_TA_19911
gcctcatcaaacaacctcttaatccaagtccaaggcaaatcaaacctccggcgagaatgctgcaggcggtggtctccaacccgcaacccgtcgccgcgtccctggggccgcgtgctccttgccgccccgggcgaggctcggtgagggtccggtccaccaggaacggacccgccgataaccttgaccagctgcggaggcccccgacggcgacggctcgacagccgcggcaggggagcgggagtcctgctccggggagccggctccgccgagccgcgccatccgggccacgccactgcttccccgacgcgccagccccccgcccgcgcgtgccctccaccgggcgctgcgcacccggggccgcagccggcgccggcccgcccccgtccgcggcccccgccccgccctcggcccggcccccacgcggcccccccccgcgctaccgcccgcggccgacccccgcgggcggccaccggcgggcgggggactacctggtgcggttcgacatgccgggcatgacgtgccgggccgggcgcgggagcgcgcgcgcccgggcgcgcnnnagcggtcgccggtggggggccccggcanggtgnnnnnnacggagagnn

SEQ ID NO: 19912 - DNA, 574 bp, Triticum aestivum
  unsure (1)..(574): unsure at all n locations
  Clone ID: PAT_TA_19912
gcacgaggccatcatcagcgtagcctccttccacgcaaaagaatcggatcgctcggggcgctcggggcgcgccgggaggccccgcgcgcccccgggcgcgccgccggttccctctctctccgtcggccgctccggcggcgggagggagggggaacctcgggtctgttcgccaggtgggtgtgtcgtagggttagggttgagggagacgctgccgaggccgttgcggtggtgtcgcgtcggaataagtttctccgggctccgttcgcggtcaggcgaggcttttgctttcgtctaggagccagcggggttggggatccccggatctcgtcgaggtcgcggctatggtggctggaggtccatcggcactggccgtttgggtcctcagatgggcgatggatgcagggagacgaagacctttcttctcccttgttggtatgatttgctgctgttctttttctccttcctctgcgctgatgctggtgggagatcttgcnnngcccggacggatggcccggccgcggtgctggacnggtcggatgactcgagttctnnttcttccgggnnggacactttt

SEQ ID NO: 19913 - DNA, 1346 bp, Triticum aestivum
  unsure (1)..(1346): unsure at all n locations
  Clone ID: PAT_TA_19913
gcacgaggctcctccactccatccctcccctgcaccgcagcgagcagagtccggctccactccgagcgcccctgcgccgcagcgagggggacaggctcgctctacgggggctagggaggcagggggcggtcgctctcatccattgccgcctagcttgggttggttgcttctcttccctcccggaggcaacccaagaaagcggagcgcacatgcttccccgggtccgcctcagagtcccccgatgtcgccggtgatcagcgagatcctactctccgggtttatgatcaactccacactccggcgccgaacccacctcgtccagtccttctccgtcgtcttcctctactggttctatgtcttctcataaactactcgcccccgccgtcgccctccccctcctctccctcctcctcctccttttagccctcctgctcatcccttcaagctcccctcgtcccacacactcgcttactctctcgctcgtcgtcgtcgtcgcagtctctctagagtcagtccgtagctggttatcgagtccatctttggttcttgcaacaacaacaaaggaaagcagagagtgcttgtctgctcgcttgcttggtggtgatggcgtcctccagcgggagcgggagcacgggctcgctgtcgacggcgggggcggccatggcgatggcggccgcgtcgggcacggaggaggagatgcgggcgctcatggagcagcgccgggccaagcggatgctctccaaccgggagtcggcgcgccgctccgcggatgcgcaagcagcgccacctcgacgacctcgccgcgcaggcggcgcacctccgccgcgaagaacgcgcacgtcgccgccgcgctcgggctcaaccgcgcggggcctccaggccgtcgacgccgagaacgccgtcctccgcacccaggccgccgagctcgccgcgcgcctccactccgctcaacgacatcatcgcctgcatgaagcgccagcaacaacaccgccgccgccgtcgcgctcaccgtcgccgcagccgccacccccaccaccgccgaccgtcggttccgacggggctcattccgangantctcttcnaattctcccccgaatntcatttcccaagcctgcaaagttanaccacncacggcatggaacaanacaagacgaggcaacaaaaggatatcacttttccngatgtccgggttcaagttaggggggccggaccatngcccanagganctttagccgtaacngcctctttaaagtntgcnggaaccggggtnccactatnctnnaaaacccttncacnggtannaaagcnacgttncttcaaatngactatgatggacnccgtcggnn

SEQ ID NO: 19914 - DNA, 524 bp, Triticum aestivum
  Clone ID: PAT_TA_19914
ctgttgttttgggcccccctcatgatgggcgcggcgcgctcggtttctggccggcgggccttgtggccccgctcgtaatgtccatcctgccgtcccacccaagctggggccccaactggtctcttcggatcattcaatcctgcccgtgcctccccaggttggcaccgtgtccgggccctcaccgggcactcatgagcaatcgtcagtggacggtgctgcgtcgtcgtacgccggtttgcccgcattccccgctcccaacgcgtcttccctgccttcgcgcgttttcgtcggtccccacccctgttgtttgcacgcttccgttggtgggggcattctgccagccccgcgcccagctgcgtcacccgccgcccgggatcactcttctacggctcatcgtgctgcgtcggctccccgttcgccggcgtcccctgcacccggcccggcctccccgccgtcgcgcggtgtcggcggtcctgataccatgattcagaatgatgaaagcaatgttaccagcaggaggccaa

SEQ ID NO: 19915 - DNA, 466 bp, Triticum aestivum
  Clone ID: PAT_TA_19915
cccacgcgtccgcaagaatgcagtacgatattggacgttgtagaatcggcactgcctatgggcttaccagccaagtttggagatggtagtaacttgaatgcaacaatacacagtgccgttgagttgcttcctgagctatggaaattagcggatttccctcctaaagtgctctcttcatataggggggctcttcttagtaattggaatctggatgcaaaggccattggtagaatacagaaggagtttgctatttttctcctatacagtggctgtgaggcctgcactccacctcttcgatcccaattggatggttcatttgtacctcggaataatttggaggaagctattcttcttttgatgattttattgatgaaattcaaccttaagaggcttgagagagacccaactgtgatgcatcatctgacttttgcattggccatatcaagaccgggttaaacctttggcc

SEQ ID NO: 19916 - DNA, 2084 bp, Triticum aestivum
  Clone ID: PAT_TA_19916
cgtccgcccacgcgtccgctctgggactattccatttcagagccctcattcaacagagtccataatgctttcttctcaaccttctctcaagattgttgatctgtccagcaattctttatctggtcagttgccaccagaaatttctaacctgcaaagacttgaatcccttactcttgcgatgaacgagttgtctggcgagataccagatgagataaacaagcttcaagggttggaatatcttgatctatctcacaatcatttcagtggcagaattcctgatatgcctcaggctgatttgaagatgttcaatgtatcttacaatgatctacgaggaactattcctaaaagtcttgagaagtttcccataacttgctttagacctggaaatgactttctaattttcccagatggtctgcctgctccaaatagtggcgatggtggacttgcacagagtcgagcgtctcaatctcatggacataaggctggtgttaaagttgcagtcatcgttggctgcattggaggtgtcttgctcgtgatcttcatagtattggcaatctatgtggtaaggtctcaagagctttgtggaagaaacggatttagaggccagattactcccagagatctaaagctcgggaaattaagccgtccaaatttgttcaagaatcaaaaagataatgtcattccaacgaagacaagtttctcaaatgaccatctcttaacagctgcagctcgatcaatgtctgctcagaaagagctattggctgaggctgctgttgaatatggatatgctgatccaaaggaagtcgtcgaatctacaagctctggtgtgactgagacctcagctgcagcatctgttcgggagtcttctcctcggtctgcgttgccatcatcaccacattttcttgattctagattccatgaggaacctgtgacttttgaagtgtattcaccagaccggttggttggagagttgattttcctagacaacaccttagttttcacagctgaagacctgtcccgtgctccagcagaggttcttggaaggagcagtcatggtacaacgtacaaggcagcactacaaagcgggcatgtcctgacagtgaaatggttgcgtgttggtcttgtaaagcataaaaaggagttcactaaggagataaaaaggattggcaccatcaagcatccgaatataatttcatggagagcgttctattgggggccaaaggagcaagaaagattaattatttctgactatgtcaatggcgatagcttggcactatacctttatgagtcgactcctagaagatactcgcgcctgtcagtctgtcaacggctcaagattgcaattgatctggcccgttgcctccagttcctacaccatgagaagggcctgcctcatggcaacctgaagcccactaatatattcctgaccggtcctgacctctctccgaagctggttgattactgcctccattggttcacgactccaagcggtattgccgagcaaatactgaacttaggagcattggggtaccgagccccagagctggcaaacacggccaagcccatgccgtcattcaagggcgatgtgtatgcgtttggcgtggtcgtcctggagatgttgacgcggaaaagcgcgggggacatcatctcggggcaatccggtgcggtggacctgacggactgggttcagatgtgcaacagggaagggcgggggactgactgcttcgaccgggacatcgccgggttggaagagtcgccgagggtgatggacgagctgctcgccatctccctccggtgcattcttcctgtaaatgagaggcctaacatgaagactgtctgcgacgatttgtgcgccataacagcgtgagcttccccgcgttttttctttctttcatcagttcaccagtgtacatgtaaccgatttttctcgtcgtcgtcgtcgtggtgcatcccaaatcttttttctgtgggttttccagagccctgtaggcagggtttgtttgattggtgactcttagtgtaaaaagaggatttgatcccgtccgtccattgattgattgataccattgccaaaaaaaaaaaaa

SEQ ID NO: 19917 - DNA, 446 bp, Triticum aestivum
  Clone ID: PAT_TA_19917
acgatgagcgtggctctaaacggcgagccggcgaccatgtacactgacccgggactcgcgctcgccaccggctggctcaaggtcgggggctacctctactacgggtcgctggcaagctcgtacatcagcagggtcgacctcaccaaatcatccatcgaagcctagctagctaggacggtcagctcatcatctgtcgattgattaattgttcgttctgatgatgaactcgtggtactttttctttaaggggagttgtactcctgaacgctcttatattgtattatgggatggagggagtagatgataccccacacctgttgcaagaaatattttgcaatgtatttcaatcagggtccgtccagaacatacctagatgtgacatagatgtccaccctagttggggcctattttttttccaattttttgggtcctggttgctgcattat

SEQ ID NO: 19918 - DNA, 643 bp, Triticum aestivum
  unsure (1)..(643): unsure at all n locations
  Clone ID: PAT_TA_19918
cgttcccctctctctcgatccggcgaactgtgtgtgacacgacgcagcagcccaccagcgaacccgccatggcctccgcctccaagcagcagagcatgtacccggaggtaccccagtcccaccccgaccacaacaccgccttccagtacaaccccgccgccagcaccgccaccggcgcaggcgaatcgctctaccccaccatggacccccacgagatggccgagaacctcttcccggccgacgcggccgaggacgccgccccagccccgcccacggtggaggaggccctcgtcgacgtgccgggcgcgcagctccacctcgtcgaccccgaccgcagcctcgacctcggcgccggcacgctctccgtcgtgcgcctccgccagggagaccactgcgtcgccgtcctcgcgcgcctcaccccggacaagtccaaccagcggcgcgggtttttcagcttcctcagcagcggccgctccaccgacgcgcaggagcccgtgcagtggccgctcgccagcgacgtcgctgtcgtcaagctcgacgccggccactacttcttctcgctccacgtccgcacagcgaccaccctgacgacaaggaggacgccgtggcggagacnnacgcgnaccgggacncnncgctgnnc

SEQ ID NO: 19919 - DNA, 671 bp, Triticum aestivum
  unsure (1)..(671): unsure at all n locations
  Clone ID: PAT_TA_19919
atcatcccgagctcatctctcttcttcctccgttcacctcgtcggaaaagagggaggaaaaatttacctccttccacaaccgccgtcccccgagatgcgccgcctacctgctgctcctccccgcccagttctccaccctcacgtctcccccgcgctcggagtactgcaacagcatggccgagtggcgatggcaaggacgatccccgtagtatgctactcctacctgctaccaaatcgcaggacgcccagccagggcgccaaattcgaacctctacgatccagatcaaccggtcgggaccggggctccgcaatggcccgagcgaatcccgtagccgcgagcggcggcgaggcgtcgccgggatggcggcaggaacccgtttgccccgctcgtcgagctgtggcgccggacggtgcagccgctaggggactacggattcggcaagcgcagcgtctgggaaggcggggttgggctctccatggtctccggggcggccctgctggcgctcgcgctcgcgtggctccgggggttccagctgcgctcgcgcttccgcgtgtacgccgccgcggtcgacttccgccgggcgtgccgggcccgcggcggcccgcccctcggnctccccggcgtccccgtcgggagcgtcgtccgcgtcgactcttcactcnnnngtatt

SEQ ID NO: 19920 - DNA, 637 bp, Triticum aestivum
  unsure (1)..(637): unsure at all n locations
  Clone ID: PAT_TA_19920
caagaagttaactgtgagcgacatattcgccctacaacttatgcaggtaccacaggtgacagaagaaactgcaattgcagttatagagctctacccgactcttgtctcacttgctcgcgcgtactccatgcttgatggcgatacccctgcccaagagaagatgctgaacatgaagagcaagatggtgaacgcgggggctagcagaaatatcttcaagcttgtctggggtgaagggtgaaatattattcctgacctagttgcctatatgggctccttcctgacttgacttggttcaaccggccttttgtcaccatctcgatgattttggcgccacctcttgtgatgaagctccattgttcctggagctgtcgtcgcataacttcctgttccgtccgaaggtagatctcgtcggcgtgccctgggccctggtgccctcgccgctgctcccgtcatcgccgtactcccgcccgatctgctggcctcctccctctggctggtgtcctgcgtcccgtccattgggccggctatgttggcttgccatgacgtctgtgcttgtggcccttnnnnagtattattaagtgtcgaaacaaaatgtattaagtgtcttgtactatgcattnncttgtgttatttgaaa

SEQ ID NO: 19921 - DNA, 1920 bp, Triticum aestivum
  unsure (1)..(1920): unsure at all n locations
  Clone ID: PAT_TA_19921
nganagttacagcttcttcaaagtaaatatgccatgcgtgcttcgacaattttagtgttaacgcctatcttttttgaattaccagatgcttacaatacgnaggaatcagagaagcaacttgtcgaaaaggtattattatcttctgtgcaagtaaagtagtacctcttactgttgtttcatgagtgcaaatgatgaggtactgtctctaatgtctgtgaatgcttggttttcaacggaaccaaacttcccgcaatatgtactttgtccaaacttaaagaagtcaaccattcttgtaaagttcagccacatcatttttaatctattaattgaaatcatggtttacttcaccatcgttaaggtacaacctacatagtatgaaggccctccttgtactgaaaatgaatccatttagtggcctagtgccatcgccgtcataatttggtaatcatgagttacatttaatattcggttggtgcccttgtacattcctttgtgttgtcttcagagcttgacattttagagaaatttggcaatcttgagttatattttggttggtgcccttgtacattcctatgtgttatctttagagctgaacattttagagaactgattgatataacaaaagaatattgggatcatgcttcgtggacaggatgtggaaccacataatgtagttaatgatttgttgtatcgcgaatgtgtgttgtataaaccacaaatcgctggacttccagagctatctatagtcacaaccatcggatttgtcaaaggtgccccagacactgatgtacaagggttcaacgtttatcacaagaatcgcttaataacgcctttttggaaagttgccagcaactcatatggcaaagggcggggagttgtgggtattcttgatgcgagtttcatcaaacctacccacgacaagcaggactttgagaagtcagtccttcatcaaaggctcgagaatcgtttgaaagaaatgacttatgaatactggggcctgcattgccatcgccttggttatgataacaagtcattacctaaagcatcccgtgcactttatcgtgctaagcagacgggcgctggtagttcgccagcaagtgttccgcatcagttactgactgctgatgttccaacaagcagctgtgtacagagtagcatgggacagaagagaaatttcgatgccctcggagtcatcagcgacataaataatcaccagacgaagcatcgggatgttattcaacgaaaacgatttcatgaatacaagaccttgacacttgaaaatgacaaattgcgtgatgaatgcttacaatacgaggaatcagagaagcaacttgtcgaaaaggaacaaaagctccggtatcaaattgctaaggaaacaaagaagtatgaggaattattagaagagctcaaattattagatgtgaagttagagacatagtgaacagtttttctttgcacttctccaccatgataactcagcttggttcttggctgactgtatttgaaggatacacatgctgattgtcgtgctatgtactagctatgattatgggaagaaatggtctcattgaccagcaatatcttctggctacccttcactgggtagagatgtacaattttgacacagtaatctttgtagggaaccttgtgttgaaatatatgcatgtatatatgttgtagaaggatgtctaccatgtaatttgattgtctaatgaggtttcacaaaaatattgcttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnnaaaaaaaattaaaaaaaaaaaaaaagggcccccttgggcccccggggggccccccccgggaacccccccccc

SEQ ID NO: 19922 - DNA, 665 bp, Triticum aestivum
  unsure (1)..(665): unsure at all n locations
  Clone ID: PAT_TA_19922
gaacccgaggaagacgaatcaatcggagaggagtggcatgcacacacgtcaccgcctcggggagcccacatcgccgctgcttctccagctacatcttcttcctcacccccggaaccagaactaaatcatatagttgtcttatggcacgcgtctgatggccaacactacaatgggaagtaccactcgatcatgcgatgcgtacctgctgttcaatggcgaaacactgcttccaaatggtgtttgcgctttcctttgtactgttgccctagcgtactgttttattggtttatccgcgatcactgcccggttcttcaagtcgatggagagcatcacaaaccactctcgggaggtcgttacaattgatacagaaacaaatacgcctatcgtgaagcatgagacagtttggacctacactatagcggccatcgtgctgcttgattttgttacgatctttcccaatgcggtccttgctatccttgcttctggtgcccgcgcgccccggttctcccgcgcatccgccgtcgctgcccggttcctcgggccgctggcggccggcacaaaccactctcgggagntagttacagttgatacagaaacaaatacgcctatcgtgangcatgnnnnnnnntggaactacactatagcggacattgctctgcttgctn

SEQ ID NO: 19923 - DNA, 624 bp, Triticum aestivum
  Clone ID: PAT_TA_19923
cggacgtggcatgtgtaattgagcatgactgacggctggctctgggaatggaaccagacggtgacgtgggtgcgtgagtggggacaatggctggctgcgcgcgtggaaccaggtcaagtgaggggcctaggctcgtcttggaggttcccactaaatatacaatccttgctcatggcctgaagtatgcctagatgctgatgggtgtattgtatcctgcttgtgttagcttatggattctatatatatagcataattgcattaaacctgatggactatggattcataaaaccttgttattatgcttactaaactgtgcattgtagatactccagttgtagcaaacctcagaatctcagtacattatggctcaagaattttacagtattgctgtatgaactgactacattagctccaggggttgtaatgcataaatttataacaattctgcgtcagattcaagcacgaaaatcttctcctggtagctagctatcttttctgtaccctctgttttagagtcaggtaataccaattcctccctgcccttttgctctttgtagacagctaacaaacggtatttaaggctttttacctattttcatctcaacccaggctgttttgaccagc

SEQ ID NO: 19924 - DNA, 1209 bp, Triticum aestivum
  unsure (1)..(1209): unsure at all n locations
  Clone ID: PAT_TA_19924
tagacacgagacaaaacactagctagcaagctagctcgagctctcaggcagagatcgaccgtcgactcgagcgcgatggacacggcggcgcaggcggggaggaggggttcgtcggaggtgagggcggaggggctgatgcggggcgggtgcgcccgtctggcgacggcgtcggcggtgctcttggggctggacacgcagacctagacggtgccgctcatcctgatgaaggccgccgtcaaggaagtccacaccatctgggtgctgacggcggcggtcggcgcggcggcggggtaccacctgctgcacctgctccggtgcctctacctcggccgcttcgcccacaacccctgccgcaacagcagggccttggcctgggctttcctcctcctcgacaaggggtgcgcgtacgtgacgttcgcggcgacggtggcggcggcgcaggcgtgcctgatcgcgctggacggcgcgcaggcgctgcagtggaacaaggtctgcaacatcttcacccgcttctgccagcaggtcgccgggagcctcgtctgcggcgggctcgccgccgccggcaccgccctgctctccgcgctctccgcccgcaacctcttccgcctctacccgtcgctctcccgcccgcgcccgcacccgcaccgctcctcctccacaaagtaggcggcccggccgacccgtgggagcagtaaccacaccgcggtgggctcccgatggatgatagctagctagtgctgttgggccgcaacagaggcattcggcccggctacgcccaagcgactacttcttcttgggcttctcttctgtttcgttatgttgctactagtgtgagaatactgctctgaaaaaaaaaactagtgtgagaagacgtgaccatgtgtactgcagtagcgtatttgccgcagaaaatacttatcagtgtgtttgtatgtatgtatgtatgtattctctgtgtattattcctagaccgtgtaacctcctccagcaccttatgagccttcgtgggaccagtattactcatatcagtcgatcccaaaataaagtcaagcaattattcactaattatatgctcgtttagaaggtagaactatgatttggttgggttctggaccccccaacagctgattgtaatcatgttggtgattgagtaatattacaagtgttctactcgggaaaaaaaaaaaaaaaaaaaaaaaannaannnaa

SEQ ID NO: 19925 - DNA, 644 bp, Triticum aestivum
  unsure (1)..(644): unsure at all n locations
  Clone ID: PAT_TA_19925
gcacgaggccccctcctgcaccaaatccatggtcaactccaccgcctccccccgcccccgcgccaagctcgccggcaccggcacgccgctggggaagctgcaccgcggcggcaggccctactacaacgcgtacgacccctgcggggactaccacatcctcgactacatgaaccgcgccgacgtgcagaaggcgctgcacgccaacgtctccggcgcgatcccgtaccgttgggagccgtgcagcgacgcgctgaccaactggacggacgcgccggcgtcaaccctgccggccatcggcaagctggtgaaggacggtatacgggtgtgggtgttcagcggcgacaccgacgaccgcgtgcccgtgacctcgacgcggctcgcgctgaagaagctcgggctcgcgacgaagaaggagtggagggagtggttcaccagcgaccaggtgggcgggtacacggtggtctacgacgggctcaccttcgtcaccgtccgcggcgcggggcacatggtgcccatgatcacgccggtgcaggccaggcaggtcttcgcgcacttcctcaccggcgaggagctctctgccaaggccattgtcgcttagtttcattcattcattagcacccactgcgtgcttagngntcgtttga

SEQ ID NO: 19926 - DNA, 679 bp, Triticum aestivum
  unsure (1)..(679): unsure at all n locations
  Clone ID: PAT_TA_19926
gcacgagggccgatcggtacacgcgcgcggcagccacagtgacacactcgctcacgcgtgcgcgcagtgcaagccgcagcggagagcggacagcatgagctcctcgtcgccccagctccggcgcctcaagccggcgtaccagtgcgtggtgaacaacttcctcgccgtgctcgccgtgccgctgccgctggccgtcgcgggcgccgtcggcgcggcgcgcgtcggcccggaggagcttctcgccaggatgcacgcgctccggcccgcgcacgtcttcctggccgcgttcctcccggccgccgcgggcatcctgtacctcatgatgcggccgcgctccgtgtacctcgtcgactacgcctgcttccgcaccaagcccagccaccgcgtccccttcggcacgttcctcgagcacgccaagctggtgacgttcatcgagggggcctccattgacgagcgcagcgtccggttcatgacgcggctgctggagcggtccgggctcggggaggagacgtgcctgccccccgcgcaccacttcatcccgccgtaccggaacctggaggcctcgcgcgacgaagtggagctcgtcatcttctccgccatcgacgacctgctcgccaagannngcatccgccccgacgccattgacttgctcgtcgtcaactgcagccnnntcgcgnnn

SEQ ID NO: 19927 - DNA, 436 bp, Triticum aestivum
  unsure (1)..(436): unsure at all n locations
  Clone ID: PAT_TA_19927
tcatctcgcagcccctcaagcgccctgtaggagcggcatctccgtctacgcctactcgccgctgtcctctttctccgatattccctaaaggtgaagcagggtgcatctttttcttgaatcggccatgagctccatccccaaatcagtggcgcactacattcctgaagcatgtgtccgagttttcaagccatatctggagttctcgggcgcgtcgtcgccagatccaccatgtcgagcaaccagctggaggtacctacagatatctgaccagtttcaattgggggcctctcggttcggaggggctcggggcgtgcgtcacttcgagggtnctggaatggctctaaagattggttccttcaagtgcaacttccaatttattcttcatgtcacttcctttctttataggtccctttgtactagatgtcagcagaaggtg

SEQ ID NO: 19928 - DNA, 553 bp, Triticum aestivum
  unsure (1)..(553): unsure at all n locations
  Clone ID: PAT_TA_19928
gcacgaggcctcgccccctttcggctcgagttagatcatccatcggctgtaaagcgggtggcttggcttgggcgcgcgggacgggagagttctcggtaacgggactcgctttccgggaggccgcccctgcgacgacagccgcgccattttctattccagcggagggggaggttccgggtcgtagtggtgctgcattggctgcggtaagcggggttcgtatcggccaacagtggaagtccacggcggttagtggttgagccgccggctgcgtgctgcggcgagtgttatctatccatcgccatggcggacaagtgtggttcctggtgattctctcgagctgccacggctgggggaagcatggcgggggagggcgccgggcggtgcatactggtggggctgcacatggacgccgtcggcaaggagctgctccagtgggcgctcaaccaggcggccaggagcggcgaccgcgtcgtcgccgtccacatttaccgcaaatccggagacctgtgcaagacgaacgcgctgacgctgatcnnnacgctggacgactacc

SEQ ID NO: 19929 - DNA, 1019 bp, Triticum aestivum
  Clone ID: PAT_TA_19929
ggcttctggcctcttgctcatctgtctccagccttctagtctcctactgcccttcctcctcctccagccaaaacgcggcaatccctgaaagctacaagattacccttctttcaccacttcccatctcaaactgcagcaagcaatcaagaaactcagagaaggaagaagacatagcaagagcaagcaaagcaagcaagctagaagcccagggagagatcacggccatggcgttagcccccacatctctccagagcttcctcacagggaggcccctatgcacggccccgcagctcacgaggtcgtcaattaggccggcatcggcgaggctctcttgcagggcgtccgaccagaaggacgcgcctccgtcgtgggccggaaacctcgagctgaaaaatcttgggaagctggcgatggtcgccatggccgccggcgtgctcgtactcgcgcccgtcgacgacgccatggcgggcaagtccggcggcaggatcggtgggaaggcgtttcggtccgcggcaccgcgctcgtccggtccaaggataaacaactcgaggacgaacatctacgtcaatcccggcgtggcgccaccgctggtcggcggctacggctacggtggctatggcgggtacggcttgtcgccgttcggcttctacggtggcccgagcgtcgccctcggggtcggtggcggcttcgacacactcgtcctgttcattgtgggcggggcggtcgtcggcgccgtccggcggttcctcaaccgcagggataacgatgattacgacgactaaatgatacgagtcatgttcatgtaatgtcatccgacccttgtaatatagcgagattactattttgctcttgtcaatggtaattttgaagtaaacatagtaatatcgaacgagcaatgagaatcagaaagtgtgtataaatttgttattttcacagaaatggaagaagaaattatagttagtactctattttctaagaaattatagttactttcgcctcgtgccgattcggcacgaggc

SEQ ID NO: 19930 - DNA, 995 bp, Triticum aestivum
  Clone ID: PAT_TA_19930
ccccggccgcgccattctccggcaccggcagtctccttcgcctgacaaaaccaggaacgccacagccccagttcttctcccctccgccgtctcgctcccactcttaccttcaaacccgccccgacaccacaaaccccgcacttctcccctccgccgcctcgctcccacttgcaccttcgaacccgaccccgcaaggcaaagaggccaatcggcggagccctcgcctcctcttccatggcggcagcccagccccagacgcgcgatgcccagcaacaaggggcggaggaggccatgaagctgctgttcgtcgagatgggcgtcgggtacgaccagcacggacaggacatcacttccgccgccgtgcgcgcctgcaaggatgccatctcctccaactccatccccgccttccgccgcgggtcgataccaggggtgaacagtgagcagatgaagctgcagatcaagctgggtgtcccgaggccggtgcagcatctgttggactttgagagaatcaaggccgtcttcccctatggtgagatcaccagctgcgaggtcgttgacggtgggatgatctgttcaagtggaacatgcatcgaagcaatgggagataaaaacgatgactgctacattgtcaatgctgcagtctacgtcggttactaatgctagcctggaggaattgttgtctttgaacagtggaaaacttgaaaaaaaaaacagccgggagaggggaactggaaattctcgtaggcaataagtatgcataactgttattaacagagaaagggtcaaaatagggggagaccatgaagcctcccggtagtcctgctgcctggggtcgccggttatattatcctaagaggctaagaaggcaatctcgcggtgagctccattgttggagttcattgaaatggcctgcacattgtcatctcgtgttgtatggtgtggggaggttgaggatgttgaccgcattctcttcaaaaaaaaaaaaaaaaaaaaaa

SEQ ID NO: 19931 - DNA, 322 bp, Triticum aestivum
  Clone ID: PAT_TA_19931
ggacggcgcgagctcctggaggaggaagacgacgcgaattcaagacgggggtaaaatggtctaattcgccatttgtcggctgtgtcctaaaattgtaaacgctcttataaaagtttacagagggagtacttgacgtcttgccgactcacattgtactttgtataaaacaaatatgtaacaaaaaccaggtgacataatagaaagttcttgtaagcattgttcggacaaaaatttctactcacttgtttagacactatgttacagtaggttctactacaaggttctgcccatacatatctggttgcaaacagattggaaattt

SEQ ID NO: 19932 - DNA, 762 bp, Triticum aestivum
  unsure (1)..(762): unsure at all n locations
  Clone ID: PAT_TA_19932
gcggccgcgaatcgcggccgcgtcgacctcgccctcctctcgattcgatctcgccttcctctccaagccacgcgagaccagagctccggccatggccgccacgatccagtccgtcaaggcccgccagatcttcgacagccgcggcaaccccgcccgcggcctcgtgccgtgctccgcacgtggcgccctcccctcctctcttcgattccagtccatgtccgaggaacagtggttagttcacggcacaacaccaccgcggcaattagttagttagttagctagcagcttgacgaggtgtgatcgaggcagaacctgggcgagaagctctaggtcgctctggcgggcctgtctccggcggaggcgtcgttcgccggcgccgaggcggccatgctgccgcccttcttcgtgggctccatgtggcagtcggcgccgggcggcggcgtcgcggctgccttgtccgaggaagacgaggtagccgccgctgcggctgccgaggcggcgcacgaccgcgcggtggtggcgacgcggaaccaccgtgaggccgagaagcgccgccgcgagcggatcaagtcgcacctcgaccgcctccgcgccgtcctcgcctgcgatcccaagatagacaaggcaacgctgctggccaangcggtagagagagtgcgggagctgaagcagcgcatggccggcgtcgtcgncgnnncggccgcgccggcgagccacctgttccccacggagcacgacnnnnnnngtggtgctcgctncnnn

SEQ ID NO: 19933 - DNA, 708 bp, Triticum aestivum
  Clone ID: PAT_TA_19933
gcacgagggcgatttggataagcgcggccatgggttgggcaaggtagtgcactgaagaacacgacaagctactcaacctcgtcatgtatgacggttagcgggtagcggacgtggcgacggggctggaggttagcggcgcggaggaagcggtgatctggtccacagatttcccggaagaactcatacatgctcatcttccaagctagtttttccaaatcgagtgggatgtttgtgcatgaccaaagcttgtaagtgcgttgtcttggcggccagttctgaacgaggcgtggtccgcgcgtttgagctactgctgttgcgccggcaccagcgaggccgcgtctcgcgtcgctaatctgggaaggcggatgccggtcaccgaggagatcacgggtgccgggacagagaactttggcgctgcgttgaaaggcctattgttcctttttcatcccagcatgaggaagagcaacaggtcttagagactcattatccaggaagagtgatgatagcatataatggaactaatgcagtacttgatttttctggttccatgtctcactcaagagattagaaatcaagacttgttcagatggaaacatctaaacgcacacggagtcagcaaagttattacctaattaaatttgatggcttgttgtctgccttcttttaatgctagctaggtgccaaaacgtcacataagagtactgatgc

SEQ ID NO: 19934 - DNA, 759 bp, Triticum aestivum
  unsure (1)..(759): unsure at all n locations
  Clone ID: PAT_TA_19934
ctgacacttaagcctggcaaaaccagaagagcacgcggacgcgtgggagaacaatgagcgtactccacagagtgaacggcacagcggttcagtaagtgaacagcatcctgaagtgctttccaatggcaccagtagcacggccaggaaaaaaagttatggtcctattgttaatcagaagctcaaggcatatttcgaaaaagaaccttatcctagtcgcccagcaaaagaaagtctggcacaagagcttggcctgacattccatcagatcactagatggttttctagtactcgtcattactcaagagttagtgctgccaaaaaagggaagcgtttagaaaactatactgctgagaacaacgatggcattgctgcggatagcatacaacagagagaacccaatggcagtgtattgggcaaaccaaatgtagatagaaacggtattgtttcggaggaaaggatggcgcaaaaaaatcttgatgaaggtgagagagaagatactccattcagacaacatatcagctgtgagcagacactagatgggactcctcctgctaacaaacacaacactgccaactcgaggaatgacacctcgaggaatgcagaagataccccactcggacaagatattggctgtgagcagaccgtggctgctgtcaaccaaaactgcactatcggctcgagcaatgtcggctcaccgaaagtcgcctggaggaaacaagcgccttagaacctctaagagtttggaanccaagactggtc

SEQ ID NO: 19935 - DNA, 642 bp, Triticum aestivum
  unsure (1)..(642): unsure at all n locations
  Clone ID: PAT_TA_19935
gcacgaggcctcgtgccgaattcggcacgaggcaggcacagcccaactgccccaagccgatcgacgccgccaggccctaaactgcgcagacggcgtgctgctcacctaggaggagctaagtagctggccaagtcgagtcgacacaggatctcattctccgctagctagccggggtcgcgcgccttgcgggtgaggaggcgagctcgctcaccagccaagtcgatcatggagccgcggccgcgcccgctggccgtcgccgtcaacgcgctgctctgcgtcctctctctctgcgtgtccgcggccgaggccgagaacgtgaccacctacgacgccaagaacttcggcgctaaaggcaacggggtcgacgacgataccaaggcgctggtggcggcatggaagaaagcgtgcgggacgcctggcacggtgacgctggtgatcccgccggggacctactacatcgggcccgcgcatttccacggcccctgcgaggccctcgccatcaccttcttgctccagggggtgctcatggcggcaacggatctgaagcgttttggcaatgactggattgagttcgggtgggtgacaaacctcaccgtggcgnnnnagaacggcggcgnnnnngannnnnnnnnngccgcctcc

SEQ ID NO: 19936 - DNA, 1103 bp, Triticum aestivum
  unsure (1)..(1103): unsure at all n locations
  Clone ID: PAT_TA_19936
gcacgaggagctcatcgacctggccctgaagaaggaggatgctgctctggcaaggcactgtgttatcaaggcaatgagggctgatccggaggatgtggggctcaagtttgattgcgccaacatatatcgcacccttggtgactgccacaaggccgcggagatatacgagcagatagtcgggatccatccctccaacaccgtcgctcgtaaagcggcggcgcagatgtacagagactctggtcaaattgataaggcgattgatttgttggaggattttatcaatgctcaaacttcaaacatcgattggggtcttcttgatttactgatatcccttcatctgagaaatgatgcccatggtgaagcccttaggcagatcaagaaggcacaactggtgttgggatctggacacaaattaccagtacgattgcaggcgaaggcagtaatctgccatgcttatcttggagatatgaaacatgctgnnntgttccttcnnnatgtgcatctggggcgttcaaaagagaatgctgatatggttaaggaggtcgccagcactcttcaaactttggggcagtatgagtatgcactaaaattttactcggttatggaagacgttgctgttcacaatgatgttagttcatatgtggaagctgctcgatgctacatggtaatgggggacaaaggaaaagctatcccttacctctatcaagctttagaagggatggaggacaatgtcgatgtacggataaccttatcttctcttctcgttgacgaggataagagtgataaagctatcactgtgctttctcctcctgaaaatccagagttgcagtccgctgatatcccggatcatcagaaaccttggtggcttcatggggaagtaaagatgcagcttgccaaactttattacaacaaaggcatgatggagaaatttgtgaaaaccatttttcttcccattcttgagacactggatatcgagtatgctaatagaaaggtcaagatgaatagaaagcttacaaatgatgttctgcaggaaagaactaaagtgctgggggaagcgcgtcaagacagcgtatttcaaggatgcaggcctatagcatcaactg

SEQ ID NO: 19937 - DNA, 1765 bp, Triticum aestivum
  Clone ID: PAT_TA_19937
cccacgcggccgcccacgcgtccgcctgagacagagtctcgagtgctgccgacccgccgtcttctccgcttgccggtgccgccatgtccttggatggggtttcgacggagcctcgccacccgctccttgcaggccgttctggacggcgacctccgcctcctcaaagagatggcgggcgtcgtggcggcggacgttggcgtctgggcgcgcgcgctgactgtggcggtcatggaagggcggctggacatcggtaggtgcctcgtcgaggaccacggcgtcgatgtcaaccagggcaccttcacaggtgacactcctttggccatttctgcgacttatgggacgcctgccatcacgagatatcttctggatcgtggtgctgatccaactttagctggtgccctgtggccacctcttcatgctgctgcaagttttggacaatgtgagatagtggaactgctgctttcaactggaattgatgtggatcatttcgattctgtgtatgggaccgcattgcattgttcgccgctactaatgctcaagatggttcaatgaatattttgttgcagcatcgtgcagatcctaataaggttttccgccttgatagtaccccgttaaggctggccatgacttctgaatcgctggaatgtgcgaagctactcattatggctggcgctgatgtgaataaaattgactatactggtgttacttacttgatggtagcagcgggcaatggtttacctgatatcctgaaatgcttactagatgctggcgctaacccagatattgatgatgggtttggtacaactccaatcgaaattgctgctctccaaggcagatgggatatggttgagatgttatttcctttaacttctcccatttcaagattgccggattggagtgttgatggaattatttcttatgtgcaatcttttggtttgaagccgagggatatacatctatgtgaaatgaaaagagctgaactaaagttgcaagctacagaggcttttaagagaaaggaatatgtgatagcaggagagctatatacttgtgcaatgagttttcagtctagtccaaaaggtcttgcaaacctgctagcacataggagtttctgtatgttgcacgcggggataggaaaagaggctctctccgatgctgctaggtgcacggtgctacgacctttttggcccaaaggttactatcgactaggagcagcctttatgttgctacaggactacggaaaagcagctcagacgttcgaagctggcttgaaactggaccctacaaatgccgatatggcaaatgctttaagggaagcccgagagacggcgaggaatcctcctcgcaccagggggctggagtgccttcacccatttggaatgagacgttcctggagagattgaggccctgtttcgttgctatgtccagtccagggtatgcatgcctgtcattctcttttcctgtatccagtccaaggtatgcatgcctgttattctctggagagactgagactctgtttcgttgcttaagactctgttttgtgttgaaccgtccaagagtaccgatctcatgtgctatattgtagaccgtgtaaacatggctatctgtacattgtggttatatgtcgttttccgtgaaccattgtggctcgtgcccgtgtccgtgaatcactctgaaaaatgcgctcgtcaaggtgaaatctaagcagtactgtactggctagaaaaaaatggataacagaaaaaaaagtcatctaggaaaaaaaaaa

SEQ ID NO: 19938 - DNA, 418 bp, Triticum aestivum
  unsure (1)..(418): unsure at all n locations
  Clone ID: PAT_TA_19938
ctcgcgcgcccactcccatccccatcaccaacccctcccacatggccatggcgccccacccaccggtcctcctcctgctgctcctcgcgccgctcctcctctgctcgctgctccccgatgcggcgcgggcggccggcgccgaggacgccggcgtgaccatcgtgcgcaaggacggcacgacctgcacgctctgcgcctcctgcgagaacccctgcaaccccaacccaggatacaactacccgtcgccacctcccccggctcaggtcacccccgcggcgccggtgtacccgcctcccacttcctacccagctccctccggtggaggcggcggtggcggtggctacttctaccctccgcccaccggcgggtacgttgaagggagcggnnnnnnnnncgggtcccnnngaggacaaggtgg

SEQ ID NO: 19939 - DNA, 653 bp, Triticum aestivum
  unsure (1)..(653): unsure at all n locations
  Clone ID: PAT_TA_19939
gcacgaggcagcctcttctcttgcgcctccccttcctctcctcgtcctgatctccagngcgagagggagggaggccttcttgctagatagaagctccaagcccggccgtttcggttatccagagaccagaggacatggcgtcaatctccagagcgtcgtcccttgtcgccatggccatcgtcgtcgtgctcgcctccgtggccagcgcccagggccctgccccggcacccaccgccagcgatggaacgagcgtggaccaagggatcgcgtacgtgctcatgttcgtggcgctcgccctcacctacctcatccacccgctggacgccgcctccgcctacaggctcctctgaactgggctccccctcttctgtagtaactcgacgccgccgtgtgtgtaatcagttcatccagtttaatcgttcgttccgaaaaccaggattgtagtctaggtagtttgttctttctttctagcttcccagttggagatttgcgagtgaggaaaatgatgccgattcctttacttctagttctnnnnatgtaatgcagttattctctgtccggaaattatccccgcagangnnnaacaaacacacactagtgcatgcatagatgcatgcttggtatnnnnnattttgtnnnnnttaaaaaaaann

SEQ ID NO: 19940 - DNA, 648 bp, Triticum aestivum
  Clone ID: PAT_TA_19940
cacacatgtacctgccgttcgggcacgggcccagagtttgtgccgggcagaacctggcgatgatggagctgaaggtggtgctcgtgcgcctgctgaccaagttggccttctcactgtcgccagggtaccggcacgcgccgttgttccggctcaccattgagcctgggttcggcatgcctcttgtcgtcacgaagcttccatgatctctctcactgccatctgtagcaagaaggtaccgcgcctgatgaaaacagtgacgccaccactccactgtgtttgtaatcggcaaagcgttgccttcgtgccactgagggcagtgagcgcgggcatggcagcggcgtggcgtcttgtgggtcccgcgcctggtgtggtcagtgacgccaccgctcccctgtctcccccatcggctatgccttgctcccggttcagtgtctcctgtgtgccccggccacgcgacggctccgttctttttttgtcgcttgcttggtgtggcgagggtggccacggtccccgtgtctcccccaaatgatatttcttggaccatgataagtgtcacatgtgtggcacgaacacatgacaactccgaacattttttatggcaagtttagtgaagcgaggatggcaactttcattttgaaaaaaaaaaaa

SEQ ID NO: 19941 - DNA, 992 bp, Triticum aestivum
  Clone ID: PAT_TA_19941
ggtcgcccaccaccagaagcacacccgagcggaccgacgccgccgccgccgccgtccgtccgttgaggagggcatgaagggcggggggaagaacctgcgtcgcgcgtgcgaggagggcaccgcggtgacgctggcggagggcgagagcatcatgcaggtcgtcacgctgcgcggctccaacctcatcgaggtcaccgacggctgagaggagggcaccccggctgactctggcccgacaaggagagcatcatgcaggggatcaagaacgcgaagctcgagcctcatcatggtgacggacggcgagggcgtcaagtctctcgccctcttcccccgcctagttccacgaagagcttctggatcaaagaacgggaatttcgtggttgttgatgctagtgggacggacgtcgccctcgcatctcccagctggatggcctgcgtcgcctcaaggaaccacatcacaggctgaggaagagcagaactctgatgaagacgacgatcatgatatgccgccacttcaggcaatcacgaacagaaatagacccttggaccggcatcccaagacggagggagactcgaactcttgaactggtagacgccttgggtatggtcaccatcctatggttaccgtccaccggtacaccctaatgtatttatgcttgtcgaatttgggcatgacatcataaacttacggcccaatctgtcaaagatatacttctccctgcggttaccgtccacctgtacacctaatgtattgaggcttgtcgaatttgggcttgacatcagtaaacttacggcccaatctgtcaaagatatagtagtcagtgcgttttgtcgacattaagtggcagggcatgtggaggcctgtcacctctagtgtaatatgaagaaaacaagaatgttgcacctagcttattgtggttgtggatgttattgtgcaagtctgcttgctttccccctgaaagtgggtttaaaaaaaaaaaaaaaaaaaaaac

SEQ ID NO: 19942 - DNA, 881 bp, Triticum aestivum
  unsure (1)..(881): unsure at all n locations
  Clone ID: PAT_TA_19942
gcctcgtagcgaccagaggcacgcactcatttcccaggactacacagatcggagaaaccgaggcccccctgccaagccgcgcgagcagcttcttccgcttcgatcgatccagcaagagaggggttccgatggggctgcagtggatgctcctgacgtgcgtggtgggggcggaggcggcggtggccgcgctgctcacgctcccggcgccgcgggccgtgcgggcacagatcgtcgggctcacctccatgcttctgcagcccatggccgcggtgctccccttcgccgccttccagctacttgatatctactggaaagaacgagcacaggctgatttgcacgggagagatgtgcacctccgagggagcgtgtccgcttcgagaaatccattttcaagtcccagaggaatgtcatcctttgtgtttcagtatttatcctttattggtccatctatcgcattttgcaagttcaacaacagacattaaggcactggaggaggttgagaagcgcatcaagggaatgagtagaatcatcctagtttgtgatggattttggtggtatttctcggccttcagcaaatgtatccagactttaggatatccaatgtatattttggtttttcctttgagcaaggttagaatgtaacctgtttccagcgcttcgcattcctctctttcttggaccggctgttctatatgtaacttgtggcggtggcttctacgaagacatctaaacgtttccatattaataatacccttgaaggttttgaacatctgctaaaaagttataaggaccgacctttcggtggtcttccgtgttgaaatagtctggtatttctgtagaattcaatcccttgccttgagtccgaaagttccaacaantgg

SEQ ID NO: 19943 - DNA, 315 bp, Triticum aestivum
  unsure (1)..(315): unsure at all n locations
  Clone ID: PAT_TA_19943
tntttgaggtggttttaccctgaaaccatacggtggcatgcaatccantttgcattttttttaggaatagtcttntgatgtgaaatgcttgggagccttttgctctgtgcaacgggatagagtgactctgccaccacaccgtaagtttgcgccaggggttcctgagtttgcatctattgcaatctgtgtgttgctgctaaacgcaatgggcctgtggcgttgctgctacacccatttgacctttaaactggaatatacttctgtaaacatgactttttacacgttcgtttgtgtttgttgcggaaaaaaaaaaaa

SEQ ID NO: 19944 - DNA, 616 bp, Triticum aestivum
  unsure (1)..(616): unsure at all n locations
  Clone ID: PAT_TA_19944
ccggcatgcagttccggatgcacaaccaccccttcgagcgagaaatggagaccttcacgaccctcatcgtcgacaagctcaaggaggccaagatgttcgccggtcagggaggccccatcatcctctcccagatcgagaacgagtacggcaacatcatgggcaagctcaacaacaacgagtccgcgtccgagtacatccactggtgcgccgccatggccaacaagcagaacgtcggcgtgccgtggatcatgtgccagcaggacgacgacgtcccgcccaacgtgatcaacacctgcaacgggttctactgccacgactggttccccaagaggaccgacatccccaagatgtggactgagaactggactggctggttcaaagcatgggataagccagatttccaccggtcagccgaggacgttgccttctccgtcgccatgttcttccagaagcgtggatcgctccagaactactacatgtaccacggtggcacaaactttggccgcacctcnngtggcccctacatcacaaccagctatgactacgacgcccctcttgatgaatatggcaacatcnnnnagccaaaatatgggcacctcannnacctccacaatgn

SEQ ID NO: 19945 - DNA, 722 bp, Triticum aestivum
  unsure (1)..(722): unsure at all n locations
  Clone ID: PAT_TA_19945
cgacgcataatctacccacgaccttccttgtcttctccaatctctcgattcctcccatctccggaacaccaacgccgccattggcctcctccggcagacccgccgcccaccgccgcggggcctcctcccacagaccccgccgccgcctgcctactcctgcagaacccaccgccaccgcgggcctcctcccgcaaaccccgccgctgccgcgtgcctcctcccgcagaacccgccactgccgccgcgacctcctcctgcagaccccaccaccgccgcgaggttcatcccgcaaacctgccgccaccgcgagcttcctcccgtaaccccgctggcggcctcctcccgcaaccccgtcgacgacctcctctcgcatccccattgccggcaacgccaatgtgcgtccctgctggatccacccgatccagtgctgccgttagccgccgttaaccccgccaggctacggcaccggtgccatccaccccgctagccactgtccccgccttccacccgtgaccccgtgctcggctagcgttgttcctcgttttcacacctctgactcaccatggacggtttcccctcctctgctcgaacttcttctccaaccaccgtcgtgccatcctgatgttcattggtgaagccccgnnngcatcgtgctctggatgtcattgacgttcttcacaaaaagaaatggcnnnngctcggatgcaattccttgtgatgnn

SEQ ID NO: 19946 - DNA, 673 bp, Triticum aestivum
  unsure (1)..(673): unsure at all n locations
  Clone ID: PAT_TA_19946
gtgatggcactgttcagctatgggatgcaagcactggccaaggattcacacagtttacagagcatcggaaaagagcttggtctgtgagtttctcagaggtggatccaactaaattggcaagtgggagtgacgattgttgtgtgaaagtttggaatattaaccagaaaaatagcgtggacacaatcagaaatgtggccaacgtatgctgtgtacagttctcgccatactcctctcgtatgttagcctttggctcagctgattacaagacatactgttatgatctgaggcatacaaggatcccctggtgtaccatttctggacacgggaaagctgtcagctatgtaagattcttggatgcagaaacgcttatatctgcctcaactgacaataccttgaagatatgggatctcaaccggactaatcctaatggattatctactaatgcttgcagtctgactttgagtggtcataccaatgagaagaattttgtaggcttatccgttcacgatggatacatannngtgcggttctgaaaacaatgaagtatattcttactataaaagcnnncccatgccaataacttcccataagttttggttccattgacccaataaccggacaagnnnnnaatgatgatnntcagcagtttgtgtcgagcgnnngctggnnnnnn

SEQ ID NO: 19947 - DNA, 408 bp, Triticum aestivum
  Clone ID: PAT_TA_19947
cccacgcgtccgcggacgcgtgggatcgactatgcggaagcatggcttgagatcctgtagtcgatcccgaatgtggcgggcagcggcgacgaaccgggacgaagcggcggcggtctggaagctcgccggcaggacaggaaaagagcagcggcgtctgacttactccctccgtaaattaatataagagcgtttagattactacattagttatctaaacgttcttatattagtttacagagggagtactaggtacgacatcaaacctatttaggttaactgctatgctatgggtggtctcatttcttcgtagctcatactcctccagccttaggttctgtgtggaagttacagatgtatactcacagtcacagaaatgcaaggcaagtgactcaataaaaattctgaaag

SEQ ID NO: 19948 - DNA, 859 bp, Triticum aestivum
  unsure (1)..(859): unsure at all n locations
  Clone ID: PAT_TA_19948
tnttgaatcccaatgtatgtgtatatatttaaaacagaagtccagacttgcaggttttacaacagtgctgatcagtacacatgtactccctccataaattaatataagagcgtttagattactactttagttatctaaacgttcttatattagtttacagagggagtaatacgcaacatggtcatggcaagaacaaacaaatagcaactgccttgccaaggttacaggtcaattgtccacggacagcgacacctatatacatccaacggtgcacatttccctggcgcttcggaactggagatacatgtcagtgcggaaaccgaatctaaggtagtttttggttgccgggttcggacgatgtgtcagcattcagctctcctcttcgagctcgtcaaatcccacccgctgatttcctcggctgagtaatctttgccgtccttcccaaagtctgctcccaggtttgcaaattcagaatcgggatccagctgatgctgctgctcaggcttcatgggagattttggggagtcgacgtgcgcggctttgggggtaacaggtgcttggataggcgaagggctcaagtcagatctttcctcagggagtggctttgatttgtggtcttcaatgcttagtgttggcctttctatagattcaaatgcttccctcagtttctcgatctcgtcagttaggctcttgacctctgggtcatctctcctggggttagccccatgctctgaatagaacaacttctttatgtggtctgcgatgctgaaagcaatgcataatcttcttttcagtttccaaatattcctcctcaagggatttacgtgggtttgtcttctctgatgcttcatcatcttca

SEQ ID NO: 19949 - DNA, 1218 bp, Triticum aestivum
  unsure (1)..(1218): unsure at all n locations
  Clone ID: PAT_TA_19949
cccagcgtccggcccgccaagcggnagcgggtgctggcggccaagaccagagtgggtaggccgcggcaagcgaggaggcgcgcgcagccgcagccgccgacgccgctgcagcggctctttcgggcctgccgcgctgtcttcaggggccccggcaccgtgcccgcgccacccgaggtcgccctgctccgggccatgctcgacagaatgaggccagaggacgtcggcctgagcccagacatgagattcttcaggactagagacaatacggcccaagggaacccaaccatcacacacaccaccatatacaaatctgacaatttctcgatggtcatcttgttcctgccgcaaaatgcggtcatccctctacacaatcaccccgggatgaccgtgttcagcaagccgctcatcggatcgatgcatataaagtcgtacgactgggccgatcctgatgatgatccagccgcctcatcgcccgacgatcaactgaggctggcgcgtctggttgtggatgatctcttcacggcgccttgcaacacgtcggtcctgttcccgacggcgggaggcaacatgcaccggttcagggccgtcgcgccatccgcgttcctcgacatcctcggccccccttactccatcgaagaggaccgagactgcacgtactacacggacattccatactcccagcatccaagtaagttagaaatactgatctcagaaatctaatctagatacattatggagatggacttgctactagtgctgaatttcgacactgcgtgcagcttgcaacaactgtaaactagcacagaaaatgcttgagctcatatcctctgctatctggggggtttggtctgagtgatcacagtaaacactttatgcatcctttttaccgacagcacgcgagagaattaactaataagtatggttaggcatcaatagcaagttgcaacatagatattatattttgcatcatcaaaacagtagtttgccttgtaagcagcccactgaatggagagagaggtcttttagttaagtaacaacctggagctttcaggtagctttgtttatcatgcacttgcaagcaagcacacggttttgcgccccccgtgcgtgggtttgagaagcacgggatgtcgaaaccacttgtgcataaaccatgttctaaagggcactaggcgagaggcatccatattntagaacagtattaaagtaatgtagctt

SEQ ID NO: 19950 - DNA, 1025 bp, Triticum aestivum
  unsure (1)..(1025): unsure at all n locations
  Clone ID: PAT_TA_19950
ttcccttcctctgtttctccctccctcaagcccctcttacctccccgatctgctagcgatgcatccaaatcgatggcctctatgcacgtcctaagagaaagtgaggcagagggagcgacccccaccatcacacacaccaccatatacaaatctgagaaattttccatggttctcttcttcttgccgacgaatgcggtcatccctctgcacaaccaccccggtatgacggtgttcaacaagctgctcatcggatcgatgcacgcaaagtcatatgactgggctgatcctgatgatccggctaatgagagtggcgcttcgtcacctgacggtaaattgaggctggcgcaactaatcgtggacgatgttttcacggcgccgtgcgacacgtcggtcctgttcccgacggcgggaggcaacatgcaccggttcagggccgtcgcgccatccgcgttcctcgacatcctcggccccccttactccatcgaagaggaccgagactgcacgtactacacggacattccatactcccagcatccaatgaccagcaatgagctcatcggcgacgagcaagaaggccggcgtctcgcgtggctgaaagaggtcgagatgccgagggatctgaagatgtgcagcgtccggtacggcggcccgccgatctccggcaggtgatcgaccccccaccggcgcgggtcctttgatcctttccttcgagccctttgcgaccgatgatgagctgtcaagtgtcaacccaactcaaaccagatggtgtcagaatcgaagttcaccttgtgaatacagcagcaagctagttagttgagccatgcataagaataggtcccagtttgtgcatgacgtctcagtcagttatggcagtctaccatgtaagagtgcttgcttgcttgcttttgcagcagctgtgtacatggaccttgtccaggagatccctttgttgatcttttttcaatacatagatcatccatagatttcacttgcttggcaaaaaaaaaaaaaaaaaaggcccctan

SEQ ID NO: 19951 - DNA, 1372 bp, Triticum aestivum
  unsure (1)..(1372): unsure at all n locations
  Clone ID: PAT_TA_19951
ggcaccccgagccgcggctcgccccgccgctgctagtcggcgctgggcggcctcgacatacggtgggacgtgcctccctctctctgccacgatccagcgcgtttctttgcgtcttctgttatccttttggagctgcctactgccatgggagcggggatggtggagctcgggcccggggtggtggaggttggtgcggcggaggccgcgcagaccgtgccgccggccaagaggaggcgggtgctggccgttaagaccgcggcggcggcggcggcaggaaggaggccgcggcgcgacaggaggccgaccgccatccaacgggctcttccgggcctgccgcgcccgtcttccagggcgccccggcaccgtgcccaagcccgccgagcgtcgccctcgctccggcgaccactgctcgaccaaaatccagaccacgaggcacttccggcctcagctcaaacatgcccctcttgaccccatcagacaaggcggcaaccgaaggaccccccgccattcacagacacccccatatacagagcagtgaaattatcaacgattctcctcttcgggacgagaacagcgatcggccctctgctcccctggcccaaagtggccgagttgcccgagctgatcttcagatatatgaacgcacagttcatctgactcgccgatctccgatgatcctgccaacgacccgggcgctgcgtcgcccgacgatcaattacgactagcacatctgcaagtggttgatgtgtcgagagcgccgagcaactcgagagtccggttcgccgccacggccagcaccaacctcggattcagccccctcgggccacctgctttcctgctcatcatgggccccaattactccatcaacccaaacccaaactccaactactacaaggcaaattccgttgccgtatgagtttggcagcaaagctgactggtccatccgcaggctccggtatgacggtctgcaagattcctcaatgagtgctggcagtctttcctgccagaccgctgcccccgatgatgagctgtcaagtgtctacccaactctaaccaagatcgtgtcagaatcgctgtttacctttgtgactacagcagcaagccagttagttgagccataagaataggtctcacgtttgtgcatgatgtctcaatcacgttatggcagtttaccatgtaaaagcgcttgattgcttgcttttgcagcacgctgtgtacgccggcccttggccagcagatccctctgacggccttttctccggaggggagggcgccccggtagatttacnngggnacagaagancccaaggggggggcncggtnncaaatcgcctagnntggncggagngcgcgggnnactggccgtgccttt

SEQ ID NO: 19952 - DNA, 1735 bp, Triticum aestivum
  unsure (1)..(1735): unsure at all n locations
  Clone ID: PAT_TA_19952
atttacggacactatagaaggccggccgtgccgggggctgaggagcaaaaggagaagagatcattcactcatcaaacgcgacgcacagagacagagggagagggtccgctgtacttgcatccttccctgcccccttcccctctcctccaagtccaggaaatccgttcccctctcccccctccctccctctcgtctgcacccgagacgccactcaagatgacagcgggagagcgtccgctgtacttgcatccttccctgccccctgcccctcccctcccaagtccagaaatccgttccactctccccctccctctcgtctgggcacccgagacgctcctctagatcagttcctcggtgcggttacctctcgccggaagccaagccaccatggtgtcgccggacgctatccgcaccgtcatcggcgtcataggcaatggaaccgccttggtgctcttcctatccccagtgccgacgttcatccaaatctggaagaagaagacggtggagcagtactcggcggtgccgtacctggcgacgctgctgaactgcatgatgtgggtgctctacgggctcccgctggtgcacccgcacagcatgctcgtcatcaccatcaacggcaccggcatgctcatcgagctcacctacgtcgcgctcttcctcaccttctccgtcggcgccgcccgccgccgagtcctcctcctgctggtcgccgaggtcgccttcgtcggcggggtcgccgcgctcgtcctctccctcgcccacacccacgaccgcaggtccatggtcgtcggcattcctctgcgtcctcctcggcaccggcatgtacgccgcgccgctctccgccaccagctgggcgcccaggtcgccgtgggcgcggtgggtcgccgcgctcgtcctctccctcgcccacacccacgaccgcaggtccatggcccgtcggcataccatgtgccctcttcggaacccgggcacgaacgccgcggcggtctcgctcacgaaaatggtgatgccaacggacaccaccaggagcaataccacccctattccactcccgggccacgcgcgtcaatggaacctgctggccagtccacgcctgcatcatgttcgcacgctacgcccccatccccactcgggctgggcgcgacgttcgctgtggggcagatcaccctgaacgccatctactacaagtcgacgcagcagatcctggaggcccgcaagcgcaaggccgaccaggtgcccatgaccgaggtcgtcgtcgacggcaagagcggcagcgccaccaactcaggcgccgccaacggccactactagaagcaataccactattaactcccgattgaagcgccttcataaatcgtcaccttagctaattctcccatgaatcatgtacgtacgctgtgtgcccagggcccctgtgcaccactgtcgcgtcttcttgtgcgctctaccacccttgaagatttgtttcgtcttgtctccattatgcctagtactgcgtacggccgctactgtcaatcagacggctaaccgcgaccctggttggcggatcattggtgttcttggttttctggaagaactatgacagtccaaaggggacggcgtgttgagtttttcttatacatgttgttgttatgctactgctgtttctgtttttgttttggccgggaaggcgggaatactactactgttttgttgttgcaaaaaaaaaaaaatttcccccnggggggccggtacc

SEQ ID NO: 19953 - DNA, 649 bp, Triticum aestivum
  unsure (1)..(649): unsure at all n locations
  Clone ID: PAT_TA_19953
ccgaagcaagagctccgcgcgccgcctctccgccccccccgccccctccgccgcgcacacccgccggcccccttcggccggcgtctcaccacatttaaacacgcaaaatgcctcgaggacaagcttcttcagtgtcaacccgcgagaggcctagagttgatgcggcagtcgtttctgataaagataacggcaggcataggaggagcgcttatttgttgctgggattgttgatagttttccttcatgggtcctggtcagtttaccgtatgcagtttgcaaatcttcctttgcccctagatgctgagcaggctggtaagcgggggttctcagaggcttctgcccttaagcatgtgaagtacttgacgggcctgggtcctcatccagttggttcagattcccttgatctggctgtgcaggttgtccttgcaggcgccctggctttcgcgttgtcagctctcccggccgtcgatgtccgtctggagcccttccacacagtctctggcgcttttcctttgcccgggggccttctcaacgggaaggctctctggtactctgcccttaagcacgtggttctcgctgttgtcccctggtctgttccggctgctggtagaaatttgattcttgtctcttctatattgacannnnnnnn

SEQ ID NO: 19954 - DNA, 1345 bp, Triticum aestivum
  unsure (1)..(1345): unsure at all n locations
  Clone ID: PAT_TA_19954
ctgcaggtcatgtgtccagcagcttgccatgctattgtcatctgctttccgttccactggcatgttagcccagcagaagcaaccagttgccatttataaacgacggttcaatcttaccatgtatgagggacgtatacagcgaagggctcatagaagaatctccagaaaggtcaaggctgcactaagcagatatgaggtgcagaattcgggacaagcctgttatcagcttcatgtggtctgcggtgtgaatgaatatgtatctggtcccgacaagagtgatactcctgttgaagatgaccgctaccatcacacacatgccaactttctggtgacccggaatgttggctctgtatgttcgggtccagtactcttctttgctgagcttagcaacaagaacaatggcgaccaggattgccagcttctatgctgccctgtggtggtccccctacctggggctgagccagtgcgctgccttttctgcgagctagaagggatcaggattgtgcacccggctagtggggagggattccatgggcacgaggtggagtttgggaagatggtccgcggagaagatctatatgacaacggctactatcgggaggtgtacaacaacgaccgcattctaagtaatagcgattatgttacgaactggatccatgatggactcgaggaggactacatgtacctaggtagcaatgacttcaccatcaaggaagacgacggccatgagtcggatgaatatggagacgagtagtgtatatagtgacaggggtgtagtattcacttcactgatgatcctcatattaagctgtagctagtttgtgtgcttcttccatttatattgggcaggtcttctgaaaggtggtgataaaaccaagcttcaggaagcggtcaatcagccgttggccattgtgacgtatctggctggccagatgcgtgaggcgccggctggcgccaatagggcgcttggagctggtgatcaagcaggagtcttgtgtattgctgatgcctgtggccgtagtttttctgctcctttaaacgttgtggtccttttgtctctagttctatctagtgcattgaactctactgttgtggttgcaggtgataccaggttttcgtgtagcgagcgctttgatggcgatcactcacaacgggtttccctcaagctctctgcctctcttttcaattaccaatttgctggtcctgtaagaactaaatatctcggttgagcgatactggaaagggaaacgtttgttcctttggnatcgttgnnatccgtaatagtgcccggagcagaaagacatgggatgctccacccanataaggnaataacacagncnaaaan

SEQ ID NO: 19955 - DNA, 674 bp, Triticum aestivum
  unsure (1)..(674): unsure at all n locations
  Clone ID: PAT_TA_19955
gcacgaggcacgcacacctcctcgcattcttcagtttcaccgcagaagagtcgaggcgccatctacatgcacgcgcaacgggcgtactagcagctacaacgggccaaacgacaacgacgatgatcccttccgccacgctcctccacgctgcgtggatcacggccgccgtcgccgtctgcctcgcgctctgcaccatccactcccgcaagtcctcctcctcgctccgccgcggctcttcacgccccgggccggctcgcagctccaccgctgccgccaggaccagcgaggagtgcaacggcggcggcggcggtattggncgcggcagccggcgccacgccggctgcgagggtgtccccgacgccaagcgacacggccaagagctgctgcgttaacgtaggcgatctgcacgagccggcgcgcgtgggggacgacgtcatgcagatcgatgccagcgccgttgccggcccggtcacggtcatcgacgtcgggacgcacgggccgatcgcgccggtgttcctggtgccggacccgatgccaccgcggcggagcctttcggtgaagcacatccggttcgctgagcggctggagaagatacggtcgnggcggtggggaggagacaacgacgacgcgnnnncccagctggacgacaccacgctgtggacnnngacnntnnn

SEQ ID NO: 19956 - DNA, 377 bp, Triticum aestivum
  Clone ID: PAT_TA_19956
ttcccgggtgcacgggatgcattacaacggcgtggtctatgatgctgtcatgcatatcatgctcaatgcattagtgattgagtcgcaacaaaggatctgactagtcgtaggggttcttgaagcaggtgtgctcccaacccctcttcttttggttcgttacagtacatgggtaattagaatgtgttgtgagataggaaggttcttttgattgcttcggcattttggttacgtgccagaaatcgccatcagattgctcaaccttagagtgtaatatagggacatcttagaaccacacagtttttggctgaatggtaaacggagatgatgtattgtatactttttctcgggtaataactaagatggtgattctgacatgt

SEQ ID NO: 19957 - DNA, 576 bp, Triticum aestivum
  unsure (1)..(576): unsure at all n locations
  Clone ID: PAT_TA_19957
ccgcgatccccctctcccctctcctctccgtcgccgccgctcgccgctgagtcccgagcaccgccgcggcccctccctccgttaacttgagacttgagaggtgcttcttgatctgaagctgtgtgcggttgcctcgcgtccagattgatcatgagctccagaagcctcgtccgatccccggtgtcctgtagtgctgtaaacgaatgcttttcctacaattcacgccgcccaagaagctactatcagtattctaataccatgaagctacaaacaccgcaagctggccagatgcttttgcctcgcaaattatggaaatctactcgattgcagaccacccttctcatccagaggcggactgtatcaaactgttgctctgaccttagtaccacttacacagagcaacttcccagctatttagcacttaatgttttgcaagaccaatcaaatgcgaaacaaaacaatattcgtaaagtccttgtcatcctgaatcctaattctggattccgtagctctcgtgaggttttctacaagaaagtgcaatcaacactgaagctttcnnncttcgcgatnnnnnnn

SEQ ID NO: 19958 - DNA, 1242 bp, Triticum aestivum
  Clone ID: PAT_TA_19958
aaaaaacactgtgcctgttccagataaaatgtcatgcttttgagttgcattgtttgaagccatgagagtatgagatatgcatgttgtgggcagaattgtacccacttacctgtagctatattataatgtagaatgccagccttatatcaattgcagcaggttcctgggatcacagacttaggtttgatgccaagggaaggtgtctaacgttgccattgttggtggtggacttatgggttctggaatcgcaaccgcgctgatactgagccattatcctgttatactcaaagaaatcaatgagaaattcctaaacgcaggaattggcaggatcaaagaaaacttgcagagtcgtgtaaggaaaggaaaaatgaccaaggagaactatgacaagaccctctcacttcttacaggtgtcctcgattatgaaaaattcaagagtgtagacctagcaatcgaggcagttgtagagaatgtgaagttgaagcagcaaatttttgctgaattggagcaacactgtccttcccattgtattctcgccactaacacttccaccattgatcttaacctaattggagagaagacaaattcccaagaacgcattgttggcacacacttcttcgctccagctcatatcatgcctcttcttgagatagtccgcacccctcgtgcgtctctgcaagcagttgtcaccttgctggatgtagggaagaagatcaagaagacaccaatagtggtcggaaattgtaccggctttgcggtctaccggatgttctttccgtacactcaggcagcactcttgcttgttgatcatggaatggatgtttacaagatcgatcaggcttgtactgaattcgggatgtcaattggtccattcagaatgacagatctggttggttttggagttgctctagccacaggcatgcagttccttgaaaacttccctgagctggtctacaagtcaatgctgattcctctcatggttgaagacaaaagaacaggtgaagcctcccaaaaggggttttacaggtatgagggtaagaggaaggcgagccctgatcctgaaatcatgaactatgtcaacgagtcgaggagaattgcaggagccacacctgatcccgagttgctcaagcttgacaacagcgcgatagctgtggtcgggttcgtccccgttctctccgtgccctcccgtgttccagttgaaggcataatgttgctagatatcagaaacaccaatggccattt

SEQ ID NO: 19959 - DNA, 847 bp, Triticum aestivum
  unsure (1)..(847): unsure at all n locations
  Clone ID: PAT_TA_19959
gcacgagggaaagaatgaatgattggagacatcggcttgttactcagcttgggaagaagatggttgaaatgactggtgattttacaccagacatggtggccctattatcagctgatatcataatttcgacccccgaaaagtgggatgggatcagtcgcagttggcacagtagaagttatgttatgaaggttggactcatgatattccacgcgtcccgtcttcttggagctgaccgtgggcctattcttgaggtcatcgtatcaagaatgcgatacatatcatcacaaacagaacgttcaattcggtttgttggtttatcaacagcattagccaatgctcgggacttggccgattggttgggcgtcagagatgatggtctgtttaatttcaagcccagcgtgaggcctgtacctcttgaagtgcatattcagggatatcctgggaagttctactgcccgagaatgaatagcatgaacaaaccagcatatgcagccatatgtactcattcacctgataaaccagttctcatctttgtgtcatcacgtcgacagacgagacttacagctcttgatctcattcagcttgcagcatctgatgagaaaccaacgcagttcctcagcatggcagataactctctagacatgattctttcacaagtcactgatagcaatttgagacatacacttcagtttggaataagtcttcatcatgcanntctaaatgatagagatagatccttggttgnnnaactcttttcaaacaacaagattcaagtactagtatgcactagcacactggcttggggtgtcaatcttccagctcacctggtcataatcnnnnntactga

SEQ ID NO: 19960 - DNA, 1108 bp, Triticum aestivum
  unsure (1)..(1108): unsure at all n locations
  Clone ID: PAT_TA_19960
ttcgtcttcttcttcttcctcgggctgttcttggtggcagaaataggggaagggctagntataggggngaataaatactgtgtcttatgggtaactgctggtttcgggggagttcctacattaacagggtctccactgcaaagtcagagactcccaagatccagagcccgtcggagagggaccggagcgatgagagtaggctgccgtcgaacgcgagggaggtggaggccatgcggctcgactcggccgcgcggaacccgctgaccgccttctctttcgaggagctccggaaggtgactaacgggttccggcaggactcgctaatcggcggcggcggcttcggcagggtgtacaagggtgccgtgggtacggacggcggcggagacgagcccctgcaggtcgccgtcaaggtgcacgacggggataacagcttccagggccacagggaatggctggcggaggtgatcttcttgggccacctatcacacccgaatctggtgaagctagcgggctactgttgtgagggcgagcaccgggtgctggtctacgagtacatgccgctcggcagcgtggagtcacacctgttctcacgggtgatggcgcccctggcgtgggcgacgaggatgaagatcgcgctcggtgcggcgaggggcctggcgttccttcatgaggccgagaagcccgtcatctaccgcgatttcaagacctccaacatcctcctcgaccatgacttcaatgccaagctctccgacttcggcctcgccaaggacggccccgtcggcgacatgtcccacgtctccacccgcatcatgggcacctacggctatgccgccccagagtacatcatgacagggcacctgacggtgatgagcgacgtgtacagctatggggtggtgctgctggagttggtgacagggcgcaagtcgctggacaagtcgcgtccggtgcgggagcagacgctggcggactgggcgctgccgatgctgacgcacaagaagaaggtgttggggatcctagatccaaggctcgactctgacgactaccccgtcaggtccgtgcagaaggcggccatgctcgcgtaccactgcctcagtagcaaccccaaggc

SEQ ID NO: 19961 - DNA, 1075 bp, Triticum aestivum
  Clone ID: PAT_TA_19961
cggatccccgcccgcgccccccgcctcctcggcccccccccggtcacccgcctcctcgcctggccgccgctctccccctcctccgccgcccccgcgcccgccccccccccccccccccgcccccccctccccccccccctccggccgctcccctccccccccgccccgcccccccccccccccctctccgccccccccccacctcccgcctccccccccccctgccgccccggccccgcccgggcgccccggcccgtggaggggagcgcggcggaacgggggggctgcggggcgacgcgccccctgccggcggtggcccccccggccgccgcggccccgccgcggcctcggcggagcggcggcgggtcgcagcggacgcgcatcgccctcggccagcacgctcaaggtcgcagcaaggtggggaagggcggcgtcacgcccaacctcgtcaccgccttcacgggacaacctcgagtccaacgagctcctcaagctaaaaattcatggaaactgccctggagaactacctgatgtgatacgacaacttgaggagtcaactggatccattgctgttgaccaaatcggccgctcggttattctatataggcctagctccagcaagatgaaaaagagggaagaagtcgctagaaacagagaagagtatgcaagaaacaatccgaggtttggaaaatctgaaaatgcatttgaagaacgtcctaggaacaacagcgcaggcaggagattcgtaaaatctgggtcgacatttaggactcaacagaagagaagaccggtagcatccaaggggtcgtcatacagcagagggtagcagcatcaaaaataatagattgtttttcttattgtatggaggaatcatgtaaattgagacccactagttgtataatggacattagtgtttagtttgtgctagtaaccatggtttcaagtctcatcaaccacaaagacaggctaacaccacttcaaattgtcgtgattcccttttattcggttggaagttcgtaggatctacttgagaatttcaaatccgagacaaccaatgagggcctcgtccgaatcg

SEQ ID NO: 19962 - DNA, 708 bp, Triticum aestivum
  unsure (1)..(708): unsure at all n locations
  Clone ID: PAT_TA_19962
gcacgaggctaggcagccagccagccaggagcgcgcgcgcgagcttggtcggaggagggggggaaggaggnnnngagcggcggcgatgaaggcggtggagcgggcgaagctggtgcggagcctgcggcaggagtcgcggcggctgcgcctgctcgtgctcgtcatcggcttcttcctcgtcaccctcaccttcgtcgtcctctccaagcccgacgccccgctcttcaacctgaacggccggctgtcggtggacgacgcgccgcgctcgctcctgattcgccaggccaccgacgccactgccggcgccgacccccgaccaanagattcgccgccgccgccgcccgccgcccaagaacccaaaggtgctggacgaattccaaaaaccccnaanccaacaacaaagggaaccaaccaaaaagactcccgagggaagaangggngcaaaaacctcccggcgattcttcaancaanaagcgcccaaaaaanggggccttaaacccccggctgntaaaggaactaatggganggttaaagggggaaaaaaaaaggnaatccaaaggtgancctcccaaaccgtttncgaaataatacaaaccgttaaccccaagaacgggaaaaatgccaagcccaacaaaggttncaaaaccaacaaanaaaaaataaacntnaaaattgccccccgcaaaaagggnacggttttnanaaaaa

SEQ ID NO: 19963 - DNA, 669 bp, Triticum aestivum
  unsure (1)..(669): unsure at all n locations
  Clone ID: PAT_TA_19963
cctctctctggctaaggtagcagtgtagcgatccgaccgagaagaccagctctccctctccctggctaattaaggtagcagtgtagcgatccgatcgagaagatgagctctattggcatgatggaggcgaggatgccgccggggttccgtttccacccacgggacgaggagctggtcctcgactacctcctccacaagctcaccggccggcgcgcatacggtggcgtcgacatcggtggacgtcgacctcaacaagtgcgagccatgggaccttccaagaggcggcgtgcgtcgggcggcagggagtggctactgcttcagcctgcgcgaccgcaagtacgccaccggccagcgcaccaaccgcgccacgcgctccggctactggaaaggccaccggcaaggaccgcgccatcctcgcccacggcgccggcgacgccttggtgggcatgcgcaagacgctcgtcttctaccagggcagggcccccaaggggacaaggacggagtgggtcatgcacaattcccctggaggaggacggacgcacacaacacaaagtcgcgcgcacccgcgccagtgcactaggagctcggtgtatcaggtggatcacctggctactacgcagcacagttctacaagagcacagcgaccagcccgacccctcccccnaaaac

SEQ ID NO: 19964 - DNA, 1271 bp, Triticum aestivum
  Clone ID: PAT_TA_19964
gcttcctctccgggctgtcaggcagtccgcaactcggcagattcaggctttcagcgcagtgcactcggcagcgaggaccttgtctcgaaaaaaagagaggaaaaactcggcagccaggaccaacgacgcggcgacgacggcgagcgtgaccgcgagcgcgcccagtctccctacagatccgcgcggcggccggcaagtttcagggatcatctgcactgtaagctggtagctgattgagaagaggggaataccagcaatgttctccttgttacatggtctatggaaccatgtgttcagcaagacagagttccgtgtgctcatccttggagtcgataaggctgggaagacgaccttgctagaaaagttgaagtcaatctatttgaaaggagaaggtcttccacatgatcgtattggtccaactgtggggcttaatattggacgtattgaagatgcaaatgtaaaacttgttttctgggatctgggaggtcagcctggcctaagaactatatgggagaaatattatgatgaggctcatgctatagtatacgttatcgactctgcctccgcatcaacatttgaagatgccaaatctgctcttgagaaagtgcttcgtcatgaggatctgcaagaggcaccactactcgtattcgccaacaaacaggatttaccagcagctgtcacagaagaagaattggacagacatcttcaccttaaagagtttgatgagaggccatatatgtttgttgcgggatctgcatatgatgggacggggatcaaactgggtatcgactggttggtagaagaaatgggaaagagtaggcgcaccgaggctctgagggcacgcaccgacacatatgcgaagatttagcaccatgactcaaaactctggtatcttcgattttgagaagcacaaagcatttgaggacgctggctgatgtcgttgatctcgtgtatacgcactttagcataatgtcatgatcagttgaagcccatcgtcatcctcactctgctatagccccagaacaaaatgccttatgatgtggctcttgcagtagtgatggcagaagcgattgttcgttcattactccaaggatgtacagtcattactcgtttggattcagtgttcatatgatgttccttttcttgaaacatgctgagtggcaaatgttgagcacatggtagctttgtacgtccgcaatgttgtgtcacataattacatgctggtgagtggcaatgttgagcacatggtagctttgtacgtccgcatcatg

SEQ ID NO: 19965 - DNA, 735 bp, Triticum aestivum
  Clone ID: PAT_TA_19965
gccggccggctcgggctcgccgcaactcggcagtttcagcgcagtgcactcggcagccaggaccgccaggtcaaaccacgccgcgacgacggcgagcgtaaccgggagcacgcccagtctcggaccaacgacgcggcgacgacggcgagcgtgaccgcgagcgcgcccagtctccctacagatccgcgcggcggccggcaagctttatggttcacctgcctttaaactgtgctgtttcaaaccggaggaaacaggaaaggttgtcctttgttcagatctaggccatattgtgctcagaggacagagttcagtgtgcttgttcttgggaccagaggcctggaagaaccttttaagtaaagtgaattaatctatttgttagaagttcattcacatgtccaatgtttgacgatcaagacttgggtttcttcaccaacttcctggggatcttcatctttgtgttggtcatcgcgtaccactttgtgatggcagacccgaagtatgagaactgatcgccttttgtttagcaatgagaccgtattatacttggagcaaatagggaaatgtgtctgttaatggtaacagagcgcttgacagatcttcttaagtgcaattacctggcattgtgacttgaatcatgtttaatctgttgaacaagtgaactgtggagatttcgaaagatcgatttactatctgtctatgttgtacccaaaaaaaaaaaaaaaaggcccctaaggg

SEQ ID NO: 19966 - DNA, 769 bp, Triticum aestivum
  Clone ID: PAT_TA_19966
cggtgcaggttctcgtggatttttcccaactagctagagccacagccacagcaatggaagctctcgcctcgtcgccgcgggctctcttcgcccgcaccgccagtccgaccacggcgctggccacgccagcaagatggacgccgtcatcgaccaggcgtgtcaaggccgccgccgccgccgagccggccggcgaggccaagccggctgcggcagccgcgtcgccggcgcccaagaagatcctcaagaagaagcccgtctactccatgaagaaaggacagatcgtgcgagtcgagaaagagaagtacctgaacagcatcaattacctgtcagtggggcacccacccttctacaaggggctagactacatatacgaagaccgtggcgaggttttggacatcagaatcttcgaagaaaccggagagtatgctctgatcgcgtgggtagggattccaacaccaccagcatggctcccaacttatatgctcatcaagtcagacaaactcgactatgagaggatatgatcgctggatgagcaattgcgagggagaacaatgttttgtgcataaattgatgtcgctatgtggtgatgttgtgacattgctccatggatacaaaactaagcagttgtaaattaaagaaacaatagtgaaatatatccaaagtttttttatttaagcattttcttttccaccgttccatggcgttggccatcccgcccctcctgttttaacctcagcatgcctgaaataagacgcatttaaattaggct

SEQ ID NO: 19967 - DNA, 654 bp, Triticum aestivum
  Clone ID: PAT_TA_19967
gcacgagggagagattcaacattgcgcgagggggcacacgcgcagaaatggcgtcctcctccctctgcgccctcctcctcctcctcgccgccttcgcgtgccactgccatgcggcggcggcggcggcgtacaggcggccccgcgccatcggcgtcaactacgggaacctcggcgacgacctccccacggcggcgcgctccgtcaagctcctccgcaaggcgcacgcgggcgccgtcaagctctacaacgccgaccagcgcatcctgcacgccctggccgggacgggcatcccggtctccgtcatggtgccgaacgacatcgtcccctctctggccgactcccgcgccgccgcacgcgagtgggtggacaacaacctcaagcggcacccccgggtgcgggtgaggtacctgctcgtcggcaacgagttgctctcctaccccgccctcgcggcgtccacgtggggcaagatcgtgccggccatgaagaacctccgccacgcgctccacgcgatcggtcgcggccgcgtcaagctcgggaccccgctcgccatggacgcgctcgcggcgtcctacccgccctccgccggcgcgttccgcgaggacatcgccggccccgtcatgcggccgctgctcgacttcctcaacccctcccgcg

SEQ ID NO: 19968 - DNA, 605 bp, Triticum aestivum
  unsure (1)..(605): unsure at all n locations
  Clone ID: PAT_TA_19968
gtctggggcttccgcgacccatttatcgtcgtaccccgtgattatctatgcctcccggacgcatagccagcttcggcaggtgatcaaggagctcaagccacccactacagtggtaccatagttcttgagcaataccctctgtcgtggatgcntctgttcttatttggaggntgatgtgtggaaatgtatgctgtttagtatttacccttgatgcctgtcgtcngaggtttggantgcagttatttcgggttaatttcatagccccttcactgtcagtgttgattttggtgcataacgtttcacagccgaaaatggcagtgctgggctcccgtgagcagatgtgcatccatgaagaagtgagcaaactccggggaaaagcacagaacaatggttgccactacctctgcaagaagcgcttgtgccgtcataacaacattgtcactgattacatgaaaaacaacaccgagcttgggagtgagccttttgacattgaagacttggttaatattgggagaaccaagggaccttgcccatattacatttcccgggagctttcccaagtcggntgatattttatttgctccttataactatctcattgatcc

SEQ ID NO: 19969 - DNA, 1553 bp, Triticum aestivum
  Clone ID: PAT_TA_19969
tttgcagcccccagacgcccataggtgtggccttcatgcttgctagcgttcgcgatggggggcaggtgccgcggagatgaccgcccccctccttgccggcgagtcgtcggctgtggacgcggtgccgccgtggcgggagcagcttacggttcgggccttagtggtgagcgccatcctgggggtgctcttctgcctcctcacgcacaacctcaacctaacggtggggatcgttccctcgctcaacgtcgccgcggggctgctcgggtacttcctcgtgcggacttggacggcggcgctcgggatgttcggcgtcgtctccaagcccttcaccaagcaggagaacaccgtcattcagacctgcgtcgtcgcctgctacggcctcgccatcagcgggggattcggatcgtacatgcttgcaatggatcaaaaaacttatgagcttatcgggactgattatccaggtaacttttgagttgatgtcccgtgcctgcgaaactgcataatgatcgtgagcaaagtaacacatcctttcattggtatttttcctctgcgcatgctcatggagaactcatttttgaatacttcgaaacagagcacccgtcttttcgacctccgttgtttgaaaaaatcaaggagcttagctgcctaaatgtatctggtgactctgaaaagctacaaagtgcgaaattgcgtgatctgcatccggcttcttggtactgtgttgcttggtatcctgtttatcgcgtacctcatgggaacttccgtgcatcattcttgacataccattcactgggtaaactggttccacaaatatgctccccagattctagtggtggtcaggacacccgaattgtttgcccggctgttggtctgcagagttacaatgacaagggtgagcaatggtttgagctgagatgtcgagattcctcgaagcccagtggcgctgaagttgtggaggagaggctgaggacactgaagcgaggtgcattcgcgatggcaagggctgtcattcctaggggatccgaggagtcgtctgcgaaccaccatccagattatgagtttttcctgtcccggtctacctaagactatgctcctttgcctgctatgctaacgcgccgcaagaatcccatgaagaaatttacaaaaaaattagagcataatagatatgacattccactaaccagtggtcggcagtagtttaccctagaaagaagaggagaagagaagggaagggaggggatactataagtgacattctaacctactagacacctgatgatgcaaacagggttgagttttagaccttgaatgttgtacaagtgtgccaaggggatcaaagagtttggcaacattttcgttttacagatcatgcaggtaggcaggcaggctggttctgcttctgcaggtgctttttttgtacagacaaagaaaaatgagagcaagatgagatttgctactcaacctttttccaatgtcgatgaaatgcggaactagtatttctctctaccggcttttccttgattaatcatacccaagcaacatggtaggcattt

SEQ ID NO: 19970 - DNA, 1037 bp, Triticum aestivum
  Clone ID: PAT_TA_19970
atcgcgcgcaaaaaccacccccaccaccgcggacaccaccgcagggcgtaagcgcgcacggcgtcgaggtccaccatgaccatgctcgcttccctcttctccccttcccctctcctcaccaccgccgcctccacctcctcctctgccacctcgcagccagcgccacagactgtgaggctcccggctcccaggccgctcaccgccacactggccgcggcagccgcggccggcctcctcctgctaacccccgcagcgccgtcgcacgcggagggggagttcaaggtgtactacggcacggcggcgagcgcggccaactacggcgggtacggcggcaacgcgaacaagagggacgcggcggagtacgtgtacgacgtgcccgaggggtggaaagagcgtctggtgtcaaaggtggagaagggcaccaaacggcacggacagcgagttcttcaacccgcgcaagcgctccgagcgggagtactcaacttcctctccgggttccgcaagctggcccccgtcggcgccgtgctcgacaactcgccctctctgacgtcgggctgcaggaccagatctcgtcggcggacgacgtgacatcggcggagcggaaggacgcggacgggcaggtgtactacgagtacgaggtggctggcgccggcgcgcacagcctcatctccgtgacgtgcgcccggaacaagctgtacgcgcacttcgtcacggcgcccaaccccgagtgggggcgcgacgaggccgtcctccgccgcctgcaccagtccttcaagaccgtcgacttcagcggccaagattaacatgcatgctgcgcgcgtggccttgtaattaattaagcggttttgtataggcgctatcatcgaggaagaggtaattgatctggatgattattcagaaccggcatacagtatcttgatctgtaaattgctttcttcctctgtgtaagaccagcagtgctgctgtagactgtagtgttagcaacgaaacggttcaaatggagtgaatgaaagttaacatgcgcactgttaattaaa

SEQ ID NO: 19971 - DNA, 1036 bp, Triticum aestivum
  unsure (1)..(1036): unsure at all n locations
  Clone ID: PAT_TA_19971
cagctccaccgctacactttgccgggtattcatccggagtgcgtacggaaggagttacccgggaagggttaagganttntctctctgtagttggtggcattaactcaagtgtttttgcgtacgggccaaccagtagtggggangacattcactatgnttggggtgacggaatgcccagtagcagatatatatgattatattaaccaggcatgaggagagagcatttgtgttgaaattctcagcaattgaaatatacaatgaagttgttagggatcttctgagtgcagaaaatactcctcttagactttgggatgatgcagagaaaggcacctacgtggagaatcttacggaggttatattaagggattggaaccacctcaagggacttatttctgtttgcgaagctcaaaggaaaaccggggagaccttcttaaatgaaaaaagctccagatcccatcaaatacttaaattgactgttgaaagttctgctcgtgaattcttaggaaaggacaagtcaaccacccttgtggctagtgtgaactttgttgatctggcaggaagtgagcgtgcatctcaggctatgtcagctggcacaaggctgaaagaaggttgccacatcaataaaagtttgctttcccttggcaccgtcattaggaagctaagcatggggagtaatgcacacgtaccgtatagagattccaagcttacacgcatattacaaccttctttgggaggcaatgcaagaaccgcgattatttgcacactcagccctgcaacaagtcacattgagcaatcaaggaatacactgtttttcgggagttgtgcaaaggacgtagttacaaatgctcaggttaatgtggtcatgtctgataaaacactagttaagcatttgcaaaaagaagttgccagactggagagtgagttgcggcagccagtttcaaactctagtctggaagcacaggtgaaggaaaaggacaaccaaatcagaaagatggagaaagaaataaaagaactgaagtcgcaacgtgatttggct

SEQ ID NO: 19972 - DNA, 643 bp, Triticum aestivum
  unsure (1)..(643): unsure at all n locations
  Clone ID: PAT_TA_19972
tttacacatggtattagagcggttagtctcacggcgccgatcctaggttcctttaccacttccgcaacacgccgcccccggggagattaatcttctctccccgggggcgcggcatctgatctgatcaaatattagattggttctttagattagtttagaatcaattcttcagatttcgaatttctagtagtctggtagatcaaattatattaggttgatttctttccgttagccaaacaaattcttattagattgatcccatctggtgaagaatatccagcagatcggtgcggcggctgcaccgccaaccgacctcgactcggacgatgcatcgccaagctgtacaagcagccacgagccgttcgaccgcccgagtcttcctcgatccgaacctgcgagcgtcgttgagcaggccagaatcacgtagcttcttggcggctcgacgtgggtacgacggtgcgtttccagagcagccacacaccgagcccagacgctggagcagccggcttcaatcaggcgacgccgcgcgcggcacggggctcctttcagcccagccgcacgtcgacttcgatcgggcagtcaacaaccgcgtgcaacccatccaccactggacgtggaccaaagaagatcnnnagatttcnnn

SEQ ID NO: 19973 - DNA, 960 bp, Triticum aestivum
  Clone ID: PAT_TA_19973
aactaattgtgcctttgttatactgattgtgcctctgatataaatcgaaaaatacagaatacaaagggcaaatggagaaacacaatgtcctcatctctgcagataactccatagttctggtgacaacagaaatgcaattctcatagtaggcaagctgtgtatgatgatactaatagtctaatactaccactcatttaactgcccactcatcatgactgatatcaaccaagggttcctccgacatgtccatcctcagttcgccatatgtatgctggcctcgacttgcttggcggttaacagggcacggacttcggtatcttgatcggccatctcggcggctgcctgcccgtaggcattctccttcttgggacatgcgccagcttcgagcagaagcttgacggtgtccatgtgttcccctctggcagcatggtggagtggagtatcgccttcagcatcaacggtgttgagcattcgcgttgcacaaccctcagcatttgcagcaaaactgagaatgtactgaactatctcagtgaagcctccagcacaagcatcatggagaggaattgccccttcttcatctttgcactctaagcttgctccacgttccagcagtagctgcacgcaaggtagatggccatataagcatgccaggtgaagcacagtatcaccatcttcaactggatcatcaatgctgccaccatagttatcgagcgcggtgcggagggcgtcgacgtcgccgctctgggcggcgtcggagagggcctggaggtggggaggcagcggcgcctcctcgtcgtcggagggggcgacgaaggcgccggcgtggtcggcgacgtcgtcgtcctcgacgaggccgttgcggccgccggggactgccatctgcggcgaggactcgcttggctagggtctccgcgcgcctgggcttcggtgggccgcgagcgtgtgctgcgtctgacggcg

SEQ ID NO: 19974 - DNA, 687 bp, Triticum aestivum
  unsure (1)..(687): unsure at all n locations
  Clone ID: PAT_TA_19974
cgcatccaagccgcctccacccctccgcggatctcccatccatggccgccgccgccccggcccgcaggctgctcctgcgcctgcgcctcccactccccctctgcaacccgccgccggcccccgtcccgctcctcccccacctgctgacgccgcacctccacccgcagccaccgccgccggcgcctccgctcccggacccgcagccccgggacctcctcttcgnccttccaccccgccgtgcacgcatacccgtccctcgtcgaacgtccccgagaggaggcccgggcggccgcgacgcgcgcgaggacggaggggggcccaaggagccggaggtgtgggcggacagcgtcaagaagaagcgcaagcgcaagatgaacaagcacaagctccgcaagctccggaagcgcctccgccgccagacctgagctgccatggatcccggcttgaggattgtgattgcaaggaggttctccggtgccgctgccacaccggtttcaagctgatggtttcttccagttattttggtttggttataggagtagcagttctggtaccaacaaagcaattgctgcgactgggcacgatacctacaaacactgtaatgacaaggagccaggaacgggctgtttcatgtctggatttctggcaggcaaataaagcttcaaatgcccgtctaaaaaaaaaaaa

SEQ ID NO: 19975 - DNA, 679 bp, Triticum aestivum
  unsure (1)..(679): unsure at all n locations
  Clone ID: PAT_TA_19975
gaattcggcacgagtccccctccctctccctcccccctcctcccctgccccgctccccccccctccccccagtcccaacccaccaatccacgttgactcgccaaccaattccagacgcgtgccgctgatggacgcttctcccaccgccgctgcccgccgcgcggcggcgatcgcccgccacctcgctggcctccccttcggtgccgccgccgccgtggcggggctgcagttctccccgtgcctgagctacgcgcccccggaatcgtccgaggccccgccggcgttcgcgccgatggagctccgagcgctcctcgacgggcaccacctgagggagcgcgactgggcgtacggcgcgatggaggagagcccgctcttctgcccccgccgcgccggcggcaaggtgttcgtgtcgccggactacaacgaggggaaggaagggcagagggaggccaccatgcgccggatcgggtacctcacgcgccggggcgtgttccgtggctggctcacggagccagggcccgacgccgagcttcgcaagctcgcgctgctcgagtgcctcggcgtctacgaccactccctcgccatcaaggtcggcgtccatttcttcctctggggagtgcgctgtcaagtttctttggaacgaagccccatcacgacnnntggttgttggacacagaaa

SEQ ID NO: 19976 - DNA, 608 bp, Triticum aestivum
  unsure (1)..(608): unsure at all n locations
  Clone ID: PAT_TA_19976
gctcccgggccatctgngctcccnttgagtccaaacccagcaaccggagcggcgaatctcggcaggcaccaccgcccagcaagcagccgccgccgaggccagcgatgactgccggcgccgcgagcgcgggcgcggtccggcgggcggtcgacagggcgtgcgcggccgccaggggggcgcggcgcgcgctggcgcggttcgcgccgcggccgtcggcgttcggcgcggcggcggacgcggaggccgcggcggtgcgcggggtccgcaacgcgcgcacgttccggtaccactacgccgcgctgcagtgggcgctcctcctcgcgtcgctggccgcggcgggccaccgggcgtcggtgctcttcctcatggccgcctccaaggtcctcctcgtctgcctcggcctcctcgcgccgttcccgcgcttggcgctgctccgccggctcgtcgccgcggcgttcgtcgcgctcgtgctcgccgacatcgccgcggccggcgccgtggccaacctcatggccgcgctggcggtgggcgttccggtcatcgtgctccacgcctcgttccgcgtccgcgatnnnnctcgannnccctcnacnnnnnnnnnnnnnnnn

SEQ ID NO: 19977 - DNA, 1680 bp, Triticum aestivum
  Clone ID: PAT_TA_19977
gccggccgggttccgggagacttgcctgaaattgccatttcaggagatgtatggaatacttgaagcgatgaaagcaagaaaccttgagcctgcgctcaattgggctgccaagaaccatgatcagctgttacagaatagctcaatgctcgagttgaagctccattctcttcagtttgttgagatactcaccaaaggaagcagagatgttgctttacaatatgcgaggacgccaccgccgtgccgacgtgccggccccgccgacgcccaccccgtccgccgcaccccgcagcgcgccggcgatctcccgtcgccgacccacgagcccccacgctggcaacctcccttagccgcccctttcctccaccacgagccccgagcagcaacgcccgacctctaccttccctgcccggggcatctccgacaagaaccgcgacgtgccaaaaccgtgctgcttagttgggtgcatgaaaatggagatcgacagtttaagagaggcatttgaccgagttgttgaaaagcgtgtgttgtcttctgctaaagttcaggaagctattggtcacatagtgaatgaagttgagcaggcaatatcgaagatgcagatgatgaatacagataccatggacagttgtgaccactcatccatccttgcagaactgaaggccaagctaaacgaaatggtgccattgatccaacttgaaggatgtcaaaaggaattgaatgttgccctgagcaaatatctcaagctcctagagaagtcttttagtccagatataccgaaggcatatagaaatgtgaattatgatgcctgcacagtaaacaacataaaaactaatcattacttggtgccctgcctctctgatcttggggcagagatccagaagctaatggcttgcctgatctgggctgaccggcttgaacagtccccatatgccgagtttgtgtcatcgacgcattgggataagctagccgaggagctaatccaccagttctgcagcctcttaggtcagtctagcgatagcccactgagtgtagcctatatcagctggtgttcaagcgctcccgaagtagctagctgaggccatagtccatcaggtctgcagcctcctaggacagtctcgagaaagcccacttcgtgtagcaatagccgctggttttcaaggactaccaaccttgttgaagctaagcacggtaatggccgccaaaaagcaggagtggcagaccatgaaacagcttccggtccccatagacatcggaccagagttccagtaccactctgttttcgtatgcccggtgctcagagagcagtcgagtgaggataaccctccgatgctgatgccctgtggacatgccgtatctaagcagtcgatcatgaagctatcaaagagcagctccaggcctttcaagtgcccctactgcccctcggaggcggtggcttcgcagtgcaagcagcttcacttttaaatgcttcatttctcccccccagatcaaaacggttcatactacacgcttctgtttcgctcttccaaaggcttgcctgtattataaccttgtacctttattgaaacctggatgttaatctgtacagtagcgagttccagtgttaagctatctctcggaataaacacagtcccaagcgtgttaaaaatatctcttggtacaaaatacgaaaataagtttcac

SEQ ID NO: 19978 - DNA, 968 bp, Triticum aestivum
  unsure (1)..(968): unsure at all n locations
  Clone ID: PAT_TA_19978
gtccagaccgaggtatctaaagcggtggcagaggagaaacgtgttgtattcacaggccattcatctgggggttcaatagccacccttgctgccatatggtttcttgagaactgcacaagacggggaagtgtcaatcaagcacagccattttgcgtgacctttggggcacctcttgttggcgataatgttttcaaccatgctgttagaagggagggctggtcgcagtgtattttgcatttcatcatgccactggacatcatcccgcgaatactgctggcccccctcgcatcctctagagaacaaattcagtccgttctggattggttatctcctcacagtccaaacttctcacctgttgcgcgtgcgcttgttattccagagttttatgaaactttgttgagaagcaccctatctattgccagctacgaggcctgttctttcatgggatgcactagctcaatcctaggaacgctgacttcctttattgagctatccccgtacagaccctgcgggacttaccttttcttgacaagtaccgatcaactgattgttctcacaaactcaagatgctgtattacaagttgctattttactgccttcaattgggtccccaacaacaattgcttgatgccgccgccagaagtttaagtgctcactgggaatatgaatcgattaagcaaagtgtgatgcaagagataggttgtgtggattacctaagagcaattccctcccccctgcctggtggtcaggggaatgggtcggcccttgctggcctggacctctgcctggcggctgtgctgggccttgcggcggctccaccaggggccaagcatagtggggcaaaccaagcaaagatagacgcaaactgcagtaaaattcaggaagccctcaagtccctgaacgagtacaaaagaacatgcgagctgcatgaagtgagctactatgattccttcaagcttcagcgggan

SEQ ID NO: 19979 - DNA, 636 bp, Triticum aestivum
  unsure (1)..(636): unsure at all n locations
  Clone ID: PAT_TA_19979
ctcgactagggtttcttgagcgcagccgccacactagctcgatctgttctttgtccgtgctccgacaccgcccgagccccgtcacctccagttcgcacctgatcctctccatccctcgttgcgtcccaatccacccctcacactcgtaccatcccctcctccaggatcgacgattgtaccacaatgcgtcgactctgcttctcctggtgatgacctgaggggatgtgtttccaggcattggatagcgatcgtggccaagttgcggcagtgcctcagggttgctggtgacgggtgggactgcctaagcatgatcgatggctgctccagagtgcatcaacttggcatctcaggcggcggcgaaaagcgagctacggcggagcctcgacgttgcctggcgaggaagtggtgcaaggtgcgggtctgcagctccnnnngaatgcttctcccaccacgtcgttgcggattgtgaccctgttccttagccacgtcgcnnnctgctctgattgtgcagcgccgacctcggccatgtccgtcgaccgccgtgggcattgttcgctgcctacatgttgtcctgtgtcggtttgccagttgccacacaacctataattaactanannngnnntgctgtttactcnn

SEQ ID NO: 19980 - DNA, 649 bp, Triticum aestivum
  Clone ID: PAT_TA_19980
ccggttttctccttcgtctaatctcctccggcggggcgcagaatcagggcggagttctgggcgcccggcggagcctttcctcggattttctctctcgccgtgcttcttcccggccgcggccgcggccgcagtcggcatcgcaagtgcttggcaaatagcaaggcgctatgaaattccgcaaagggggcaaggtggaggtactgcagaaggcggaggcacctttcggttcctggcggcctgccgagatcctttctggcaatgggcacacctatcttgtaagctatgatccatgtctgcttgccggtagcctggccattgaaagggttccaagaaaggtgataaggccttctcccccgtccccagatggtccggtatgctgggtcccaggcgacatccttgaagtcttcgacaactattcatggaaggttgtggaagtcgtgagattgcttggtcatgagtactatcttgtcaggctcctcggatcctccctagaattgagggtagatgcatccaatcttgggacaaggcagctttggcaagatggcaaatgggttgctcttccccaggattctgccagctgtgctgctggttcacacaggagtcggacagaaggtgcagactccgcgcgcagtcagctgccaccaacatc

SEQ ID NO: 19981 - DNA, 1024 bp, Triticum aestivum
  Clone ID: PAT_TA_19981
ctctcctctaccaaaactgtaccggcagaattgtactgccttccctgactgatcggtgatcgccgatcggtttctgaccttctacttgcaccttaaacctgcaactatacgctgatggagaagatgcgggcagcaggggaggcgccgccgacgcagcagctgcctccggggttccggttccaccccaccgacgtggagctggtgctgcagtacctccgccgcatggccctggaccgcccgctgcccgccgccgtcatccccgtcgtccacgccgccgccatgcccgacccctgggacctccccggcgcgagcgagggggaatcggcttacttcttcagccagaggcaaggccgtggcgggcggcggaggagagcggccggcgggtactggaaggccacggggaaggagaagccggtgttcgtgcagctgccggttggcaagcggctgctcgtcggcgtcaagacggcgctggccttccaccgcggcaagtcgcgcacggactgggtcatgcacgagtaccgcctcgccggcgcggcggaacagaacaagggtgccaatgacggctcgcagagcagcgaatgggtcgtgtgccgggtgtctctgaaaagcagagcaaggaggacggcagcgggcggcgagacgaccggcgatcaccagcaggagcagccatcaccgtcgccgtcttcgacctcgagctgcatcacggaccacacttgtcacgccccagaccaagaagaggtcagcagcagcacaactagccattgccagcagcatccaagacgctaagctccagctgctgctgcagtgcgatcatgcctcccaaagagaggcctagccaggcatttaaattccagccttccttgtacctgtccttgtatacgtacggccgcagcgccatgataaccatgagaattgggttgaatgagaagaagaaatctccattaaagcggctgcggcatccgcatcagctgtaacttgcaagtctccccaagacactcatcaacgaaagggaaaccagcggcat

SEQ ID NO: 19982 - DNA, 610 bp, Triticum aestivum
  unsure (1)..(610): unsure at all n locations
  Clone ID: PAT_TA_19982
cgaaccgccggccggcggcggtggagccgatctggcgcggtggccaccgacgccggccacccccagtgcatctgacgcctcccctcagccccagccaccacagaaaccacgcccccctcctcttcgtcgtcttctccgttcccttcgcagtctcctccgacacaggcctcggcaaggatgccgccgatgtcgttcggccaccaacgcctctcctactccctcctcaactgcagcagagttccactgctcactatctccaccacctcctccctcctcctcgacatcccctctgccccccttcccccatctccttcagctacctgcgcaagtcgtcgccggcgccgttcatgccccaacgtctctcctatctcccccctttccttctgcagcaggctcactggccaccgcccaccaccaccacattccgctcctcatcccagccccttccgacgccgacttccagaagtatgccgccgccgccgcctacgacctgctcaattctgagacaacgatgccacctactgctatttccccttccccgctgacgcactccaccacatgttttggtgtgattgttgatgtggaggtgctactgcctttccttgccann

SEQ ID NO: 19983 - DNA, 911 bp, Triticum aestivum
  unsure (1)..(911): unsure at all n locations
  Clone ID: PAT_TA_19983
caacaactaccaattggtatccacggaagaatcgcagatcaacaaccacgaccatggaagccacccgcgcatgtccttactgggtatggctcatcgtcgccgggctgatcttcactgtcgccttcgtcctaatcttcgtcttcgtgatacccggcgacatcttctactccatcgccatcgactccgcctccggcctcgacccgccgtcgcccaccgacttctcgctggcccgcccagagttcaacctcaccttccgcgtcaccaccgacggtcttaggcgcaccgtgtgcgtggacgctggcatctacgtggaggtttcctaccgctgcgtcccgcttgccgccagccccgccacgccgcaccggatctgcgtcgcgccggggcacgggggggacgagcccatgttcgcgaggggagcccgcatccgcctgccggggtacatgatggacagcctcgccgccgacatacggagcggggtggaggcgttcggcgtcacgctcaaacagtcctccggtggtgctctagccggcgagggcgagaatgtggcaaagtgtggggctaggcgggtcggggacgtccccaccaggtgcgatacgttgtacacgtgccccgatggggacccatcaaggagtgctccagactctgctgctgcttccccaagaagtaccccagatactgctgcttccccaaggagtactccggactcagctgccattgcgaatgcttctcgaccataggaagaacgatcaagatccttcggtacaagatacattatggatttactagatttgtttgaacgattttttagttaattttattatattgctcttacagttacgcatattggtaatgcttccgctcttctgttatttgttcatgtctgttaatcaagagttattgacgtctttann

SEQ ID NO: 19984 - DNA, 911 bp, Triticum aestivum
  Clone ID: PAT_TA_19984
ttttttttttttttttcgtccaggctctcggtttgttatgcactgcgtctttgcagtatacatgcctctccctgcttccgcagctattgcatccatcaatacttgctctacaacatcaatgctttgcgcttctcattggacacatgttttttacctaaataaatgtatgatcagcagcacacaggcatcatcggcaggatacatatcctagatgtgacactagtgcgtatacatcatcatgtactactgcaaagtaatactagctagagctgcaggaggagcatcatcagccccacttctaagaactggaagcacgggacatcgtgtagcgggtgccccttgaggttcctctccatcaccctcctggccagggacacctgcttgcccaccgcaaacacggaagccttgccgtcgcctgatgcgccacgggctgtcctgccaaccctgcgcacgtactcgctcgggtcgcgggggtagtcgaagagcaccacgtggttcacgttcgtgaagtcgatccctcgtgaagctctgtctgtgcacacgaggaacatcgagtctgtagtctgtttcttcaggaactccttcatgtttgcgatgcgtttcgcctggtccaatgcagcatggaacggtaggaccttgatctgtgtcgctttcctgtccagccgtgtcagcacattctctacctttctacatgtctcaatcttattgcagaaaacgattgttttacgaactggagattcctcaataatctttagaagtgctgttctcttgttggaaaaggctgtttcaggattcttttcatcattgtcatttccactgcagtccacaagaatctcttcaagacgggcgcttgtccggtggacactaggtcccatgagcacctcacagtcaggaaatgtttcaacaacctg

SEQ ID NO: 19985 - DNA, 471 bp, Triticum aestivum
  unsure (1)..(471): unsure at all n locations
  Clone ID: PAT_TA_19985
aaaaaatagaattaaaancccaacccactcnctccggatcataaatgtcatcggaaatggcatgcggaccattggtttttggtcaaactattctggcttgttatcaactgtccctccagaggctctatattcaaagtccccaaatacttctctagccaatcagcaactctatgatgttatttggcctgggcagactgcacagaggcctcgaggatgggtttttccttctaatgccaaggagttaaaaattggtattcccaacagattcagtttcagggagtttgtcacgaaagacaatgttaccgggtcaatgaagggttattgcattgatgtctttactcaagcattggctttgcttccttatcctgttacctacaagtttgtaccttttgggagtggtactgaaaatcctcattatgacaaactcatacagatggttgaatcaaatgagcttgatggagctgtaaggga

SEQ ID NO: 19986 - DNA, 1106 bp, Triticum aestivum
  Clone ID: PAT_TA_19986
ccaaaacattgtcaggaagatcaatactttgctggcttgccaatttccattattgaatcttggtaccagcgcgagggctatgtgaaatcaatggctgacttaattgagaaggaactatcagtttttacgaatcctgaagaggttatgatattcttcagtgcacatggagtaccacttacctatgttaaggatgctggagatccatacagagatcagatggaagactgcattgctttgatcatggaggagttgaaatccagaggaaccttgaatgaccatactctggcttaccagagtcgcgtgggaccagttcaatggcttaagccatatactgatgaagttttagttgaacttggtcaaaagggtgtaaagagtctcctggctgtcccagtaagcttcgtgagcgagcatatcgagacactggaggaaatcgacatggagtacagggagttggctctagagtcgggcattgagaactggggcagggttccagctcttggatgcacttcatccttcatctcggatcttgctgatgctgtcgtcgaagcccttccatctgcctctgcgatgacgaccagaaaggtcaaggatactgactctgacatggatatgatgcattacctgaccaagatgttcttcggctcggtcctggccttcttcctgctgttatcaccgaggctagtttccgctttccggaatactcttcattgagctgcttatttttatcgatgctccgtggttaaccattttggccattgtaactagaaaccgtatacaggataatatctgggcgagaaagaaaggaagagtttgtttcacttatgtcttgcccataacatatcgacatgcccgttgtatgaaggagtcatgtaccaccagcatgtataatggcagatgcttatatactggcgcttaaaagggtacatggtcacatcgtttaccatgtacgtcagttttgtttaatcttttgcgaacctctcttcgggttcttataaataattatattccccgttaattagtgctagtttatatgcaaggttttttgttgagcccccatttgtaatcaaagatttattatattttaactaaaaccatgacacttatgg

SEQ ID NO: 19987 - DNA, 708 bp, Triticum aestivum
  Clone ID: PAT_TA_19987
gcgtcgcctcccccccccccccccccccgcccccccacgccctccgccgtcgtcgccccgcccgccgccctcggcgacctgccgcagggactcggggtgccgtggcggcgtcttccgctgcctccgcgtcttccgccgcccgctcctgcactcccgcccgccgctcgtccgcgcccccgccgcccgggtcgccggccccggccccgggcccgccgtccaccgccgggtcccccccttccacctcgtccgcccccccggccacctccgccgccccccccgcgtcgcccgccgcgccccgctcgtcgccggccgctttgaactgtgggggcaaggcgccacctacgacgaactggagaaggcgatacggcagtaccccgacgagaggaagctgccgtacctgacgcccgaaagctcgttcaagattgtcgtcgacagcttcggcaaggtgatcagcttcgaagagcagaatgagatcataaaggggttcacttacatcccattcgagggccgtgttaatttgaagaagcccgagcacaagttctttgtcttggagaccgatgactatgggtcacaaaatggcctcccgccagttgtccagaagacggtattctttggccgggaggttggagcagcagataggcatctattgccgacgtatcagttgaagagccggaagtacattggtccgactgcaatggattgtgaaat

SEQ ID NO: 19988 - DNA, 538 bp, Triticum aestivum
  Clone ID: PAT_TA_19988
gggacgcgcacctcgtcggtcaccatggcctcgccggcaatggaagcaacgggtgggggtccccggcgacgatgccggacgacggcgacgacgaggggttcggcagcaagcggaagggcgccggcatccggatgctcggcgacctgtggaagaagaagggcaacaagtgagaaggcgacgaccaggcttgcatatctgtgtaatgcccaacgctcgtctctctcgggtcacagatccacagttcgctcgcgacggcgagctagctcagctcagctcgcgctctagctccatgcatgcttggatcgatgcgctgatgtttactgcattttggttcggatttcgcttatgtttgtacgatgatgagatgatgttcgtgagattaaactctgtttggtgctcccgtcgtgagctgtatgatgatgatcgatggcttgatgctgtattgctgttggctgctgttgcccattgtaagatgcagttcggcgttatcttggattctgttgaagctataaccagattgtatgcttcaaaaaaaaaa

SEQ ID NO: 19989 - DNA, 1296 bp, Triticum aestivum
  Clone ID: PAT_TA_19989
ggcgcgcgtgcaccctcccccatcccctcgtcccctccgccggcgccggcgcgatgggaggcgacgcgccgccgatgaagaggcccaaactggagaaggacgacggctggtcccgccacccctcccccgccaacggctccgcgcccagaccccccgcctcccccagccaggcgccgccgccggacggggaggaggacgacggcgagctcccggaggaggccgtgctcgcgctcatcgcccaccacgagcgcgaggtcgagcgctacaagctcaagctggaagccgccgagaggaagctggccgacacgcggtcgaggctcgcccggcaccgaggccgcgcccccgatcggagccacccgcccccgccgccgccgcccgtccagaaggccgccgcgccggatcgcaggacgccgccaccgagccagagggaggcccccaagccggcggcgcagagccagaagccccccgcgccgcaggcgaggccgcagctcgtcatcccgggggcaggccacagccgtccagccccgcggcccgctttgcccgtaccgaagaagtccccgtcgtcatcgtcgccgtctttggcgcaggcgccgcagaggaaggccgacaagaagcccaagcgagagatcgtgcagagagaacatcagaacttggttcagagcgtcaagaagtcatctgcgccgacgacgcttaagttctacggcggaactctggtttccagccagcacaagaggaagcttaggtgtcttgagctgtgccctgctgatgaccagcttgtcgttacaagtgcattggatggaatggtgactctgtggcaagtacagtcaagtgggccatccatctctttgcttagcactacaaattgcttttcttcaaagcaaaggtggcctgaggatgtagcttggcatccagatggtgacacaatttttgccgtatatactgctgatggtggtgacacccaggtttcaatgatgaatcttaacacatcaggacaaaagaaagttactttcctgcaagcgaagcctcataccaagggaatcataaacaacataaatttcatgccctggtctgatacatgctttatgactggtggaagtgaccatgctgtcatgctctggcaagagaaagacgattcatggaaccacaagaaagtgcacagggatctgcattcttctgctgtcatgggtgttgccggattgcaacagagaaaaacaataatatcagtcggaatggacaagaggataatatcatatgatgtctcagctgaaagggcagagtacctgcccgggcggccgc

SEQ ID NO: 19990 - DNA, 629 bp, Triticum aestivum
  unsure (1)..(629): unsure at all n locations
  Clone ID: PAT_TA_19990
gctcctttctctttgcctctcttcttcgatacgaccttttccccaccgccgccgctaggtcatgtccagccgccggccaccatggagcatgccccatccgctatagttcgccccaatccagagcaacagatgtcgcgaacctgcccgaactgttgatttctccatgggagcggagacgagcctctccccgtcgccgctggatccgaccatgtcgcgggatcgagagaaccaacaaaacaacgatctggtaagaggcggcgcctcttttctggtcggtatctgggcttcttctggtgttcacattcctgattttgattcttcctgattttgattttttggttttacaactggatatcggcgctgcgggagtcggtgtcgttcgggcgatttctatcagagccacttcagtgggataccacggcgcatgtctggccggcaccaatggctaccatagcgcatgtgcaatcaccgccggcagctgagctcgatttatcggtgtgcatttttgcccaacacaggatggcgtgcaaggagaatatgagctcgccaagtgatctgtacctaagcggtgtaccttaatttgttgtcatgcttctgatcccttgatgctnnnaattccantnnnaann

SEQ ID NO: 19991 - DNA, 835 bp, Triticum aestivum
  Clone ID: PAT_TA_19991
accacttatttttggttttattgtgatagaagtaagtaagtattaatagagttcattagttccaggaattttctttcaaaaaaatccagaaatattattcctattttcatatcagcttgcgttgtcgcttcttcgcccatgcatgttctagaagctattggtcctggccctgtgtaaggaactcctgcagattccaatagcgattgaatggtgccatcctccccaataccaccatgaactgctatgaacactacagctttagcttctttaacataatcaatccactgttgcagggagtatttgataggttgttcatcagtgatgtcaaagcccgcaaaccaatcttgcttgcttaatgctcgttcaagttctttcattacttgatcacgtaagcgagatgttatttcaacccgctctggttcaattgcttcgaaacatgcagcatgaacttcttcagtggtatgtcgtaacactaatgaatatggcagtgtccaaacatcgcgtgaacttttgctaaaatcttcgttgtgggaagaatatccattcgaaggtgcaagcaagcacggtgtcacatcaagatcatcgaagccttgcaaattaagccagacatttgtgccactcataagagatacttgccgctctgaagtatcgccaccaaatatcacaaaagccttctgcttgcatgtaccattctggattatctctgcttgttttgcagattgcatttttctggataaagcagtccatgcattattgcttgaaacaagggaaggaaaacgtgagcaagcacgctgaacaattgtacggaggattcgagagtgagagaatccaacct

SEQ ID NO: 19992 - DNA, 631 bp, Triticum aestivum
  unsure (1)..(631): unsure at all n locations
  Clone ID: PAT_TA_19992
gcacgaggcctcgtgccgaattcggcacgaggggtggttcttatggtggtgatgtgttgcactagctagatatgttctctctttctcgtgtctacttggctttaggagtgcttaagatgtgttacagtgaaattagttaaataggtcgcgcatacctggtgttggatgctcggaaaagcactgcgcaatagtttttgtattgtgacccatgagtcaccactcctggatcccaaacatattccgatgacgagtcagtcggaaatttattatttaaaagttgcacatgtctagtgttagatgattggaaaagcaccggagatacttcttgtaaatcctaataaaaaagattgagatgaccaagtcagttgtgtgagctctgattgtgagtcaatcggttgacaggggattcaaccctattttagcctagagaggtttgcctgacagcttgatgcttataccgcttaactaattaacaaacaaatcaaagtagtttgtttgttttaaagaaaggagaatagtaaatataatattttncttcttccatgaagatgaaccantagaacctataaacctgtgattctgaaatctctctattgcagcatgtagaagtccccgtcccttcagcaaagaa

SEQ ID NO: 19993 - DNA, 562 bp, Triticum aestivum
  Clone ID: PAT_TA_19993
catgcacaccttggatgacaccgatcgatcactgactcatcgccggcctatgctttacatacgtgtgtgtgagcagagcacacgcccgtgccggcttcctagctagttggcttcatcgagcgacaatggcctccgaccgcctcagcgccctccgggccttcgacgacaccaaggccggcgtcaagggcctcgtggacgccggcgccaccgccatcccggccattttccaccacccacccgacgccttcgccccgtccactgtcgccaccgacgtcgccgttccaatcgtcgacctctcctgcgagcgctcggccgtggtcggcgcggtgagggccgcggcggagacggtgggcttcttcctgctggcgaaccacggcgtgccggaggcggccatgtcggggatgctggcggcggtgcggcgcttcaacgaggagccggcggaggccaaggcgccgtactacacgcggggcgcggccaggcgcgtgcgctacagctgcaacgcggacctcttccagacgctggtgggcaagtggcgcgacaccgtgtacatggacgacgcgga

SEQ ID NO: 19994 - DNA, 679 bp, Triticum aestivum
  unsure (1)..(679): unsure at all n locations
  Clone ID: PAT_TA_19994
ccgcccggccggtcccggacggggcgccgccgcgccgcgccccccggggcgcccccgccctccccgcccggccgcgtagagcgcgcggcgggggcggcggccgccgcgtgccccggccgcaccgggcgctccggggccgccgcggcgtgcgccgccccgccctccagggcgcggccggcgaccgccgcccgcgccggcgcctcggcgtgcacgccgccgccgtcccgctgggacgccccccccctgcccgcgtccgccgccaccgcctccgcctcctccggcgccccccgcccccgccccggctggggctccgcctactcccggatcacgggcgccgccgccccctccccccgccgctaccgcgccgtcgtcgtccacggacacccggtggcgcccaagctcgccctcccgctcttcagggcgcatggcctcaaggtgacgctggccaagagggacgacaaggccaagctctgaaccacatcaaactcctctggtggcggtgtccccaagtggtggtgtgctctctcccgtgatactttgcaagagaaaagctgatgctgtgtggagtgtacgcttgttagctttcctcccttctttctttgttcgccttctgcttctgtcgctttgctggcctcggtgctatgtccttgatatgtttcgttttgcattgttagcatnn

SEQ ID NO: 19995 - DNA, 2312 bp, Triticum aestivum
  unsure (1)..(2312): unsure at all n locations
  Clone ID: PAT_TA_19995
cacagtacgagcgagaacggaccggagcgagaggaagagcacaggatccttatctcctccgggggaaagcgcgccatggccgccgcagtcgtgcacctctccgtccacggccgcctccgccgctcgccggaggtcgtcgtctctcaggcgtgccaccgcccttccctcctccgctgccgcgcgttcaagcaggagaccggcggcgaggacaagtacacagagaatacatgggtttccgtgttctcactctctgtcgtctgtgcgttcataatgctttccagttcgggcggacctttccctggcacataatccctggagtcgccaaaccagataattcttttttcaccactgggattctatcatccaatgacatatgttgcgaatggggcaaaggtgatcccagacgcgtaattatgcgcaaagaggatcatcatcagccgccttaccatttaaggataagctaaccgagccctcagattaagaaaagggtaaatagcatttgttatgtgggcattccacttactgtaagctagtgtgtaaagctgtcttgcaagaacatgtgtctgaagtaaccagagcatggaaagagtcgactggcgttgctcgtctcttgtaccttttctctggagaccatgttgtaattgcttcccgcagccctgattcagttcttcagaccatcaatgagcttgaagagaacatacaggagggcttgtcagttgccaagaagaaacaaagagaaactttattacaagctaaggttgttggtacatcttgtgatgtttgcaaaccagaagatgtaaaaaagcttgtaaattttgctgttggtgagctgggttcaattgacatttggataaataatgctggcacaaacaaaggttttaggccattggtaaatttttcagatgaagatattacccagatcgtctcaacaaacctagttggttctttgctctgcaccagagaagctatggatgtcatgcaataccaagagaagggaggtcatgtattcaacatggatggagcaggatctggaggatcaagcacaccgttgacagctgtttatggctcaactaagtgtggactaaggcagttccaagcatcgcttatgaaggaaagcagaagatcaaaagttggagtacacactgcgtctcctggaatggtccttacagatctccttctaagtggttcatctctccaaaataaacagatgttcaatataatatgcgagcttccagaaacagtagcaaggacattggtcccaagaatgcgagttgtgaaaggaagtggaaaggcagtaaactacttgacaccaccaagaatcttgcttgccttggttactgcatgggttcgccgaggccgatggtttgacgaagaggggagagcagtatatgcagccgaggctgatagaattcgcaattgggctgaaagtcgaacacgcttttccttcacagatgccatggagatgtatacagagaatacatgggtttccgtattctcactctcggtcgtctgtgcattcataatgctttccagttcaggcggacctttccctggcacataatccctggagtcgccaaaccagacaattcttttttcaccacagggattctatcatccaatgacatatgttgcgaagggggcaaatgtgatcccagacgcgtaattacatgcaaataggatcatcatcagccgccttaccatttaaggataagctaaccgagccctcagattcagaaaagggtaaatagcatttgttatgtgggcattccacttactgtaagctagtgtgtaaagctgtcctgtaagaacatgtgtctgaactctgaagtaaccagagcacggaaagagtcgacgggctttgctcctctcttgtacatggatgtactctagtagttatgatccttatgaactcccgggtgtcgctttgtacccttcaaaaatgtatagcaacttagcaacacggtttagaactggaaggagtcgccatacatggttcatcagtgtaaagttcaggatgtatgttccttttcttgtagatttatactccctctgtttctaagccgncgncgccaccgaacgagccgcggaagtgcaggaaggggccgctgnacacgctgaaggcggcgatccaggggctcgcggggtcccggtcggcggcggcggaggtgtatggcgggcagcaacagtacgagctcgccgtcgagaaggccgaggagatcttcttctcggttgctactcaggtaggcagatatgtcatcactatgatgagcagtggtgttgtactagcagttggatttcagttatcagggggg

SEQ ID NO: 19996 - DNA, 1269 bp, Triticum aestivum
  Clone ID: PAT_TA_19996
aaaataaaaaaaaaacggacgcgtggtctcgctcccatccccttctccgatcctctcccctacgccgccgccgccgccgcctcggcttcgcaggcgccgcccaggtagcgctcgcgctcctctgccggagctcgacgccccggtcctcctcctcctcccccggcgttccctccggccggcgcgcgtctcctcgtgccccagccgcagcagccagccgccagcctccaccggcgtctcctcctgacccggccgcggaagcccgcggcaccttcgccctcctcctccgaaggacctccatcggcgcccgcgcacaaggcagaaggaaattgggaaatgagcaagcctgagaacatgttctcacttcttaatcttgatggtgaagatgatgcagggaatgatagcgaagtgaaccaaacgtcttctaccagcgcaaaagaaactgctgcccgcaaacctgataaaggtgtgcaaaatgacacaactgttgtaagcaataatggaggaactcttgcatcatcatctggtggttacaggatgcctttagtgtggatagacctggaaatgactggtttggatatttcgaaagatcggatattggagatagcttgcattgtaacagatggtaaacttacaaaacaaatagaggattgacagagagggtactgcagagtgagatttctgagggtgacgcggagaaacaagtgttagacttcctcatgaagcatgtaggttcagacactccatcaatagctgggaattcagtttacgtagatttactatttctgaagaagtatatgccacggcttgcagccatcttctctcacgtgattgttgatgtgagcagtatcatggctttgtgcacacggtggtaccctaaagaaaggaagcaaactcctaggaaaggaaaaagccacagggcgatggacgatatcaaagagagcatcgccgaactgaaatactacaagggcaacatcttcaaacctcagaaatctaaaaagtagccgttttcaaaggcgacatgggtggggtgtaatggatatgttgcagtaagttgatcaccgaatgagtagctagccaagttgtccatgcctcgctccgaggcgagcttgtcgtattccatagctcctaacgtgttgatcaatgtctgggatatatccatctatgacatatatactttcttctcactctcacccctgaagctgaaacctgcaaaaagggcgtttgatctgcagcacttgtactgtatcagtgaattgtttcgtgtaaact

SEQ ID NO: 19997 - DNA, 739 bp, Triticum aestivum
  unsure (1)..(739): unsure at all n locations
  Clone ID: PAT_TA_19997
nccctgatgttgctacgccccttggaaggttgccaccattcatgtcgtttcctagtccacagtcacagtcttcttcttctccatctagttgctttttccaacaaggtttcagcaccatgtctgttctcaaaaatcaacatgagacgcctaccatctgtaggcaggaacatctcagctcttactacatgatgtctggctgctcgccttatgctggtgatggaaaacaatgggcaagtggagtctcaacgccataccattctaccccagaaacgaaaagcgagcgatcgccctgcagcggcgagcttcgcaccccatattctggaattgaaggtttcagcaggcaaaggaaggtttcgtgctctagagaaaggtagaggaagcacatcaaaattcaacaagacacacgagtcatgactcacacaagcagctgacatggctataataccagcctgatgcctgcaatctgatatgatcctcctgtgtgcacatcatctgccgacaccggccggccgagttcctggatctgataagagatgttacttgtagtttaggccaagctgttgccatgctcatggtcattttggtgcctctagatttctgacatggcgcactccactcctgtacagtagttgttagtctcctgtagtcagccctgctgcaccctgtctcctgttagtctgttcccttgtatagtgtatgcatctgttggggctgaatctgccttttgggccangnatcc

SEQ ID NO: 19998 - DNA, 844 bp, Triticum aestivum
  Clone ID: PAT_TA_19998
gcacgagggttcttcgtagtaccactcaacaaacctagctagccccttgcctttctgtctcctgactgagagctagatcatcaatggctagtcctggcacattgctgctggcgacggtgctcgtcatcctatcaattttcgtaagccccatctccggctactggaagccgagccgcacccgcaccaggcgccctagcagccgccggtcctggtcctccggcggcgcgacgtggtacggcagcccctacggcgccggcagcgacggtggcgcgtgcggttaccaaagcgccgtcggccagcacccgttctcgtcgatgatcgccgccggcggaccgtccttcttcaagagcggcaaaggctgcggtgcatgttatcaggtcaagtgcaccggtaacaaggcctgctccggccgcccggtgaccgtcgtcatcgccgacaactgccccgacggcatatgcgcctcggaggatcatttcgacatgagcggcaccgccttcggcgccatggccaaccgagggatggctgaccgcctccgctccgccggacagctcaagatccactacgcgagggtgccctgcaactacaacggcatgaacattgtcttcaaggtggacgcgggctccaacccgttctacctctccgtgctgatcatctaccaggccggcgacggagacctctctgccgtcgacatcatgcagggcggctgcgcgcccggccaccacaacgatcacggcgcgccgtggatggcgatgaagcagtcctggggcgcactgtggctcctccagtcgaacaacgggaagcctctccaagccccgttctcgttccggctcacctcgggttccgg

SEQ ID NO: 19999 - DNA, 585 bp, Triticum aestivum
  unsure (1)..(585): unsure at all n locations
  Clone ID: PAT_TA_19999
taagtacgcgcaaccgtctccgctagcaaaccctagccatcagccatactccatccactcctccccgccgccgacgcatccgcatccgcatacgccgatccgagcaagcatggcaggcagccgacggggcggtgccacgggcgccttcacggttaccggaaagttcaagccggtgcctgaatacgctttaacctttgtccgcgactacgacatcaagggcatcggggccatgttagctaaagctgctccttgctcgatggaggaacggatcgaactcttcaggaagaatgttggaacaattcaagaagcctaatgcctttggaacattccccaataaaggcatgtccaaggcccaggacgaggaagaggagggcgaggagagcgagggggaggatgacgaggtggatgcagatgctggcgatgatgtgtatgaagatgatgagtacagtgaagttgaagatgatgagtacagtgaagttgaagatgacgaggacggtgaaggagtagatgnnnngacactgaagcttcaagtccctaatgnnnnnngacgagcttgcaagaagnnnnnnnnggcagnnnnnnnnn

SEQ ID NO: 20000 - DNA, 907 bp, Triticum aestivum
  unsure (1)..(907): unsure at all n locations
  Clone ID: PAT_TA_20000
cccacgcgtccgcccacgcgtccgcccacgcgtccgcccacgcgtccggccccactcgacaccagagaggaagcagctatagcaatggccgtccccagctcgccgtctcttctcctcgtcgccgcgctgctgctctgcgcgacggcgacgctggccgcggcccaagccgtcaccacgaggaagtaccagttcgatgtgcaaatgacgagcgtgacgcggctgtgcggcaccaagagcatcgcgacggtgaacgggcagttcccggggccgacgctgcacgcgcgggagggcgaccacgtggaggtcaacgtggtcaacaactcgccctacaacatgagcatccactggcacggcgtgcggcagctgctcagcggctggtacgacgggccctcctacgtcacgcagtgcccgatccagccgggccagagctacgtctaccgcttccagatcgtcgggcagcggggcacgctctggtggcacgcgcacatctcctggctccgcgccaccgtgcacgggcccatcgtcatcctcccgcccgccggcgtgccctacccgttcccggcgccggaggccgaggtgcccctcatgttcggcgagtggtggcggaacgacaccgaggccgtcatcgcccaggcgctgcggaccggcggcgggcctaacgtgtccgacgcctatactatgaatggactccccggcccgctctacgcctgctcgggcaaaggacacgtttaggttgaaaggtgaagcctggcaagacgtacatgctccggctcatcaacgccgcgctcaacgacgagctcttcttcgnnggngcgagccccacgcgccccgtcgtcctcctcgtcccgcccctcgtcgtccccgccnttctcgtcnaacaccctctcccnnnnnnnnnnnnnnnnna

SEQ ID NO: 20001 - DNA, 1145 bp, Triticum aestivum
  unsure (1)..(1145): unsure at all n locations
  Clone ID: PAT_TA_20001
cgctgcgtggttttttcatcgccccggcgcgttccgatggcactgcgccagttgctgccgatgtttcccgatctcgcctatccctaggtcttccctctcattccgtgtcttgttgccggcctctgcattacgctgatggccggaaggatgggcccttcggtcgggatgggttacatggtctgctctgcgccgcgcagccaccgggcgtacatcctggagggttcgacaccgggccggcccacgaaaatgcctggcaattactgggaacacggcctttggggaccttgtcctagcgccacaggagctattttctaatgcttaatttgcaactcggcatcaggtataccgtgggtaaaatcacccctgtacctttgcgtgaggttcgttcaaatgattttggacctagggcccggataataatgtacttcccttgtgaaggctcgcagtatacccctccacactgctctgtcaatttcttttggaaagactattgtcctatggtcttccggaatcttcgggaaatgtttcatattgatgccgcagattacatgatgtccatatgtgggggtgatagtctaaaggagctttcttcacctgggaaaagtggcagtattttctatctttcccaggacgaacgatttgttataaaaacattgagaaaaagtgaactgaagatacggtggaggtcgcccccaatatactaccatctcaacatgcttccagactatactaccaatgtctggcctgctcatggttcccccattacggaaatttgtcggcgtgctctggtgggcgctttctgccggcgcaatcgcccgtgttctcgtgaggggtcctgggcgctgcactgacctccgatgtcaccctcaggacgacttgcagcgatcttcccggggccgctcggcaaccttgcggaaaatctgtgtggtcgcatcctcnaaggatcttgacctagcacatgcatttcatgttgatnaatcgtggaggcaagcgcttttcaggcagatagctcttgatagtatgttcctggaatcccaatcgattattgactatngcatgctattgggaatccatttcagagcccccnatcacttgaagactgccacgtcacatcagaatacactcgaaagcagtggaattacgtc

SEQ ID NO: 20002 - DNA, 374 bp, Triticum aestivum
  Clone ID: PAT_TA_20002
cccgccggtctacggggtgttctactcgtcgtcggcgcctccaatgccgctggtctacggggtgtcgtacgggtcgccgccgccaccgacggggccgtagaaatagctgctagctaggtagcaccactagctagccgcgccgcaggctgatctatcggcccggccgccacctccacggccggatcgctcgtcgtcagccagccagccagtccgtccgtccgttcgtccgtccgtccgtggctcgtccgtcaccagtacatctctccctgtagtttcttgctctcctcctctccttgaacgttattttttgttctctgttgtccatttgttatgtcgttatttgatccgaattaaattataaaccctgtcacgtc

SEQ ID NO: 20003 - DNA, 397 bp, Triticum aestivum
  Clone ID: PAT_TA_20003
ccgactctcaacccgaaagaaagctcaggcctttctctttccccacacaccacccaccagtctcctcccgcctgaacccccattaattcctcggcaccggagaagagatcccccgtcctctgacgccagcggccatgtccgtcacgcgggttcttgcgctgctggcggcggcggcgctggtggtcgccgcgccggcgcgcgtgggcgcggcgggggcgtgcacggcggagaagttctccaagaaccgcgtgtacgcggcctgcaccgacctgcccaccctgggcgcgtccgtgcactggacctacgacccggcggcgtcctccctgtccgtggcgttcgttgccgcgccgccctcgtctgggggctgggtcgcctggggctcaaccccaccggcgac

SEQ ID NO: 20004 - DNA, 2156 bp, Triticum aestivum
  unsure (1)..(2156): unsure at all n locations
  Clone ID: PAT_TA_20004
tgnnnagtncnacanccttattaaccctcctaaagggaacaaaagctggagctccaccgcggtggcggccgctctagaactagtggatcccccgggctgcaggaattcggcaccagggtccaacacctgatttttactcgacacattatcagcccactggtgtatataagtcaaaagaatctcagactttgtctggccagagtttctctttcactgacccaggggtgctgaggcttggcctgcagacagatggtgcagaaacaattcagcctctgcaaacaccaaatgaaacagttcattcttttgctgttgttgacgaggcttcaacatctgctgctgtaaggagcatgggtggctacatgccatcgctactctttgctccccgctccagttcttctgctgccaatgagacacaattacaaagcagagattcactaaactccacacactacaacagcaataacggacgcgtggttcaacatcttcagctcagccctgaaccttctgctacgacagagacttcgtttggtgtgagctctgatgtggtcactggagcaaccacatcagaacaacggagtcatccccgtcatcctaagaagtgcaggttcaaggggtgctccaaaggtggcagaggctcatcagggctgtgtattgctcatggaggcgggcaaagatgccataagcctgggtgccataaaggagctgagagcagcactgcgtattgcaaggcccatggcggaggacggcggtgtgaggagcttggttgcaccaagagtgccgagggaaagacagattattgtattgctcatggtggaggccgccgttgtgaatatcctgattgtcctaaagctgcacgaggtaagtctggacggtgcataaagcatggtggtgggaagaggtgtgcaatggaaggttgcattcggagtgctgaggggaaggctggactctgcatttctcatggtggtggacgccggtgccagtatccggactgtgccaagggggctcagggcagcacattatactgcaaagcgcatggtggcggcaagaggtgcgtctttgatgggtgcagcagaggtgcagaggggagcacacctctgtgcaaagcccatggtggtgggaagagatgcatgtttgaaggaggtggtgtctgcccaaagagtgtacatggtgggactgaattctgcgtggcacatggaggtgggaagcgctgtgcagcacctggctgcaccaagagcgcccgcggccgcactgactgttgtgtgaagcatggtggtggtaagcgttgcaggattgacaattgtggtaagagtgctcaaggtagtacggacttctgcaaagcccatggtggaggcaaacgttgcacatggggatccggttgtgagaagttcgcccgtggcaagagcggcctgtgtgccgcacatggaaccttggtggccaggcagcaagaacatggaatggtgaagagtggagggagcatgatcggaccaggcctcttcagtggcattgtggcatcatcaaccaccgctgcaagtagcatgacaaatgagcactcctcatcgggcatcagcacagcatcagatagtgacggcacagtgaggagccaagcgatgatacctccgcagctgcttgtgcctcgctccatgatgccctcgtcgtcgtcggagcctactgtgcatgggggcagagaagcaggctgtcctgttcctgagggaagggtgcacggtggcggcctactgtcactcctcggtggcagcttcaggaacgccaatatagataagctctgaagtgttttctccgcctgcaaattctgtcagtttggttgtacataaaaggcaccgtgttgcctattgaattttatgcttcttctgtttgcttgataaacatttcatggatgtttagtcagtccattgtacatgttgtccggcaattcttctgatctgcattcgacatgccggtccagtcagtcgtagttactgccaataaaccgtgtgtatttgatatactgtttcttatttgcttgtggattattactcctaagaaattcggtgcgccgttgctaggcagggttttgtaaaattgaattttggcttagaatgtctgattattattttttggaaatcttgggactcaagtactagcctttgcattcaaaaaaa

SEQ ID NO: 20005 - DNA, 784 bp, Triticum aestivum
  unsure (1)..(784): unsure at all n locations
  Clone ID: PAT_TA_20005
cagtggaagagaggacaaatgaagaagaccaaaaaatgttgtcagtgtatgggattgcgaaaactgattttttagacggcattcttactgctcaatacaatgaaaatgatttgaatctaagatattgttataaggacaatgaattaactttagttcccagcgtctccttgccttccaatgcagtatccctagacttcaaaaggcgttttggttcttctgataagttaagctaccattttaacttcgacactgatgaatggaatgctgtttataagcatacaattggtaaaaattacaaactgaaagctggttatgattcagaggtgcgagttggatgggcttccatctgggctgggcaagaagagggcaaagcaaagactgcacctatgaagatgaaagttcagtttatgcttcaggtgccccaggataatattcgcaatccttctttactatttcgagtgaagaaaaggtgggatctgtagagtggacgcattcctctgatacattgccgggtaccgaggcttggtctgacctattcttggtaaggtgcatatgtcatcaatgggatacacattccgcaagcgtgctattttatcatgtattttgggttattgtacataatgggccaccgtcccccctgcctcggcttcgaggttagggtcgcatatttatttanttctggaccannaaaaaanaaaaaactcagggggggcccggtaccaattcccctatgtgagtctattaccncgctcactggcgtcgtttaaacgtcgnacnggaaaan

SEQ ID NO: 20006 - DNA, 617 bp, Triticum aestivum
  unsure (1)..(617): unsure at all n locations
  Clone ID: PAT_TA_20006
gcacgaggaccaccaccaccccggagcccggacggagcgcgtgcggcgctcccctcccccgcgccgtcgtcgccgtcctcggcccactggctgagcctcgtcgggaccgtctggctgcagaccatcaacggccccaactccgacttccccgtctactcgtcgcagctcaaggcgctcaagggcatctcccaggtgcagctcaacttcctcgccttcgcctccgacgccggcaagctcttcggctgggttcgccggcgtcgccgcgctctacgtgccgctcccgctcgtcgccgtcgtcggcgccgccttccggcctcgtcggctacggcgtgcagtacctcttcctggacacccccgggctcgcctgctggcacctgttcccgctcaccgccctcgccggcaacggcatctgctggatcaacaccgtctgctacctcctctgcatcaacaacttcccccccagggcccgccccgccgtccgcctccccccccgccgcctcgccctcagcgccacactgggcaccagcctggccgagagcttgccccgcctggccgactccannnccangacgtacctcctcctcaatgccgtcgtgccgatgatcgtcaccgtgttc

SEQ ID NO: 20007 - DNA, 732 bp, Triticum aestivum
  Clone ID: PAT_TA_20007
cgaagaagcagagtcggcgagattatccatcgatggcggcactccggcacgcggggaggaggctctgcgagcgggcgctccagcgaggtggaccccaggtgattccgtctggccgccggtccatgttcatctccatcggtggcaagcctaaacctacgactgcggcggctcaggaggagctgaaaatgcagttccagaaaaagaaagaagagttgttcgatgtgctggtggagttgtcaaggacacgcacgtacccaaatctctcctgggaggctctccaggttaatcagctcgccactcgacttgttggcaaggtggagcctaggcctggtgactactactggcgcagttatcgactacaaggcagactcagcaccttcttggtttcgtacttgtttctgcattttgtatatatggaacacttctggatacccaagaagcagagagaagatggcgccacaagcaacaacggtgaagccaagatcctccccgacagcgacgagaaccaaataaggacatgaactagcaccatttaagttaaaaaaaaatagtactaagacgtcttggctaaatgtatcctagtcattagattgtttccgttgtttgctataaaggtactttgttctcgaccgaaccggcctgggttagatgctgaagaattctgcaattctagttctgtttttcatctactgaagttgtagtttaaaatctctactcctaatgaagcagttg

SEQ ID NO: 20008 - DNA, 1054 bp, Triticum aestivum
  Clone ID: PAT_TA_20008
gcgcacgtgatccgactacccccgcccgcccgccatgccgaaacctccgccggtcgcccactggcgaccgccgcccaggtcgccgccacatttctctccttcctctcatgcccccgtcaccacaccgctccctccccttccatctccttcctggcgacccctgtattgcccgcctcgctccgggccgctgccgcggggggccaaaccctcaccttccgctgccggggccgtcgcatcgccgtcgttgctcagctccctactatgattccagagctagctagcggggagaagaaaatccggtggtcatcgagggcggtgcgatcattttgcaatggcggagctggaggcacggaagatgaggtacccaaccacaggcaccgaggggctgcttatgggcatactcgttgaaggaactagtgacgcggcaaaacttatgcgtgctaagggaatcacattgctcacggtgcgtgacgcggcagcaacaatacttgggaagtcagaaatgttttacttcagtcctatgcatccaccattgacagaatctgcacagcgtgcccttgattgggctgtaaacgagaaactaaaatcaggtgaggacggagaggtaacggccaatcatttgttcctggcgatatggtcagataaagagtcagctggtcataaggttctggcttcccttggttttgatgatcagaaagccagtttgctggccaaaacggcaggcgaagagaaagcaatgagtcctagatagcaaatcaagcagccggtttataattgaacttcccggaggttatttatgtgttcacctggcaacatctaggcactagttggcggctggcggtaccacggagcttcgataagttttaggggttttaagatcggttaggccgaatccaaaatgtgtactcccactattgccaaacgcagtacatgtaaaaacattacaatgtattttcggacgaacacggttttcttccactctcagctagtttgttggactgcccttcggagacccacccatcggagacccattcaaagatccagattctgagtc

SEQ ID NO: 20009 - DNA, 925 bp, Triticum aestivum
  Clone ID: PAT_TA_20009
ttatcctatgaaccaaaagaggcgtaagattcgcccgcatctccttcgattccttcctcagtttgtctcggaatccggcaagatcggaggtctcgccggaacccggcgttggccgtaccgaccccggctggatctccgggctcaagagttattgatggttcttgggatccagagggtgtggctgaggagttctcggcgatgagcaggctggcgtcggagctccaccggttgcggaggtcgccatgggaggtgctgtgctccgcgctggtatcatgcggcctggttctcttctcgcagctcgccgtggccatagtgccccgcctcctcccatccatctccctcctcgccatgctccccgtcgcaggtttggtattcctggcggctattctggtgggcaggttctggaggaggttcatcggagtggccgcgtcggcgccgctgttcgtgctgttcaacgtgctgtttttgtggggcgtctacctattcgtcatccggagagatacctcttctctactagacatgctgattaatgctgagtgtgcactgcttctgtggggactttacaggattctttctggtgatcccggcattgttgcatacgaatcttcatttttggaagaggctggctgcaaggatttcgtggatgctatatgctcgagtgagaactatccatcactctcaagggtgaggcattgtaactgttgcaaagcaaatgttagaggttgtgaccacccttgccctgcatttggtgattgcataggacacaaaaatcgtacgctatttatggcactatcgacaggatttgttgctgctgaatccacatatacagtgtgtgcaactaaatatataactagttgcataacctcatgaactttaagaactgagaatcatgtgtctctaaacatggtgatcggcacaatgctct

SEQ ID NO: 20010 - DNA, 613 bp, Triticum aestivum
  unsure (1)..(613): unsure at all n locations
  Clone ID: PAT_TA_20010
gcacgaggcaagaactcacaagtcacaacaacatcgcacgattcgctcttgaactctcgtagttgtttttagttggtttgctgtaatcgtagtgatggcgccggagcggaggcggtcggggctggcggcggcggcggacgcggcgtcgtggtgctgcgggctggcgctggtgacgctgctgctggtgtcgtcgctgcgcgcgggcgagggggaagagagcggcggcggggcggtggtggtgcgcggcgcgcggatcgcgtcggcgccgcggcggccgtgcgacgagatatacgtggtggtggagggggagacgctgcacagcatcagcgacaggtgcggcgacccctacatcctggagcacaacccgcacgtccacgaccccgacgacgtcttcccgggcctcgtcatcaagatcacgccgcgcgccgccgctgacagccgcaggtgaacgccgcgctgacgacgcagcttcctcgccgtcttcagcgctgtgcggcgctcgtatgatcgtatcctcctggatggatgcgactcgcggacaagaatttgtttcgagctgtagncnngtgaaatggtcgtttctggtacgattgagagagnannntnnatcgnn

SEQ ID NO: 20011 - DNA, 1034 bp, Triticum aestivum
  unsure (1)..(1034): unsure at all n locations
  Clone ID: PAT_TA_20011
cgagggttctttccacacgtatcctagtctgggcggaccattccagagcttgcaggaagctgagaatgctatcactagccatcttgatgagctgcgctctccaatgatgtgcacagatgggctttcggatgctgagattggtatattacacgacctttactggcctgatggcacaaggcagaattcttctgaaggcgatgcggaccataggaatataagcttattggttcaagcgttactggacaaatacaatgaagatcaccatcttctgggggattttgcacatgaacttgatgatgttgttatcttccgagaatttgttgagggggagaaagtggttaggttctatcatatcaatctggctacaaaaaccaaaggagaagatggtttgcacagtggcgtcaacaatctattttttgctgaagtcagacaaattaaaggagaaaatgtatatgtactcagttgtttatgtatggttaaacctactgacagtggccaatgctatggttgcttgagttatggaaatattgatttgaagcaccctgttgatactgataaatacaaaggtggccacactgccccgcgctcaccctgttgcggttttgatctacggtgtgatgtacctgcatacattgaggatgaggatgaggaggctaggctggcgaaggaggaggctaggttaagatatatatacaagtgccctgctccggcaaaattggatggtgcaagagtgcgtgctggtttggcaaagagagaggatgctggtttgaccaagggagatgtggccagggaaaagcgaaatacattgtgcctgctangcgtcgtctgctggttgagtaaccacatttccaagtatcttgggagacggattaancgctgtgcaccataattggatgttgttgctgcaataatagatgtatggcctccattgcttggactggtgtactctccgaattggtcttgggtctaatggntatgttcanattantccatggaagnctcaatggactgcctttgntttaaaaanaaaaaaa

SEQ ID NO: 20012 - DNA, 1638 bp, Triticum aestivum
  Clone ID: PAT_TA_20012
ggcaggaaaggaaaaaggctttttgtggtgatcgggactttaccgccttcggtagcaagaagcgtcgtgattctgtcagggggacctggatgcctcaaggtgagaaactcaagaaattggaagaggaaaggggagtcgtcatttgatttatgaccgcttcatttcgtgtttcctctgtgtggtgtgaggtgcgtgttgttttgagagcttgaagcaagcagaacgcctaaggagcgtcctggggatgacagaggcattggcgacgacatcaggcgagagatgaagacgacatcgatcaagagctgcttgcacaaccagaggcggcatgggctcaacgcaagtggaccatcatccagcacgtcttgttcctgtccatgcgacatttcctcatacatgagggcttcagcatttacaaattttgattatgtacgcctacaaggtatttgttgaaaatcccagagggctggcagggaaggagtggtctatataagccatgtgattccattcttcaaaaaatcagtaccagacaatcataacaagatgattttgagattaacgagaatccatgagatgaataaaagtatgaagaaacaaggaattctgtcacaggagaaactgtggtacaacacttcaacacggcacaggaggcagatcagggcaacttcaaggataaggcaacatctgcagacctggaggtggttgaggtgaccttgctgttggagtggtttgccgaaaattatcggcagtttggttgcacgctggagcttatcacaaacaacacacaggagcccggccctgttcgcgctatcgtgggtttggcaggggatcccgcgcctccgggctgtggtccgcgctttcgatgtcactcttgatctggtgctggttggtgtctgggtcgtcctggctgctgctgctcccgtcctttctgtacacggggcccatgtcctggcccggaaccggaacgcgctacgcgccacagcaggaggctgaggcatctacaagctcatcgaggaaagcttaaggaagacaacgagaagacttgagaaatgatgatataaagtatgctgctgttgcatgagttaagtcctctcagcgtgatctagacaaatctaagacaagtaatttggcatggaggtaatacaaaccaaagtaatttgcccaacaatcaccaagccacatacatgcgacattgtaccgagtaggcaatccaactttcttttgacagtgagtaggaaaaaaatggcatgacttcaagtgcgaccactagaactgtgtgagatacccttttttgtaatagatgatgcgtcatcaacacatcctgatagtgagctgtgtttgaacctatggagattgcttctgtagacaagctttacacgatcttcgagagaggccagctaacacgtaggccatcagtcacttcatatgtagagaagggatggacagcgcgactgacgcctttgctggttccttctggcacgtgtatatataatgtggtggcactatcaaagttgaagtactgattgtgcccattccaaatgaactgtttctctgaactttgttcttaaatagacacatcgggtcatccctcctcggtaaaggggttagtttgtttgttctttcatcagctcactccaagct

SEQ ID NO: 20013 - DNA, 664 bp, Triticum aestivum
  unsure (1)..(664): unsure at all n locations
  Clone ID: PAT_TA_20013
gcacgaggattccaactccctctggctcccactactgctgctccaggcggaccaggccgccgaaccaactccgcccctcccccccacgccccacgccccgccgctgaaggatgggccacgcccaatcgacctcccgccacaatggccgcgccggcgccgccaacggcgtcgagccgccgctgccgtcccgcttctcccggttccgcagccgcctgcgccttcgccgccaccgcggccgtgaccgctgcggcgccgcgggggactccagcgagtcggggaagggcgtcgccgccgacgagttcgccggcatcgcgcgcatccggatagtcaaggcggacctgcggttcaaggacaagttcttcgcctgcctctcgctcggggagcgcacctaccgcaccgagacctccgacagcactcacaggcctgtatggaattcagaaaagaaggttgtaatagaaacaaatggacctcatattgcacgaatatctgtttttgagactaaccggttctccaagaataccttggttggttactgtgaagttgatctctttgacttgctcactannnacttggaggaggaacacgctgnnnaccttgctttgttggacccatcatcgtccattaccaccatgggaaccatatccgtatcctgctacattgannn

SEQ ID NO: 20014 - DNA, 435 bp, Triticum aestivum
  Clone ID: PAT_TA_20014
cccacgcgtccgctgggcgagacgcacgagatccgatccgatccgatccaccccggagccggaaccctaccgaagcgcgcctgccatctcgaagcggaggagctcgcgcggttctctcctgatcttcctcctccgatcccttctgcagctgctggtgtggcgtggctcgacgcgattcattttgttgaaaaaaattgggggttcaactgaacccccatgccccgtgttaagcccgcccctgtgaggagctggagctggtgctggtgctggtgctggtgctagtgctggggctgtggagaagagcgcattaaaggaggagcaggggtggaggatgctgagcgtggtacgggtgcacctgccgtcggagatcccgattgtggggtgtgagatcaccccttatgtgctggtgcgtctgcccaatggggccattttcac

SEQ ID NO: 20015 - DNA, 581 bp, Triticum aestivum
  Clone ID: PAT_TA_20015
ttatggccggggtgttgctgtgctggtgggtgtgccgcacaaggacgccgaattcaagacccacccgatgaacttcctgaacgtgaggactctcaagggcaccttcttcggaaacttcaaggcaacttggcgaccattcacaatgttcgatactgccccgccgtggaacagcctctgtggatctagagataaaatcagtcgctcgtgaataagcatgcatgttgcatccataggcgtgtggtgtgcatgtatacatatgtgagctccgcgcgctcaacatgtgtgggctatctgctatgaatgagaataaagagaatcattctgtggttctttaatttcaactaaaaaaaaaaaaaaaaaaaaaaaaaaggggtctgtctgtgtgccctttgtgggaagaagaagatagtagtgtgttatagtagtgtgtctagatgtttgggttgtgctttgtgtttgctggactgcatgtaaaaagacaaataaaccggcgcagaagctctccctgctctgctctttggcaaatgttgaagggtgaagagggatagcaagttgaaactgaaaatcagagttttactttt

SEQ ID NO: 20016 - DNA, 1096 bp, Triticum aestivum
  unsure (1)..(1096): unsure at all n locations
  Clone ID: PAT_TA_20016
agatagcccacccatgttgagcgcgcggagctcacatatgcatgcatgcacccccacacgcctatggatgcaccatgcatgcttattcacgaacgactgattttatctctagatccagcatacactcaaggaactacaccagcgaaccagacttggctagaataccatggcgtgcaagtccagctgcaacctcctcctcttggccgccgtcctgctctccgtcgtcgccgctgcttccgcctccggcagctgcgtcccaggggtggcttttcggaccgatcttctgccacactgccgcgactatgtgttacaacaaacttgtggcaccttcacccccgggtcgaagttacccgaatggatgacatccgcgtcaatattctcccccataagccatacctcgccaagttgtattgctgccaggagctcgcagaaattcctcagcagtgccggtgcgaggcgctgcgctacttcatagcgttgccggtaccgtctcagcccgtggacccgaggtccggcaatgtcggtgagagcggcctcatcgacctgcccggatgccccaggcagatgcaatgggactttgtcagattacttgttgccccggggcagtgcaacttggcgaccattcacaatgttcgatactgccccgccgtggaacagcttctgtggatctagagataaaatcagtcgctcgtgaataagcatgcatgttgcatccataggcgtgtggtgtgcatgcatgcatatgtgagctccgcgcgctcaacatgtgtgggctatctgctatgaatgagaataaagagaaccattttgtggttctttaatttcaaaaaaaaaaaaaaaaaaaaaaaaaaaaaaaaaaaaaaaaaaaaaaaaaaaaaaaaaaaaaaaaaaaaaaaaaaaaaannaaaaaaaaaaaaaannnnnaaaaaaaaaaaaaaaaaaaaaaaaaaaaaaaaaggggggggccgttttaagggtcccagttttataacccggggttggcaaggtaaaattttttttttggggcccctaaatttaaattctggggcggggttttaacaagggggggcggggaaaaaccttgggttaccccaat

SEQ ID NO: 20017 - DNA, 575 bp, Triticum aestivum
  Clone ID: PAT_TA_20017
ctctcttgggggcatgggcggcggaggctctcttggtggcatgggcggcggaggctctctcggtggtggcatgggaggcgggggctctctcggcggcatgggtggaggaggctctcttggtggcggcatgggaggcgggggctctctcggcggcatgggtggaggaggccctcatgggggcctcgaccacctgatggggctttgagcgagcgagcgagcgaaagaagctgtgtctgcaggctgtggagagcctgaaccaacccccagcgatgcatgtgtctgtctgtctgttgtagatgtagtagggggaaagaaactccgtgctgtttgtagttgtttgtgttgtcgaaacaggaagaagagagtcgtctgtctgtctgtctgtctgtgtgccctttgtgggaagaagaagaagaaagaacaagataggagtgtgttatagtagtgtgtctagatgtttgggttgtgctttgtgtttgctggactgcatgtacaaagacaaataaaccggcgcagaagctctccctgctctgctctttggcaaatgttcaagggtgaagagggatagcaagttg

SEQ ID NO: 20018 - DNA, 1945 bp, Triticum aestivum
  Clone ID: PAT_TA_20018
gcgcagcgaaccagacttggctagaataccatggcgtgcaagtccagctgcagcctcctcctcttggccgccgtcctgctctccgtcttggccgctgcttccgcctccggcagctgcgtcccaggggtggcttttcggaccaatcttctgccacactgccgcgactatgtggcgaaccaagacttggctagaataccatggcgtgcaagtccagctgcagcctcctcctcttggccgccgtcctgctctccgtcttggccgctgcttccgcctccggcagctgcgtcccaggggtggcttttcggaccaatcttctgccacactgccgcgactatgtgttacaacaaacttgtggcaccttcacccctgggtcaaagttacccgaatggatgacatctgcgtcgatatactcccctgggaaaccgtacctcgccaagttgtattgctgccaggagctcgcagaaatttctcagcagtgccggtgcgaggcgctgcgctacttcatagcgttgccggtaccgtctcagcctgtggacccgaggtccggcaatgttggtgagagcggcctcatcgatctgcccggatgccccagggagatgcaatgggacttcgtcagattactcgtcgccccggggcagtgcaacttggcgaccattcacaatgttcgatactgccccgccgtggaacagcctctgtggatctagagataaaatcagtcgctcgtgaataagcatgcatgttgcatccataggcgtgtggtgtgcatgtatacatatgtgagctccgcgcgctcaacatgtgtgggctatctgctatgaatgagaataaagagaatcattctgtggttctttaattacaacaacaatatctgcaggctatgcgaggagcctgaaccaacccccaacgcatgcatgtgtctgtcggtctgtctgttgcggaggtggtaggcgggaagaaactccgtgctgtttgtagttgtttgtgttgtcaaaaacaggaagaagagagtcgtctgtctgtctgtctgtctgtctgtgtgccctttgtgggaagaagaagatagtagtgtgttatagtagtgtgtctagatgtttgggttgtgctttgtgtttgctggactgcatgtaaaaagcccaaataaaccggcgcagaagctctccctgctctgctctttggcaaatgttgaggggtggaactacaccagcgaaccagacttggctagaataccatggcgtgcaagtccagctgcaacctcctcctcttggccgccgtcctgctctccgtcgtcgccgctgcttccgcctccggcagctgcgtcccaggggtggcttttcggaccgatcttctgccacactgccgcgactatgtgttacaacaaacttgtggcaccttcacccccgggtcgaagttacccgaatggatgacatccgcgtcaatattctcccccatgaagccatacctcgccaagttgtattgctgccaggagctcgcagaaattcctcagcagtgccggtgcgaggcgctgcgctacttcatagcgttgccggtaccgtctcagcccgtggacccgaggtccggcaatgtcggtgagagcggcctcatcgacctgcccggatgccccaggcagatgcaatgggactttgtcagattacttgttgccccggggcagtgcaacttggcgaccattcacaatgttcgatactgccccgccgtggaacagcttctgtggatctagagataaaatcagtcgttcgtgaataagcatgcatgttgcatccataggcgtgtggtgtgcatgcatgcatatgtgagctccgcgcgctcaacatgtgtgggctatctgctatgaatgagaataaagagaaccattttgtggttctttaatttcaactcaaaaaaaaaaaagggatagcaagttgaaactgaaaatcagagttttactttt

SEQ ID NO: 20019 - DNA, 1110 bp, Triticum aestivum
  unsure (1)..(1110): unsure at all n locations
  Clone ID: PAT_TA_20019
agccgcgccccggctcgcccccaccacatcggcgcccctctctccctaccccgactgcgaccgctcgcgggcgcttgactgccggcatggccgcgtccttctccacgtgtgggtcaagggcaggggttggcatttcaccgtctgggaccccgtcaccggcgaccagcagagcctcccggagcccggcatcccgtggctgatctacaccgccgccgtgttctgccctgtggccggctgcggccaccttgactgccacggcggccccttccgggttgtctttgtggccaccgacgactacgacgagctagtcaaggcggcagtgtactcatcaaggacagctgcgtggagcacgccagtgacactcgacgacggctgtgaatcctatgttcggcacanncgagatgttcttgctgctgatggatcattctactatatcccctatgtcgagcctaagcggggtgtcgttattggagatgaaacctacttcgcgcttcgggagggtaacgcaatcatcagatatgactgggccaagaattgcatatccatggttgatccgccggacccgaatgtgtacgacgacgttgccctcatggcgatggaggacagttcactggggtttccctgccttggagaatccagcctttatctgttctcaaaggaaggtgaatgcagaatgggtgtgctgcagggccatcaaactgggagacantatacctgttgccgntcctggatgaaggaaccancctttgtccgatgtgcaagaggtgttgggtgtccatatccntggancacacatgttgggttatccacaaccaactnaattcctggggcgggttaagaagncccccgancccggaaanactcancgtccttaccctacatgacttctacacccaaaacgtgggaaatttcaacnctaacaaggcacggattctgatttgcgccaaaacaanagctgacncacnaatacatggagattcatcccagcgaaccacgatgtctgattgcgccaaaacanatnatgcccacaaatttaagcacacataatcacncgtngttctgangcncccacaanccttatttcgtagantacncacnggaaccacatan

SEQ ID NO: 20020 - DNA, 784 bp, Triticum aestivum
  unsure (1)..(784): unsure at all n locations
  Clone ID: PAT_TA_20020
cgagaccgcctggtgaagcacgatggaggccggcgctggttgcgggcaagctcactaaggcaggcacatgggaagccggttttggtaaccggaggaggaagcggttgcgaggcggaggtcgggaggagttggggcagggagcgctctgcccggccgccgggggcggcggaattcactagtgatttcgagcggccgcccgggcaggtgtggggaatttgggcggcactcatacagtaagagaattcatgtgccagatcacaattctgttaactttgaatcatacatgggttggactggagcattttaatttcagcattaggaaacaccatccgctaccctttaagaaatttttcttcttagttgttcgctacttatatgacactacttatgtgacagtcgtgtctttttagccatgtgcatactcagtctgattgagatactgctaatcattaaattcccagtacttgtgactcagcttatttacaatcttcagttcgcataatcttcaggacctttgcgtctctgtaaatatatgtattgggtttctgcatcaaaaaaaaaaaaaaaaaaaaaaaaaaaaaaaaaaaaaagagaatcttgtccaccgctgccgccccccgcgttaacgctaagtaattgcctctgcnaaaaaggacaaacagtatccaacatgatgtctcacatcaatgagnnctccgggtcccctaagctaaaacactactgtcagatctttggttttttttcgtcaagcagtggaggaattttgcacaaagtgtancaattg

SEQ ID NO: 20021 - DNA, 809 bp, Triticum aestivum
  unsure (1)..(809): unsure at all n locations
  Clone ID: PAT_TA_20021
gcacgaggggaccccccgcacccgccatcttcctcgccgcccccaccctaccttcttcctcgctgcccccaccccaccttctttgccttcgggctcccaggcccccacgcgccggccaccatgacctccaccaccacctccatatccaccgccggccgcccaaaagtgttgtgccgtcagccaccccttcctaccccagcgtgagatctcccccttccctgttcctccgcctcccgccagatcagcgccggcgcgccccctccaacgcacagccagcaccgccggatccggctgccgcgaggcacctgcgccgcactccctctgagaacccagcacatcagccaagcaaaggctggatccacctccaccgcgcgcttgccccgaccggatcgggctggactcccccgtgctagccccccgacctcccctcggcggagatcctcggcccccctttgagtgtgcccactccatagtgcaggattcggtgagtcggtgccgccccgcaaggttcttctccacccccaaccgccttgaggtgtgtgaccccgaccacatcttcatcggccatggacccatgtatcccgtgtcggatccgagttcgtccctcccctgagcaacaccgcgcccacctgaatcgccggaggatgagctctctcctcctcgtggcggtctccggccaaggcctatgtgcacatccgtngcaactcggtgccggccccgtgcaactcggtggnggcccntgcaactccgtggcggccccgtgaactcggcgcgcgccccttctgagggatggcctgcggccccncttg

SEQ ID NO: 20022 - DNA, 529 bp, Triticum aestivum
  Clone ID: PAT_TA_20022
catggcaacgatagatgagaacagcggattcccccgctctttggtacgtttcgtggcggacgcgtgggatgagaccaactttctgttgaaagaagagaagaggttgagatcattggtgaagaaaacaattcggtatttccatggaaacgatgcgaaagatgacggatttagcctgtttgtcattgtaagagattttttggtgatgctagataaggcctgcaaggaagttggggcatcacaaaagaaggcggcaagtcaatctcggagcagtggcagttgtaacccagcttcccagttaaatccccaggagaaacagtttcctgcagtactggatgatcatttagatagctcggactcaaatgattaattttgggatataatattaggtgtaatctataggtttttttttgcctgagacgatgtacaaatacccatttgaagagacattactgtatacatacaactgccacatacacatggcttaatacatgtttgcaaaggcattgctgtatacatatgcatgccccat

SEQ ID NO: 20023 - DNA, 1116 bp, Triticum aestivum
  unsure (1)..(1116): unsure at all n locations
  Clone ID: PAT_TA_20023
ccactttccagcgatggcgtcgtctctgccggagaaggctggggttcccccgtggagcaggctggaagggcaggttgtgctggtgacgggcgcctcctccggcatcggccgcgatttctgcctcgacctggcgcgcgccggctgccgggtcgtcgccgccgcccgccgcgccgaccgcctccgctccctctgcgacgagatcaacgcatccgcggacgcggccgtcagccatccctgggctgtggccgtcgagatcgacgtcgccgccggagggtccgccgtcgaggcggcggtgcagagggcctgggacgccttcggccgcatcgacgtcttgatcaacaacgctggcctccgaggaggtgttcattcctcactggattggcctgaggatgagtgggataaactcatcaagacaaaccttaccggattatggctcgtcgccaagcatgtatgtagacacatgcgtgatgccaagataaagggttcagtaatcaacatttcgtctgttgctggcctcaaccgtggcaatctgcctggctccattggatacgcatcttccaagtcggccgtgcattctgtcacgaagataatggctttggaactaggagcgtatggaattagagtgaacgcaattgcgcctggaatattccagtcagaaataactgctcctctgttgcaaaagagatggttgagcaccgttgtttcgaaagattgtgccacttaagacaaatggcactaccgatccagcattaacatcgctggttcgttttctgatccatgaaaaggcatcatatataactggcaacatcttcatcgtagattcaggcgtcaccgtacctggtgttccaatatctcttctctgtaatctttgttattagattacaattaagttatatatgagtgcaacaagcaataaaaattccacctgttcctttttcccaaaaaatttaaagagcctgttcctccagacaccacattcgttctgcttcggcatcgctgaagcttccggcgccgttccctcccacccattcctggtttgttcggccacaggcgtcccttgcctcccacaggaaacctgggggccaactatcnctgagaancccnttcacngggaga

SEQ ID NO: 20024 - DNA, 703 bp, Triticum aestivum
  Clone ID: PAT_TA_20024
cacgcgtccgcatcaacttgaaacgagaaagctccgaagatccacgaacatgttcctaggggtgcaggccgtcctcaggtacgataaggagaaatgccgttcctgggccggccgcgctggctcgcttcgtcagccactgtggctactccacggcctccaactcccaaaggttggccgggaaggtggccgtgatcaccggtgccgccagaggcatcggcaaggcgaccgccgcggagttcgtcaggaacggcgccaaggtcatcctcaccgacatccgggacgacctcggccgcgccgtcgccgcccagctcggcccggacgcggcctacgcccgctgcgacgtcacggacgaggcgcaggtcgctgcggccgtcgacctcgcggtggcgcgccacggccggctcgacatcatgcacaaccacgccggcgtcaccgggcggatggtcctggactccgtcgggtccctcgacctcgccgacttcgaccgcaccatggccaccaacgcccggtccgccgtcgccgggatcaagcacgcggcgcgcgtgatggtgccgcgccggagcgggtgcatcatctgcacggcgagcaccgcgggggtgctgggcggcatcatcgcgcccacgtacggcatctccaaggccgccgtcatcggcgccgtgcgcgcgttcgccggggagctgggccgccacggagtgcgcgtgaa

SEQ ID NO: 20025 - DNA, 550 bp, Triticum aestivum
  unsure (1)..(550): unsure at all n locations
  Clone ID: PAT_TA_20025
tttccccaaatcccgccgacgcacgctctccctcccgtgctcgtcctccctcctctccacctccacgcccatgcttccccacatccctcctctcttccacctccttcccggatctccaccataatccccaccagcgccacccactcgtctcctcctctcttctacctttatcccccttcctgatctctatatctgcggcgacgcgggggaagcggcagtgacggagacgctccggtgggcggcgcgggagcggcttatccgggccctagtctgggggttcagttccaaggcaccgatggttttcttcgtctacgatgccggggcggagctggcgttccagtccacaactattccagccgccgaacgctcggcgatggggcgaggtggtgggaagcattgggtgatgggaagctgacccgtgccgggtggtgggagcaaccggccgctcgcccggcgctgtcgtccacgaggagccctggctgccgccgccccccgttgccgcagttgctgctgcttgggctgcgttcgtcaactggaaaannacgaacnt

SEQ ID NO: 20026 - DNA, 558 bp, Triticum aestivum
  unsure (1)..(558): unsure at all n locations
  Clone ID: PAT_TA_20026
gcaaaaggcgaaaagggaggcgactggtgttcttccggtgtcggccggcgagcctgcgggctctctcttcctccgtccgccgctccggcgacgggaggatgggggagccctgaggtgtcgcatccggtctgtacatacgggtagttttaggtgttcgaggggcgccgccgtgtggtgggtgacggcgcttcgtcgaggtagggcggccgcagctttccccccacttttggagagctggcggcgtttgtcttctcactgggtcagtcccgccaagtgggattgcgtttcccggggcttgggtcctcaaggccggcggccggcgaaccaacgccagttgggaattttgaacctcccgggattctgcctcctgctaacgaacgatgggctccctcctccaaccgttttgtccattccgggaaggatntacaagagttttgctggcctcgtcctctccgggaagcattccgtctgctaaggtgnaggttccccncncaggttgtggtttttgntgcggatntgggctcctccacaacaactccctggaaacgtggttccggg

SEQ ID NO: 20027 - DNA, 761 bp, Triticum aestivum
  unsure (1)..(761): unsure at all n locations
  Clone ID: PAT_TA_20027
gnatcnactctcgtgccnnttcctngttacgagaattgtagntgtcgtccgtgggcagtcagacgttctttggattagtgcncgatgacggcgaaatcggncactcnttgagttgagagggttgntattcggcggagacgaatgacaacgnatctacccatgcgtgatgaggatgcgactgttgcgttgacaactagtcgggaagatctccgnttggcggcgtcgggagccggacggacgagctcggttccatgtttttggcgccntcggtgtacgaatggggggtgaagggggaggggggagcccagcttagggacgcgcttgtcccgaaatgtaggctgcgataacaggacagaagggccggttttgacaccacggcgtggagcttcatttccgactgaggggtagaagggggatttcgcgtgtctgggctgcgggagcgatttcggatgaggagggagttctcgcgcgcgtccaaattttgggataacaaggcgcgacgcgggttgaagaagcgggagtttcaaagcaggtgagacaaaagatactcgagcttgaaaatttcgggataacaaggtgcggattccttgttcggcagaacaaacttaacgtgtaaaaaaaatcatacaagacacaagagagtcatgtccccctttactatattgctatagatgccattgaaaaaactacaagaaaaatgtaaaaaaaaattgggagaacatgattaacctgcacagtaccaaatccaatcccacttcccc

SEQ ID NO: 20028 - DNA, 556 bp, Triticum aestivum
  unsure (1)..(556): unsure at all n locations
  Clone ID: PAT_TA_20028
ggtttgaagaaagctctgcgttggatgccacgttcctctgccagcccccggctggaggaagacgaagacaacaacgagaggaacgggctgctgaggagccaccgggatcagaaccgggtcgtgcccgtgacggatctccatgttgacgagcaacccaaggcaggtgcgcatgtggagcccaagaccgtggctctgaaggtgtcgatgcactgccatggctgtgcgaggaaggtcgagaagcagatctccaagttccacggagttgtgtccatcaaaatagagctggggatgaaagacggtgaccgttggttggcaacgtgacccccatgcaatcctgggagaccgtccccaaggtgatcaagtacgcccacatctgccgccgccctaaacatgctgtgtcccggtccactgtgtggtgattgcactttccttgatgaaaacatgagcgctatcctcctttctccctcctcctttttttaaacatttctccctcntccttagcgccctccctgccgccgacaacagcatttttatgcagtttgcattgtggagcacc

SEQ ID NO: 20029 - DNA, 466 bp, Triticum aestivum
  unsure (1)..(466): unsure at all n locations
  Clone ID: PAT_TA_20029
ggagagaactagtccggttttttttttttttttttttttttgcacaaaaaacatattcatgtagcaccacctctccccctctctcctcttgtgcaccaccatgtcccgcatcacggacgaccccgagcactccccgagggactgcgccaccaagcaccgccaccaccactcggctgggcgccgccggctgctgatcggggcgttgtcggcggcggcctcgctgctggccctggccatcatactctggctcaccctccgcccttccagcccgcgcttcacgctgctggccgccacggtcacggccaccgcccccaacgccaccgccggcggcatcgtgcggctcgacgcggccttcgtcgcgcacaaccccaacgcccgcgccgccgcgctctangaccggctccaggcgcgcgcgtcctacgccgcggtcccccgcgcgccgnccgccgcgccgctcccgccgttt

SEQ ID NO: 20030 - DNA, 1710 bp, Triticum aestivum
  unsure (1)..(1710): unsure at all n locations
  Clone ID: PAT_TA_20030
gnnngtntgttttttttctggcgcgcaatttaccctactaaagggaacaaaagctggagctccaccgcggtggccgccgctccggatccagtggatcccacggcctatggcaaattggcagcagctgtcgggtgccgtccccgtcaccggcccttgttttctaatccccgccggatccgttaagcaaggggaaatctgctcgtcgtcgtctctctcgtggagtgcggtttctaaattcgagagagagacgagagagagtcctacttgctcctctctcctcctgcgagtccaatcgcgaggatagggatggagagctccaacggcaagccgccgcagggagaggaagaggggaaggcggcggggtcgatcggaggccacgagtcgctgcacaggctcctcgagtccaatctcccccccgagctcttcaaggaggcaagccggttgcttttggggctgaattgtgcacaccctcttgaggctgtttccctgcccggggccaccactgatcttgccaaagcgcataatttcgatgtgcaggcattccatttcaacgctgacaaagagcatatgaggcaaccacggattgttcgagttggcctaattcagaactcaattgctgttccaacgacttgtcattttgctgatcaaaagaagtctatcatggagaaagtaaaacccatcatagatgcagctggtgcttctggtgtcaatattttgtgcttacaggaagcctggacaatgccatttgccttctgcacgcgtgaaaaacgatggtgtgagtttgctgagcctgttgatggagaatcgactcagtttcttcaagagctcgcacagaaatataatatggtaattgtcagccctatccttgaaagggatataaaccatggagagactatatggaataccgttgttgtaattggaaataatggcaacataattggcattcatcgaaagaatcacatcccaagagttggcgacttcaatgagagcacatactatatggaaggtaacactgggcatccagtgtttgaaacagcttatggcaaaattgctgtaaacatctgctacggcaggcatcatcctctgaattggcttgcatttggcctcaatggagctgaaatagttttcaacccatctgcaactgtcggtgaacttagtgaaccaatgtggcctattgaggcaaggaatgctgcaattgcaaatagctactttgtcggatcaattaaccgggtaggcacagaggtattcccgaacccattcacttctggtgatgggaaacctcagcatgccgactttggtcatttctatggatccagccatttctcagcgcctgatgcttcctgcaccccatcgctatcgcgctaccgagatggcttgatgatatctgacatggacctgaacttatgccgccagatcaaagacaagtgggccttccgcatgactgctcggtatgacatgtatgctaacttgctttcagagtacttgaagccagattttaagcctcaggtcatcgcggatcccttgataaataagagggcttaattctggatcagttgggtctaagcagacgaagtcgatgccctttcccttcttttctgtatatgttgtataaatataaaaataaatcagtaaacatcttttgatcaagtttccatggtctgactttacccaatgttgaaatcacaaaaaaaaaaaaaaaaaaggccccta

SEQ ID NO: 20031 - DNA, 532 bp, Triticum aestivum
  Clone ID: PAT_TA_20031
gattctcttaatggccatggcaccagcatacctggcgggcccccttgcctatgtttgcaggaacccaactttcagatcctagttggcaacctcaacaatctgagagagctctaccttgatggagtggatatgtctaccagtgcagatgattggtgtgatgcatttgctgattctcttccgaatctccgagttctcagcttgagatattgtaatcttgttggtcctatttgcccctccctgtcgaccctgcactccctagctgtgatcagtctccaagataactttgatacgtctgtcacctcctcgggagatgctcatggattctcacaatttaagttttcttcagcttgcttggaaaaatatccaacgcttgtgccctagtagaatcttccaataaaaaaaactaaggtccttgatttgttgggacatggtatgttagattatgtgccaatattttccatctaattaaagtgaactgcatgttttcctggaagggtgctatccctgaggtacctcggccgcgaccacgcta

SEQ ID NO: 20032 - DNA, 1994 bp, Triticum aestivum
  Clone ID: PAT_TA_20032
cggcgcgaccacgccctcccccccggcgcccccgcccccccgcccccacccgccgggggacgagacgcagacgccgctggtgcgcccaagcccgcgcgagggtgactgcctgtgccgcgcggggacagctgggtgtggtgcacggtacccggagaggctcaaggggtggtacgtggtcgaccaggggaatcggccggagggccggtggaggtccagggtctggtccgcgtcggagcccaggcggcggccgcacgtccccgagggcggcgacgacaccctcgcgctcgcctggcgggccgccgcccatgatcaagttcgccatctcgcccaacctcgagaagatgaagtacgacatggccaattccttcatctctttctgatgaaacaacatttctcctctctctggtacgtagcatgcatgctgctgcctatacaaaaccaccgcgtcgacgcatcaatctgtgcatgtacccaatgtttatatgtgtctgtcgaaagtatttgttcctgagagaaccgtatgtacgtgcatgcgtggctgcatcaggtctacgctgtcggttgtatgcacgtacgtacgcctgtttcctagagtacattgctcgcggcttcggttgcgggtcggtttcgtccttcatgtactctacctaggatgtaactaagattgagtattcttctccatccactccgacaaggccaaggcgctcctcgacacgtaccgcatcggcgagctcatcaccacggggaccggctacaactccgacaactcggtccacggcgggtccagcctctcccacctcgccccgatccgcgaggccaccaaggtcgccggcgcgcccatcgctctctccagcccgcgggagaaggtcccctgccgcctcgtcgacaagaaggagctctcccacgacgtccgcctcttccgcttcgcgctgccgtcctccgaccaggtgctcggcctccccgtcggcaagcacatcttcgtgtgcgccaccatcgacggcaagctctgcatgcgcgcctacacgccgaccagcatggtggacgagatcggccagttcgagctgctcgtcaaggtctacttccgggacgagcaccccaagttccccaacggcgggctcatgacgcagtacctggagtcgctccagctcggctcctgcatcgacgtcaagggcccgctgggccacgtggagtacaccggccgcggcaacttcgtcatcaacggcaagcagcggcgggcgcggcggctggccatgatctgcggcggcagcgggatcacgcccatgtaccaggtgatccaggccgtgctgcgggaccagccggaggacgagacggagatgcacctcgtgtacgcgaaccggagcgaggacgacatcctgctgcgcgacgagctggaccggtgggcggcggagtacccggagaggctcaaggtgtggtacgtgatcgaccaggtgaagcggcccgaggacgggtggaggttcagcgtcgggttcgtgacggaggacatcctgcgggcgcacgtccccgagggcggcgacgaaaccctcgcgctcgcctgcgggccgccgcccatgatcaagttcgccatctcgcccaacctggagaagatgaagtacgacatggccaattccttcatctccttctgatgaaacaacatcatgtctcctcctctagtacgtagcatgcatgcagctgcctaagctacgtaaataccaccgcgtcgacgcatcaatctgtgcatgtacccaatgtttatatgtgtctgtcgatcgtatttgttcattagagaaccgtatgtacgtgcatgcgtacgtgattgcatgaattatactctgtaggttgtatgtacgtacgtacacttgtttcctagagtacattgggacatataccgatgttttgccccaggaaggatgtgaagtttacgcggcttcggttgagggtctgtttattccttcatgcacactacctagtatgtaaataagattgattattcttct

SEQ ID NO: 20033 - DNA, 2857 bp, Triticum aestivum
  unsure (1)..(2857): unsure at all n locations
  Clone ID: PAT_TA_20033
agttcccgtcgctgcgttcaggcagccgccggcgaccagtgactgcttccgcagcccaccgcgcgtcaggaagcagagaccagcgtccagccgccagcgcgcccaccctacccgagctcacccccatcggcagccgccgccgccgcgttactgcgcgcagtggacgagcgccattatttgatcctctgattctttccccacgttgggcgatacttcctatgcgccaccgccgcccgcggatcacacagcggcagcagtagcgcgagggaggtactgagaggccgaaagattcggatcgatggagatccgcgcccgcgcgcccggaaagatcatcctcgccggcgagcacgccgtcgtccacggctcctccgccgtcgccgccgccatcgacctctacacgcagtcctccctccacctgcccccctcatgggatggcggcgccggcgaggtggaggtcgacctgacagacacgggcctcgccttctcgtggccatgctcgcgcctcctcgaggcgctgggggagacctgccgcaaggcggagctgcaggccccgaggccctgctccccggaggagctggccgccattgccaagctcgtggagctgcacgagatacccgaggccaatatctggctctccgccggcctctccgcgttcctctacctctacacctccatcctggggtgtaggcctgggaaggtcgtggtgagctctggcctgcccatgggcgcggggcttggttcgtcggctgcgttctccgtgtcgttgtcgggcgcgctgctgacggcagcaggcgtggttcatcctgatagcgccgtcggcggaacagagtggcggttgttggggaaggatcatcttgagctggttaacacgtgggcgtttccccgggaaaagattattcatggcaagccttctggcattgacaacgctgtcagcacttttgggagcatgatcaaattcaagaagggagaattgacaaacctcaaatctggcaatccagtcaaaatgctcattactgataccacagttgctgcaaaagccaaggctctggttgctggtgtgtctgaaagagcatctaggcatcccgatgctatggcttccgtcttccatgcagtcaacactattagtgaagagctttccagcattgttgagttagctgctactgatgagatagccatgacctcaaaggaagaaaagctagcagaactcatggagatgaaccaaggtttgctccagtgcatgggagtcagtcatgcctctatagaaaccgtgctgcgctcgacattgaagtataacttggtctcgaagctcaccggagctggtggtggaggctgtgttttgacgttgataccaactctattgtccaagttagttttggagaaggtcaccacggagctagaatcgcatggtttccgctgcttcaaagtcgaggtcggtggacaaggtcttcagattcaccaaggataagataatgctcgctcctgtttcaatggagatgttgtacactatttttaggtttgcttgaccttccgagatgaaagcattcttcctattctgtgcctagcagaccactcactgtatcagtcaataagcgagtttgccagtcgcatgattgttgttgtatcaaatcaagaaaccctgttccatggccggtcgaggggcgagagttgatgcattgcttgccttctggcattgacaacgctgtcagcacttttggaagcatgatcaaattcaagaagggagaattgacgaacctcaaatctggcaatccagtcaaaatgctcattactgatacaagggttgggtaggaacaccaaggctctgggttgctgggtgtgtctgaaaagagcatctaaggcaccccgatgctatggcttccgtcttccaatgcaggcaacaccattagtgaagagctttccaggatggttgagttagctgctactgatgagatagccatgacctcaaaggaagaaaagctggcagaactcatggagatgaaccaagggttgctccagtgcatgggagtcagccattcttctatagaaaccgtgctgcgctcgacattgaagtataacttggtctcgaagctcaccggagctggtggtggaggctgtgttttgacgttgataccaactctgttgtccaagttagttttggagaaggtcaccacggagctagaatcgcatggtttccgctgcttcaaagtcgaggtcggtggacaaggtcttcagattcaccaaggataagataatgctcgctcctgcttcagtggagatgttgtacactatttttaggtttgcttgaccttccgagacgaaagcattcttcctattctgtgcctagcagaccactcactgtatcaatcaataagcgagtttatcagtcgcatgattgttgttgtatcagatcaataaaccatgttccatagtcgggcgtggttggaaggaatatttgaggtgccatgttgcatctgatctcatgtatcattgttatcaaagttgagttcattgggttgggtcatttttcttgtaataaataaactctctgcctgctcttttgtgtgtgtaaacatttgcagttttggggcattgaatgctcaccgtttgtaattacagtgagctctggattggaagtgttgggttgtgctcaagttttgtaaatgtcctgtaagataacatttacaattccgcaagggaaaagttttggtatttcaanangtagactaacnntgtgtatgtagtacantactattaattaaggncctngtncgtcccaangccngaataatanatangtactccanttatccctcatncanaaacataatgttttgggattccaatatcactcatnactgan

SEQ ID NO: 20034 - DNA, 427 bp, Triticum aestivum
  unsure (1)..(427): unsure at all n locations
  Clone ID: PAT_TA_20034
ctcgtgccgaattcggcacgagcacgccgcctcttcttccgggaggaattccctcgaacacctcgggcgcgcatcccgcgcgacctctgtccgatcgaatggcggtaacgaactgagctaggagggagtacgtggctccaatggcgtctcttccccccttatccgctgccgccgcctctctcctgcggcaccacgtctgcttcaggcaccccacttcttcccggagctgcttcgctgacagtgagagctatggctgctgcggcggagtgcctgacgccgggcgctgcgcganggctgcggctgcggcgggaggggcccggtacgttgccaagggccccggcggtgggtggagaccggagcaccgggttcccgcttgcgcggggctcccgcaacgggaccaaacccaangaacctgcgggcgccccct

SEQ ID NO: 20035 - DNA, 613 bp, Triticum aestivum
  Clone ID: PAT_TA_20035
ctctcccatcggcatggatcccctaacctctctcctccgatcctcccctgtggagacgttctccatgcctctccatgcgcccccgcatccatgggtctccgtcgccagcgtggctccgcgcctcatctggtgtggctgcacagcgtcttcgcacgcgcgggagatgaattgcgctcgatggtgctgctccgcctcggctacatcgacttcgacgccgacggttcggtggcccacttctcccatcggcccttggccttcctgccgctgcccaccgtcggggccgccgcgccccttgctcgtgtccggcggcgcgtcgcgcactgcgcgccccgccttcgtgccccgccccgggcggctgtgtggggcgcgacgcctccgcccgccccgctgccacggcgggcggccgaggccgttccccccagcgctgcctcggcgccccgcccctggccccggcagcattcttgtttgtgcccccatcttctctgtgatcgctcgtcgctcttgggcgttcgtctcgtggttaaaataattgtacatcttctctgcctatttggtatgtaagtagtgtgttttcctcttctggttgatatgcaagtaatgtgtgctcattgga

SEQ ID NO: 20036 - DNA, 605 bp, Triticum aestivum
  Clone ID: PAT_TA_20036
ccgccccggccccggggcgcccgtcgcgtccccggcgccacgcgggccatctggctcgtcggcggcccgcggccgggacccgcggcccggcgtagcctttgggacggcggagaggcggaggctgacggcgacgcactggctcgtcgcctatgggctccggcaagcccggcaagaagggacgcccgtcgggggccgcggcggggaaggtcgggaccgacgtgctgtggagcatgtcgtcgagggtggtcgccgacatgtggctcaagccgatgcgcaacccggacgtgaagatcgcagccaactaaggccggctgccgctgagctcctcggtttccctccaggctgaatcacctcttcatcttccccaccccaggaactacctacgggaattccttgccacaacatcttcgcccccaaggtactattctaagcgctcttatatttctttacggagggagcagcaggaagttgaaactgtcaatgttttcttcttcattttgttcctgtgttgatgagaatactgtaagtatatttttttaacagataccttaatacatgtatttttgtacaggatagaacaaagaaacaatatcttttgaacagat

SEQ ID NO: 20037 - DNA, 982 bp, Triticum aestivum
  Clone ID: PAT_TA_20037
cccccgcgtcgtctagcttaggcgacacgggcggcgactcggtcccccgccgccagcagctccctccacctgctcctcccccgccgccgccgccgccggtggccacctccgggcaaagcccgcgtggtggtggcggcggcggggccttctccgttgctcagctctctttcggtgggagcttcggccggcggcgcccgatccagttgccggcggcgcgatgcgcagtgggggtcgacagctgccggcgcggcggcctcgcgcatctccggtagggctatggcggcggttgtgaggaggaggcgggtggggagggctgcatttggtcggactcggccggatctggcttctcctgtccgtccagcgggtgcagggctccatggctgctgcggatggagtggaggacgccggggcggcggcctcgggctcgatgttgctggttcttgccggcagggagctgtggtgcctggatctggcggttactgcgcggatccatgaccggtggtggtgtttcggccgacgtagcgagaggtgctgcggaggacatgacgcgagatgcagattggtgggcttcgaccagggcgtttgcgacatgctgcatgctccggccatcttggcgctccggtgcccagatctggtcgtgcaacctcgccattctcgggtttgtggatgagatctgcccgacctcggttggtgccgacaacggtggcacctcgatgccattttcctcattggaggcgtggtcgtggagcctctttccaccccgtggcggatgggctctccgggagaaatccctagctctgatctctcggagcggctacgtcgcatcctccttggaggcgtcgccttggagagccagatgcagatgtttgcgccgttcttgtcgttgaggttggtggatgtcggggcggcggcccggatgtttgatgtttgtgcgtcgaggcggcggctcggatgtttgatgtttgtgcgtcgaggcggcggc

SEQ ID NO: 20038 - DNA, 910 bp, Triticum aestivum
  unsure (1)..(910): unsure at all n locations
  Clone ID: PAT_TA_20038
gtggtgaatacgtgtctcatttatatcaataatgatcatagtacaagccatgtaaacacaaagatgcactggaccatatatatatcgtttttttttgcgggctaggactgtatatatcatgctagtacaagcattcttatactttaatcataactgaagacgcagacagtgcctttgagctagcccatgttcagaaaggcttcgcgcatggctcggtacctgggtttcagccgaggaactggcgccgggtgatccttcaccggcatcaagtccaagaacctgacgacggacgccgacagagacgggaacctctcctcggtgaccatcctcacgccgatgatctcctcgtacatcgggatcacgtacgccaacgcgccgagcgaccggtcaacgaccccgaccccacccccgccgagcacatccccccccccgagggcgagcaagtcctccaggacctgcagctgctccacggcggccccccagcgcggccttctggccctcgcctggcgccgccgtgaaccacttccagatcggcggcgagagcttgtcgtgcacgaacctcacccagaagcggcccatggcgcgctcgtgggggtcgtcggggaggatgcggccgccgcggtagctccaccgcctcgtcgacgaactcgacgatgacgtcggactccgccaccggtttgccgcggtagagcagcacggggaccttcttgtgcacggggttgtgctccaggaggtcgtcgctcttgttcctcaggtcctcctccacgtactcgtactccacgcccttgatgctgagagcccattttaccttgaggacgtaggggctcgcccacatgccgaaaagcttcaccttctccggcgcttcctcttgatgatcatccatgcaatctcgtgcggaattcggcangag

SEQ ID NO: 20039 - DNA, 616 bp, Triticum aestivum
  unsure (1)..(616): unsure at all n locations
  Clone ID: PAT_TA_20039
gaaatacgaggtccattgtacggctcaattctctgcatggcagtgcttgcttacgcctcattcgtattgtacctcatcaccgcggggccccgaaatctccaaccagatgatcgtagcgatacgcaagagattgtcatgacagctgtaacaaaattttgctctcttattacacaaccataacctctgaacctatagaaggcttctcttccgagaacagagaccggggatccacagtgtacagtgacatttgagttgttgaaatagacccgaaccgctgttgaatttggttgtagctctttgactcgtccggaaggagggaaatttacagggcagtgaattggtgatgctgctgaacagcttcgcgttcattccttttgtctaattctttatttgtcggcggactaaaggcgtagagaaagagaagagtagaagcggaagaaagcagtgtaatcttatccttcatctgtacatgaaaacatttctatctggacagcgaatgtgatgacccaattctgactattgtttgtacgattgtcctcgatgatatgttattgggtacgggatacttcggtgctgggaatatactatagtgtcctnaaaactacaatatgtcgtg

SEQ ID NO: 20040 - DNA, 906 bp, Triticum aestivum
  Clone ID: PAT_TA_20040
cgcccgccgcgccgggggcccccccccacccccaccgctgcgagaacccaatcgagggcgggaggcaggagtttctcgtacaagaggaggcacccagccggccgcgccccgcgcgactgcaattgctctgcggcgcccatggagctcgcggtgagagccgcggcggcttcctgctcctcctccccgtcgctccatcccccgcgcttcccctgccgccttggccgcaacccaggcctgccgctgccggctcgccacgtggccgtcgccgctctggcggccatcgccctcgacccgtttcaggagatcaaaaccgagctgaatgacacttcaaaaaccgaggtgttcgcatgccctgtttgctatgaaccgctgataaggaaagggccgccaggcatgaacctgccggcgatttataggtccggattcaagtgttcaaaatgcaacaagtcattcaccagcaaagatgtcttcttggatctcactgtcacctcaggaatgaaagaatacagtgaactcaagcctgctaggacgggtgggcggaggcgtgcgctcgtctcctatctttacgagagggggtggcgtcagaacttcaatcggagtggcttccctggccgcgacgaagagttccaaatggctcaagactatttccagtcagtcgctggtggtatactcgttgatgtcagctgtggcagtggcttgttttcaaggaagtttgcaagctctggggcatactcatctgtgattgctttggacttttcagagaatatgctccgacaatgctatgactacatcaaacaagaagaaacccctatgaacacgaaccttgcacttgtaagggctgatatttctaggctcccttttgcttcttgttcaattgatgccattcatgctggagccgctatccac

SEQ ID NO: 20041 - DNA, 568 bp, Triticum aestivum
  unsure (1)..(568): unsure at all n locations
  Clone ID: PAT_TA_20041
cgcaaccgaaaatccccgcggccgccgcgctcccccggcgccgagcgccagccggccagcgcatgcgaggagcccccggagcccggatctagggcggggggacgcgtccgtgccagggccccatgggccgggggtcgccgcggtgggcggcgctgctgctgctgctcctcctcctcgccgccgcggggctctcctccgcgcatcccggggcgtgcccggtgcccgccgcggcggaggccgtgctcgggcctcccagcacctgctcgccgctggatcgccgcctcggcgacccggtcggcgtcaatcgagggagatgaggctacattggcgagggcagtcaatcttctttacttgaacaaagaatgagtacattgctgtacttttccatgcctncgttggtgccccgttttcccaagagtgcttccctcccttcgtgttcgtggctctcttggccccaacttttcccccttttgcttccggccaatctgcgctttggccacgcctattctcgggatttggaccccccccttttcctacactatttctcttgaattcaacaatgcgagtg

SEQ ID NO: 20042 - DNA, 763 bp, Triticum aestivum
  Clone ID: PAT_TA_20042
gaacaaaccaggatatcaagtccctggtgcatctgtgaagctttcatggggaaccctgcaccagtgcatttcataattctcttaccctacaatccttaactgtcttctccctcgttgctgtttttgcagcagatcatgcccagggaggagacgatggatgcccacgtttctcctgtggccatctccgagatatacgacatcctttccgtcggctaggtgatcctcttgagtgtggtgttgaagaatacgagctgggttgcaccagtagcaaggctataattcacatcaacacaggaacatactatgtgactgccattaactacaccggttcctacttctgggtcatggatcccaatttcaataccaatagcagctgccctcttccaccttcgactcatgttccttactttggatactggtgccgattggattcagtttcaccatctggctttcggttttcggtccgtcaaagcgatgacatagcctgttccactaattatgcgctagctgtaacggttaatcctgcatacatgcccgttgcatacctcagtccaaaaatcacctgtgtttgcctggcgtcatttaacatatgggtggtcgaggcgcgggggtgcaacagtcgcaagattatgatttacacccacaccggcgctaaattcgggccggcccccggctccaccggccccgacttctgggtcatcgatgccaacttcaataccgaaagccagatggtgaaactgaatcaattccgcgccagtatcca

SEQ ID NO: 20043 - DNA, 629 bp, Triticum aestivum
  unsure (1)..(629): unsure at all n locations
  Clone ID: PAT_TA_20043
gccgccacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggagctggaggtgatccactgccggtgggccatgctgggcgcgctcggctgcgtcttcccggagctgctcgcccgcaacggcgtcaagttcggcgaaggcgtgtggttcaagggcggctccaaatcttagcgaaggggggctcaataactcgggaaacccagcctccccaccccccaagcagcctccccccccttcggccggcaagtnctggccaatgggcnccgtccaagggtaacgccttcccccgggggccnctncggnaaaattttccn

SEQ ID NO: 20044 - DNA, 1888 bp, Triticum aestivum
  Clone ID: PAT_TA_20044
cctcgcgtccgcttgctgtcacagcatacccggcccccggcaaatcgctctcgtgctccggtgggcggcgtttgctgaggatgctagagagcagggcttttgaaggctctcgtggacctcctcaacaaattaatcccacgcgtccactgctcaccaaccttggttctgcttcaaatgtatctagtcctatagcagtgaactcagagcgacctgataggatgttgcctgcagtatcaatgagtggactggcatctatggatgttagcagaacgccggatgttaaaccaagaataactgatgaatctgaaaagctaaagacctggaagttggccgacattgttgattcaggacatcttcgggcacggcgttgtccagatacaggagcatctccaacaaaagttgtccgtttgttgtatacaaatagtggggttgcacttttgtctctcggttccaatgctgttcataagctgtggaaatggcaacgcagtgacaggaatcctaatggcaagtctactgcatctatttggggcagtttatgtcagctaggccatgggattcggatgcacaaaggggagtcgcgcctccccaggctaacggagcccacccgtccatgtcatcagctccagcagcatctaacaaccagacgtctgatcagccaacgagatgactcaggccactaaaacaatggtaggactctaggagacagggagaaagaaaacagttagattcatgagacaaggtgaggtgatatgtatcaattccacaccatctccttgccacaggtggtgattgatgatggcatgtctagattagtttttggttcctggttgtttttttgccccaaaaatcttaacttcatcacctggtgccctcttcctttgtaaagcttttcctgctcccagctagtggtggttacttagaagcagctatgtgtctggagcaatgatggttgggagaagaagaaatcaaattatatccaacccccggcaaatcgctctggtgctttagttggcgatacaagggtccagtttcacaatgaccaaacacatcttcttgtagttcatgagagccaactggcaatctatgatggaaatcttgaatgctcgcgctcgtggtacccaagagatgcactgccagcgccagtttcgagtgcaatatactcgtgtgatggtctcctggtttacgctggtttctgtgacggtgctattggagtatttgaagccgagtcccttaggttgcgttgcaggattgcactttccgcctatgtgcctccttcaatatctagcggggcaagtgtgtaccccatggttgtagcggcgcatcccttggagcctaaccagattgcagttggaatgagtgatggggcagttcatgtggttgagccgctggacgcggacccaaagtgggggagtcgcgcccccccaaggataacggagcccatccgtccatgtcatcagctccagcagcatctgaacacccaggacgtcttgatcagccaacgagatgactcaggccactaaacaatggtaggactctaggagatagggagaaagaaaacagttagattcatgagacaaggtgaggtgatatgtatcaagtccacaccatcgccttgccacagatggtgattgatgatggcatgtcttagattagtttttggttcctggttgtttttttgcccccaaaatcttaacttcctcacctggtgccgtcttcctttgtaaagcttttcctgctcccagctagtggtggttacttagaagcagttatttgtttttatttatttatgctcctttatttgtgggggtagttactttgtagtgtaaaatatgcttgtcgtgttggatgatgatgatatttgcttcgctcgttgccgccgattcgataa

SEQ ID NO: 20045 - DNA, 723 bp, Triticum aestivum
  unsure (1)..(723): unsure at all n locations
  Clone ID: PAT_TA_20045
cgctctctctccttctctctctctctagacactaaacaaaagagggggaagaaaagctcacaccacccaacaccatatggttactcccctctccccccctccccaggagcttgctagctggaatagcagcaacatcagctcgccaccaccgcaaatccaccgccgccgacgcatccccgtcctccgccgccgacgcagcagcagcagcagatagagcagctagagcagaggaggcgctccgccatgggtgcgccggcgtacggcgccgtgctcctcttcgccctcgcgctggccgcgggcgccgccgccgctgagaccgcgcggccggaggaacccacattgcccgccgctgctggcggttggtggcgaccgggtggtggtgggcggccgcngcggtcctcaancgggtccggggcgggggtgaactccaacctcggttgctggtggcgcctgctggactcgcactacacggagctggcggagctggtggaaaaaggcgctgctgctgcaaacctggangacccgttggnccccaaaaagtcaacaatccttcgccgccccccaaacaangcgcctggaaccggaacctccaacccgggtttaaacgcnttcctgtccaagcccncnaanctcaaantcgctccaaaagcctgctccncntcaaagttcttcccgggggggccaacccgggggggctcctggnccgggggcttccaaaccnaa

SEQ ID NO: 20046 - DNA, 716 bp, Triticum aestivum
  unsure (1)..(716): unsure at all n locations
  Clone ID: PAT_TA_20046
cacccgtccatctctttcccccatggaaaaccaaatatcttgcccacggtcccttcctctccaatctttctctctcaaatctctctaccctagaaaccaaactaatacagagcaagcgcggcgatggatctaaaaagcatatggggccatggatctagcgttcctgatctagatcaggttgtcctcgaattcaccctaatcacgatttggatcaaatcctcaatcttttgaagtacaatttctggatcaggttgtcctcgaattcatcctaatcacgatttggatcaaaccctcaatcttttgaagtacaatttctgtatgccttatggagatcggaccggagcacaactatgcccatcaggcagcccttgcacaagagatgccggagaagcgggagtaaccccatcgcatgtagctcagtatgcgtggcatccaagaagctgcttcgatcgcagactacatgctcaggtccatggcatagcatatacatcatgtacgtcatggatgcatgcataaaagtgagctaggacgtaagacaggttattttttacttgggacatcatgacccataaaaaattccactcggcaacttagttacagtgcttccctaacgtgtacgagagatagtatctaaagaagatacaaattctcattgcgatgtgctctggttctgccgtacgtaatattatcttacacaagttactatcaatggtatn

SEQ ID NO: 20047 - DNA, 705 bp, Triticum aestivum
  unsure (1)..(705): unsure at all n locations
  Clone ID: PAT_TA_20047
ttctcaaggcatatggcacatcgaaacccacaagatacactttccctgaggttaagaagaagcaagacggttcaaggataaactgggtcagggtggatttggaagtgtatacaaggngagctacaaaacggagggcccgtggcagtcaagatgctagagagctctacaggggagggagaggaattcatcaatgaagttgcaaccattggactaatccaccatgcaaatatcgtccgcctcctcggctcgtgctcgcgccgtacgagacgcgccctcatctctggattcacgcctgacgtgtcccgggtgttcgccctccttcccccccgacgccttttgttttgggtggccgcctagggccactgatcatgctagatgttgcattaggcatcgctcgaggaatggagtacttgcatcangggtggcaaccaaagcaacctccanttcgacatcaagcctcanaacatcctgttgggcttcaacttcaatnccaaaatttcagacctttggnccaacaaagttgtgntgcaangggaacaaagttatcaatttacctttaactgcancaaagnagggaacaattgggctaaaantgcnaccgggnggccattttcaaaggggaacttttggggggnaataaccanaanaagtccanatttttntttaanatttttgggaaatgcctggggtttanaaaaatngggg

SEQ ID NO: 20048 - DNA, 374 bp, Triticum aestivum
  Clone ID: PAT_TA_20048
cccacgcgtccgctcctcgcgaccggcgaccatggcgtccaacaccgtcaagctcatcgacatcgcagtgaacttcactgatggcatgtttaagggcatctaccacggcaagcagtgccactctgccgacctccccagcgtcctcgcgcgagcctgggctgccggcgtcgaccgcatcattgtcaccggagggtctctgaaggagtctagggaagcgcttgagatcgccgagaccgatgggaggctattttgcaccgtgggagtccacccaacgagatgcggggttgtggcagttggcgagtgtggtttggattatgacagacttcagttctgtccttcagatatacagaagtaagtactttgagaaacaattc

SEQ ID NO: 20049 - DNA, 1195 bp, Triticum aestivum
  unsure (1)..(1195): unsure at all n locations
  Clone ID: PAT_TA_20049
ggccgggagacgcgctccgtggatctcgagcgctacgtcaaggagctccgcaagtacaagcgccattcccaggccctcgagttgatggattggatggttcatacaaagggtatgaacatgtcgtacactaaccatgcaatacgtttggatctcatctacaaagtgcgtgggatcgaggcagctgaaaaatatttcgatggccttcctgatccagccaagaaccatcgaacctatggtgcacttctgaactgttattgctcatcgaagaaggaagagaaagcaacgacctttaccgcaagatggatgagcttggaatctcatccagcactctgcccatcaacaatctcatgtccctatacatgaagttaggccagcataagaaggtttgtagcctgtttgaggagatgaaggagaagaatgttaaaccggataacctgacgtgctgcattctaatgaccagctgtgcggcattggacaagatagatgacgttgaacaagttctaaaagaaatggaagaaaagggtggggttctagggtggtctgcatacagcacactggcttccatctaccagagcgctggtttggttgaaaaagcagagtctgctctgaagaaacttgagggccttgttcaagatcgtgatggcagacagccttttgactttctcatgagtctgtatgcttccgtaggctacctcccccccgtcaagagggtgtggggcgtccttaagggcactttcccaaaagtgactaacacgagctacttcagcatgctgcaggctcttcttaagctcaatgacgccgattacatgaagcaggtctttgaggaatgggagtctaaccatgagtgctacgacgtgaagctgactaatgtgatgactcgggcccacctgaagaatggcatggccaaggaagcagagcagttgtgggagaaggccaaggaaatgggtgcatgttttgactctaaaacatgcgagctgtttctcgatcactacatggggacaggggacatgaaatcagcgctgaactgggtggagaatgtgacgaanctccccaaagaaagcagggaagctggctcctgataagatcccgaagttctccaaagtacttcgaanaaccagnanggacntgcaagngngccccgangaggttccnccanctgcctgaaggggcgttccgggttgcaancgaccggcaa

SEQ ID NO: 20050 - DNA, 1407 bp, Triticum aestivum
  Clone ID: PAT_TA_20050
gacagcctgcgtttagatgctagatcttcagattctcaacatatagaagccacaaccccgaaggaggcggccaaacctaggaatgggaagtcatctctcaagggaaagatttcaagcttcttctcaatgcgtaggaaagccggaaaagagaagctcatcacatctccctcgggtagcttgaatggcagagttcctgtggacagtgatgtagtagttggtgtatcacagtcggcctgtactggcctacaagacgatgttgcttcagagaatttagaagataagtatcagtatgcaacaatagtacttccggtcaaggaatcagaggcactttcttcttctaaggcactaatttcttttgagaaagcacactcatttgagattcggaactcacactttgatgagcccagtcctacatctgttctcgatgcgctgtttgaggataggaatgaaaagtctgccagttcatcagaaagtgcaattaccgctaaacaagaacctttatcgagatgtcttccgatcggatcggttgcgcggacgttatcatgggatgattcctccgaagaagaggccgcgccgtgctctagcaaagaagaagattcccacgagcaagagcagtacgaattcgtcgagaagatcctatcatccgccggcctctgcaacggggcgaccagcaacgtcttcgcccggtggcactcgctcgacagccctctggccccaaacgtgcccgaccagttcctggagcgcaaggtggaggacgccaagtgcagagagcggcggtcgagccagaggctcctcatcgactccgtcaacgccgcgctgcttgacatcggccagagcaagctctggggcgcatacccttgcaccgcagggccgatcatcatcaacgtatcgcagcgagacgaaccggtgggcgacgcggcatggaggctggtgaaaggctggctgtcggacgacgaggcgggcaacgggctgccggacaatgtgggcgccgcggcggaccgggtcgtcggcgaggagatcgagggcagggggtggtccgagatgctgcggatggaggtggacgacatgaccaaggagatatgcggggatgtcctgggcgaggtcgttgaggaggcgctgtcagagctcgccgggtgccgttgatggatgctcctctttatttgtttgccctgctcgcggtggtgtccaccggtggcttttatttccgatctggtggagaccgtttgctgaggaccggcgcatcttggctccttgtgtgtgtgtgtgtgtatagtccctcttgactgtcctgtatgctccagtcaagtgtgcgtgcccactcccctctctctgtcgcgccacatgccgttacagttgatacattctattctacagtaataatgatcgtgaatgatacgaagaaaaaga

SEQ ID NO: 20051 - DNA, 605 bp, Triticum aestivum
  unsure (1)..(605): unsure at all n locations
  Clone ID: PAT_TA_20051
gcgtggtttaacaatggcgaggcacctctgtgttcctttagccatatccgtcttcttaaccctgtcactaagttgctccaataagagcagacccttctcgccctgaatcaccaagcaagattagcgagcattccctatcatacagcccacaagccgcaacacttcccaaatgaagcggctctaccgcgcgtacctcgttttccaagcgttttcaagaagcatccatcactagtgaccccaaaaacatcaccacaacctggtatggccctgacatttgcaacaaaacaaagatatgttgggttccactgcgcggtagcacccggggtgggctaagaagctcacagtcccgggaagttgttttcaatgggntttgggctgcatgcaaccgaaggctgcaaggcttcatcgaacaactccccgaacctttgcgctccttcaagcttcctccgaaaaagctttggggggaaanatccccctcccccgattaanatttgagttaaaacgtttaaacctcaattacaaattgccgattttccaaagattaanttttctgnaaagcaaaagggattctttaaagngggncgcaaaccgtttggccaactngg

SEQ ID NO: 20052 - DNA, 587 bp, Triticum aestivum
  unsure (1)..(587): unsure at all n locations
  Clone ID: PAT_TA_20052
gcccgacgccatcggagtccgccatcgctccgagctgcgtctcctccgccgcgcaccttcgcacccgtcgtgacggcgcggctggaggcgacggcgccgtccagcaccttggcgccctcctcctcatgagcgacggaacactcctcgtcgtctcctccggcttatcggacgccggggaatttgtctattgcgcggccgcccggaggcgagggcgccatcctgcaccgcgacaccctccgccgtcatgtctctcctagcacggtgaccaggcgatgcccatgggcgaacgggaccctcctgctcgtcttctacggggcgctgcggttgccgggaattctaaggccggcggccatcatgcgctaattttttgctaatcgctgctatgtgtcgctactgtcaaggttagtgaagaacgcctgcaaggtattcaagtgttcttcctggttnccccttcctccccttcaaattttttttttttggtggaaagggggttatgtttaggggcaaatggtagggtttttttttaatgctcaaggccctttaattcccattttagacctgcaagattacgacagcttttaagaatn

SEQ ID NO: 20053 - DNA, 1246 bp, Triticum aestivum
  Clone ID: PAT_TA_20053
gaagcttcatcgtacccagttggagttggcaatggtgcgaacgcagaggtggacgatgagatgcttcagctatgggaggctgcagagaggacgtgcaagaaccaaacagccaagtcgtcgtcatgcgagcacgagcacgacatagaggcggttgaggaggtgaagagcgagtacccttcgtcggagctatcaaggggaagagacctgggaatcatcaacaagctcgagatgtcgtcttcagcagagcctgatgagttatggggcaagaatgtggcggagaggctcgcttctgatgggcagagactggcgagcatccaagagagcatcgaggaactgaagcggaagatgggtggcccggccaaggggcactcggaatacgagagcgtgagcagtcagctgcgcgagacggaggggctggtgttggagcagatgaacctcaacagcaagttggcaaagaaggccgagaattaccctgcgctgttggatagcatgaacgcggagcgggaaggtggttttccaagcaagaggaagatgttggagcaggtgcggaaagggtcggacaaggtggcgaggctggagctggagcttcagaagatacagtacgtgctgctgaagctggaagaagagcacgagtacacaaggctcaaggtgtcggagaagcgcacccgggtgctcctcaaggattatctctacgggaggaaggaccaccgtggaaagaagaagagggcacccttctgcagctgtgtgcgctctaaatccaggactgagccatgaccattttgtggccgtcgcggccagaaataagaaacctttcttatcttgtacttatatatataaagataaagaggaaaccatacttgtagtaggctcgtgtcccctttgtaattgagctagcatgttagtattcagaacaagcttgggtggcaagttctcttttgtggaaatggatgaaggaggtcggcctttctgcggctcgtgtgcgctctaaatccaggactgagccatgaccatttttcgttgccgtggcggcaagaaataagaaaacctttctcgtcttgtaaaaagagaaaaccatacttatagtaggcgcgtgtcccctttgtaattgagctagcatgttagtattcagaataagcttgtgtatctagagtattttttttttcagctgtcggtgcgagtaaaatgtgttaattttcttaaaaaaaaaaacctcggccgcgaccacgcttaatcacttagtgaattc

SEQ ID NO: 20054 - DNA, 639 bp, Triticum aestivum
  unsure (1)..(639): unsure at all n locations
  Clone ID: PAT_TA_20054
gaaccacactagctcggttcactctactccaccgagctgctgcggctgagcagctggtccagtgagcttaagaccacacacgggctggggatatccagctcgcggtagccaccaccacaccgagcgcgcgtccgtacgtctcggccatgctgccgtctttctcaccggcggccactgcggtggcgacgccgccgccgaagccgatcccgggcggctacggcgcgcccgtgctgggcccgctccgggaccggctggactacttctgggtccagggccccgaaggagttcttccggcggcgcgccgcgcaattaccggagcacggtgttcccgcgcaaaacaatcccgcccacngtttccccttcctcgtcgggcgtgaaccccgccgcgtcgctcccctggcctcgccgccccggccgccctgttccgcccggacttggtggacaacgcgatgctcaatcggccctanaaccaaacgatccttaangggcggaccncgttggcgtgtactggacaggaggaccgganaacaacgcacaaggctcgcatggctctcgcgantccgctttgggnccanttccaggntcacgatccccgcacatcgctcccccgaaagggggggcaattttngcctaaatnan

SEQ ID NO: 20055 - DNA, 454 bp, Triticum aestivum
  Clone ID: PAT_TA_20055
cactacaactgctcacgtacacgctcattatttgccaacatgtctttggtggcacgtcggagaaaacctgagcttgtgctaccggcacgagcaacgccgcgggagactctgcctctctccgacattgacgaccacaaagaactgcggtacctgcagcctgccgtcgagttcttccgcgccgtcgatggccatgggtggcctgccaaggcagttgtcagggcggccctcgcggaggcgctggtgcactactacccactcgcaggccgtctccgggaggcttccgggggaaggctagtcgtcgagtgcaccggggaaggtgtcgtgttggtggaggcggagtcggatgtgtccttggatgagctcggcgagcctccgctgctagcatgcccgttcgtggaagaactgttgtgcgacgtgggcgacgccagggttgtcatcggaagttccatgtttt

SEQ ID NO: 20056 - DNA, 1232 bp, Triticum aestivum
  unsure (1)..(1232): unsure at all n locations
  Clone ID: PAT_TA_20056
gcgcgcggccgccccgcctcgcctcgctgcaggtgtaccaccggacccgcacccgccacaccagtacagttaacccccaaatccagccgtcgcgagcatctccctccacctttccaccatggcggcctcggcggcgcgctccctcgcgctcttctcctccgccgcctcgctcggcctcgggcgcgcctcgtcccgcctcgcgctctcctcctccccttcccactcggggcttctcccccggccggcgctcgccttccgcgggcgcgcctcgttcgccgccacggccgtcgtgatggggaaggccggcgccgtcgacgccgaggcggacgcggggatggacgccgtccagcgccggctcatgttcgacgacgagtgcatattagtcgatgaacaggacaatgtcatcggccacgagtctaagtataactgccatctcatggaaaagatagaatcagggcatgcccttcacagagcgttcagtgtttttcttttcaactccaaatatgagttgttacttcagcaacggtctacgacaaaagtgacatttccacttgtctggacaaacacttgctgtagccaccctttacaccgtgaatctgagctcattgaggagaactgccaaggggtcagaaatgcagcacagaggaaactatttgacgaactgggaatacaggctgaagatttaccagttgaccaattcatcccactcgggaagatgctttacaaggctccatctgatggaaaatggggcgaacacgagctggactacctcctgttcatggttcgcgacgtgaagctcaacccaaaccccgaagaagtgtccgacgtcaagtacgtgaaccgtgacgagctgaagcagctgattaagaaagcagatgatggggaaggtggcatcaagctgtccccttggttcaggctggtggtggacaacttcctgatgggctggtgggatcatgttgagcaagggactctgaaggaggttgccgacatgaaaaccattcataagttgtagaatgtgtagagcgtcaagtaacgctgttgtcattcgatagagaaatgagcacagctgctgctgctgctgtaagtgcgcgtctttcatttcatttcttctttccttttgttcatggatgttgcttcctattgttgttgttgagaaattcgggtgcacattttgtaaaaaaagaaaaactttcaataaaganccnctgctcaacatccctaaaaaaaaaaaa

SEQ ID NO: 20057 - DNA, 545 bp, Triticum aestivum
  unsure (1)..(545): unsure at all n locations
  Clone ID: PAT_TA_20057
accacttcaccctcccctcccccgcaagcatacacctcagggaagcgcaaatccatggagttctacgttgacgagaagtggaagttctccaagaagagccggaacaacggcagctgcaggcgcgtctccagcggcggcggcggcggcggcgacccgttcctcaagaggtcggccagcacaagggaccaaggtgatcggccggcgggcgagcgccgccgcgtccgccccaaccgagcgggttgcgcggcgccttcgtttctcgacccgctgcccttgggctnggtgaaggggcgccggccgcccgccctctccatgccacggccccccgccttgcgcctccgctgcctccgtccgcgcgtggccatgggccgccccccgtcggccccgccggcctccccggcccgccccccccccggccgctttctccccccccggcccccccccccgcccgtctttctccccccgggttttaagnccacaagttacangaaagccaaaganaattngaaggatnntccgaagttanggcnggttaaaatttgggt

SEQ ID NO: 20058 - DNA, 714 bp, Triticum aestivum
  unsure (1)..(714): unsure at all n locations
  Clone ID: PAT_TA_20058
cacacaccaaaaccaaaactccagcacctcacacagaggcacatacacagagagagaactgcctcgaggtcccagcttggatccggagcctcccctcttggcggcgccggaagagaactccaatacagaataagcactcaaagcctcggggaatgctgaaagatgtgcttgcttagaagaaatttcacctgcgcgataaaggagattgcctcttctccacaggagctgagttggtcaactctttatgcgagcaaccatcttgtttgcgtcagctctacaccatctagactccgtcgagacaaagacatgagagtggtgttcattgtagtggatcaagactaccttggagaggatggttgaagtgccgcagtccatttgaattatagccacaatataggctgtggttttacgcagcttgaagtcatggcaaacagagggaagattctaatggagcggtacgagctgggaagattgttggggaaaggaacattcggcaaggtgcactatgcaaggagcctanagtcgaaccaaagcgtcgccataaagatgctggacaaggagaaggtgctcaagggtgggctctcggagcaaatcaggcgtgaggtgacaaccatgcgggtggtggcacacaagaacattgttcagcttcatgaggtgatggcgacacnaaacaaaatatactttggcatggagtatgtgaaangcggggagctc

SEQ ID NO: 20059 - DNA, 1195 bp, Triticum aestivum
  Clone ID: PAT_TA_20059
caaaactccagcacctcacacagaggcacagacacagagagagaactgcctcgaggtcccggcttggatccggagcctcccctcttggcggcgccggaagagaactccaacacagaacaagcactcaaagcctcggggaatgctgaaagatgtgcttgcttagaagaaatttcacctgcgcgataaaggagattgcctcttctccacaggagctgagttggtcgactctttatgcgagcaaccatcttgtttgcacccgctcttccgcccacgcgtccgcccacgcgtccgcccacgcgtccgtgttcatcgtagtggatcaagactaccttggagaggatggttgaagtgctgcagtccatttgaattatagccgcaatataggctgtggttttatgcaacttgaagtcatggcaaacagagggaagattctaatggagcggtacgagctgggaagattgttggggaaaggaacatttggcaaggtacactatgcaaggagcctagagtcgaaccgaagcgtcgccataaagatgctggacaaggagaaggtgctcaaggttgggctctcggagcaaatcaggcgtgaggtcacaaccatgcggttggtggcacacaagaacattgttcagcttcatgaggtcatggcgacacgaaacaaaatatactttgtcatggagtatgtgaaaggcggtgagctctttgacaaggttgcaaagagtggcaagctcacagagggtgctgcacataagtatttccagcagctcatcagtgcagtggattactgccacagccaaggcgtgtatcaccgggatctcaagctggagaacctgctcctggatgagaatgagaaccttaaggtctcggattttggattgagcgcactttcagagtcaaagaggcaagatggcttgctgcacaccacctgcggaacacccgcatatgtagctccggaggtcatcagcaagacaggttatgatggtgcgaaatcagatatctggtcttgtggtgttatcctttttgttcttgttgctggttatctccctttccatggttccaacttgatggacatgtaccggaagattgagcaaggagatttcaggtgccccaactggttctcacacaaactccagaagctcttgttcaagattctggaccccaatccaagcaccagggcatctatccagaagataaa

SEQ ID NO: 20060 - DNA, 630 bp, Triticum aestivum
  unsure (1)..(630): unsure at all n locations
  Clone ID: PAT_TA_20060
ctcgtgccgcgcgactttgtcaggctcacatcgcctagcctctccaagagcaatcagccatgacgatcgtggagatgcagatgaacatcgactgcgacggctgcgaggacaacgtgaggaaggcccttctcaggcttcaaggcgtgcactacgtggacgtggaccgagcgcgggacaaggtgacggtgaccggcacggcgagccagaagaaggtgctgcgcgcggcgcggcgcacggggaaagctcgccgtgctgtggccgtcggcgtacgacccggggtaccaccacgcccacgcctacgctcaacgcgcagccggcctactaccactcctaccaggccaagcccgccgccgcccacgcgcaccgctactacaacagcgtcccgcacggcgggtccccggccccgccgggcgctacggggcccccgccggcccgctccacctccacggccctgcgcccctctccacgccggaccccccaccgggggcctccacccgcctactcctaccggcgccccggggcctcatccaccctgccgactgtccccaaccggcctggcctccgtccacgttggcgccttgcctcccgtcccccggactcaccctcagggccttaactacccanttgaaa

SEQ ID NO: 20061 - DNA, 588 bp, Triticum aestivum
  Clone ID: PAT_TA_20061
cccgccccgtcgcacgccccctccccccacgctaaccctagccgccgcacccccgcctcccatctccgcccctcctctacccctgcaccaacgccgccgccccccttcatcaacgcctgcccgggtcccggcaccaagatctgttcccccgtgtcgccccaaatccccgagccgcctccaccaatccacaaaaggtcaagcccacaacctgagtccgcctccacgcaagatccaccgcataccgaggggaagcacgaatcaaatctttggccgaatgggtcgaggcagaaaggatccctggggcggtcgcgcggatccagtcgattcacgtggaggcaggaggaaccgtcgcacccggggatgggagggtggaggaggaggaggtaagtgctgaggaagaacaggagaggaatggagaccacgagggagggtggaagcggaggaggagggacggaggaggaggaagaggagtgggaacaggaggatgaggaggctgaggaggccgcgccgccggaggagccggaggccccgcgctcgccggccgagcgggcggagggattctacgagatcgagaccatccgccgccgc

SEQ ID NO: 20062 - DNA, 548 bp, Triticum aestivum
  unsure (1)..(548): unsure at all n locations
  Clone ID: PAT_TA_20062
gcctcgtgccgaattcggcacgaggcaattaagaaaggagcaaaggagactgatgttaagagagtagcaaagcagtacgtaggaagggaatggccggccgcggagaggagctgaagctgctgggcatgtgggcgagcccgttcgtggtgcgggtgcagatcgcgctccgcctcaagggcctcaagctacgagtacgtggaggaggacctgcagagcaagagcgaagctgctcctgaggtccaaccctgcccacgccggcaaggtgccggtgctcatccacaacggcaagcccgtctgcgagtcgtcggtcatcctgcggtacatcgacgaggccttctccggctccgggccctccctcctccccgccgacccctacggccgagccgtcgctctcttctgggcccgttttcgtcgacgacacggtgcgtccattcataggccccgctccctccccctcacatggccgcgcgctcctatataccgggttcgaaggcggcggttgaaagcccggcgcaggcgttggggaaaccttggaggggggttttnat

SEQ ID NO: 20063 - DNA, 626 bp, Triticum aestivum
  Clone ID: PAT_TA_20063
tccgggccgaccacgcgtccgatacatacagtgtggccatagtggtgaactgagaagagctacgagcatcgagcaaggcacgccggagatcgagatgggctgcgacgacaagtgcgggtgcgccgtgccgtgccccggcggcacgggctgcaggtgcacctcggcgaggagcggcgcggcggcgggggagcacacgacgtgcgggtgcggcgagcactgtgggtgcaacccgtgcgcgtgcgggcgcgaggggacgccgtccgggcgggcgaacaggagggccaactgctcctgcggcgcggcctgcaactgcgcttcatgcggctcggcgaccgcctgatcggtggccgacgcgtcgacgcgccactagtcgtgaactgatgcactagtagtagagctagctactgagttagccataaataagtgccgctgagccgtcatgagtcatatgtggacgtgtcgtgtgtatttacctacctactcgcatcagtgtgtaagaacgaataaatagtttatgtgtgctattttctcctttcctaaatgtacttgaagtcctttggcttgttacaaaaaaaaaaaaaaaaaaaaaaaaaaaaaaaaaaaaaaaaaaaaaaaaaaaaaaaaaa

SEQ ID NO: 20064 - DNA, 675 bp, Triticum aestivum
  Clone ID: PAT_TA_20064
gttccggccccgcgccctagtgcggagccgataggggcatagtggtgaacgcgagaagggcgaactgacaagagctactgcgagcaaggcacgccggagatcgagatgggctgcgacgacaagtgcgggtgcgccgtgccgtgccccggcggcacgggctgcaggtgcacctcggcgaggagcgacgcggcggcgggggagcacacgacgtgcgggtgcggcgagcactgtgggtgcaacccgtgcgcgtgcgggcgcgaggggacgccgtccgggcgggcgaacaggagggccaactgctcctgcggcgcggcctgcaactgcgcttcgtgcggctcgacgaccgcctgatcgatggccgacgcgtcgacgcgccactagtcgtgaactaatgcactagtagtagagctagctactgagttagccataaataagtgccgctgagccgtgatgagtcatatgtgggcgcgtcgtgtgtattgcctacccactcgcatcagtgtgtaagaacgaataaatagtttctgtgagttattttcttcgttcctaaacgtacttgaagtcctttggcttgttacaagttttacttattgcaaaataattatagttctacgattttcttaagaaaaatgaccaagtctaaacaaaaaaaatcaaaaaaaaaaaaaaaaaaaa

SEQ ID NO: 20065 - DNA, 373 bp, Triticum aestivum
  Clone ID: PAT_TA_20065
gagagctaaatgcctttgtatcagatgatgaagaaaacagatgattttgtttggagtgatgctgcgaactctacctttgaggatctgaagaaacagcttgctgagccaccggttcttgctgctccaattgagaaagagccgctattgttgtatgtagccgctaactcacgggctgttagtgtggcaatcgtggtggagcgcaaagaggttggcaatgaacagccagttcaatggccggtttattatgtgaatgaggtactgatcgaatctagacatagatatccacattggcagaagctcgtgtacggggtgttcatggcaagccggaagctcaagcactattttcagggtcacccgatcactgtggttagct

SEQ ID NO: 20066 - DNA, 478 bp, Triticum aestivum
  unsure (1)..(478): unsure at all n locations
  Clone ID: PAT_TA_20066
gttcattttgttttcagtttttgtagtcctccgtcggcctccctccggcgcgatggcggcacggggtcgccgcctccgcgcggggctctccgccgccctggcagttcccctgcacaccccgctgtcccccctccccggttcactgccatagcagtttggtgtgtgtgccaaacaagtcttgcaattccattacactctccctctggtaggagcctgcccagcctctgcttcatccacttgggggtgcaactccatcgccccaaagcctagctggagaggcgcgtgcgctcctttcggtccgcgctggcgtcccctccttcgtgcgcctcgccgcctgtccaccctcgctgctccgcgtggcgctaggctggtgttccctcttgtgcccgtggtcggcttggggggtggccatccgttccgtccgcccacgggggggcccgccggtcatttaatgatgtgagcatctagtcattanaaa

SEQ ID NO: 20067 - DNA, 960 bp, Triticum aestivum
  Clone ID: PAT_TA_20067
cccacgcgtccgctgcactacactggtgcggtacagaggaagcagcagaggagcaacgcacgaacgagctgccggcatggcgaggccgtccatctccctccacctctgcctggccgtcctggccatggccgccgccgcgtccgaggccgggttctacgaccagttcgacgtggtcggctccggcaacaacgtgcgcgtgaacgacgatggcctggcccagcaggtggcgctcacgctcgaccagggcaacggcggctccggcttcagctccaaggacaagtacctctacggagagttcagcgtccagatgaagctcatcgtcgacggcaactccgccggcacagtcacctccttctacctgacttccggcgagagcgcgaccccccacgagtccgacatcgagttcatgggcaactccagcggcgacccctacgtgatgaacaccaacgtgtgggccagcggcgacggcaagaaggagcaccagttctacctctggttcgacccctccgccgacttccacacctacaagatcgtctggaaccccaagaacatcatattccaggtggacgacgtgccggtgaggacgttcaagaagtacgacgacctgccgtacccctccagccggccgatgacggtgcacgccacgctctgggacggcagctactgggccacccgccacggcgacgtcaagatcgactggacccaggcgcccttcgtcgtcaactaccgcggctactcctccaacggctgcgtcagcaacggcggctcctcggcctgccccgccggcagcgacgcgtggatgaacacggagctcgacggcaaggccctcggcaccgtcgcctgggccgagagcaagtacatgtcctacgactactgcaccgacggctggcgcttcccaacggattccccgccgagtgcaaccgcaactgatccatagtttccattatgaattgatgattc

SEQ ID NO: 20068 - DNA, 1186 bp, Triticum aestivum
  Clone ID: PAT_TA_20068
gccggccgggctgcggcactggagttatactcgttccacagtccactccacttcccatttatccagctagccttcccacctcctccattccaagaagcagagcagagcagagtaaaaatggcgatgccgcgggccgtgtccttatcggtcgccgtgctcctggcgctcctggcgtcggcggagtcgtggctgtacgaggagttcaccacggacggcaacgtgcgcgccgactacaacgcgcaggggcagcaggtggcgtcgctcgtcctcacccagcagtccggcggcggcgccttcggctcccggcaaaagtacctctacggccagttcagcatccagatgaagctcgtccccggcaactccgccggcaccgtcacctccttctacctgtcgtcgggcgacggccccgggcacgacgagatcgacatggagttcatgggcaacgccacggggcagccggtggtgctcaacaccaacgtgtgggccaacggcgacggcaagaaggagcaccagttcgacctctggttcgacccggcggccgacttccacacctacaccatcatctggaacgacaagaacgtcctcttcaaggtggacgacctcttcatccgcagcttcaggcgctacgccgacctgccctacccgggcgccaagcccatgtccgtgcacgccacgctctgggacggcagctactgggccacgcagaagggcaaggtccccgtcgactggtcgggcgcgcccttcgtcgtctcctaccgcggctataccgccgacgcctgcgtgccaaacggcggggaaggcagcccgctctcctgccccgccggcaccgaccgctggatgaaccggcagctcgacgacgccgagcgcggcaccgtcgcctgggccaagcgcgactacatgcgctacaactactgcgacgacggctggcgattcccgcagggcttccccgccgagtgctcacgcggctgaagaacgccgccccccttctgcggattgttcgttatccattcatttcttgtttcttggtcttgggtcacatctagtgttcttgatttcgttaaccctctgtttattcttgcctagagggattagattaaacgataataagggtgaattcttcgagtaaatatcggaacacacagtgagtcccacagtgagaattgttcaaggaatttgctgttccggc

SEQ ID NO: 20069 - DNA, 1827 bp, Triticum aestivum
  unsure (1)..(1827): unsure at all n locations
  Clone ID: PAT_TA_20069
cggccgctcgggccggctctcgctccactccacttcccactagctagcctccaagaagcagagcagagcaccatgacgatgctgcgggctgtgtccgtcacggtgggcgtggccgtggcgctgctggcggcggccacggcggcggagtcgtggctgtacgaggagttcaccacggacggcaacgtgcgcgcggactacaacgcgcaggggcagcaggtggcgtcgctcatgctcacccagcagtccggcggcggcgccttcggctcccggcagaagtacctctacggcgagttcagcatccagatgaagctcgtccccggcaactccgccggcaccgtcacctccttctacctgtcgtcgggcgacggccccgggcacgacgagatcgacatggagttcatgggcgacccccctccgccccctccgccccctccggcgccctaaatcagaaggccaccaggagccacccgggcgcgcacgccgccggcggcgcgcccgcgcctccccctcgccctccgcgcccggccctccccgcccccgccgccgccggcccggcccggcggcgagaccccgcgtcgggggcgcggggggcgcggccccacccgggcccgcggcgcggcgccggcccccaggccggggcgctcgcccgggacgggcacgggggcagcccgctgccgccccccacgggaccgccaccgccccgcggctctcgcgccgaaccagcttcccgtcggcgccacccgcccgcccccggccgccccccccaccctgcgccccccggagggccccgggccgcgcgggacggcacgacagtcgactgcgaaccccaggggccagccctaggtgctgcacgcccacgtgtgggcccgcgccgacggcaggaaggagcaccagctccacctctggttcccccccccccgccttcctcacccacaacagcctctccggccccccaaacacgccatactccggcaggacgacctcttgctgggcacccacgaggcaggccgccacgccctggaaccgcggcgccaggccctaccggggcaggcaacgctctgggggacgcggcccactgggccacgcaaccaccgcgacctccagctacgacggggacccaggcgcccgtcgtcccgtccactaccgcgggctcctccgccggtggccgcgtcacggcaacggcggctacggcggcgccccccgcgggccgccgcggcgtggatgaacagagaactcggcggccagggcccacggcccccgccaccggcgccgagagcaacgtacacgtccaacgactactgcaccgacgccggggcccctccccaacccgctcccccgccgcgtacacccccaacggatcttatccttttcatcgattgttcctaattttcttttctttcacccttccttcctcgtctttgatccattttcttctttgtccgttccatgcaagaccgacttacgttactttcttaagttcatttttcaatgaacagttacccatggtatttgattgttacagtagttgttgtcggttagatgtttcagagagaattttggtggtttcttgtgggtttgacaaattggagaggaagagatacgagtgcacgtgtaatcaataggttatgtatgaacaaaccttaataaattatagagaatcgttgcaataaaaaaaaagtactcaaacagagtgaaaaaaaagaggctctgcgtggcactccgcggcgaactcttcccccgccggcctaaccccggggcgggggtgttttttcccccccccacgaaagaggatgtctctaagtgttatggacaattgnatgcatatga

SEQ ID NO: 20070 - DNA, 538 bp, Triticum aestivum
  unsure (1)..(538): unsure at all n locations
  Clone ID: PAT_TA_20070
gattctctccaccatagccagcgctccttggtcaggccgccccctccccttcgtcaccaccgtcggcgctccctggtcaggctgccctccccttcgtcaccagcgctggccgctctctcacaccccgtaggtcaaaggttgaatttttatctgccgctgatggtgctgctgggcgaggaagcgctggacgctggatccgcgtgcgccggcgctggatctgctccgtctggctccggcgaccttaccctgtggctccgggacaggaaggctaccccgacgacatacaacaactggactctatgcacagagaggaggatgaagacacccagccatgggatttttagcagcactcactcaagggaaaacgagacctcaacacgccaatgggatgcagccaagcctccaactcacaagcaactccacaattgatttgaggaacgaggaagaatgaagtttctctcaacggatggggcccgcaacccagccgaggggggcacacaatccaaagtaggctgaactgcaatgagtcntcaantgg

SEQ ID NO: 20071 - DNA, 834 bp, Triticum aestivum
  Clone ID: PAT_TA_20071
gcacgagggtgggcctcacccaggcacccagcccgcgtagttgaccggacgcggcgcgccccgtccgtccgtcgcccgtcgcctttcccctcctcccccaggccgcccacctcgctccaccaaccgcgctcctcgcccaccgcccggagcggagctcgccggggcgtcgccggcaccgcgcgcacctccgcggatcacgcaagatttctgcttcacgagtccaggaagaacaacactggcatcaagcaagtcatattcagcagggaacagcagcatcgttttgatctgccttttcgcaggatacttggccaattcatagtggaaacttcaacttgttcaaggcctctctgttcacagcagtacatcattttacatccttggaaattgtggagcgagcctacttgagaatgcaatgtagcaggagtcattagtttcagtaagtcggagacttgccctggagctgccatactcggctgcattggcctttgatagatggttttttctcagacatcctctctggcagtaaagcttgcacaaggacccaagctctttactacaaagacaattctccccatggatcccccgggcgttgtctcctctgaaaatgctgaatatgatttctctgatgtttttggttccagtccagtcgagacagcaacagaactttgtgttgttgatcctgacagccctgcagctcccgttgagtcccctgaggaggtttataatgatcctgcggtcatcttcaagcggtcacattctcttgttggtccatcatcacttgttagctgctctttgggacttggcaagctcactctaaacatagcagatggatca

SEQ ID NO: 20072 - DNA, 1160 bp, Triticum aestivum
  Clone ID: PAT_TA_20072
gaattcggcacgagatcaattttgttgctgcgctcagccaacctcctcccccgtcgtggctagcgaaccacctcccattccaactccggccatctccacgacgcatagcgagcgcgttgctctgttgcagacctctcccgcagcgccgcggaccccacggggcggctggaggtgctgggcgcgctgggccgcccgtgctgtctgctgtgaagcgcatcgggagttgttggacctccagcggccgtgctgcgacgagccacagcatcgaccaaagctgcggcggggttgcatcaggatcccacgcgtccgctccccaccttatctcttcgcctcctctcgaatcatctatctctctcgtcaattccccacgagctagcccctggttctccatggccgccatcaattttgttgctgctactaagctttttgctggaaccattattaagttttgctggaaccggcaatcttttggcttcaaatgattactgaaagtttttgttgctttagattttttgctggaaccattgttcaattttgctggaaccggcaaatctttttgcttcaaccgattaccgaaagcttttgttactttagattttttgctggaaccgtcattcatttttgctggaaccagtaaatgtttttgcttcaacctttaccaaagttttttttttcttttagatttttgctggaaccactactaaaatttgctggaaccaccaaatcattttgcttcaaccaagtactcgaggtttttgtggtggcattcatggtgagcggaggcagccgaggcgagcgcggtggcatgtgtggccggcgatgacagcggtaccatggctgcaacggcgacgacggaaaagctgctactagcgacctattttttgctgcgactaacaggaaatttgctaccagcggggatggagagagctgatgtgaacgggactgccggagggctgcgacggtggagatggtggccagaggtgctggaagacggagacacttgcagccggcgcaatagttgatgcgtgtgggctgcatctggtctgcgatcctcttttgtcgggggtatctgaacttctgaagaccagcgcgtggacgatgacggcgacgtatctaacgactgacaaaactctagtctaatttaatcagtcgggtgctag

SEQ ID NO: 20073 - DNA, 644 bp, Triticum aestivum
  Clone ID: PAT_TA_20073
gtcgtccaggtctctcctctatctccgccttcaccgtcccctccccacagcccaccccgcagacagttgggtggccgcgccggcgccgcccatggccgcaccacccgcgcgtgtgccgcttcttcgtgcacccagccggcccttccccgcctcccagatcaacccccgccgtcacttccggccgtcggtgtcggtcgccgtaggaggcgtgggcggccccgtgctccgcacctgcaagaattgcaagaagcagtacgacccggctgcgaatcacccttcgtcatgccgctaccacacggcccactttggaggggaaacaaagagaaaatttgaaagtgtccattctgggtgggaccatggatacgccgggtgcaggcaaagtgctccactactgggcattgttgtgggtcacgaggatccatttgatgttggttgtactgctgctcctcactcttcatacgatgactaaacacctggatcgttatctgtcaattgtgctcttgtgattctactttttttcccacaatgaatagtgggcccctccttgtgtttttttccttgtgtcttgagtggcagcatctgccaacatgatttcttcttctttagctttcttacattatctggaaactgaatgttccatatgt

SEQ ID NO: 20074 - DNA, 652 bp, Triticum aestivum
  unsure (1)..(652): unsure at all n locations
  Clone ID: PAT_TA_20074
gcacttgcccaacccaagcaacgaaggaagctacctcgcccgtggagtagctagggagcacacggcgacccagttgctgctatcttgctccgtggagaagcgagggaaagggagggaggcctgcaaagccgcggcaaccgccgagaagcctgggcgaggagagatttgacgggcgagaggcgagggcgtggagctgctcgagcaggcatgctgatactgggagctgggggcgtgcatcatcccaatgacgctcatcttccgtgccgctccggcggctcgtcctgctggtggccaagctgcaggagctggaggaatgcttcatgccccccaaaggccgccgccccccgcacatgtccgcccgagatgtacgggcacatntccaccctccacaccatggccatcaatggtgtgaacggtggagggccgggccgcgcgcggcggtcccgcccccccccccctcccccgcgccccgccgcctggcggcccggggtcgcccccccctcggggggttggtgcctccccacctgccccactggggtgccctttctatggttcgctgtcgccctctctctgtgccatactccccccctcctgccgccccccccccccgncaaggttcaatttccgntcaaggaaaanttttttttttttt

SEQ ID NO: 20075 - DNA, 649 bp, Triticum aestivum
  unsure (1)..(649): unsure at all n locations
  Clone ID: PAT_TA_20075
gccgaccaccgcctcggtgcgctcaaggcgttcgacgacaccaaggccggcgtcaagggcctcgtcgacgccggagcgacggccgtccccgccatcttccaccacgcgcccgaatccctcaacgacgcgccgcatcaccatgaccatcagttcgccatcccggtcatcgaccttgccggcctcgcgacaccgtccgggcgagcatcggcggtcggtgccgtgaaggcggccgcggagacggtaggcttcttccaagtggtgaaccacggcgtggccggagggaggccatgtcggcgatgctcgcggcgcttgcggtgcttcatcgangagccggcggtgggcaaaggcgccgttactacaaccgtgaacaccggcggcgcgttaggtaacaagacaacttcgtacctgttccaatccccgggcgggcaactggcgccgcaccccccgttcttggatacgggacccccgccccccggggccccccggggatcccccccccccctgcatggcaaggccccccacgctggggcaagggtggcccgttccgggagggctgggcgctggtcgggctgttgtcggacccgcctgggccccccggaaggnaacctnaagangaccccctttctnaaangggngtaacccccctgca

SEQ ID NO: 20076 - DNA, 1279 bp, Triticum aestivum
  Clone ID: PAT_TA_20076
acgctaaactttcctgtagcgcccaaagaatcatgtactaacatacacgacccgctctccatagccagcaagccgtgcagcaacagttgatcggtgcccggccagcatgagcaagctcgactactgcttcagcaatgactacatggtgctgcgcccggacaggaccagcccgttcgacctcctgcacctcctcttctcgcccaaggtcggacggaacaaggccgtcgactgcttcaccagcaccgagatccgcagcttcccccgccggctcgccctcttcctcaacctcctcctgcagatcctcctcctctcgctcgccggccccgtggccgccatcggcgccgccgtcgagctcgcgctcaacctcgtcgacaacgtcctccacgggaagatggagtatccggacagatcgtcggcgtcgtaccggtcgctgacggggctcatcgaccggcgagtcgatctggacaggagcatcgcgccggcggacagccggcaccacgccgcgctgtgcgtcatggcatccaaggtggcgtacgagaacgaggccttcatccgcgacgtggtcacccgccgctggcagatggagttcgtcaagttctacaactgctggaacgagttcgagagcgcgtacacggcgcaggcgttcgtgttctgcgacaaggcggggccggacgcggagctggtggtggtggcgttccgggggacgccggcgttcgacgcggcgcggtggcgcgccgacctggacccgtcgtggtacaaggtgccgcggctcgggcgcgcgcacgccgcctacacgcacgcgctgggcgcgcagcgcaacatggggtggcccaagtgggtggagcacgtcaagggcaaaccccagaaggtgtacgcgtactacaccatccgcgacgccgtgaaggggctcctggaggcgagcccgaaggcgaggctactggtgaccgggcacgggagcggcggcgcgctggcggtgctgttcgcgacggtcatggcgtaccacagggagaaggccgtgatggaccggctggccggggtgtacacgttcgggcagccgcaggtcggcgacgccatgctcgccatgttcgcggagcggaacctcgacaggcccaagaagcggcacttccggttcacctacgccggcgacccgctgccgcggctgcccggcgtgggctcccccgcgcatttcctgcatttcgggctatgcctccacttcgacgtctcctaccacctcaaggtgatcattgagcttcacttctcgaaattaaccgcgctcacc

SEQ ID NO: 20077 - DNA, 870 bp, Triticum aestivum
  Clone ID: PAT_TA_20077
tgagaacctaaataaaatacaaaacggaagggctctccatactcttttcaggcactaatgcagcaagaaattattgagttcattggtgttgaagaggaggaagatatacaatgtgcctggggaatcaggcacctattccagagtagtggagaggaggtttctggttatactcactgtgagctggatctttcttttctgttgggattaagctgtggtcttatcccttttgcaaatcataattttgctcgaagggtgctgtaccaagcagaaaaacactcacagcaagctattggatactccacaacaaatccacttaccagagttgatactctttctcatcagctttactaccctcagagaccccttttcaaaacagtttcagctgattgcatcggcagatcagattatacttttggaagaaaagatgacttttgggggcctgaatatttcaatggacaaaatgcgatagtggcagtcaatattcatcagggatttaaccaagaggactccctggttatgaatagagcttctcttgaacgtggtatgtttagaactgagctcatgcggagctataaggcagaagtagagaccaaagggcccagcaaacgactgaaaatgaaggagaaagtaaacttcggcaaaatggaaagcaagagaggacgagttgacaatcttgatgatgatggattaccttttgtgggttcaagtcttcagattggtgacattataattgggaaagtgtcagaatctggtgaggaccatagtattaagctgaagcatacagaaaagggaatggtccagagagtgttgctctcagccaatgatgaagggaagcattttgctgttgtattcttaagacaggttcgatca

SEQ ID NO: 20078 - DNA, 699 bp, Triticum aestivum
  unsure (1)..(699): unsure at all n locations
  Clone ID: PAT_TA_20078
tgggcagtttatgttggtaggtcaagtcgcagngattggtccccccgtgccgtcttcggcggcgtcctccgcgggggtgcctcttcatgggccctgtgtgcggcctgtctcccgcctctgggtcgatgccgccctgtcccccgatgcccgcctctggcttcgccttggctcgccttcgtggcgctgatattcaagttcatggttaacggcagccttgacagatggttacattctgagcaacacaatggaatcccaggcagagtgctaaactttggccagaggatatgcatagcggcagatgtggcttctgctcttgattatgtccacaaccaactgacgcctcctctgatccattgtgatttgaagccagcgaacatccttttggacgatgacatgaccgcgcggctcagtgatttcggctcagcaaagtttttgtcgctggatatgtttattcctgaaagcctggatgatgttggaggaacagttggatacatggcacccgagtacgggaccggttacgagatctctgtaggagctgatgcatatagttttggagtgcttctgctggagttgcttaccggaaaacgaccaactgatgatatgtttgttgatggacttacccttcccattttctctgaatccatgttccctgaaagantcgcggagattctagatcctcgaatgggacatgnnnagcan

SEQ ID NO: 20079 - DNA, 950 bp, Triticum aestivum
  Clone ID: PAT_TA_20079
ggaccggaatcggaaggcccggcccgacccacgcgtccgcgccgagggcccctgctgtccaggggccggtcccctttcatttcctccgcacccacctgcccggcggggatggctgctccctccgccgccctctccatctccggtggggcgcataccagtgcatttggctgcaagccaaagaagttgatctcaaacagaaattacttgcagctagcagctccctcaaattcccaaaatgcaaatctttatgggaagttgaccgtctgcagagcagaaagtgaagattctaaaggcgggggaggattcttgactggatttctcatagggggagcagtctttggaacgctgggttatgtctttgctcctcagatcagcaaaactttagatacattgctgaatgacgatgggcaagatggtaagcctgacgagcaaggcgtccaaagtgtaccaaggccacgtaatgctcaatactatgatgaaggtttagagaaaactcgtcagacactgggtgacaagataagccaactgaaccttgcaattgacaaagctgccgcccgattgaagcgtgtcaccggcagtgtcgaaaaagaggctgttaaagatgaaaccgaaattgaaatatcaacactggatgataatggagttttggagggaaacttgagtgaacagggttttgtgcaaggagaaagtgcattatattttctgtattcaatctgtattgctgtagttctgtatgctctgtcatcgccatcagctccaaaaactttcatgaaaattgtgtaatttagaactcgcgatctaaatagctgagtggcatacgatttctcaatctgttgtgtactaagtaacatttctttgcaaacaaagtgctttggcttaagtactctcaaacgtacaagttaatgtaaaggctcttcaaataaatactagtaaaaacaatttttacataa

SEQ ID NO: 20080 - DNA, 432 bp, Triticum aestivum
  unsure (1)..(432): unsure at all n locations
  Clone ID: PAT_TA_20080
cggaggttcggcctacgacctcacgcgtacggagaccgtgaagatggtgtactccatgaacatcagcgcgctcctcgacccgccgctgccggcggggtactggggcaacgtgtgcgtgccggtgtacgtggcgctcgccgcgggcgacctcgtcgggcggccgcttgcggagacggcatccctggtcaggaagagcaagcggggggtggacgaggagtacgtgcggtcgtacgtcgacctgcaggagctgcggcgcggggagggcggcgtcacggcggggcggcgcggcgtgagcgcgttcacggactggcggcggctggggcactcggaggtggacttcgggtggggcgggcccgacgccgtgctgccgttctcgtggcgtctgctcgggagcacgcagccgtgctttctgctgccctacngcgccgggga

SEQ ID NO: 20081 - DNA, 1340 bp, Triticum aestivum
  Clone ID: PAT_TA_20081
tcgaccccgcgtccggttcgtcatagaacccccctgctcgatccccatacaccccagcggcagctagggttcctagccgccgcccctccaccgccgcgcgccaagccgcctcccccccgcgacctcctcctccgccaccgctcgccggacctcctccctccgcctccccgcctcaacaactcgcgtggaccactgaaccagcaagggcagccgccggcgacgcctcccgctgccccgccgccccgccgcgacctcctccctccgctctccaagaacaacctagaacggcagcagcgaaggcgatggcgagggaggacaggaagcggaggcagcctgacggcgatgaggcggcggacgagggcgagaggcgggggcggagggacaagaggcccaaggaggagaagccggcgccgccgctgccctcggagatcaggaacaaggagaagcgcagcgaggtgtacgccaagctcaagcgcgagaagaaggcccagaagcgcaggctcggccgcgagcgcggccaggccgcccagcgtgccgccgagcttggcgaggaggtgccggagaagcaggtcccccggacgatcgagaacaccagggagcctgacgagaccgtctgccgtcctgacgaccaggagctgtttgcagggaatgatgctgatgaattcaatgcagtgcttaaacaagtagtaaccccgaaagtattgattaccacatgccgcttcaattcaagggaaggggacctgcttttattaaggagttaatgcaagtgattccaaatgctcaatatgttaatagaggaacttatgacctcaagaaaattgtggaatatgcaaataacagagagttcacttcagtcatggttgtccacacaaatcgacgggaacctgatgcgctgctgatcatcaacctacctgagggccctactgcacattttaagctatccaagctcgttctgcggaaggatataaagaaccatgggaaccctacaagtcataagccagagttggtgttgaacaattttactacgcgccttggtcatcgtgttgggaggatgatacaatctcttttccctcaagacccaaatttccgtggccgccgagttgtgaccttccacaatcagcgagactatatatttttccgtcatcacaggtacatctttgaggagaaagaaaagaaaatcgtttcaaaggacaagaaatcgaagggtgaaacgaaaactgagaagcaaataaactgccgccttcaggaatgcggccctcggttcaccctgaagctgctcacattgcaacacgggaccttcgacaccaaaagcggggagtacctcggccgcgaccacgcta

SEQ ID NO: 20082 - DNA, 634 bp, Triticum aestivum
  unsure (1)..(634): unsure at all n locations
  Clone ID: PAT_TA_20082
tgtgctgctagctagtctgctactgctagtggctagctacctctcggccacggccatggcgggcggcaagaagctgcaggagagggtcgccctgggcaggagtgcgtggatgctggccgacttcgtgatcctcttcctcctcctcgccctcgtggcccgccgcgccgcgtcgctcggggagcgcggcgggacgtggctggcagcgctcgtctgcgaggcgtggttcgccttcgtgtggatcctcaacatgaacggcaagtggagccccgtccggttcgacacctaccccgagaacctctcccacaggtacgtacgttcttgtgcacactaactgcaaaataatgttgacctacagcttcgtgcaacttcttccttaaactgtgtcgtgtctgtgatgattttgctaggatggaggagctccaacggtgggacatgttcgtcacgacggcgggacccggcgctggagccgcccgtttgatcacggtgaaaaacggggctctcgctgntccccctggactaacccgcaacgtccggnaaagcttggggtngctacntctcccnangaacgggtnnccccccctttaagttgncaacggtcttgnangaagggcncccaattttccnaaccccctgg

SEQ ID NO: 20083 - DNA, 657 bp, Triticum aestivum
  unsure (1)..(657): unsure at all n locations
  Clone ID: PAT_TA_20083
gccggccggttgggtttggttggttggncgcactcgcactccctcctctccatccatcgccaccaccaccttatcatcttccccatcatcgtcatcctcagttcctcacaacacccactcaacgccggcgtcgtcttcactgccgtcgccgctcgacatggccaccactcatagaggcggagaagacgagcgtcgtcgaggccgtggaggaggcttccccggcggcggctgcggcgccggcggaggagaagaccagcgtcaaggcccgtgcaggagccttccccggcggctgccccgcccccgggggggtagacaagcgttagcgccgagcgggcccctgccccggcgcctgcccccgccgggggccagcggcccccgccggccgctccggcggcccgcccggccgggcctccgggcggcccctccggcgcctcaacatgatgaacttgctcaacgacccgagcatcaaggaatggcggagcaaatngccaaggaccgtcttnacganatgcggacaactgcagaagacgtggcgccggngcngngcgtcccgcaagagtggcggcgcctggaccgcanaatactgtcgacatcacancnatgaagaccgcattctngcatgcggacggntggaaccnctatcagaccgcattctcg

SEQ ID NO: 20084 - DNA, 763 bp, Triticum aestivum
  unsure (1)..(763): unsure at all n locations
  Clone ID: PAT_TA_20084
tggaagagataattaaattaattaggccttgaacttctactttcgtttagaatttaggcattatttttccccttgcttccgaaaaaagagtcaagaaacactaatggcaacccttcgagtcgacgaaattcataaaattctccgcgaacgtattgaacaatataataggaaagtagggattgagaatataggtcgcgtagttcaagtgggggatgggattgctcgtattataggtcttggtgaaataatgtcaggtgaattagtcgaatttgcagaaggtactaggggtattgctctgaatttggaatccaaaaatgttgggattgtattaatgggcgatgggttgatgatacaagagggaagttttgtaaaagcaacaggaagaattgctcagatacccgtgagtgaggcttacttgggtcgtgttgtaaatgctctgggctaaacctattgatgggaaaggcgaaattatagcttccgaatctcgcttaattgcctcgcccgctccaagtataatttcaggcggttccgttntaccaancctccttcaaacnaggggcttaattggctaatccaattccgaatnatcccctaatagggggcgccgggtcaagccannaagtttnatttatttggggnaacaaacccaaggcaactgnancggttcccccctaaatgatttttgggncaaaaaatcaataaagntaaanggggggataccanatncctngtcaanaannatttaaaatnggnttncccaaag

SEQ ID NO: 20085 - DNA, 685 bp, Triticum aestivum
  Clone ID: PAT_TA_20085
cgcggcctcccagttcttggcctccgtcgggtggctagaccacgccacatagaagacgagggttatgtcagttaggggcctcggcaacgacgacgagaatggccaggtcgaaatcacaggtgcgtgacggctggagacggccgcagggtccagagatggggcgcacggcggatgtgttctacttcccattgagagaattctggtgggtttctctaatagtatgccaaactaactaacaattgtagttaactataccgcagcggcgcacttcttattttgggattaagcctaatgcttgctctaccaatcaagtagtactgttgtgaactcataggtaaaaccattctctatccaatacagtgttagcatagctgagcgtgattaggagggcatgattattactttggattgctttacgtagattggcatggctgatcttcccttccattattattgctactttatgttttaattccatttttctttacttgttcggatccatgttccagtgacttcctgaacttttacttgttgatgggaagtttctattttaatttttctttcactttatcttcaggtttacagggttaatggatccatgtttgagtttatagaagtgtgtttacttatctagctttctgttttcattcctgtttgaaatccatcgacattttccaaaattccc

SEQ ID NO: 20086 - DNA, 590 bp, Triticum aestivum
  unsure (1)..(590): unsure at all n locations
  Clone ID: PAT_TA_20086
accaaacccgaccgcgcctccgcccccccctcccgcagccgcagcagcagcagcagccgccgccgcctgcgcgccctatctacagctcctcccccaatccctggccctgcccggccactccagcgcccaatgcagcagcccaaacccgccgatccgccgggccgccccttcccgccgccttccccgtcgatggcggcggcggccacggccatgcgcggggcgcaccaccgccgcgccagatctgaggtcgccttccgcctcccggacgacctcgacatcggcggtggcgccgacggcgacggctccgcgggcttcgacgagatcggctccgaggacgacctcttctccacattcatggacatcgagaagatctcctccggccccgccgcgggctcagaccgcgaccgcgaccgcgccgctgagacctcctccccgccgcgccccaaagcaccgctacagcagctccgtcgacggctccggcctcttctccgctgccggcagccctgcgcggaggggcgccggtgccgcccaagcgctggccgatgtcctggannnnnagnnnnnatgtcccccgagcagctcgccgagnn

SEQ ID NO: 20087 - DNA, 427 bp, Triticum aestivum
  unsure (1)..(427): unsure at all n locations
  Clone ID: PAT_TA_20087
ccacgcgtccggaaccagttcttggcgaagctcaacgggtgaagctcaccttatgatggccgcgccccggcccgggtacagtgtagagtaaattggaactgaattggtctgtctagtaggctcacatgttttttgtttttcgccagccttggagatctttcttgttttagttttcatacctagagaaaaaaaagagaagaagatcgcaagatctcggacaagatggctaacaagcaaccagttataggtgattgagatggagatatctcaattcttttgccgcttttgctaggagagggggctagatggatgggccacaagagcccgtgaagttttggggagttttgtgtacccgccccggcggctatgatccaagagtgtagctcctttgaaattcagaatccaattgtcatttttcactgctgnn

SEQ ID NO: 20088 - DNA, 833 bp, Triticum aestivum
  Clone ID: PAT_TA_20088
gttatggagcatgagaagctcactgaatcttgtaggctcaacactagatgtcctcgcggccgactggattgaatattcgtcaggcattggtgctggagttgattcattttacgagtatttgattaaggcatatgtcctttttggaagtgatgagtactgggatatgtttcactctgcttacctagcagtgcagaagtatttccgacacgggccatggtaccatgaggccgatatcaggactgggagaagcaacacactggcaactaactagcctccaggccttctggcctggtgttcagacactactaggagatgttgctgctgcaaatctgtcacatcgtgaattttacaatgtatggcaaaggttcggcgtccttcctgaaagatatctgttagactacggaattttgcatcctacagagaagtactatcctttacgtccagagtttgctgagtctacattttatctttatcaagcaactaaagatccttggtacctagaagtgggtgaagctataattggatcacttaattactacaccaaagtgggagccggttttgctagtgtccgtcatgtttcaacaatgaaccttgaagatcatcaacacagcttctttctttcagaaacgtgcaaatatctttttctcctttacgacgattcattcttgaggaacaaaaattacatctttacaacagagggccatccccttccagtaatgagcacgtggcacgagaaaattcctcgactggatgttcccaccaattggacagttcttaaggacgacaaccaaccgattcgtgtgagcgcattgtcatccaaagtctgtccggag

SEQ ID NO: 20089 - DNA, 398 bp, Triticum aestivum
  Clone ID: PAT_TA_20089
gcacctcttgacgcccgactgcgacaaagttaacgcgccgtgatgctcgtgtggatgtgcccgcttattatcgtgccggcagctttgtgtgtcgcgggggcgatccctactgaaataaatggattgcgataaatgatgaaataaatttggttggataattttgcggagtgtcttatcatacctcgcgtgctctcgcctattatgctttggttaaattttttccttttcacgataatacgtttctcatttatatcataagcgtcgtagtacaagtcacgtatacatccacctaataaaactgaaaaaactgcagaacactagtttttaggtaaaggaagaccagccaattacaatcaagactgaaaaaaacatctaagcttgacaccaatgctggggcc

SEQ ID NO: 20090 - DNA, 726 bp, Triticum aestivum
  unsure (1)..(726): unsure at all n locations
  Clone ID: PAT_TA_20090
cacaaagctccacccgacccaccacccgcaaatcctaaccctaacgctcctggccatcaccgcggccgccatggtgagcgaagccgccaacgccggcatcgaccgcgtgctgtggacggaggccgagatcgccacgccgcgcgcccgggtcgcctcggagctcgccgccgacatccgccggctcgcggagccggctgtcgtcgtgggcgtcgccacgggggcgttcctcttcctcgctgacctggtgcggcgcgtcgacgtgccgctcgccgtcgacctcgtgcgcgtcgagtcgtatggcgacggcaccgagtccagcggccggccccgggtcaccgctgacctcaaggtcgacgtcgccgggaagcacgtcgtggtggttgaagatattgtggacacagggaatactgtttcctgtctcattgcccatttacaaaagaaaggagcactgtccatatcagtttgcactttcctggacaaaccagcaaggaggacggccgttttccagcgagtggggnnnnngaaaattttacagaggcttcgagtgccccgacagctttgttgttggctatggtatggattatgcggagctctaccgcaacctgccctatgttggagttctcaagcctgagatgtacagtaagaaaactgacaactannccggaagcagacnngacttgcaaccccttttgcaagagcacataaattttgaagaaacannacann

SEQ ID NO: 20091 - DNA, 884 bp, Triticum aestivum
  Clone ID: PAT_TA_20091
gatgcctccccgcccgcagctgccctccgcctcgcctccccgcgcgctcggccctctcccctcctcggcccgacctccccgccgagcgcctcacctttggactcatcggcccggctctccgactgttgtgccttccctcccggacagcagccgggtctccatctctggtcgcgacgcacagggccatgcacgagctggagtcgtgcgacggttgcggctcgatatacgaatccggcgcgttccggccttgcctgccgctgggaggcgttggacggagcggagtgcaggttcgtccatggcctgggttacgcagctgccccgccccagcacggccgggatgccctcgccggccatctctttgtcgtgctcgagtggaggttctccaggtctttggctgagccgtgggctagcaaggttccaagacccctctatgctctctattgtccctctttttgtttcctctgtcgcacaaccctcgcgtgtcactgacgtgccgcgacgcctcaccccaagagagcacgccgacggcctatcgtcctctgacagttccgcgtcgggagaaactggacgtggaggcggcggagggcgcggacggctgcgctgccggtgaagcgggggggtaggaccccgcccccgtggtaggccatcgcgccgccgggaaaggagaggcaagtcgttgattggctcgtgcaagagctggcagggcgataaatgcagcctcggattggagcgaggaattgtaccagctggagatttttttaggtgattcctgtagaacattcgggttgattttggcaaaccgcgggggctttttgcaaaaaagcatgacgaacgaccaaaacacaatttgctttattattaggtaaagatatagatttatgtgc

SEQ ID NO: 20092 - DNA, 607 bp, Triticum aestivum
  unsure (1)..(607): unsure at all n locations
  Clone ID: PAT_TA_20092
ccacgcgtccgaggaaagcacagaattctggaaaactggtctagcatcagattttatatggtctgaggcccagacaccactagagtttcttggttcctttttgacaatttcatgtgacgatccagcatctctgcctatcaagaatcatgagcttactacagatgaggtagtggagtattgcctgcctagcttctcttctgtcttagttatgaccctggttgcttgtacctttgctgtctagcagataaaacaactctgtgaatatttgtttgtgctacgtgaaaatggctacaatcatctcttggagtaagtatctttcttcagttccttttctatcttgtaatttacttctagattatgattatccaaacatgtctattagttacgcgtccacagaaattggtcctgtcaacctcatacaaaattgatttacaatgttagatggcgcatgcgcgtaaggaaagcactgtcatcatgttcacaggtgacaccaaggactgatgggactgcgacggacaacaagggcagagaaggtgaccaagttttacatgaagtggaagatttgaagaatgtttttgatagaaagagaatgagagtgaagtgtnnn

SEQ ID NO: 20093 - DNA, 823 bp, Triticum aestivum
  unsure (1)..(823): unsure at all n locations
  Clone ID: PAT_TA_20093
ccacgcgtccggtcagacatggagcagatactgaaggaggctcaaacccgatggttacgccctactgagatttgcgaaatacttaagaattacaggaattttcatatagctccagagccaccaaatatgcctgcaagtggttcacttttcttgtttgatcggaaggtattgagattgtttnnnnaggatggtcataattggaggaagaaaaagaatggaacgactgtcaaagaagcccatgaaagattaacatctggaagcatcgatgtgcttcattgctactatgctcatggggaagataatataaacttccagaggaggagctattggatgctggaggaggactatatgcacattgtccttgtacattatctcgaagtcaagcttccaagtggtaatgatggtacgagtactgaatgtcttcagcttccaagtgctattgatggcacaactactgaatttcagcttccaagtgctactgatagtacatttgctacagtggacagttttgaacaaaacaataaacttttgggggaagccattaatttccccgtcctgaaaactcaatcatctaatctttctgatatgctgaaggacagctttaagagaagtgatagttttgctagatggatgagcaaagaacttgctgaagtagatgattcccaagttaagtccagttctggattgtaccggaacagtgaagatgctgacaatatcattggagcatcgaggcatgatcagttggattggtttactctggacccaatggttgcacaagatcagctgtttagtataactgaattttttccaagctggacatatg

SEQ ID NO: 20094 - DNA, 1258 bp, Triticum aestivum
  Clone ID: PAT_TA_20094
gttaagcctcctccgagcccgacacgagcgtagtcgcagcacccgccgcaacggacccaccggcggcgccgcacgcgggctaccccaaaaccaccggatagccaatccctcggcgggccacgagcgcgagagaagcagcggcagcgatggagccggagggggtgcggcaccggatggtggaggtggccaagggggtggggctgcacgtggcggagggggggcccgaggacggacccgtggtgctgctcgtgcacggcttcgcggacctctggtacggctggcgccaccagatggtcgccctggcgggccggggcttccgcgccgtcgcgcccgacatgcgcggctaggtcgacgtccgacggcccgccctccgcgggctcctactccatctgccgcctcgtcggcgacctcgtcgccctcgtcgcctacctcgctcagccccaggtgttcgtggttgggcacgactggggcgcactcgtggcatggcagctctgcctgctccgcccggaccttgtgcgggcgctggttagcatcagcgtggcctaccacccgcgcagctccgaggggagcccgctccaggtcatcagggccttgtgcggggaagaccactacatgtgccgtttccaggagcctggagtcgctgaagctgaatttgctctatacgacaatagtcataagtttaagacggtctttggaatgcgcaaaccagctcctcctattctacccaaggacaagaccttctttgactcactagattcggatggtacttgccctccatggttgtctgaagaagatatttcctactatgcagacaaatttgagaagacagggtttacaggagggcttaactactacagatgcatggacttgaattgggagctttctgcaccatggactggagctccaataaaaatagcaacaaaattcatcgttggggaccttgacgttacatacagtgtaccgggggtgaaagactacattcacaagggtggcttgaaagcgagcgtgccgaatctggaggatgtggttgttatggagggagtgagtcacttctgcaaccaggagaagcctaatgaggtttcagattacatctgcgagttcttcagcaagttctgattatcaagagagtctcggcgaaccgacttgttttggtgctgtttatgtacttataagttgtcgattacacatgccatgatactgaattttctctaaataaaaccatggtctgattgtcacagaagaatttctgaaaaaaaaa

SEQ ID NO: 20095 - DNA, 1614 bp, Triticum aestivum
  Clone ID: PAT_TA_20095
cggacgcgtgggttcgtgcttccgcctccgcttctcgccttctccgcccataatctttctcggtctaagaaggattccaccggacaaggcacagcgggaggatctcgaagggagaatacgggggagaaaaatgttgcttggagctaagtgataccgtcatataacgctaacacttatgtgtaaaatggaggatcatcctggccatcctatttccaactatgatttcttgtcagggaatggctgttcatacgaatgaaattagttcataagaactacgaccgggactcctcatcagccaagtctggccggttcacaacaagaaatcatctgcaacaagtgacagtcatctaaatgagcaagacacctcaagaccctcatcacaatctgataatgacaatgatcatgggaagcccgatcagcacatggtaaagccgcttttatctttggggaacccagagactgttgctcccccaccaatgcttgattgtagccaatcatttgcatatattccttatactgctgatgcttatgctgggatctttccaggatatgcctcgcacgctattgttcatccccaattaaatgctgcaacaaactctcgtgtgccgctccctgttgagcctgcagcagaagagccaatgtttgttaatgcatagcagtactatgcaattcttaggaggaggcagatacgtgctaaactggaggcccaaaataagctggtgaaagcccggaagccataccttcatgaatctcggcaccgccatgccatgaagcgagctcgtggaacaggagggcggttcctcaacacaaaacaactcgaggagcagaagcagaagcaggcttcaggtggtgcaagctgtacaaaggtccttggcaagaatacactccttcaggatagccctgccttcgcaccttcggcatcagctcccgccaacgtgtcaagcttttcaacaatcagcatgctggctaatcaggagcgcacctgcttcccctcggctggcttccgcccctccggtggagcccggccttcgcaccttcggcatcagctccctccaacatgtcaagcttttcaacaaccggcatggtggctaatcaggagcgcacctgcttcccctcggttggcttccgtcccacgtttagcttcagtgcactgaatggcaacgggaagctggccccaaacggcatgcaccagcgcgcttccatgatgaggtaaagcaaagcaccctctggtgcgctgccggtggcaattcatccttggcttatgaagatgttccggaaatgtggttgcaatatcagctggaccaagacatggttattagtccttttgagtttcatctagttgaaagcactggtgtgctgatggagactgaaatcttcatcacatttcttttgtgtgtacttattcaaataagacgcaccctgattatcccagagatcggagttgggcatggttgcgaaaccataggcctatccttccttacccgttgtgaatgtatctggtactgtacttaagagagggttgagccttaatctttaaccacaacactagtctgaatgctgttgcagttcatcaactttatgatgcaacagtgtaaaaaaaaaagtcttatattt

SEQ ID NO: 20096 - DNA, 389 bp, Triticum aestivum
  Clone ID: PAT_TA_20096
cccacgcgtccggcctccactatactccaggacagtagacatcagcatccacaagcacaggtagttacaattagttgcaaccagaagaagctgatgaaacctgcattatatatttatattgtcatcttctacggctagcccactactacttattagctgcaagatcagaagcgacatagggagcaagctgaacgaagaggctgccatgagctactggggcacctcgccatcgtggggggcggcccgccacgggccatctccgatggtgcccctcatggtggtgctggccctggggtgggtcatctacaacgagaccctgcttgagtgttatgagcgggtgactgaggtgcgggacaccgtggccgacaatgccatggtcttcatcctcg

SEQ ID NO: 20097 - DNA, 1351 bp, Triticum aestivum
  Clone ID: PAT_TA_20097
ggcccctcgacgtctcgggtgtgtgtagtacgtgcatcaatcctgtttgttcgatcctcagagagctacctactcgatcgcaccacttgaaattgcagccaaggccttgtaattgtagcacaccgaagctagcagagcatttggtatttgaatcgggaggaactatggtgctggacaaggaggaggagaggagcagggtcctggtaattggtggcacaggtcacattgggaagcatatcgttgctgcgagtgtccgccgcagccacccgacctctgtcctcatcagggatgctgcaccggctgatctggccaaggcgcagctcctcaagagcttcattgattccggtgttgctctcatcaagggagatttatttgaccacgacagcctcgtaaatgccatcaagggtgcagatgtcgtgatctcggccgtggggacctgtcagctcgacgagcagacgaggattgtcatggccatcaaggaggctggcaatgtcattaagaggttcctgccgtctgagttcggctctgacccagagcgggttcacaccgtggatccagcggccacactgtacgctggtaaaatcagccttcgccgtctgatcgaggcggagggtatacctcatacatatgtctgctgcaacgggttcgccgaaacctaccttcggagcatcggcgatgttacggctcttggcgccggtcctccgtccgacaagatcactgtcctaggcgatggagttgcaaaagggaagcacgcatcatatcctttttcctgccactgtagtaaatccgcgctgtcagtcagttacatcctgtgttgatctgtattgatgcacgcgtgcaggggtgtttgtggtggaagaggacatagctgcctacacggtgagagcgatcgatgatacgaggaccctgaacaagatcctgtacatgaggccgccggcgaacatcgtgtcccacaccgagctcatcgcactgtgggagaagaaagcgggaaggactttccagatcgctcgcatcccagagccggatctcctcatgttgatcaaggaggcggcataccctctcaacatgatgctgtcccactcgctctccgtcttcgtgaggggcgaccaacccaacttcgacatcgagccatcctttggtgtcgaggccaccgagctgtaccctgacgtgaagtacaccaccgtcgatgagtacctgcacccctcctctgacagttcttggctggatggagcaataaagatgatggagcaataaagatgatggagcagtggcctctcccaaatccaatgatgtgtgtggtcttgtgtgcaaattcaccagaaagaaaagaagaacctctgcgttccttgct

SEQ ID NO: 20098 - DNA, 661 bp, Triticum aestivum
  unsure (1)..(661): unsure at all n locations
  Clone ID: PAT_TA_20098
ccacgcgtccgctattgctttcatgagcaaaagcctaagcccgcgttaccaagggctgtccacgtatgaaaaagagtaccttgccattatggtggctgttaaccaatggcgcccttatttgcaacacaacgagttcatcatctatacggatcagaagagcctcatccacttggaagagcaacggctgactaccccgtggcagcaacgagctttcaccaagctactcgggctccgctacgtcatccgctacaagaagggatctgaaaacacagctgcagatgccctttcacgtgcgcatacacctgatctgctgtttgacatcaccacctgccgtcccagttggcttgaggacgtggctgccagttatcatagcaaccctcaagcccagaaacttatgaagcaattggctatccaggaggatccgaagcagcgtttcactctggagcaagggattttgcgattccgcgggagaatttggctcgggggcaccacagcaatgcagcagaagattatctctgcttttcatgacagccccatgggcaggcacgggtgggtttccagccacttttcagcggatacggcgtctttttgcttggccnnnnnngnnnnngcacattctgcagtacgtgcgctgctgctcgatctgccaacagctannccn

SEQ ID NO: 20099 - DNA, 771 bp, Triticum aestivum
  unsure (1)..(771): unsure at all n locations
  Clone ID: PAT_TA_20099
gtttcgtgtaaattagcctcggagctcgtagtagaatagtagtacagtctagtggcatggcactggcagtggccgctggcttagctataaatatgtgaagccaagctgctgctgttaccacgagttcacgatgcagcgaggagtggctgcatctgcatgtagtacaactgagtgcaccaccacaccgctaccaccacaggcgcaaccaatggcggctgaggcggccatggatgggaagaagggcaagaagaagggcggcctcagaacaatgcccttcatctttgccaacgaggtggcagagaagctggccgtggtgggcttctcgacgaacatgctgacctacctcacccagcagatgcacatgccgctggccaaggcggccaccaccctcaccaacttcggcggcacctccgccatgaccccgctcatcggcgcctacctcgccgacgcctgcatcggccgcttctggaccatcgccggcgcctccgtcgtctaccaattcgggatggccctcctgacggtgtcggctgcgctgccgcagttccggccggcgccgtgcaagggcgccggaggcggcngngggcggcagcggcgcgtgccaagcaggcgctgccgtggcagctcgccgttgctccaantgtcgctgttcctgaacctgtgggctcnncgggtaacgggcgtgcaccctggnttcngggcggacanttcgacaatcnanacngcgancgccccggantgggctcttaactgggacacttcngaagcgggctc

SEQ ID NO: 20100 - DNA, 734 bp, Triticum aestivum
  unsure (1)..(734): unsure at all n locations
  Clone ID: PAT_TA_20100
atctctcccttctttcctccctcgcaacattccccgccgccgcccgccgccgccacggcgacacaatcaccggcgctgcgccgccccaccggcctcctcctttgcgccgcgccgcgcggggctgggctgaggtgggccgcgccgacacgctgccgctgcagcggcacgtggggagccaccaccaccaccaccaccctatgctcctttgcccgcctggtaagattgcacaagcagtgatcttcggagcttaaagtgttcgtcaaagacatgggaaaagtggtcttcggggcatatcaccttcaatgcaagctatttgtttcagaagaaacttttgattggcgtgttttagctcgtgggaacacccaactcttctctctggtgaactgcacatagtggttctatgctcaacgacagcaggctgaggcgatcctgaagcgatactccagtctatgctccacatctacatggtcaaccatctttactgcattcagtctccatctgtcactccctagttagttgccatttgctttactgtgtaccatctgaggtcaaggctcatccttgctatattctgggactctactatggttgctgtgggatcttcgngaggggaccaaagccaagacagcacaaactagtggaggcccactgttcaattcacggatcataaatctgttcgtgcggactgatagacaatatattggtcgcttagactttgaaacacttctctgtgc

SEQ ID NO: 20101 - DNA, 696 bp, Triticum aestivum
  unsure (1)..(696): unsure at all n locations
  Clone ID: PAT_TA_20101
aaaaaaaacaagttgantatntnagcagatcnccagagaatcagtttgcctattcgaccantacttaaaatcagtgtttatgaaattaggangagataagtttccctttttcttcgttggtgtgtccttgtggatacgantcgattgattttatcctcgcctccggttcaacacagagaccaccaccacaggtgcatccgtgcaggcgttctgcatcagttgccgggagccgcgtcgtgcgcttgcctcgccttcatcggcggccttcgtcgtcaccgggacgtagaagatgcggatgcagcgcaccgaggagcctctgcgggctctgccgtgagccgcggcagggagggcgtcgcctgcctagtggttgaggccgggcctcaccttgtacgggcaccgagcctcagagggcgtacatcagtgccgggcagaccgcttcaggtagccggccttttaacggcgtcgctgggcactgcttccgcgccgggagggagccgctgctgtcgcgcaccgccgtgggaggccggtgagggctgcgccatggcgagagccgcatcgcgcgctccagnnngaggccacgaccagggctgcttccgccatgggcggacgaggggagccgcgccacgcacgagtcgccgcgggtcgggcaacacgccacgccnnggatnnnntnnnnnnnnnngctgannncggccn

SEQ ID NO: 20102 - DNA, 763 bp, Triticum aestivum
  unsure (1)..(763): unsure at all n locations
  Clone ID: PAT_TA_20102
ccacgcgtccgcccacgcgtccgggcaagtatatctcttgtgggactgtagcattagagaggaagtgcaggcaggtttcagattctgctacatgtagcttgaaaggtgcatcaaaaattgccaaggggtttgctgcaagcatgaaagggtcagaatattcagttgacctttcttttacagccactggtaccattgcctccctcccatcatttgatgctaagccccccaataacactgacccagcatcagctgctagcacagaattgtcattgtcgttgccattgcctttgcctttaccttcctcaagtgatggttctgctccttctttgaatcatgattctagtgctgaagctgtagaccctagcagcaaaattaactttgcatacgatgaggatcagaaggtctggattccacaagataagaaggatgaaatggtcttgattcttgtccagaggcagaaagagttgcaagcacatatgagggattggacagactgggctatggagaaggtgatgcaggtcacacggcgacttgccaaagagaaggaggagcttcagtcactccggaaagagaaggaagaggcgagccgacttcatgatgaaaggcactgtctggaagagagcactcggaagaagcttttagagatggagtctgctatttctagggcaaacaatcaactggataaagcagatgcttctgctcgtangcgtgaggctgagaatgcacaattaggatgcgatggaagccggaaaaggggagcatg

SEQ ID NO: 20103 - DNA, 464 bp, Triticum aestivum
  unsure (1)..(464): unsure at all n locations
  Clone ID: PAT_TA_20103
cgctttccttcatgtgaagcacccctccccgtcacatgcctatctccgctagcgctgctagttcatcatttcacactcccacccctggccctcgctctcccacgcctcccggcctctccgcactctacccacacccgtcaccacagcctcgcacaattatcgccccaggtacaggtacaggtaagagggcgagagagcaaggcgatgtcaatggcggaggagcagtactacgggggcccgcgcggggcgccgcacgggctgctgctggcggtggtggtggggctggtgggtggcgggcccgctcttcctcggcgacggcgggcgaggcggtcaccgaacgccatcgnccgagctgctcagcccccgttgggcctngctcctcctccccgtgggcccctgcccctcctcaatccggcccccctctccccccggaacgggggcgnccccggggnctnngccgaatg

SEQ ID NO: 20104 - DNA, 793 bp, Triticum aestivum
  unsure (1)..(793): unsure at all n locations
  Clone ID: PAT_TA_20104
cnnncgtccgcctnnncccctgaccctacccattctccacaccgcccgccgccgccgccgcctcccgtcccctggcgccgccaccatgcccactcaccatcgcgccgtcgcgccttcccctcctcctcgccctctcgctgctcagcaggaggagcacggctcgccgccggccctcacgcgccgcctctctcctcctccgcgtcggggccgctcgatagagggaacactgatggcttcaacgggagaagcggcaggccaacccccagcggctggcaccaccggatggcggcggcggccacctcctcccggccagccgcaccgcgccatgcccattttcgcgccgagctgccactctcttctgtgtgcacgcccttccagcctcatggcgggagaagaggaaggagaagccctgcaacctccattcctgttcatttctttatgtgcatcggtcggctggctttgcacacccaacctttccacctccacgcccacctgtttctgcatccctttcttgtagggctacgacgcacacccccctcctcctccccctgccccgccccccagtcgtcttcaatttaatttgattgtgtagattcgtttttgtatgtgcctacagagtgttcgatgtaaatccatgcaagttgtagagtgatgttattgtttcttttggcaaaatgatgatggggaattgatcaatattgaacggataggcctactaatgttacaggcttaataattggatttgtgagttccatccagattgttctattatgcaagagttttattttaatgt

SEQ ID NO: 20105 - DNA, 577 bp, Triticum aestivum
  unsure (1)..(577): unsure at all n locations
  Clone ID: PAT_TA_20105
cccacgcgtccgcccacgcgtccgggcaggtgtgaaaacaataagcaaggatgagtacccaaagttcgctcaccacgtcccttgcttccatctgacaaatgaaaaagcaggcaagcttcgaggctgtttcgagctcgatccttattcagtgccagaggtgtttctctacaccagttaaatgtgggatggccttatttgcggtgcatctttaggagctgaagttgtgagaaccaaggttctatccaagttgggcagtccacgtctctaacattgttgcattgggctttttggctgtttcgaatacatccatgaaggtttgaacttgtcaggcgaatgggggtcttttgcatccatcagcgacggtttgcaagcggatcaatcttcctgcagcagctttctatagcgagttagcagcttagtagcattttgctgtgtccagtccctagtgtcacccctcatttcctgctcgtgtactcgaaaatgttggaaccatgtaatttaaccgtgctaggctaatttgatgggatcttggtatccnnnnnnnnnnnnnnnnnnnnnnnnnnnnnnnnnnnnnnnn

SEQ ID NO: 20106 - DNA, 858 bp, Triticum aestivum
  Clone ID: PAT_TA_20106
cgagtccttctggtttcctctggcaatgtgggttcttcccccgcctcaggtacagagtcattttctcatcctgtggttgctagatcaactggtagaaaaaatgaatatgaaataatccctcgcttccgtgacatctgggccgtttacaagaactggagggctggatggactgcagaagactttaaaaactgtgagtatgaatttgtggagattgttggccagactgattcgtccatacaagttcagcctttaggaaaggtggatggctacagggcagtatttcgaagaggggcagatgtgaaaacaataagcaaggatgagtacccaaagttcgctcaccacgtcccttgctcccgtctgacaaatgaaaaagcaggcaagcttcgaggctgtttcgagctcgatccttattcagtgcctgaggtgtttctctacaccagttaaatgtgggatggccttatttgcggtgcatctttaggagctgaagttgtgagaaccaaggttctatcgaagttgggcagtctacgtctctaacattgttgcattgggctttttggctgttttgaatacatccatgaaggtttgaacttgtcaggcgaatgggggccttttgcatccatcagcgacagtttgcaagcggatcaatcttcctgcagcagctttctatagcaagttagcagcttagtagcattttgctgtgtctagtctcaagtgtcacccctcattccctgctcgtgtaatcgaaattgttggaaccatgtaatttaaccgcgctaggctaatttgatgggatctcggtatctttgttgctgcaactttgaattgaggtgtagtcgcaggttagggaaaaaaaaaaaa

SEQ ID NO: 20107 - DNA, 2087 bp, Triticum aestivum
  unsure (1)..(2087): unsure at all n locations
  Clone ID: PAT_TA_20107
ccacgcgtccggcagttaaaggaactcatatttgacaagaacgggagacgcccattgctgctttgtcagctcatctacaacctcagtataaagttctgtgtcatcaacaatggagagaagacacagaaccttctggcggacggatctcctcgaaaccctaacccctcgaacttctagaacctccatggacggcctcgcggcgccctcaccctcccactccggcgccacgtcgggcggcggtgcctcccaccgcaagcggaagcttccgccaccatccctctctgacgccaccgccgacgaggacgacgacaccacggcgccgtcgtcccccgccacctccctatcctcgccttcccgcccgtcgtctccgtcctcctcccattctgacgaggatgacgacgactcccttaccaccttcaccgccgctcgcctcgatgccgcacctgcatcctcatccggcaggcctccgaagcccgactcgtcgtccgcatctgccgtcacagcggcggctcctaagcccgatgccgcgtccgcggcggctggagacgggaaggaggactccaaggggctgttcacggacaatatccagactagtggcgcctacagcgcccgcgaggagggtctcaagcgtgaggaagatacagggaagctgaaatttctctgttattctaacgatggagtcgacgaacatatgatctggttggtaggtttgaagaatatctttgcacggcagctccctaatatgcccaaggagtacgtccgccgactcgtccgggatagaactcacaagtcaatgatggttatcaggaataataatgttgtaggaggcattacttaccgcccttatgcaagccagaggttcggagaaatagcattttgtgcaattacagctgatgaacaagttaaaggctacggaacaaggctaatgaatcatctgaagcaacatgcccgagatgctgatggcctcactcatttcttaacttatgcagataacaatgctgttggttattttgtaaagcagggtttcacaaaggagatcacattcgacaaagaaagatggcaggggtacatcaaggactatgatggaggaatactgatggagtgcaaaattgatcaaaagcttccgtatgttgatctagcaacaatgattcggcaccaaagacaggcaattgatgagaagatcagagagctttctaactgccatattgtttattcaggaattgattttcaaaagaaagaagctggtattccaagaagactgatgaaaccagaagatatccctgggttgagggaagctgggtggactcctgaccagtgggggcattccaaatcacgttcaacattttcctcggattataacacttacagacagcagcttactagccttatgcggatgttgttgaagagtttggtcgatcatgccgatgcttggccattcaaagagccggtggattcacgtgatgttccagattattatgatattatcaaagatcctattgatttgaagacaatgtccagaagagtcgagtcggagcagtattatgtgaccttagagatgtttgtagccgacttaaagagaatgttcattaatgcgagaacctacaactctcctgatacgatctatttcaaatgctccacacggctcgaggcctacttcacaaatagaatccaatctcaccttgcccaggctgcgtcaacgaagaactagactgattttgggcgcattgggtagtcacttgttatgccgtccagcaattttttactattaatgcagcatcgtctcacgattttacttggtcaaagtccaaattatcactctttaggctcatggaatactagttgtctgagagaagctaatgttgttgtgcatgattagcgaaaatagctggatcgtcgttttgtgaggagtggactgaagatgcctaataaaaaaaaaactctattgaaaaaaaaaaaaaaaaaaaaaaaaaaaaaaaaaatctcataatgtaagacgtttctggatatcagtgtatgtcttacattatgggacagagggcgtagttaataaagnaggaaataaagttatcaaaaaaagaaaaaaaann

SEQ ID NO: 20108 - DNA, 817 bp, Triticum aestivum
  unsure (1)..(817): unsure at all n locations
  Clone ID: PAT_TA_20108
ccacgcgtccggtctgcagcctannttctctccccgctgttccatgcttgtcccggttcttggtgtcctctttggagttgctccatggtttgctggtggatttgtttctcttcttttttcttaataaatccctctgttttttctgtgcttgatctatactcacctgtttgcgtcttcatcttcttcttcttatctccggtgaatagcagagtctcccccgccgctcatgttccctttcccttgcaggagctcaccgagcaaccatggcgccaccccgaactctggatccggcgcccccaaacctcgacggcctcccccgcgcgcctccctgaccctcctccatctggatccgtccggtggcagccggattgtcgccgttctctggagtcaaacccgcgccgccgcgtccctcagtcgtctcgcgcaagaggacgacgagtagaccccctgtcacgggatctcgcgggctcctcagcctcggctggatccaacacgcgctgattatgccgctgccccgcctcccgcgcgtcctcctcctcccagccgtggcccacggcggcgaggagcgtgttgagcagcccgatcgtggtcggcggcgtgcgctccagccggccgacgcgggcctggagcgctgcggcctgggcctcggtgtcggcgaaccgcgtgcggcgaagaggaggcaggccgtggtgtggggaggagggcgcggcggagaggaggtaggccggcgcgcggggatggcgtggcggaggatgcggaccgacggcggggaggcggaggatccagatcgggaggcgcggtcgctcgaccctcgtgc

SEQ ID NO: 20109 - DNA, 679 bp, Triticum aestivum
  Clone ID: PAT_TA_20109
ccacacaacacaagcccacgcccacgcgcccccaaacccaaaaccctaccacgcctccgcgcccatggcccctaccgcgccgcagccgccccgcccctccgccgccgccccctccgcggcgccggtcgacgcgctcttcctccagaacctgatgagccgcgtccagctccgcccgcccttcctcgacaccaactccttcctcacccaggacctcgacgacttcctcctcaacgagttcgccgcgctctccgccgcggcgggcgagtccgacgacgacgaagacgacgaagaaggggaggacggcggcctctccgacggggaggcctccggggaggccaggcggcgccggatgctctcgcgggaggaggccaagctggagaaggagatcgtccggatggtgctcgccggcgacggggacgcccttaagcccaactcgggccagtccgtcgccgtcggcgaccaccacgtgtgcgtcggcttccacgacgaggccggtggggagtaccgcgtgtgggagtggcacggccacgtcatgctctttgacgacgaggacggctactccgccgagtacatctacgggaaccacttcgagccgctcgctgccgccgctgccagggccaagcagaaggagaaggagaagagagagaaggacctcacctcgggccttcgggatttgatt

SEQ ID NO: 20110 - DNA, 1065 bp, Triticum aestivum
  unsure (1)..(1065): unsure at all n locations
  Clone ID: PAT_TA_20110
cggncgcgtgggttgcaataggcgacgtcatgccgcggactgcacatcggtggtgcaaatggcacgtcctgaagaaggcaaaagagagccttggggcactgctttgcaaagggaagtgaattcaagccagaattcaacaagctagtccaccacatagttagtattgatgaatttgagaagggctgggcatgcatgattgaaaaatatggcctccaaaccaatgcacgcagcgaagcgagagcgcaaaccaccttctgaaagggtatgtaccaccaggctgccccatgcatttgttcatccggcaatatgagaagatgcaatttgacggcaactcagaagaaagttaccaggagaaaaggacaaaactaggtgggattgtcctgaagcaaaagatcccagtcgaggtacatgcatcgcaggtttacaccagaacaatgtttgagaaatttggtgaagcattgcacgtgtgtgggtcgtatgatcttgtagaagtcaagccccaattggagtacattgctaggcacataaaattccagtcaaggggaaaagtggtgcaagaatgagtttgtcatctccctgagtgagacagccaatgagttcaggtgcgagtgtggaacatttgagaactatggaatggtttgtagtcatgcgcttaagggcatgtcatatctcctcttcggtattttacaaaccattttctgtgtgagctcccctccgaaaacatgtgctgttggttaggtcatgaaactgacattttttggttgctggttcgccaggtcatgatacacctaaaactgcatgagctccctccgaaacatgtgctcaagcgatggactagagatgcaagagatatactactaccggagtatttgcgctaccagaaggaccatgggcccctgaagtattcttctcgtcgacacaacactttatacttgttggcagtggatgtggttaagttaggtgacaacaatgtggaagcatatgcacttgcaatggagaaaatgcgagatgtcaaagtgctccccgagccagttgccgccgtgcgggagggcttggtttgtctga

SEQ ID NO: 20111 - DNA, 1349 bp, Triticum aestivum
  Clone ID: PAT_TA_20111
gctccgcggggcgcgcggggcccccacgcgtccgcccacgcgtccgggtgtgcaactgactgaaggcggcataagtggaacagaggatgcggaggaggctttgatttcttctctgccgataggacgagctggtggcggcatggattatgaagggggcgaaggagctggtatggggggtgcgcgtcgtatgatcttggcgatgaagggatggcgatgcctgcgagagccgcagtgcaaatgtagtccctgaccctgcggaccaggagccagaccaggatggcatgggagtgtcaagggctaaccaatcttcttggatcaggagggcagaatatggtgcgtaccagccagattctagatctcaagctcgcgcgatggaaattgcaataggcgacgtcatgccgcggactgcacatcggtggtgcaaatggcacgtcctgaagaaggcaaaagagagccttggggcactgctttgcaaagggaagtgaattcaagccagaattcaacaagctagtccaccacatagttagtattgatgaatttgagaagggctgggcatgcatgattgaaaaatatggcctccaaaccaatgcattcctaacccagctttacgaagtgagggggaagtgggcgaagccatacttcatgggtgtgttttgtgcaaagatgacaagtacgcagcgaagcgagagcgcaaaccaccttctgaaagggtatgtaccaccaggctgccccatgcatttgttcatccggcaatatgagaagatgcaatttgacggcaactcagaagaaagttaccaggagaaaaggacaaaactagggggattgtcctgaggcaaaatatcccagtcgaggtacatgcatcgcaggtttacaccagaacaatgtttgagaaatttggtgaagcattgtacgtgtgtgggtcgtatgatctagtagaagtcaagccccaattggattacattgctaggcacataaaattccagtcaagggaaaagtggtgcaagaatgagtttgtcatctccgtgagtgagacagccgatgagttcaggtgcgagtgtggaacatttgagcactatggaatggtttgcagtcatgcgcttaaggtcatgatgcacctaaaactgcatgagctcccttcgaaacatgtgctcaagcgatggactagagatgcaagagatatactactgccggagtatttgcgctaccagaaggaccatgggcctctgaagtattcttctcatcgacacaacactttacacttgttggcagtggatgtggttaagttaggtgacagcaatgtggaagcatatgcacttgcattggagaaaatgcgagatgtcaaagtgatg

SEQ ID NO: 20112 - DNA, 615 bp, Triticum aestivum
  unsure (1)..(615): unsure at all n locations
  Clone ID: PAT_TA_20112
ttttttttttttntgttcccaagaattctccatcatctctttctgttttattcacctttgtggttaattaatggacacacatacaggttacaacttcttccaccacccaccaaaaatcgcatgaacccgaaatctgaaacaaagaaacgcaaaccaaatcccacagcgacagcatcacatatgtacacgagcgaagattccttgaccacccgctcgtaaatattcagtacgtctcgtcagtcgtcacccccgaccggtacgtctgacggtggtgcgcctgctgaacccctccgtggttccgcgtcccgcctcaccgctgcccccctcggcggagcccctgcctgcgccggctctgtgcgggaagtccgtcatgtcctccgtgtccgccgcgctgctggccgtgtactcgctggacgggttcagcccgtactcgctcgtcggcgcgctcatctcgctgctggcgtactcgctgatggtgccgccggccgtccccggtgcccggcccgaacgccatcctcctgagccgcctgacttcgtccgtgttgccgccccctgagcgatgcatcgcgctctggcccggcgncnnnccgcnngtnnnnnnnctccgccgacagc

SEQ ID NO: 20113 - DNA, 671 bp, Triticum aestivum
  Clone ID: PAT_TA_20113
gaattcggcacgagaagaagacacctacgtggatttgttgcagttcttggagcctctggagctgtgctaccgatcgctgtgcgactgcggggacaagctaatcgccgacggcagcctgctggacttcatgcgccaggtctccaccttcggcctctgcctcctcaagctggacatccggcaggagtcggaccgccacatcgacgccgtcgacgccatcaccacgcacctcggcatcggctcctaccgggactggcccgaggagcagcgccaggagtggctcgtcaacgagctccgcggcaaccgcccgctcttcggccccgacctgccgcagtccgacgaggtcgccgacgtgctcggcacgttccgggtcatctccgagctccccgccgacagcttcggggcctacgtcatctccatggccaccgcaccgtccgacgtgctcgccgtcgagctgctgcagcgtgagtgcggcgtcaagaagcccatgcgagtcgtgccgctgttcgagaagctggcggaccttcagcaggcgcgcgccaccatggagctcctcttctccatcgactggtacaaggagaggatcaacggcaagcaggagatcatgatcggatactcggactcaggcaaggacgccggccggctgtcggcggcgtggtatctctacaaggcgc

SEQ ID NO: 20114 - DNA, 664 bp, Triticum aestivum
  unsure (1)..(664): unsure at all n locations
  Clone ID: PAT_TA_20114
ccacgcgtccggcgacgcaatgatgtgcggaaagtacctggcttcagctacacagagataagtggtgtaatgcataagttcattaatggtgataaagagcacccaaggttgcaggagatttacagagcgctagaggaaattgtatcaagaataggtgagctgggatatgagccagaaacaagtaatgtgcttcatgacatcggggaggaggagaagcagtatgcattgtcttatcatagcgaaaagctggccattgcatttgggctgattgccacgccacctggggagaccttgcgggtgataaaaaatctccgaatatgtggggactgtcatgtagtggcaaaactcatatctaaagcctatggccgagtgattataatcagggatagagcaagattccatcggtttgaagatgggcagtgctcttgcggcgattactggtaaaacactggtgtgtgtaatgatttacaggggctgatggagttgataatgagccactgacttcacaggatcagcggactacagcactctgtagacggcttattcaattcgaagttgccactggtgaggcattcaatgttttgtncgttggctgcacagagacagccttanngaagaatgggagaaattcattgagaaatgagtagatctgtagatatgatgn

SEQ ID NO: 20115 - DNA, 656 bp, Triticum aestivum
  unsure (1)..(656): unsure at all n locations
  Clone ID: PAT_TA_20115
ccacgcgtccggacaaccctgtttttcgtgtttaagttatgccatttacgaacgtgaatgtagagactagagagcaactccagattgctttttggggaaattgaacagtcaggacattcaggtatgtcgacagtctaaacggaagaaaattttataaaagttttacaacaacaatgcatcatatggatgacactatgcaactgcattctgttgtaactaggaatttagtaactaaaaaatatataaaaaaagcttgcactatcaggtagatccatgattgacatgatattgccatagttggcccaaagagacatgcttctgaaaatgtgttaatcaaggtttgtattactagtaaataccacctataagtattccactatcatttaacaaatttgctatacggacctttggcacagtttcaggtcaaaacaaacagttctgtattgcatgaacattctgaatatactgatcctctctctgtaccttgaaattttgatttaagatgcagtagtgggtcagatctttccttggccgacaatgcactcttatggaattttgtaatatggttccagtttatcaggcagatgttcctaggtccagttatggtatttagtattgtaaactctcctttctgttnnnatgnnngggatgtctan

SEQ ID NO: 20116 - DNA, 645 bp, Triticum aestivum
  unsure (1)..(645): unsure at all n locations
  Clone ID: PAT_TA_20116
ccacgcgtccggtagtatttgttctatatctgatatgtgggccatgtgcccacaatgatattaaatttattttttatgagggagggaccaccacaatggcttgcaattgggttaatcatgtgttgcctagtgcgttgcactactgcctgggctggcacaccccaaccaaatcaagttaaaattttctatttttattctcttcagatgatttgaagctaggtacacatggattttttttcttgtgcgtaccttcatgtgatttggttgcgaactttggttccgaactcataacataactcaagagattgaaagcatttcaagacaagcagagtggagtaatggcaagacatattcgtggctgtgatttcattatcatcacaaaatacacgaaggatggtgtgcttaccggtttgtgaaccagttgagagggttcaatctgcagaactcacgcaaagggagaaagccgcaagagaggaaattctctgagtaagggaagcgagtgggcaccgaccggcatccgtggnttggtctggtagcagatggtgcccggtcattgcagcgctagcacgtagtggtcgatccggcctgccattgcttcctccngnncgctggcgacgccaacactgcgccagggaacagcacgnn

SEQ ID NO: 20117 - DNA, 782 bp, Triticum aestivum
  Clone ID: PAT_TA_20117
gcttccatgttaaacctttaccatactgttgcccacaaatgcgtaggctttcctgccaggaaggaaggtcatgcccacagtagaagcgctgctgcactgccgttgagaaaacggcgtcttgctagtgatgcctcagcatggtgtatgaataagcacttgagcagttatggtgggtcgttgccttcctatgctgtgacaatggattgcaagaacattatagccggttcagcaccatcagatgaagcagatggtatcgggatcacagagttctttgtgggcaagaactttttcatcactggtgggactggatttctagcaaaaggtacagtttctttcttctacatccttgatgtttaacacgcaacatagctttcgagcttgagttctatttctctattgcgccacttattattgagaaaatcttgaggacaactcctgatgtcggcaagatatatgtgttgataaaggcgaaggacagcgaggcagcactggaaaggttgcaaaacgagatagttggcacagaacttttcaaatgcttagagcaactccatgggaaagactaccgccattttttagcaagaaaactggttgctgtagtaggcaacgtgagagaagccaacatgggcattgcgcctgagctagctgatgagattgcaaaaaaagtggacgtcatcatcaacagtgcagcaaatacgacattcgatgagaggtacgatattgctatggacgtcaacaccatgggaccattccggtttatgagtttttcgcgtagattttcaaac

SEQ ID NO: 20118 - DNA, 731 bp, Triticum aestivum
  Clone ID: PAT_TA_20118
caagaacctcaccctgttcaacctgttccgaaataggctcaggggtgacatccccgagtttgtcggcgacctgcccggcctcccgcgcgtccggttgtgggagaacaacttcaccggcggcatcccgcgccgccttggccgcaacggccgcttccagctgctcgacctctcgtcgaacaggctcacgggcaccctcccgccggagctctgcgccggaggcaagctggagacgctcatcgcgctcggcaactcgctcttcggtccaatcccggattctctcgggaaatgcaaggcgctcacccgcgttcgcctcggcgagaacttcttgaatggttcaatccccgaaggtctatccgagctgccgaatctgacccaggtggggctccaggacaacctcctatcgggcagcttcccggctgtggtgagcgcgggcgggccgaatcttggggggatcagcctctccaacaccctgcccgccggcccggtgccggcggcctctcggggcgcctccggcccgcggaagctcctcccggagcagacgccgtgctcccgcgcaatccccccggcgactgcgcggctacaacagctgtccaaggctgacctcagcggcaattcgttcgatggtggcgtgccgccggagattgggaaatgccggttgctcacctaccttgatcttagccagaacaagctgtctggagatataccgccggctatttccggcatgcggatac

SEQ ID NO: 20119 - DNA, 480 bp, Triticum aestivum
  Clone ID: PAT_TA_20119
gggcctgagaaaaatttgagaccccagaacgcaagacgcgaagacgacccaccaccggcccccgcccctaaattacggccgcacgcctcgccgccggcgatcccaccgaccgtcggctcccccgcgcctcgtccgcccctgcggcgtgctcgtgcccacgaggacgccgctcgccggtgcgggcgaggagggcggcgatggggaactcgctcgggtgctccgcgtccggcgagcggctggtgtccgcggcgcgggacggggacgccgtcgaggcgcgcatgctgctcgagctcagcccggcgctcgcgcgctactccaccttcggcggcctcaactcgccgctccacttcgccgccgccaagggccacctcgacattgtgacgctgctgctggagaagggcgcggatgtgaacgcgcggaactactgcggtcagaccgcattgatgcatgcatgccgacatggacactgggaggtggttc

SEQ ID NO: 20120 - DNA, 745 bp, Triticum aestivum
  Clone ID: PAT_TA_20120
cccacgcgtccgcccacgcgtccgacaaaactgagaaaggagagaactaatattcatggcggctaacgtagtgcaagccctggccgctgtcctcacactgctggtgatcacaagagcgctatggtatctgctttggaggccatacgctgtggccaggtggttcgagcagcagggcatcagaggtccgccttacaaattcctggttgggtccctgcccgactgccaaaggatgctcgttgccgggagagtcaaggatctggacacgagctcccacgactgcatcaccaccgtgcaacccttcttccggaaatgggcctcactgtatggaaaaacattcctgtactggttgggaccgacaccagcactgtgtactacagacatagaaatagtgaagaaagtgttaagcgacaggacagacatgttccaaaaagattacttgaatcccagtttggaagcaattctagggaacggggtaatatttgcaaacggagacgactggaagcggcggcgcaaattcatccacccggctttcagccaagagaagatcaaggttacttagttagcaatctcttctttcttttcttttttaacatgcttgaaggatgtgggattttcttgaaatctcaacggaataaatacgtttgaatgtttgtgttcacaggccatgtcagcaataacgttggagtgcacacagcagatgatggaacagtggcgcactcaaatgcaagagagcaacatgcagcaa

SEQ ID NO: 20121 - DNA, 601 bp, Triticum aestivum
  Clone ID: PAT_TA_20121
ttaaatttccaatattcaggaaggtaggtagtagctgctagatacgatgggcagccgcgcgggtggcacggaaacggcggaggagaggacgcgggtgtgcgacctcccggaggcgtgcgtggcgcacgtgatcgcgctcacctccccgcgggacgcctgccgctgcgccgctgtctcgccctgcttccgcgacgccgccggctccgacgtcgtctgggcgcgtttcctcccgccggactacctccagctgcaccaggcgccggcccggcgattcccgctctcgcgctccgcctccacggcctcggcgggggcgtcggcgtcgtccaccaagaaggaggcctacctcgggctcaccgacgcggccctgctggtggacggcggcggcatggcggtgtggctggccaaggagagcggcgccaagtgcgtggcgatctcggcgaggaggctcagcctgccgtgggacgacggcgagttcagctggaggtggacgccccacccgctctccaggttcgcggacgtggcccagctggtggactgcacgtgcctcgacatctacggccggctccccaccgccgcgctcacgccggccaccggctacaca

SEQ ID NO: 20122 - DNA, 579 bp, Triticum aestivum
  unsure (1)..(579): unsure at all n locations
  Clone ID: PAT_TA_20122
tgttactntctcatccaacattgtaccatnagtgnttcngggantaatggcggaacttcttccaantgtgntattcctggactnggactggaaatccttggacggattatgncctcgcgtccgcctggatgatgatatggcacctatggctgctgctgtgctgtctcggtcacccattggaggaatttcttcttcatcatcgcaggctgggacacatgtcctttaacaccctgggtcagttgtatcctaacctctataataatatttgcaaagaaagcctagtatgtgatgcctgtcagtatgggaagctaacccgtagtatatatgcttcatctgatcacagaagtacggtgccatttcaaactatccactcagatgtgtggggtcctagtggggtgtggtcactttatgggtacaaatctttcgttacatttattgactgttgcactaggactacttgggtttatgtactgagaaataaaagtgacgtgtttgaatgctttaaggatttccacaacctaatcaagaatcaatatgatgcacgggtgaaaatatttcgaactgacaatggtacagaat

SEQ ID NO: 20123 - DNA, 809 bp, Triticum aestivum
  unsure (1)..(809): unsure at all n locations
  Clone ID: PAT_TA_20123
aatcccttctatggacaagttcaggcatttgcgttttctggactttgaagattgcaaacagctagagaaccaccatcttgaaaatatagagagattgtttcagctgaggtacttgagcctccgaagagcggagaaagtaactaagctcgtanaacaaatcggacatctccgcgcgtccgagatactaaatttaaagaggcacccatgtttgtgggttaccaacatctattctcaatctcaagagattggtgcacctattagtcgacagtggtgttacactttcttgtggaatttccaagatgcaatcactgggagaatttgaagcttgtcagtgtctacaaccattcatttaacttcctgcaagaattggagcagctgcagagtctgaagaaattggcccttgattttgaggattatagttctgctgaccgagtgaatgctgaaaatgagtccaagagagctattattgtcacttcccttaaaaacctagggaaccttctacctctagctattggggatggccccgaatttgtaggggaatctctgtgccctatgccacttaacctccagaagctgaaagtccgtggttctattattccccatgttccaaattgggtgggctcccttgtcaacctccaggagttacgccttgaattgttcagagctgagcagaaagatttctatatccttggaggcttacctgttctgcgttgtctgattctgagaatttttgaccgtgaaattagaaatacctcattaacagaagnncctgaagttacannngntcatagtctgtggtnnnnnnngnn

SEQ ID NO: 20124 - DNA, 1034 bp, Triticum aestivum
  unsure (1)..(1034): unsure at all n locations
  Clone ID: PAT_TA_20124
ctcgctccaccggccgatacggcagatccccggcctccggcgaccggcatgcccgcgccaccaccgccggccggcggacggcggcggtggaggcaccggctgagccccacgctcgcgcgggaccgctgctacgcccgcgccttccgctccgccggcctccgccaggccgccgtgccgctccccgacggcgccgtcgtccacttctggctcccgcgccccgacccggcgctccaccccgtcctcctcctccacggcttcggcgccaacgccacctggcagtgggcccccttcctccgcccgctcctcgccgccggcctcgcccctttcgtgccggacctcgtcttcttcggcaactccgcctcccccgccgccgacagatcccccgcctaccaggccgcctccgtcgcagccgccatggccgccctccccggcgtgccgcagaggtacagcgtcgtcggcgtcagctacggcggcttcgtggcctatcacctcgcccacgccttccccgccgtggtggagcggctcgtgctcgtcgctgcgggtgtgtgcctcgaggaggccgacctggcgtcagggctgctcgccgtggacgacatctcggaggcggccagcctgctgctgccgcagcggccggaggatctgaggaggttggtggagctcaccttctgcaaaccgccaaagttcatgccgtcctgcttcatcagggattacatcagggttatgtgtactgaaaatgtgaaagaaaagaccgagttgttatatgccttgatcagtggtaggaagctttcggaccttcctaaaattaaccagcaaaccttgataatttggggagagcaagacagggttttcccattagaacttggcttacggttgaaaagacatttgggggatacatcggaattaaccattgtcaaggatgctggccatgccataaaccgtgaaaagcctgcagagctttgcagacttataaagaactacatcatcgattcctctgtcaantnnnngatgatcgnnnggatgttggaagtttgcgt

SEQ ID NO: 20125 - DNA, 664 bp, Triticum aestivum
  Clone ID: PAT_TA_20125
cggacgcgtgggcccggctgcccagctcctggccatcccccagactcttcatcatctcccctaaatccccacgccgatcgatctccaagatttgccctggccccgagcgattccatctccccaatcagaattctattcgcctgaatcggagcaggactgcccccagtcccgtcgtcatgggcggctggaaccgcatctccagtgccggtggtctgctgaagccgctcgccggcgtccctttccgctccatgcccggcgccggcgccgcctacttcatcgtcggctccgcgctcggggtcttcgcgatgctgcacgcctccgagtctgaggtcggccgcgagtgggcctccgccgcgcactgggccgccctctcccgctccgtgcgcgcgcaccacgtgctcgtcgtaatgtccctgatctacctggccgccatggtctggcgcctcggcaagcgctgcgacgcggtggaggggctcgtggggagcgcgggcgccaccgtgcaagcggtgcgcgtcagaggcgtcgtctgcaccatgtgtgggagtgggacgaaggcgcgggctctgaagaacggcagctcgggccacaccgtggagcgcgcccggtctggcagctgctctgacaagcctgtttcgaggtcgctggcttctgagctggagcagga

SEQ ID NO: 20126 - DNA, 934 bp, Triticum aestivum
  Clone ID: PAT_TA_20126
ttcggcaccaggccccgactccggtgggctgagcccctcgccgccggccggcgcaaatagccagccggcaactctcccgcactccggctcggtagcctttccctttccccgttcggttggtccaagcgctcgcgctcctggctagctggttggctggatctagccggccggaaccctaacctaacccggcgggtctccaatcctgtccgcatggagccggccgccaacggcgacaagccctccggacgagcagcagcagttcgatcccagccgcatgattgcgcgtcatcaaaaggaaggccttgattaaagacctagccgctgcttaccacgctaagcgtgtagcatgttgtcaaaaggctgctggaacttcataaagaagtgggacggacgcagcaatgagtcgaagctaagatgcccgaatggaccaaaacaatcttcgacgaacccttctaagcgcaggaagaggtagatctaccaggaggaaaagcgatgctgcagtttacttcagtgggggatatgggaggttaaaagaaagtgggcgtgaaaaagaagtgaaataccagacccatgtaaacatatttgaaaacctgatacgcaggaaggcgtggtgaaaaactctactgagattctgtggacttcaaaatgtggtcacgagctagtaaaaaaattccgagtaatgtgtgtgtactgatagcaagttgaagcaacatactatcacggcttgctgctgtcttgtcctatgggtaaaaaatctatcccggcttgctggttcggctatgacggtgtcaggcccagccttgatgaaaaaaaaaaaacagatcttagccatccttgtgtggcaaaacatcagttgccttcaagaaggtagggggcaagtgatcaaagtcccagcaaaagtggagcaaaagatcaattttccctcgcagaaaaa

SEQ ID NO: 20127 - DNA, 601 bp, Triticum aestivum
  Clone ID: PAT_TA_20127
gaggaattcggacgaggacagccgccgccgccgcctagatcgaccggccaggctgtaacgagccgccgcaccactcaccagtacccgagcgtaacgcacgagaagcggcgccgcctcgcgcgggagcggggactcggatagccattgcgatgaggtccgccgcgtggcacgccctgctcccgtcactagtgcctgccaagcccggcatcttcttcctccgcagccggcccgggcggttcttgtcacacgctcacggcttgcggccgtgtggcgctgcgagctctctgccccccggggagtaccttcctcccttgttcagcgtggcgccgatgatggactggacagacaaccactacaggacgctcgcgcggctgatatcgaggcacgcctggttatacacagagatgttggtcgctgagaccattgtgcatcagaaagataagttggatagatttttagcatttcctgctgaacagcatcctattgtgttacaaattggtggaagtaatcttgacaatttggcaaaggcaactgaattagcaagtggatatgcatatgatgagatcaacctgaattgtggttgccccagcggcaaagttgc

SEQ ID NO: 20128 - DNA, 835 bp, Triticum aestivum
  Clone ID: PAT_TA_20128
accacaaagtcataattccgttctctgctgtagattaacaagcatgcgatgttgtgaagaaaaattcgaataattgacagaaaatctcgacaaagatcaagcagatgttctagagacgaagcaatatctacatggagtccattacaggtattcgcaatctgcttcatggcatgaaccctcctgtaccttgtgatgccacagcattttggcaccttgctcacagcttctatgaagttctccactgcaactcgatttgaatctgcccatttttcgagtcaatgagatggaacttctcgttgatccgcttgttgctgatcacgtctgccagggatatatcaatgtagcccaaggcttccttgccatgcaatattcctttctttccagctttacttaggacttcaacatgcaatttatcatttgtaggtggttcctcacaaacaaactcaaactcatcctcccagcgtggatccctgttcttcttgatcacctttgttttcttctcttctcctttaaagattatctttgcgtatgggtttgtgtgatgcttcccttcaagatcttgagcttcgtgaacaacaacaaaaagcagcccaccaccagctggagtattgtctggagctttctgcacttcatcagcaccatccacgttttctttctccatatcttcttccttgaaaggcttatatgtcgcctccaaaataatctgaccacgagatttctcattttgtatatcatttggatccatggtcttcagcaagttaagagtcaacactttagtctcctctgggggaagttctttcaacagaaccatgttcatgcccatcttttcatgttt

SEQ ID NO: 20129 - DNA, 3148 bp, Triticum aestivum
  unsure (1)..(3148): unsure at all n locations
  Clone ID: PAT_TA_20129
tgagtacttgtgccgaccccaaaccttagctagggcaaaccataagcgggtgtggaacggcgcgagacaagccagcactaactcgtcgtctgttgtcgataacaagcctgcgttgttctgaagaaaaattcgaataattgaccgaataattgaccgaaaatctcgacaaagatcaagcagatgttctagagacgaagcaatatccacatggggtccattacaggtattcgcaagtctgcttcatggcatgaacccgcctggaccttgcgatgtcacagcattttggcaccttgctcacagcttctctgaagttccccactgcgactcgatttgaatctccccatttttcggagtcaatgagacggaacttctctgttgatccgcttgttgttcatcacgtctaccaaggaaataccaatgtagcccaaggcttcctttccatgctatattcgtttttttccgagcttcactataggacttcaacatgcaatgtggctcctcacaaacaaacccaaattcatccccccatcgtggatccccgttctgcatccccgtccttcttgtcctcctttgttttcttctgttcacctttaaaggttgtcttggggtatgggtccgtgtgatgtccccacctccatgagcttaagctgcgtgaacaacgtcaaaacgcagcccgccaccaggtgcattcttctctgtagcgttctgcacttcgtcatcttcctccacgttttcttccttgaaaggctcatatgtcaccgccttattagtcggctccatagccttctaactgcgaaaatcctttgtttccatgatcttcggcgtggtagtcctccgcgcggtggagcacaagcagaagaagtcgtccgacggaacattgttcaactttaacatgtcaacagaggaactgtgatccctggcgaccacatcaacgcccagcgactggttttctggatctgtcacgacaaatttgaaatcttcattccactgcggattgagattgctgcgctttactgatgttttcttggatggaagcttgtcctctgtcatcttaagtttcgcgtatggatctgattcacccagcagatccttctttttcagattttgagctcttacaccattcagaagtagaattccaacaggcctctttgatgcttttgagggatccattatagggacttctatgggtctttggccacagatacatgttcccaacttgcttattaatggtgtcttgaatgaatttgtaaagaacaagaatagccgttaaatctgctccgaatagattgagcccgaaatcaacatgtggcttctccatgagagaaacactgatattagcgaagcaaggaaatgtaggcaccaacggcttcagagtaatacgaggcgatgcaaagacttgcagatccacaatctggacagttgctttcaacccatagcccacccgaccaccagtgattttgggatttgcagcccactttagagatggttccattatcaactctttctcatcggtgatatagactttcattccttgaaaggtgggtggtaaactacccagagtaagtgtttcaaactcaactgaatctatcttgtacttctcacagttctcagcaataattggctttgcaatatcctgcgccattctgcagatagccttgttaagattgggccacatcaattccagaaacctgttgagccaatcaactctatcatagtcgggattcttgacccacataggaatttcaggaaggattccgtccaaagaatttgagtcatattccacaagtgggcgaacttcgacgtccttgacattcgttggctggaagtagatgaagaaatagtaaccgataacaataccagaagagaatccaaagccaaatccaaagagaccaagcaccgtgctgattacgcccatctctgattgtttttaagaccagagaggccggcggcgggtgtcgcggtcgcggtcgcggtccgtgcggcgtcggtcaccagagtgcctcgtccgcggacgcgtggcgcgcggccatggaacctgacccggaggggatgtcgaggggcggcggcggaggagggtacgggaaaggcagcagcaatggcttctccaggttcgggacaggagacgaaggcatgatgggcaatggcggaggcagtgggatcctcagccactcctccaccgtcgagaggctctacgcctgggagaagaagctgtttcttgaggtcaagaactacgaggggcataagcaggagcatgacaagaaggtggggctgctgaggaagcaggaggtgaggggcgtggactacctcaagatggagaagaacaggatggagatggagagcctcgagtccaagatgctggtggccacccagtccatcgacaccaccacctgcgagatcatcaggctcagagaatccgagctgtttcctcagctacttgagctggttgctggcttgatgagcatgtggaggggcatgtatgagtgccaccaggtacagacccacatggtgcagcagcttgaatacctgaccatgagcagcaacccaacctccaatgaccaccggcaagcggcgctccagctcgagatcgaggtggacaggtggtactcggcgttctgcagcctggttaagtcccagagagattatgtctactcgctgaccggctggcttcgcctctccctgttccaatgccttcacaacccactcatgaaagacatccagaactccgacatctacagcctgtgcgaggagtggcagctggccatcgaccggatccctgacaaggtggcctcggaagggatcaaaaccctcctttcagtgattcatgccgtggtagttcagcaggcggaggagcagaaacagaagaagaggtcagatgctgcattcaaagactttgagaagaagacagaggaacttcgatctctggagtccaaatacgggccgtactctgctgaaggctatggagagatgacgcggaagacaccggttgcagagaagcgggcgaaggtggaggccctgaggagcagggcggacgacgagaagagcaagcatgagaagagcgtcggggtgacgagggcgatgaccctgaacaacctncagacggncttccccaacgtcttccaggcgatgacgggcttcgccagcgtctgca

SEQ ID NO: 20130 - DNA, 2329 bp, Triticum aestivum
  Clone ID: PAT_TA_20130
gcgaaatgaatttggagaagtctgaaaaagaattgcacatttcaaaactcgagaggcaaattacagtgtctgagctaaaatacatggaggagatccagaccatgcaagttgaaacaactgaaaagaatgaagcacttacaagcaagatgcaggagcatgcaaacttagtccatgaaaaagatcagttggagcaacaattgctggaagttaggaaggaactggaggctgcttaccgtaccatcgctaaccaggaagagcaagcttcagtgagggagataaagtgggatgcgtttaagacgtattcagcggatcaactagaagctgcacaaaaacacgctgcagagctggaagtacaagtatcagctctaaatcagcagctgcaagaagctgagatccattacaagaaaaaggttgcaaaggagagtgagaaactcgctcttgtcaatacacagctcaacaagctaacccaaaatgtgagcaagagcgctgaaatggagaagaaggtacaggaccttgagcagaagttgcagcttgctcattccaaatctgaagaacaggcaaaggatgcagtggtgtcaacgagatcccgagaattcagcctggactcgttagcaccgcaaaacaaacagcgcgacatatctcaggctcctagcacggcctccccgaacccggcgcagcaacaactgcgggagccctccggcatcatggccttcaagttcatcctgggtgtcgccctgctgtcagtggtcatcggcgtgttccttggaaggagatactagtgccgatcttgtgaagttcctgctggtgccctatgggaaaatcccattcttaacagctaaaaactgttgcttcccatgaacctaaactactactctagctgaacaacgcatagcttgcttggtttggtggattgcaattgaacggactgatggctttcagggagaagtcagaaatccggaagcttcttcttggtgagttctccctatagtttctttttgggtcaaggggggtaggaatttgatttttgttcattcctagtttcctacccttgggcatgcataaggccatatgcatgcaatttggtgtttgctgtcggtgagcttgtatctaattctccctctctctctgtaaaaaggaagtccgtcaggaatattaattcgttcatatggtcgagtgtaagctgtgtcatatgctgtacaatcactctagtgtttttgatctatatatatctgggttgttggttggcccaaaaaaaagagcagatgaagcaacaattgctggaagttaggaaggaactggaggctgcttaccgtaccatagctaaccaggaagagcaagcttcagtgagggagataaagtgggatgcgtttaagacgtattcaacggatcaactagaagctgcacaaaaacatgctgcagagctggaagtacaagtatcagctcttaatcaacagctgcaagaagctgagatccattacgagaacaaggttgcagaggagagtgagaaactcgctctggtcaatacacagctcaacaagctgacccaaaatgtgagcaagagtgctgaaatggagaagaaggtacaggaccttgagcagaagttgcagcttgcttattccaaatctgaagaacaggcaaaggatgcagtggcatcaacgagatcccgagaattcagcctggacacgttggcaccgcaaaacaaacagcgtgacatatctcaggctcctagcacggcctctgcgaacccggcgcagcaacaactgcgggagccctccggcatcatggccttcaagttcatcctgggcgtcgccctgctgtccgtggtcatcggcatgttcctcggaaggcgatactagtgccgctcttgtgaagttcctgctggtgccctatgggaaaatcccattgtgaacagctaaaaactgttgcttcccatgaacctgaactactactctagctgaacagcgcatagcttgcttggtttggtggattgcaattgaacggactgatggctttcagggagaaagtcagggatccggaagcttcttattggcgagttctccctataatttttcttttgggttaaggggggtgggaatttgatttttgttcattcctagtttcctacccttggcatgcataaggccatatgcatgcaatttggtgtttgctgtcggtgggcttgtatctacatctccctccctctctctctgtaaaaagttagtccgtcagaaatattaatttgttcatatggtcgagtatatgctgtgtcatatgcctgtagaatcgctccagtgtttttgatctatatatatctgggttgctggttggc

SEQ ID NO: 20131 - DNA, 1281 bp, Triticum aestivum
  Clone ID: PAT_TA_20131
ccgcgcgcgcccgctgctccgccccgcgctgccctgctcgccgcccgccgatggaccctgccctgggtggcaccgcgctcgctgccccccccgggaccgactctgaggccgcggcgccgaccggctccgcctgccgctcggcgcttgggcctgcgcagactgaccccgcccacgcggagccccgtggccaggtgtgggaggtcgtgcagcgcaccgcggcgaactacgcgtcggcgccgggcccgcggcactccggacctctggtcgtggctcggtgccacagaatgagcctgagagtctccttgtggaaactgatactagcatagagcggcaggaggcgcgcggcagccagtatgcaggttctgacaagggtccagatggtatgtacgaagaccagcgggcgaaactggaggccgatcgtcttgaccgggatcaccctctccgctgatgatatggaccctgacgatggggacccagagccccgcaatggtgatgctctggacaggatcagttactttgacaaaaggaaaagcctttcctctgttgatatggaacctgatgatggcagcgagttgcacaggggtagtctggttggaaaagacccagttacgttctcatcctctgtttacaatgcaactgacgctgagaaagaagctaccgagagtgccaaggagaagactgaagaaagtccaactcgccaaaatattgaccctgtcactgattcgtccactattgttgcttccggtgacgagagcaagcctgacggttctggagccccacgcaatgcatggtggcagaagcaacttatatcgctgtacaggagcgctaaagagagcaacaagctctggcctatcgttgtggctgctgctgctctgatggggatggcgtatttccggcggcgctggcagaagggcaagctgcagcttcagcaggtcaaattgcaacctgccagcagcaaggagagaatcaaccaggccaccgtaccgcttaaccgaatcaaggacattcttgtcgctggcaaccacccgagtccggctactcacggaaatgctcggttgggctgatgatgataaccatcccgcctgacggatgatgtatcctgaaactagtgtatgcaatggagaaatacccgatgccgcagaacgtatgggcgtttatgcgtgctggctgtgtaattaaaccccaaaactcctcctgggcatgtaaatatacacgagttttgtgtggttgctttccctcctttggaagaaaaaaaaaaaaaaaactctctccttggccagg

SEQ ID NO: 20132 - DNA, 715 bp, Triticum aestivum
  Clone ID: PAT_TA_20132
cccacgcgtccggaaaaggtcccagttgatggtgttgtcatcaaaggccaaagccatgttaatgaaagtatgataactggggaagcaaggcccattgcaaagaaaccgggagacaaggttattggtggtactgtaaacgataacggtttcataattgttaaggccacccatgttgggtcagagacggctctatcacagatagtccagctagttgaagctgctcaacttgcaagagctccagtacagcggttggcagacaagatttcacggttttttgttccaactgttgtggtggctgcatttcttacatggcttggctggttcatacccgggcaacttcacctctaccctcagcagtggattccaaaggcaatggatagttttgagcttgctctgcagtttggaatatctgtcctagtcgttgcatgcccgtgtgctctgggattagctaccccaactgctgttatggttgctactggaaaaggtgcttctctaggtgttcttatcaaaggtggcaacgcccttgagaaagctcacaagattaaaactatcatatttgataaaactggaaccctgactaagggtaaaccttctgttgttcaaacaaagaccttctccaagataccacttctagaattgtgtgatttaactgccagtgctgaggcaaacagtgagcatcctctatcaaaggctattgttgaatacacaaagaagc

SEQ ID NO: 20133 - DNA, 1887 bp, Triticum aestivum
  Clone ID: PAT_TA_20133
cgaattcgcggccgcgtcgaccgaaaagttagctgttgcggtctccaaagcaatgcgtagtcattctcttcatgaaacaaagagtgatgcccacgcgtccgcccacgcgtccgcccacgcgtccggagcaatactcaaagaggaaatggaacgttctgccgatgtgctgtcggctggtttattggaagtctcggatccttccctctcaagtagattcttcctgaagcagcattggatggatgagcaagataatgtacaagattctatcaagcacaagcctatttgggaatcttacatgcccagaaataagaaagaaaagcgaggagctggaaaaaagaaacatggagccatgtacagaacttatggaaccagagtgattccagtctttgtattatcattggctgattttgatgctgagcttatgatggaagaggaaagccttgtttggacaagtaaagatgttgtcattgtattggagcataacaataaaatgattcctctaagctacgtgtcagaaacaactaggcagtttgcgtatccatctctagcacagcgtcacatcttggctggtttggcttccgcagttggaggtctgagtgcaccgtatgaacgggcatcacgtattcatgaaagaccaattgtgaactggctatggtctgctggttgtcatccttttggaccattctcaaactcctctcagatcagtcaaatccttcaggacgttgcactgagaactacaatctatgcccgggttgatgcagctcttcgcaaaataagggacacatcagagtccgttcaatcatttgcgtcagatcatcttaagacgccattaggagaacctgtcaaaggtaataaaaacaagtctagcactgagttatgggtagagaaattctataagaaggtgaccacaatgccggagcctttcccccatggccttgttgaacgtttagaagagtacctggataggcttgaggaacaacttgtggatctatcttcattgctctatgaccaccgtctggttgatgcttctcaaaacagtaccgacatccttcagagcactatatttacagaacagtatgtagaacgtgttctttctgcggagagagacaagatggagtgctgcagcattgaatatagtcacccgaaacagtcatcccaggcttttgtctatggagggatccttctggctggatttcttgtctactcattggttattttcttctcttcaccagttcgataactcgcacaaccactggatgaaggcggttaaggattttctctatgatgacaagatgggtatgtcaaggacgacgtctggttgaagccatgaactaacgttgtgtggtagactattagttagggcttgtgtcttcaaaaagaaaagaaaagaaatattaggggctatgtcggattgtagcacaattttgtctatgagattgttatttttcagcacttgagccgtaggaatctccatgtggcatgtactacctccgtatcaaaatagaatacgtttttgtaggctaaactagcattcaaaaacgttttactttttgctacggaggtaatatccgattatcggctcacttgtcagtgcgcaacgattttgatcgtcccccctcttgcaacttgctaccgcatagtatatatagagatactgtacaagacaatatcacaaccgcctttcatggtgtgagtaaacgctttctcttctcttttatcaaaacattggacattcactcatgtccatttgtgtccccctctccccctctttgtttttctgtttttttggtggagagagtttcccgcctattgtgtttagagcaacgttcttacatctgcaacctccaaagcgtttttgttttggaggatgctctattctctttgttt

SEQ ID NO: 20134 - DNA, 1078 bp, Triticum aestivum
  unsure (1)..(1078): unsure at all n locations
  Clone ID: PAT_TA_20134
ccacgcgtccgcggtaagccagcaccggcagcggggctcctgcagcagtatcagtaccagcagatgggcggccagacaggggccagtgagccgctccagttcaccaacgacgccgcgttctggaaccagtctgccgggttcggcatgggcatggcagcgccgccggcgactgacaacactagcgtgcgtttggcgaaacaaccggcgccggcgccgcgtggggcaaaccttgcacttaagactgtgctagaaagtgtgggagattctagctcaatcgtcaccaagaaagcaagcggcgagccggcgttcaagaaaccgagaatggagacgccgtcgccattgccgaccttcaaggttaggaaggagaagctaggggacaggatcacagcgctccaacagctcgtctctcctttcggaaagacggatacggcgtcggtgctgcacgagaccatcgagtacatcaagttcctccacgaccaagttggtgtgctcagcgccccatacctcaagagcggccatcatcagcatcaagtgccacagtacctcaagagctcgagcaatggtagccccgacaagtcgtgcaaggacggcggcgaggtgcccctcaagggccgggggctgtgcctggtgccgatatcgagcaccttccccgtggccaacgacctccccgtcgacttccggcaccccttgcccccagcggcgtcatcggcagcaaggccgcatcctcctggtttgctccccctcaccatggcggctgcgcctccgcgctgccgtcggcctgcctcgtgccctcccctacttccctggtccgcttgctttaantccaaatgcatgtcgaatgcaactttaatgtgccgcccttcggcaaanctcacaatgtancccacaatctgangacgnggaagggtcctaaggccggggtttccgngcaatcagaacttcctgaacantcctnatttggaccttggccattngaagaaacnccaggtttantncccgttataancaagcgttttnaattccntcaatnnacagnaattaantcccacaggtntttggacaaacttaggtaaggcnt

SEQ ID NO: 20135 - DNA, 637 bp, Triticum aestivum
  Clone ID: PAT_TA_20135
ccccgcgcccccgcgggtccctccccgaccgccttggcgcccccgtcttccccctaggcgccatgccttcccctttctgcccgaagggggcgatgcgccgcccgctttgcccgacgggacagcgtccccccccgctttttgctactggtcgctggccgtctcctgaaacctatgacattgcttctgatcttccatttggatttcagtggtgcccttttaatggattcacacaactagcatccgtttttgaggagggtgaagcggagccaccgtcttgtaagcatgttgacccagatttttaactaacgaaatttctatgtcgtttattgattttttaaaatttttatgaagatcatacagtcgcagaccattcgagtgctgcaagcacgttcacttgtttgtccttatctttcactgcgtggttttctccatcccgtgcatgtgcctcttggttcaaattctggtgctgaaggcgcttcatttcatcgccatccaactagcttggtgcgcctggcccctcctgtcttgggcgtgagcccagctagctgtctaatcctcctgtgccgggcatcccggggcttgcggtgcccccatttggtggactactcccccggtatcgggcctccccccatcaatt

SEQ ID NO: 20136 - DNA, 647 bp, Triticum aestivum
  unsure (1)..(647): unsure at all n locations
  Clone ID: PAT_TA_20136
ccacgcgtccgcaaccaccagcaaagccgccgctcaccgccgatcggcccacatggccgcctctatcgccgccgccgccgccgccgcgtccgtctcccacgtccttcccgcgccgaaacccaagcccagaaccccaccccgcctctccctcctcccccgcaggcgctcccgcgccgccggggccatctccgcgtccgcgtccgcggcctccgacttcctcgccccggtcccgtccctcaagtcccgcctcgccgcgggcgacaccctctacggcctcttcctcctctccttctcccctacgctcgccgagatcgccgcgctcgccggctacgactacgtcgttgtcgacatggagcacgggccgggcggcatcacggaggccctcacctgcctccgcgccctcgacgccgcccgcacccccgccgtcctccgcctcccggaggcctgccccgtctgggcgaagaaggcgctcgaccttggtcccgcgggcctcatgcttcccgccgtcgagtctccggccgctgccgcggaggctgtatcccactgccgctacccgccccgcggcgtccgtggcgctgcctacccaatcgtccgcgcatccgcctacggcctcgacgactcctacctctcccgctgcgnnnatgaca

SEQ ID NO: 20137 - DNA, 863 bp, Triticum aestivum
  unsure (1)..(863): unsure at all n locations
  Clone ID: PAT_TA_20137
gctgtgcagtgatgcaaacgtcttgccaaaacctgagcatgatatctgacaattcatctcctacacgcacccctcctatgtagtagtagtagtagtagtttccaccactggcttctctcgtggtgacaagagcccttcggtacagcttgggaaacaaaggtacccaaaaagagagccaccatccggttgcttccgacgaagagtcgcttttccgcgcgtccgcatcggcaaccggtgagcagggtctggattgaactgcccgcagccgccttcttcttctgcggcttctggttgttgaagaggtcctctgcgatggactccatttgcttccgccgcttctcctctctcatgaaatcgttcaaggtgcccttctcataatcagactctctgtatggttcttgtgcacatggaataagggccttgaagctgtttccagacacggtttgcctctttttgaatccgtttgaagttaacccctccagttttctgtcgacgcggcaaggacctgggccgaaaggacccttttgacaatcagatcttgactgaaaattacaatgacaagtcccttccctgctactgtccaagttctcatccttaagcgccttgttcacgaaaacagcatcacaagcctcatcctgcaccaccttgttgataacctgaacatcctcacctccagctctgaacccagaaattgttgttttctctatgacctgaacatcctcctccatgggttccgaaatttcttctttctccaggtcgttctgaatattgatgctgacgtttgtttcttctaaatttacagcactcacactgcttgtaactttactttctgctttatcgtcagacatatgctgaatatggtn

SEQ ID NO: 20138 - DNA, 641 bp, Triticum aestivum
  unsure (1)..(641): unsure at all n locations
  Clone ID: PAT_TA_20138
ccacgcgtccgcgtgttaattcttcctcgaagtgcagacgagcgtgaagaggtgtggttggaaatccagagagaaagcaatcacactattacaatcctgttttctattgatggcagtggtccaaacaatgctatttcctgatgaagatgaagcaataagtgatgttggatgtgaagatgatcagctatgtaaacaggcaagtgaacactctttgcggggctgcgatggtgaacggcagacagatgaaagccgactaactctagagtgtgacaagagaagagccatcgtccaagcctgaagtgcctgaagcttcagggcagtcccaaagtattggcttgagatcagaaggaagacgtagcagatctggaaagaaagggaaaaagagacctgcgcgccgcagatcacaacagaaaatggatgaattgtcaactgtggagagcggaagtaattattcttcacgaagagatgatgatactgtgatgagtggccgggaccaagtcttaagttccagttcacgatttgcttcccccgnnnaatccaaaaataagctcnnntcttctgctgaatctccaatggaaataatttctgaacataagttgcctgcnnnncttggtagaaagcctcctgnnnnncttaaagnn

SEQ ID NO: 20139 - DNA, 783 bp, Triticum aestivum
  unsure (1)..(783): unsure at all n locations
  Clone ID: PAT_TA_20139
ttcaatgtaggctctgccatcggcttgaccattaaaaatattccaggatcttctcgtgctattatctctcgcaataagcttgccacatttggtgaaagaaaccaagataaggatacggaaaatgggatgcctaagtccccgcctccggccgcgccgcctcctgtcaggcctgggtggttgcttctgcctgtcgcaccccgtcctttctcgtcccgcgtcgtgttcgacgttgcagactcccccgcggaaatgagggagcatggttatatggaaagaaaactacaactactgcacaatatcacaggagcatttcagccaggggttctctcagcccttatgggggttactggagcgggaaaaacaacactccttgatgttcttgctggaaggaaaacgggtggtgttattgaaggggatataagaataggaggctatcctaagatccagcaaacttttgctacgatatcatgctactgtgaacagactgacgttcattccccacaaatcacagtgggtgaatcagttgcatattcagcctggttgcgccttccaccagaaattgattcaaaagcaagaaatgaatttgtaaatgaagttcttgaaacaattgagttagatgaaattagagattctttggttggaataccaggggtaaatggactatcgacagagcaacggaaacggctcactattgcagttgagcttgtgtctaacccttcaatcatattcatggatgagccgacatcnnncttggatgcannngcagctgctattgtcatgcnn

SEQ ID NO: 20140 - DNA, 724 bp, Triticum aestivum
  Clone ID: PAT_TA_20140
gaaaacgtgctttccgtcctcgtggggccggggcacagttatggtataggtctgggttcctagtcgatgcacattttcctcgcgtccgagcagagcagataagataaggttcgtgttgctcgaagggcaggcgcctgaagaagacgacaccattgatggggatgggattcctacggcagctaatcagccgattcccactgattgaagcggtggacgacactgaatgcatgtgagatccgctgcggcgaatggctgccttgacggttgttggtatggatcaagtgccggggccggccgcgagtgcagacgcacagatctgctcgagcgtggtgtggttggcagaaagaagaactcgtcgccgccctcgcaggtctccacgggaaggccagcccacaagctcctcggtggttaaagaggttagtgcccaacatggtaaaggtacatttcttttgtggatatagtagtacttcgttgtaagaatccattagtgatctggattagagtcatgtctgatcggtgaagtggttagtttttcgttcaatgggaattattgctactgtctttgctaaaaatggtaaaagtcggtagaacagaactaactagcaacgaccaatgttactatgtaaattactacaagaagcctacaggcagtgctgtaagaccttggatttaaaggaattgcttctgacttgaaataactactgctgctgaacttcaactacta

SEQ ID NO: 20141 - DNA, 967 bp, Triticum aestivum
  Clone ID: PAT_TA_20141
tgccaagaaagtaaattgcataatccacttaggtccatcttctgtgacaaacactgttgattatcagaactggatgaaatcttttggcaccacacagcatatcatggcagggcatgaaaataaaaacatggaagttcctatcctgaaaggtagtgcaaggatatcttcacgtcttaattttgtatgccctcagctcttcccatcctctgggttttggcctgtggaacctgcaaatggtattgatttagagaagaataagagtacttcattccaagcctgtgaaagtgtgacagcagcaaacgtgctgcagtttcgtctgcgtccatatgctcaactggggttggatagagcttctattccaagcttgtttagttatgaagaaattgtagatgaacttatttctgagattcctgagattaaagaagttcctgagcagattagcaagttctggcaaagtagtgtagaccaaaaaaatgcattggcaccagcagggaaacatatgctgatggttgaagagccatggattagtaaagactcctgtcttcctgatattttagatgaacaggggaattcaggtaagtttcaagatgacagtagtttgagagaaagtgtctggagaaagcgcccaaagggcaattcagagaccccctgctgcgtggagaatgctacgagagaagatatggaaattacgtttttgggtacgggttcttcccagccttcaaaatatcgaaatgttagttccatatatattaacctgtttgcacgaggaggtatgcttcttgattgtggtgaaggaacgttaggacagctgaaaaggaggtttggtgtaagtggtgctgatgaagctgtaaaaaacttgaggtgcatctggatttcccatattcacgctgatcaccacacgggtctcgctagagttcttgccttgaggtcaaaattgctaaacggtgttcctcacaaacccttgctc

SEQ ID NO: 20142 - DNA, 932 bp, Triticum aestivum
  Clone ID: PAT_TA_20142
gcgggggcggggtgcggcggcccctccggcgtccgccccgtccccctcgccaccttcgtccgctcccccggctgccgccgcctcccgggccagtgcgcgggggaggtgcgaccgaggctctgagctgcgcgatctgcacagcccgatcagcaagtcccgggggcgggtggattatttggtgaggtacaacacctgtttcgacagtgaacaggaagccgaccatcccctcactgaagccgaagaggtgttcttggatcggctggaaagccaactcgaagatgacagaccagagggaagcacaagcaaacagcacgaagtaagctccgagattgtggaaatggaggacgatcaacctgagctgaaatctgaaaccaaggcattggaggacatagaagaagaagaagaagaagaatgtgcagagttattgaaatgatacagagtcttgtgttcttgggcaggtagatcttgtggtttttactctctggtggattgagtttgtcaacatctggttgaaatgtattgcttgtagtgtctgaacttaactctgctggtgctgggatatggccatgtgggtcattcatatctgtcctgccgtaggacaccaccaggattcactgctgtatggtcaacagtgttgtatggaaatgactttctcaatacattgatcttgaggacccttccagagcgtgatgatgtggctcctggagattacactccatactcatctccagcatcttccggtcggcattctgatgccgaatactatggcagtgagcgggagatgatggacagaagcttgacctgagcgatatcacagccagttcacaatccggggggcagggggtctccgctatgggcattagtgtgcactcgatgttaaaaaaaaaaaaaagaaggaagggagaggggagagaggaggggggggaggagag

SEQ ID NO: 20143 - DNA, 616 bp, Triticum aestivum
  unsure (1)..(616): unsure at all n locations
  Clone ID: PAT_TA_20143
atggcacacatcatcctactctatggtatctacgcttcttctcgttgcagtccagtgcaacaaactggtgcagttaagcagaagagtaatgatgtcagtggtagggaggctctggacaaggctcgctctcttgttctactgctcgccactcttgccgccaccatcacctacacagcggggttggacccgccgggtggcgtttggcaggacaacggtgacgggcacatggctggcgaccccatcctcctcgcgacaaacgctaggaggtacaaggccttctactactgcaactcggttgcgtttgtggcctcattggtggtcatcatcttggtccagatggagaagctggtcaagcaccatgtgctgggaggcgggcatgatactcgacctgtttggcctcatcgggcgcatatgccgcccggaactgtcggggcgtgaatacccccatttacgtcatggcttttggcaagcgcctgccctatttaatgttggngattcaaaaatggtcctttttaanaactggngcttgggtttaacaaaggnccaaggaaaagaccaccaattaaaaattnngtttncttggganaaaaaangngcnaaaaacgggtgggncccc

SEQ ID NO: 20144 - DNA, 943 bp, Triticum aestivum
  Clone ID: PAT_TA_20144
cgctcttatattagtttacagaggaagtactagtttggcactgtatctaacccgtactaaaatatttcagcagttcaacaggggcgtggggttcagttcgaaaggtgatgacccaggcagccgaccttcgcataacgaactggtgcagtttgatcttgtgtgaattggaaatcacctgatgctgagtgtgtcagtacaaccctacgctacaagtagagcaaatactattttttatgccaagtaagttcaaacagaactgaaagtggagtacttgcatcaactcattggaattggtgtgtgtgcttgtagcaccgtcagttcagatcctatctccccgcctccgtcctcactcacgctggtggtcagcccagctcctgcaaccaacacaggtcgttgccccttttgccacaacggcagcagcacaaacattagtgtggtcgtcctcaaccagtccctcacgcggcctccgcgcaagccctgctcatgtatgcttacaccaaaacagttcaacaggggtgtggggttcagttcgacggtgacgacccaggcagctggccttcgcataacgaagtggtgcagtttgatcttgtgtgagttggaaatcccctgatgctgagtgtgtcagtacaaccctacgctacaaggcatgcgtacatccacttcacatgttagtcaatagaattgtgcattttcttggtacctttgctactctagccaaaaatattttgttgttcacttttctgtgcaacaggagtagagccgtttgagatgctatgttctagcgaggtggcttattatgtttgtcagaatgtaatactttggccgcaatgtacttgtgtatctttttctgaacggagcacgaacaaagattatgtcattatgaactttggttgtgatggtactacaaactctataaaaacaccaataatccaattttactgtt

SEQ ID NO: 20145 - DNA, 768 bp, Triticum aestivum
  unsure (1)..(768): unsure at all n locations
  Clone ID: PAT_TA_20145
cggncgcgtgggcggcgagaaccccgtgcggtttgcttctcgtctcgtctttcctccgtcccggcgtcaaccgaacgacccgcccgcccgccgtagatcaccaggagaaagggatcggctccgccgccgacgccgagagaggatgagctaccagcaggtccctccgcaggagtcctacccgccgccagggtattcgccggtgtacccgccgccggccggcgggcagcagggcccgtactacccgccgcagcagcagcagccgccgccgcctccggggtaccagggatacttcagccagggccagccacagcagccaccgccctactactacccgcccccgccgccgcacagtggccatcaccaccacggccaccaccaccatgaccaccacgccgaggaccaccaccaccaccatggtcatcatcaccaccaccaccacaacgacgatgactgctgccttggcttcctcaaaggatggttggccgctctatgctgctgctgctgtctggaggagtgctgctgctgtttctggtaatgtgcgtgcttggaagctactcgtgtcttgcatgttcgacattgggcatgccgcagtatccagtgaatcttctggcttgttattatgtgtagctatatgaacttagtctgttacctgtgtcaaataaactgtgtttacattgtttgctgaactgcttgggccatggatgaacggtgttgtgcaaagtgtacatgatccagacttgactgtattttattggtttggattggggg

SEQ ID NO: 20146 - DNA, 2862 bp, Triticum aestivum
  Clone ID: PAT_TA_20146
gtccgcgcgtccgacgcctgagccagtccacctgccgtcttttaccacaagaaagataccgaattcgcacccaaggaagccattcaaaagactcaggccgcccggcggacaccgcgggctgagacgcctccgctgcgcgagcaccaccttcctccgggtccccacccggggctcctacacgacgccagggaattcacgcgtgccccaaccgccgaccggcgggcggcagcgcctgtcctacttgccgtcccagtggaaggccaccatggccaccacggataccacggacaccacaaccatgggcaccaacagcacgcctaccacaacaatcatgtccgctgccttgggcttcatagtggacattactatgctcgatgatgacccccatgcccagaacaccggaggaccatctacaaagcttgtggtcacaaacaaggccatcagaaggcagtcgaagagcaatgcagtggtcaggtcgaaggacagtagcccgatccttgctgatacaactctccattggagtttttcgactgtttgaagaaatgaatgcccgtgtacattagtgaatgagtccaaggcaagacattgagtaagacgtaggtgcaggccataactcagccactttgatttgggcaggaaaatgaccgtgatgagaaagatgtccggaaaaacgagaaagttcaggcctacctgtacaccatcattaaggttcgaagggaagacgagttaactgctccgatagggaaagatataggtttttatcttgttgatcatgataaaggcccgatccttcgtattcaatagtagatgccttttactcaattcaatgaggaggtagcaaatgaattgggcatcccttcacagatcttacgattttggtcgtgagccaagcggcaaaaccatacctaccgacccaatcgaccgttgactcctcaagaagaagcactaactgttgggcaattaaaggaagcagcaaacaaggcccacaacgcagaactgaagttgttcttggaagttgaacttgggctggacctaaaacctcttgctctaccagacaagaccagagaggatattttgcttttcttcaaactctatgatcctgagaaggaacagctgcggtatgttggtaggctctttgtgaaggcttcaggaagaccacaggatattctgccaaaattgagaaaaatggctggttttttgcaagatgatgatgttgaactttacgaggaaattaagttcgagccaaatgtgatgtgtgaatacattgataataggattatatttcgctcttgccagctggaagatggtgatattgtttgttttcaaaaatccccaaagccagatactgctgaccagtttagataccctgatgtcccatcgtttctggtgtatatacgtaacagacaggttgtccacttccggtcgttggagaagcccaaggaggatgatttttgcctagagatgtcaaagattttcacgtacgatgaagttgtagaaaaagtcgctcaacagcttggtgttgatgacccatcaaaaattcgtcttacatcacataattgttactctcaacagcctaagcctcaacccattaagtacagaggcgttgaacgtttgctagatatgctgattcactacaatcagacttctgatattctgtactatgaagtattggatatacccctgccagaactacaagcattgaagacattgaaagttacatatcatcatgccaccaaggatgaggtgtctgttcacagtataagattgccaaaaaatagcacggttggtgatgttctaagtgatatcaaatcaaaggttgacctgtctcatcctgatgctgaacttcgattacttgaagttttctaccacaagatatacaagatatttgcacccagtgaaaagatagaaaacatcaacgatcagtactggacactgcgtgcagaggaggtaccggaggaggagaaaaaccttggtccttttgatcgcttgattcatgtataccattttaccaaagacactcaaaaccaaacgcaagttcagaattttggagaacctttctttatggttattcgtgaggatgagaccttatcttctattaaagaacgtttacagaaaaagcttaaggtctcagatgaggatttctccaagtggaaatttgcgtacatatcccttggtcgcccagactattttgaagattctgacactgtagctacgagatttcagagaaacatgtatggagcttgggagcagtatcttggactggagcacccggacacagcgccaagaaaggcacatagtgctaaccagaaccgccattcatttgagaggcctgtaaagatctacaactagacagttgtgagaagcgggagcgacgtcctgccatgcaataccaccaagcaagtggctgaaagtgaaattgctggcttgaataaatcgtgtgccatatgatggcaggactagttgctcaagttaatgacggagcctgtaagctagcgtttccgcgcactctgccctggatatataaagtttgtgcagagatgacccaacgaaccatcaccttttagtagataaggaggctgtttttcttttcttgcactaggtgctctatacagtcaaatagctagtggattgcttggttctgcagttgttgctaggtgcagagttgttgatgctttttctgtatattattgttgtgagctgtacaagtccagtccttgttgacggtcacacggtatctgtaactccagtgatgatatagtgctctgcgtcttttcacaaatttgtattaactgactctcctaagctgtgctacagggctattaccgcacctgactcgaaataagcctccaaaaaaaaaaaaaa

SEQ ID NO: 20147 - DNA, 664 bp, Triticum aestivum
  Clone ID: PAT_TA_20147
caacggcgtgagtgcgcagcatacgcagatcccatttattaacacaactcacaccacccagacagagagcgagagacaggcagacaggggagagcagagcagcggcagcgcccacactcgcacccgcacccgcacccgcactcccatccgccggccgcgccatggcgtcgggggtgtcgacgagcatggtgctcacgctgctcggcttctgcgtcagcgtcctcttcatagtcttcgtctgctccaggctcgtctgcgcgctcgtgcgccgccgccgccgccgctcccgcgcctcgccgctaccgccgggcttcccgcccctcgccgcgaactacttcttcgccgtccaggtcgaccgcctgggagcccaggccgcggctggccccggtgccggggggctggacctggccgccgtcgcctccttccccacccgcgccttcgcagctgccgcctcctccgactccgactcctcagacgcggccccgcagtgtgttgtctgtcttgcagaatacgaggacaaagatgtactccgcactcttccttactgtggccacaatttccatatggtgtgcatagatgcttggctaaagcagcactcaacgtgcccagtctgtagaatttcactgtctgactatcccgatagcaagcaaaaaaaaaaaaaaaa

SEQ ID NO: 20148 - DNA, 654 bp, Triticum aestivum
  Clone ID: PAT_TA_20148
ccacgcgtccgacgaggtcctatataggagcagcgggtgttccgaacttacagaaagaagaaaaaaaaaaagaaatcccaccccgaaccccacgttccccacctctccctcctcgctctctccctgatccctgccgccgccatccccgcccccgcatcgccatctacctcaatccaccccgcacgccggcgccgccgtgaccctcgcacctccccacgcgccaccgctgctccactccgcctcaccagctacctacctctcccccacccgagtcctgcttcctactgccgccacgcggatctagccgccgtacaggatcccgccgccgcgtttgtcgcttgctgggcccgaggacgcgtcggaagctgacccgtccgtgatctccggccaacgaggcgcggcggccacccctccccctgtttccacggcgctcgacccggatgcccgtcgccggcgctcctcctccccgaccccttcttccctgatccaccccgcctccacctccggtgacgcggtccaccagtctccttccccggtgcgagccaccagcctgaccctcgtcggcgtgatgcccctgcgcgccgtcgtggcacaggcccccaccagggatccagccgcgacgtactactcaaaagcaaaagacaacgatgagat

SEQ ID NO: 20149 - DNA, 905 bp, Triticum aestivum
  unsure (1)..(905): unsure at all n locations
  Clone ID: PAT_TA_20149
ggcatcctcgggccggacaccggcggtccgtgatagtaggggcgaccatatccccccattctgattctgcacggcacagcacagcacagcacagcggagaagaggaaggagagcagagatgactgcgtccgtctcctacgggctgcgagcacttccgacgtggtccagctctgtgtccggtgacgaccactgctcggcgctggccatgtcggtgtcggcgcgggggccccggtggacgcggccccttcggacgccggcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgattaccgagttctgtaagaccatcggcgctgaccccaagcagaggcagggcttgatccgcctcgccaagaagaacggagagaagctcggattccttgcttgacctgcctcacaatccccctttccttctcctaccttttctactagcaaaaaggaaattccttggagttggagattgcatgcatgcatgtatgtatactagtatactatatattttttcttcttttcttctcttctcttgtggagacagcactgagttcagttaaatttcagttcccatgtggatggatggatggatggatgatgtatctatcctctactgatgatgacctcagcggtagtatatatatgcgcaatgctactggataaataattcaaataatttgtctcaataaaaaacctgcccgggaagccgctcgtttnaaaaaaataaaaaaanaaaggcccccctagggggccctccaggggccccgccccaccttgaaaccactccacccttatttaaggtttttttggggggg

SEQ ID NO: 20150 - DNA, 602 bp, Triticum aestivum
  unsure (1)..(602): unsure at all n locations
  Clone ID: PAT_TA_20150
gnaaaattgacgattngagtgcaccttccaaaggtcggactgtcactggctggatagagcatcctgggagatatgttgattttttaatcgtcaatgtcaaggacttgtctgtatttgatgtcgcgcgtgtaagtcttgattgtgacatgcagtttgaaccttataggaaggtagcagctgtatggcgcaatttcagttcaggacttttaggggccacaagcggagtagatcttgcctctctaagcgctctaaccagtgagacaatgttcagcacatgccagatcaacaaggctgggattggaggcccccttgttgattttgatggtaactttgttgggatgaactgctctcgtaccagaaggaaaaagaccccctacgtgcgaagggagcaaatccttcaattcttggagtattacaggatggtcagtgttagagctaaggaagagattgatgatgctgaagaacccggaatcgaaagtgagatgaaacaactactttgcagcattccaggaggcaagcgtaagattcattttcttgaagcaaatttcgtcgacgatatctggagtaaactacccaaaggcgttgcttcaaaaatgtctcga

SEQ ID NO: 20151 - DNA, 1552 bp, Triticum aestivum
  Clone ID: PAT_TA_20151
gcggccctgcagtttggatttcatcaatgcgtttgatctcaccagcgcgttttgagttcgccgtcaaatccgatttcgcgggcagctagtctccccacgttaaaatgtacaaccagtgagacgtctttttacttatcacagtataatggctgcaaagggcaagttgttgattggcaaacgaagcaagctcgattgcgaagaactatgcgtctccacgtgtaaaatcaccaaggctgggattgggggcccacttattgacactggtgggaattttcttggtatgaacttttaccatgaggaagaaactccgttcctgccgagggatgttattcaccgcctcttgttgaacttaaataaaggatggactagggcaggtgatactattgttgagggtgacgaaaagagatggctgttggctggtacatgttggtcccatggaaatgctgatactattgccgagggtggtgtcaacaagtggccgttgcccgagccatgtgtgctccctgctgatatacctgaacctactacattggatttctacaagctggataggaggcagtgtgctttttagtcctgctactgctcgtggtatggatttttataatctggataggaggcagtctgctgtttactcctgctattgttcgtggtaattgataatgtgttcatgttggttggctgtctgacgtccactccagtctttgtgttgcttggtctgtttacgtgtcgcattccacgatgtatgtaaatgagtcatgtctaaacagtgaagtactacctccgtcccataatgtgagacacttctgtaagctaaattctcgtggcatggaagaaagttgccactatctacaaacattggaaataagatggcatagacctttatgatgaggaagaaactccgttcctgccgagggatcttatttgccgcctcttgttgaacgtaaataaggaatgggctagtgcagatgatactattatcgaggatgtcgaaaacagatggttgttgcctggcgggacacacagaaacactgaaactgttgcaccgattgatggaaacaaatggccgttgcctgagccacgcttcgttggtcgtagagccaagcctttgccacgtcaaaaatggcctctgcctcgtggccgaaagcctctgcctgtgtgaggtcacgtttgttgtagagccgacgatcgctgctagtattgataatggtttcttgtccgttggtgctgggacctccattctgagctgctcgagtactagtactaatattgctttctccatgacagactcctgcgtatctatggtttctgttggtagttggctgtcagtcctccattctgaactgtttgctctgtgttgctagagttctgttaccatcaaaaccaattaatgtcatggtattctgtatgtgtaagtgggtaaaccatgtcacaagcccatgtgctctaagcatagtggtgtccagtgatttatgttctttactcgtctccccggtaccaagcagcacctgtttgttgatcttcttgtggttatattacgactatggattggtgc

SEQ ID NO: 20152 - DNA, 655 bp, Triticum aestivum
  unsure (1)..(655): unsure at all n locations
  Clone ID: PAT_TA_20152
ccacgcgtccgacccaatatcatcactcgaagtaagaatggtcaaaaaccaatcactcctaggcatttatatagaatagatactttgaggcacatcaaactagaatttccctcgggttaattgaaagaagtagtgcattctatggccgtacgaaataatgcatttcatcatcatctcctagcatctgccagtcaccctaatcttccccgtccactgatgctaacaaaagtgcgatatgattagctttttggcgcccatgatgaggatacaatagtcaactatgcattgcacattagaagacagtcttgagtttcatcaatacagaacgtggtacaccctagacggttagtgtcagtaggggccaatcaaatttagttgtagacagtgacaaagcttgtgttctgatgaggggtgcccactactatgtggcccggttgcagatatagttgttgacgatgaccatgccgtcagatgaggcatggacgttgaatttagctaaagagttcatataacccattgattagccagaactgaaccgatctgtgaaatctggacaaaacttggcgctcctgagttggacgacttgaacactgagaatgtggccttcaatgccatgggtagtttggtacgacctgattnnnnncagctcctgcta

SEQ ID NO: 20153 - DNA, 716 bp, Triticum aestivum
  unsure (1)..(716): unsure at all n locations
  Clone ID: PAT_TA_20153
aagacccgccgtgtcacccgctcaaaagcttcctcgacngcgggcataatccatccgagactcctagccgatcgccccccgtccggatggcgaccccgaccgtcgtgctgctgcccgtctgggccgccggccacctcatgtccatgctcgacgccggcaagcggctgctcgcccgcagcggcggcgcgctgtcgctcacggtgctcgtcatgccggcgccgggggagaaccacaggtccgaggtcgccgcccacatacagagggaggaggcgtccggcctcgacatccgcttccaccacctccccgccgtcgagcccccgaccgactgcctgggcatcgaggagttcngtctcccggttcgtgcagctccacgcggcccacgtgcaggcggccatctccgggcctggcgtgccccgtggccgcgctcgtcctcgacttcttctgcacgacgatgctcgacgtgtcccgggagctcgccgtcccggcctacgtgtacatcaccgccgacgccgccttctgcgcgctcctcctgcgcttgccggcgctccacgaggaggtggcggtcgagttcgaggagatggagggcatggtggacgtgcctggcctgccgccggtgccgccgtcgtccctcccggttccggtgatggacaagaagaaccacactacacgtggttcatgtaccacggcnnncgtttcacggnnnnnnaaggcgtcnn

SEQ ID NO: 20154 - DNA, 646 bp, Triticum aestivum
  unsure (1)..(646): unsure at all n locations
  Clone ID: PAT_TA_20154
ccacgcgtccgcgttcccttccacccccgatctcccatccccccaccctatcgaaaccattcccaagcaaaacaccctgcgcgatcccaaaccctagccatggcgaccggggcggcggcgaagactccgaccaagccatcggcccccgcggcgcccaagaccccggccaagcccgcgccctcggccgcggcgacggcggcgaagactcccgcaaggcccccgtcctcggcggcggcgacggcgaagaccccggccaggtccgtctcccgcgcgcggttcgcgcacgcctccgagaactccgaccccaacatcctcgcctcccctccccggaccacgtccaagacccccgccaagcccgccgccgccgccaccttctccgcctccgtcaggaagaagcgtgccacgcccgccccgccgccgccggtcccgcagcgccgcttcctcgtggcgaagaagggagcgcatcggcggaggcaagccggcgcgagcggaggaggcggccagttcgacttcgacaagtgccgcgaggccgcccgcgaggcgctgcgcgcgtcgcacgaggagttcttcctcaaggagcgcgcggtgtccgcggccagcgaggagcaagagtcgcagaannnnnnnnaagcggccgaagntgacn

SEQ ID NO: 20155 - DNA, 804 bp, Triticum aestivum
  Clone ID: PAT_TA_20155
ccacgcgtccgtggaagcagaagtggagccctgaggaagtctgtaatgagaaccttgatgtcacaaaggggccgatcaagatcgaagtaagcacgtgcctaagcgtgtccgatttcggtgctagcttgtttgtgatgggaggacagagtgtcgatgaacgttgttggtgttttggcagtggtttaaagggggcaaaactaacatatgccacaatgccgtggaccgctacgtggaggccggggacggtgcgaagattgccatgtattgggaggggaatgagcctgatcaggatgggaagctcacatactcagagctcttggataaggtttgccagctggccaattatttgaagagtgtcggagttgaaaaaggtgatgctgtggtgatctacttgccgatgctcatggagctgcctattgcaatgcttgcatgcgctcgcattggtgctgtgcactctgtggtgtttgctggcttctccgccgatgcaatagcccaaaggatcactgactgcaagcctaaggttgtgattacatgcaatgctgtcaaaagggggcagaaactcatccctctcaaagatatagtagatgcgtctctggttgaaagtgcaaaaaatggtgtcacagtaggcatttgtttgacatatgaaaatcagttggccatgaagaaagaggacacacaatggatagctggaagagatgtctggtggcaggatgttgtgcccaatttcccaactagatgtgatgtggaatgggttgatgcagaggatccattgtttcttctgtacctgcccgggcggccgctcga

SEQ ID NO: 20156 - DNA, 762 bp, Triticum aestivum
  unsure (1)..(762): unsure at all n locations
  Clone ID: PAT_TA_20156
aaattgtcgtgcaggctggagatttcagtggaagtgttgtctttccaaccaaatccagcaacataagtcaaaaaggttttgacgcttggtgattgtaaagtggagataactgttgcttggtccttgctcattggaagccagtatgatatctcggtgatgggatctatacagccttacgcatgggaatcaattccacgtagacctaccatgaagctcgttgacgcttgttgaagatgttcggtgaagagtcatttgtgcatctgctacttatagcttattgtgtgtatgctaattgttcgtangtgctgggatttgtcctgcctgcgggagtgttggtcggaacgtcggccctgcctcggatgcctcctgctccctgtgtctacgaggttttgagcttggtgattgtaaagtggagataactgttgcttggtccttgctcattggaagccagtatgatatctcggtgatgggatctatacagccttacgcatgggaatcaattccacgtagacctaccatgaagctcgttgacgcttgttgaagatgttcggtgaagagtcatttgtgcatctgctacttatagcttattgtgtgtatgctaattgttcgtagtactatgataagaccagcctatgataatgatttcttaactttggtcttgcgtgtatgctaattgttcctgtactatgatacggagtacaatacaanntctatattgcatcttgcttttatgtatgtatatttttgcttaaaaaaaaaaaa

SEQ ID NO: 20157 - DNA, 1195 bp, Triticum aestivum
  Clone ID: PAT_TA_20157
tgaaggtcctcatcctcgacccccaaaccgtggggatggttagcgtagtgtacagccagtcggatctcctgcggaaagaggtgttcctcgtggagacggtcgacgacgcctccagctccagggcgtccatggcgcacctaaaggcagtctacttcctccgcccgtcctctgacaacgtccagaagcttcgctgccacctctctgcgccgcgattcgccgagtgccacctcttcttctcaaatatattgaagattccacagattcaggtgcttgccgattctgatgagcaggaggttgtgcagcaaattcaggagttctatgctgacttttgtgccattgatcctttccatttcactctgaatatacacaataaccacatctacatgcttccaacggtggttgatcctcctggtatgcaaagcttctgcgatcgagctgttgacggcatcgcttctgtcttcctggctctgaagcgtcgccctgttattagataccaaaaggacatcaaatgtcgcaaaaaggattgcacaagaaactacgaggttgatgtatgagcaggaaagtggcctgtttgattttagacgaactgaaaactctccctttcttttggtgattgacagaagggatgatcctgttactccgttacttaatcagtggacatatcaggcgatggtccatgagcttattggaattgagaacaacaaagttgatcttaaggagttcgctaatgtccctaaagatcaccacgaggtggttctatcagcagtacaagacgacttttttagagtgaacatgttcgagaattttggagaccttggtatgaatgttaaaagaatggtagatgactttcaacatctttcaaaaagcagccagaattttcagagtatagatgatatggcaaaatttgtgagcaactatcctgaatatcgaaagacacatggaaatgtgacaaagcatgttgctttggtgagcgagatgagcagaatggtggaggaaaggaagcttatgcaagtttcacagacggaacaagagctagcatgtgcaagtggacaagcagcagccttcgaggctgttacttccttacttaacaatgaaagtgtatctgatattgatcgtttgcgacttgtaatgctctatgctttgcggtatgaaaaagagagtccagttcagttgatgcagcttttcaacaaattgg

SEQ ID NO: 20158 - DNA, 856 bp, Triticum aestivum
  Clone ID: PAT_TA_20158
ggcaaaaacagaaactgcggtcccgggaaaaagccttacatgtgaagttcagatctgaagcgtttagcttccgaacaaacccacgccatcgaccgagagaagatcctctgagagaccccgcccgatcccgcaagacaccaggccgttcttcctcctcagaaagttcgacatctcgccgcttgtttccggatctgagcgagggatctgcggcgtcgggtctctttgggggaggatgaactggatcgggcgcaagatccacctttacaatgtcaacatcggcctctacatgctcgattggtgggagcgctacctcttcaatacattgatgctttgccttctctggtacattctacggtatctcactgggttctttcaaagtaatctggagaccatcctacaaggtgcgaactaccttctacaaggtagttaatcatcgaaggcaaaagcacatatgttgatggctttgtggaactccccctgtaatctatgttttgattagtctcaactgagaaactagaaaggaacgacttatgcgttgttgtgtttgtagctgtcttttactgtatgtttgcattgtccatggtggttgtaatatattgatgttgctgattctcagttgactgcctggaacttatgtaaatctagtcacctcggtttgcacatccctaaacctaaaatttgcagtcccaacttttagtcttgtcatttttcttagttgggttcatcctgtccagtaattatgtaagaggatgtcatgaacttggctatgcactgtcatatgtatagccctctgtattttggaatttagcaatttttttaccttaaaaaaaatggaaaacaaaaaactcgagctatt

SEQ ID NO: 20159 - DNA, 711 bp, Triticum aestivum
  unsure (1)..(711): unsure at all n locations
  Clone ID: PAT_TA_20159
gccggcgcggccccggtcctcgaagcagtcttgggggtcctgccggggcccgggcatctccgccatcagctgggtgctgccctcgcccgcgcctggccagcaccggcactttgctgagctctccgtcgtctggctttctcggaggcctcctcgtgcaggcgccagggtccccgcacgtgctgacacctcgtacaagtgccatggaccaggcacctgttgaagacagtagaaatgaaaaacaggatgatagcatttggctgaaggaaaaatgggaaattggacagataccgctggatgagccgccacagaggcacgttagccatgtattctaataagtcctggaattttgcaattgtggaggcatgatccagtcagtgccctttaggtggtctctttctatgtagttgaggtggcatcaaagtcttctccccatgagctcggtgatgatacggcgaagcaagctggagagtgtaccgccctggacgtgcgcgcgggtcgatccgctgccgggctcggcgccacgttcctctgcttgcccccgcccttgcctgatgccttcttgggccagagcccgtagagtcgagcagccgcagctgcgcgctgggctgcaggtgtttgggacatgcctcagtcaccgcgggatgtgtggaggaaccaaagtaaacacgaactgattctagccgaacaaaaaggaaaaagagtgtgaagnnn

SEQ ID NO: 20160 - DNA, 658 bp, Triticum aestivum
  unsure (1)..(658): unsure at all n locations
  Clone ID: PAT_TA_20160
ccacgcgtccgtcaatctcgcaggtaatttacttgctggagtgattcctagggagctagggcagtgtcgaaacctcaagtttctcaacctcagttccaatagattgtccggttcgcttgataaaaatcttcatctgcattgcatggatgtgattgatgtcagtggcaacaaactctcatgctcaattccagcgtctgcgaacaaagagtgtgcgtcacagcaaccgttggatggcgtgacatctggctattcttcacccttcatgtcccgagctgtagcacaactatcattgggttactgtgaatcaagagagtgttcagttgtataccataatttcgcaaagaacaagtttggaggccgtcttacatccttgcctgttagcgcacacagatatggaaacaggaccttgtatgcattaattcttgatcacaataacttcactggatcattggatgcaattctgttggaacagtgcagcaacttaaatggtttgatcgtcagcttccgagacaacaagatatctggtgagcttacagaagaaatctgctcaaaatgcaatgccatcagagttttggttctagccgagaatcaaatttcnnnagtgttacctgctaacattggtttgttgggtgctcttgtaaagatggacatcagcnnn

SEQ ID NO: 20161 - DNA, 245 bp, Triticum aestivum
  Clone ID: PAT_TA_20161
ccacgcgtccgggcgagttggtgcacaaatttattctatttagtggaatctgtatccgctaatgcctaatgggatggcatcgaagataaatagttcagtttgtatcataaaatgttccctctacatgagagcattcatattcctgtgcactcatgggctgtttgtgtatcatgcctctctgtttgagtttgtactacattcctttaagaagaagaatcggaaaaataaacaacaaaaaaaaaaaa

SEQ ID NO: 20162 - DNA, 755 bp, Triticum aestivum
  unsure (1)..(755): unsure at all n locations
  Clone ID: PAT_TA_20162
ccacgcgtccgnngaagtggagcagcaggtagagaaagccgtgcaggagcttttcaccaaggggtccaaagcccttaaggatgaggacttcttcggcgctgaagactgcaaacgcaggatccttgagatcagggtggcacatcatggtaaactttctccaaagtgtcgcagtgcatatcacaattacggatgtgctttgctacagaaagctctaccaaatcaggattcagtgaagagtacaaccacccaaagtaatactgaaagcgacatagtagaggatttggatctggcctggaaaatgctgcatgttgcaagggcaatatctgagaagagtcctggcagcactactgagaaatataaactctttgctgctcttgctagagtctctgtggaaagaggagacacgaactactcactgattgcgtgcttcaaagctttggccaacatggagcatttgcttgagcctgaccatcgtcatattatcaaccgtatccttctcttgcgctgtgcctgcgtgttgcggccctcgcctggggatgccatcgctaccgcatcccgcttctcccgggtcgtgaacctcctgcgggcgtgtcctgcggtgttggcggatgttcttagttatcctgctgcttctgtggctggctcctgagganccttttcatggggncanccaaccaagctttaattgggttgcngatgaatcctgcacggnacnctacttacttaagaccatanaatgtaaagtgggacgggan

SEQ ID NO: 20163 - DNA, 856 bp, Triticum aestivum
  Clone ID: PAT_TA_20163
ccacgcgtccgatgagttcgtctccaatgggacactatatgaatttcttcacggcagtgctgatcacaatctgtcaccaattccactggaccttcgcctgaagattgcgacacaatcagcagaagctcttgcttacctgcactcgtcgacatcccgcacaattttgcacggggatgtcaaatccgccaacattctgctcgacgatcagcgccacgccaaggttgcagacttcggagcatcggcgctcaagtccatggacgaaagcgagttcatcatgctcgtccagggaaccctcggctacctcgaccccgagagcttcatcagccatgtcctcaccgacaagagcgatgtctacagcttcgggggtcgttctccttgagctgataacggaggaagagggctctctatgccgatagctccctccaaagagaagagatccttgtcccatagttttctcctgatgttccaccagaacatgcacctgaagatgcttgactctgagatcgcagaggatgccgccgctatggtggtcgttgagaagctcgcggccctcgccgtgcactgcctgagcgcgagaggagacgacaggccgacgatgaaggaagtcgcggagcggctgcaggtgctgtgcaggattgagatgcatccggccggtgatggtgacaacgatgatgtcttctgtgggagcttggagacgtgagaactggcgctgggcgtttatcttcatcttgtatcgttggtacttcgtacgaacagttcgtatgttttgtgggattatttgtatggtgtgtttatgtgatacgtatatataattataaacacactgtgagtagggtcagttacttgaaaaaaaaaa

SEQ ID NO: 20164 - DNA, 1382 bp, Triticum aestivum
  Clone ID: PAT_TA_20164
ctcgggggcgccgtacctccacatgcagatgaaagcgaccgaagccggcatcctcggcaacgccgggatgcgggccgtgtacgcctccaacggggagatcctcaaggtcggcgacgtgtgccgcaacggcaagctcgcgtggaccctcgaggccgtcgcgggagagagggccggccgcgtgctacagtggcccggtggcggacctgctggtgaaggacgtgaacggaggccggagggatcatgaccagggaggatctggaagaagtatcaggttaaggtgcgccggccgctctcgcagagtgtcatgggccttaccgtgctcagcatgcctcctccttctgccggtggtgccggcctcatgctggttttgaacatcctggctcagtatggagtttctggtatctctggctctcttgggattcatcgccttgttgaatccttgaaacattacatggcagtgaagatgaatcttggagatcccgactttgttgatgttggtgcggttgtctctgatatgctctcccccaagtttcgctgctgagctcaaccatcggattcacgattatatgacattctcacctcaacattatggtggaaggtggaacatccttcaggaccacgggaccagccacctatccatcgtggacggcgagaggaacgccgtctccatgacgagcaccgtcaacgcctacttcggatccctgatactgtccccgagcaccgaggttctcctcaacaacgagatggacgtattcttgctggacgcggcgacgagaggcgacctgctgaagaagggtcacgccctgaacctgctccctctgaagcgccccctctcatccatgtgtgcaaacagcgttctcacgcatgggaagctgcgccgtgaggtgggcgacggcggcgggagcatgatccgtgtagggacgatcatggctctcctccatctatgggttaagtcgatggatccgctctcctctgtcatggcgccgcgtcatgatacacacgcttatcccgtatcgaggttaagtacgaaaacaggacgaagacgcacggcgacgtattattgctggacccggcgacgaaaggcgatctgctgaagaaaggccacgtcctggagccgctcgccgggggaaccataagccagctcgtggtgcacaacgtcgagggccgcggggacctgaccgccgtgagcgatcccaggaaaggcggcgtcccggcggggtactgaacttcatggctggaccgcgtttaagggttcattcgacgggcatcctctctagctgtcatcagctcaagatacacgcgtgattcttgtatttgttcatggattggaataaaaagggccccacgtcatcctgtcaaataaacacgtgcgcttcattatc

SEQ ID NO: 20165 - DNA, 466 bp, Triticum aestivum
  Clone ID: PAT_TA_20165
tcgacgggtaccaccataacacaaagaaaaaagattataccttgctggtcaaattaacctcactgccggctgttcgtcaaagtgaagacgacagaagtcgcgggcccacagaaagcgtcacacgcgagtaccgagtgtcgtgtaggacaaccaccgactgcatgtggccaaaacatgtatgtatgaaagggttatgtaatgttctaaataacgaattcacgactctgatgtggcacctgcctaacaaaacggccaacgcacacggtggctcacaactcgtagtgtactgcaagccacccgccaccccccagacgcacacgcccacacacacacaacaaatccaccgcaactacgatgcatgttaaattatcccgtggtgaacatatgttaccaaaggagggacgttttaatttaaaaaaacagagatcgttaagaccgtttagtacatttgattgatttccaaggg

SEQ ID NO: 20166 - DNA, 625 bp, Triticum aestivum
  Clone ID: PAT_TA_20166
atttggtcgaggagataggctttggtgggatgctggggattcagatgttggcaaagttgaatttgaaattcagcgcgtggctaatggaaagagtcgacgtcgagtcgagtacactgaaaatagacgagcaaagggttctgcagatccaggaccatgatgtccagaaggtattcagtctgccatgtggcaccagatcgatatgccccgatacaaccgagccatccgaagcctgcaaagagttcatgcgagcttctgcctatttgagcaaaggcgcgcatagtctaaaggccgcggaggcttatctcctgagagatgacatcaatgcagattccagcaaggtccagatagattgcttcaagatagcctttggtatttttgttgttgggcacctgttggctccatcgactaagcatgactacatcaccatagatttctgggctgcactcaacgacatctcgcaagttaaggaatttaattggtgtgcttatgtactcgagcatttgaacagagctgttgggaagttgaaaactgatatccgcaaccggaacatcactgtacatcttgttggctgccacctgtttcttcaagtattctacttggacaatcttgatcttggtccactttc

SEQ ID NO: 20167 - DNA, 1074 bp, Triticum aestivum
  Clone ID: PAT_TA_20167
gcgaggttcagcgagaagcggaggaggctgttcttccagcactacccccgggactctctccacgccgccgtctcctcctccggcgacgactccgacgatccctctccggcccgcggcgccacgggagcccgacattcctcgcaagcgtcatgttggcggcgcgtgttaacctcaagggctggcagcaggcagctgttgcagttggttccgcgttcggggccttgcttgatccgaagagagctgatctgatagccgcgcttggggagaccaccgggaagccagcgttcgagcgggtgcttcagcgcatgaagaacagcgccgaaggcagggaaattcttttggagcgtcctcgggttatatccactcgggtttcacacgcctgggacatgcctgagaacacgttcggtgctgcctatgctcagttcatggggtcaaggaacttctcaccagacgaccgcccaccagttcgcttcatggagaccgacgacctcgccttcgtcgcgacccgtgcccgtgaggtgcacgacttctggcacgtgctgttcggcctcccgaccaacctgatcggcgagactgctctcaaggtgatcgagttcgagcagatcttcctcccggtgtgcttgccctctgtcctcgggggccccgcgcggttccgcgcgaagcagaggaggctgttctcccagcactatttccccatgggcgaccaaggcaggtgtcaaggctactgatctgatgtccgtgtactatgagaagcacttccatgaagatctggaggaggtgaggaggaactgggggatcgtaccgtgcccggatcccaagacgacgagcagtgcttagactttaagcaagtgcatttttgcataaaaacgtctgtatcttggtttttcagccttgcttgttgtcagtttctctttgtgagaatgataccatgaattgtgctgctgatatgttagcaagtaaatagggtatggtagctgttggatgttgcttcgtaaggtaatatgcaatgttaaccacaaactacttatatgatgatatatcttctcggtttgctcgaacacttatactattcta

SEQ ID NO: 20168 - DNA, 1065 bp, Triticum aestivum
  Clone ID: PAT_TA_20168
tctctgctgggttcccagctgcctacaaaaccttacatcccttgttacattgaggattgatgcatgtcggcacataacatccattccaggcaggctttggagcactagtctcacatcacttgagaatttatcgatttcatattgtccagacattgtatcaattggaggagaaaacgcaatttcagaaatacagaatgtacagattaaacactgtcataagatggaggatttaaagcagcccttggaaagaggcaatcggttctcatgcatctcgagagtggagccagtcttcctttatggtacgtgtgtttacacaaacttcttccagaactctttaaccatcctttacttttttttcgaaaacaaacaaaacacagacaatatattactcaggcaggccagctaaatcgctggtaattgcagaatttaccacgcctccgacttcgtggtccccgccaaccgggtctcccgccgcccaactggcgcccggtggcgcgagaacacgcgcttcctggtttccggctcgtgcagcccacacactgtcttcagctggaggattcaaccctgcccgtcgtctggccctctcggttcccgcgcctctcgggggtgcagcctgccctcctttatgcaccacactgggaagcatcatactcttcagtggagattgcttgttgcagcacatgggaatcagtttcagaaatgacattttgacaccccaagtcacttgctctttcaattgctccgatgagggctaggctttctgcatggagagcatccatgatatgcgtcaacctccccgctcttgctgcctctgcaaatccctctggattgcgaatgatgtagccccagcctcctgtgtgatcttcttccttaaaagctgcatcaacattaattttcaggtaacttgatggcggtggagtccatttttgctgtgatgttgtggtttttcctgtgcacatgtctttctttactatcctttacattactgaccaattctttcttgttcactgggcacaaagttctgagcttttagcagaatcaatgttacgccataaaaaaaaaaaa

SEQ ID NO: 20169 - DNA, 988 bp, Triticum aestivum
  Clone ID: PAT_TA_20169
cctcttcttaccccggacccccttcccctgcccgcgcgcgcgctagtacgccgcccgccgccccccccccgcctcgtccgctacgccggccgcccgcgcctggtggcggccggcggcggcgtcgcgtccccggcggccccccggctgcggtcctggccccccaagcgctcctacgatttctgcaaccgcgcggtctccaccatgcacgccggcacccgcgccgcccccgcctgcctcgccgtccccggcggcgccctccccggcctctccgtccccgcccccgcctccccccgctcccccgtcgcctcaccctcctcgccgcgccagatgagggcgctggcggtgacgctgtcctacatgatctacgacggggcttgctgccacctgagcggcgacgcgcggctggacaacgccctgcaccacctcatcagcatcgtcggcctcgccgccggcctcgcctaccagaggtgtgggacggagctggtggcgtgcctgctcgtcacggagatctccagcccgctgctgcacctcagggagatgctcaaggagctcggcgtaaaggacacagacctcaacctcctcgtcgacatcctgttcgcggtgaccttctcggtggcaaggatggtttgtgggacgtacgtcacctaccgcactgtgacggctgacaaccccatcctcatcaagacgatggcgacgagcttgctgctggtgagcgcctactggttcttgaggatcctcaggatggtcaggcacaagattgggaagaagaggctggcgtccaaagccgccggcaagggatctatgtgatgccacaagtggtgtctcgccgcaattattgttgaaaatgcacatcatgtactagtagtacgtactatctagcacaatgattgtgtggtgggtaaaggatgatgtcccatgcatgagatgcatgtattcgggcaattttcattttattaatgcgcatgtactatgagtgttcattcatgct

SEQ ID NO: 20170 - DNA, 883 bp, Triticum aestivum
  Clone ID: PAT_TA_20170
gcatcgatttgtttagttctgcagagaggcaccgatgctgcggttcatggcgccgccggccgtagccggagggcttgctcgtacaacgccacgcgccagagggcgttgccggccgtcggtttctgcgccgtgccggaggacgtcgcctccactgccgctcatggtgcgctcatgccgaagggctggatagccgcgtcgtggttggtcgctccgtgggagccgccctgaggtcgagagcctcggatgatggccatgtggcgggctcgtcgctgtgcgccgaggattcaggccgatgggaggcgccgccggggtgcgtcgggcacagagggtgtcgcctctgcctgggctgtggaccgcgctgccgcgcgcctgagggcattgccatgctggtctccggccattagccgctgcggccacctccgggtgcagcgctgggagcagccgggccgaaggttgccgccgctcagctaggagcctggccgaggcagcgttgtccgggccatgggtcgccgccgaagtttgccttggacggcatgcaaacgacgccctggagatcgagagattcgccgcgcctgaacgatgttggaatcggatcactgcggtggggtatcaatacgcgaacatgcgtcggctgtggactagtgtcgtcgtgccgttctgcagggtgaagcgtgcacgcaccacgcgccggtgggcatggactgtcgctagttccgcgttgctcgcaggcgagccgttagtgaaatcgctccgccggggacaacgcgatgcgtcaaagaggtctgggctcgcactcgttcggccgtctctcggccatcaaggacatcgccggtgacggattgatagtgtgcgggcgccgccggcgctgccggtttgtttagtg

SEQ ID NO: 20171 - DNA, 1156 bp, Triticum aestivum
  Clone ID: PAT_TA_20171
cccgccccgccgctcccgccccggcctgctctgggccatggcacgacggggccgcggccggctcggacatcgacgccgacccgcatcttccggacggtgtacgcgcagatgaccatcttctcggtgtcgcaggccaccaccatggaccgccggattggcccctcctttcagatcccggcgggctccctcaccgtcttcttcgtcagctggatcgtacccaccggacccatctacgaccgcatcgtcgtgcccgtatcccgccgcctcaacggcaacccgcacgggctcaccccgctgcagcggatcggcatcggcctcgtgctctccatcctcgccatgacctccgccgctctcgtcgaggtcaagcgcctccgcgtggcgcgggactccgctgtccccgcgggcgcccccctgcccatggcggtcttctgggtcaccccgtggaccttttttggcgccggcgcgatggcgtccacctacttcggcccgctggagttatgcccgccggagtgccccaaggggatgaagaccgcgcgcactgggcccttcgtgtgcacgttctcgctctgattcttcgtcagctcgtcgctcgtgacggtcgtgcacaggagcacgggtgaccggcggccgtggattgccgacgacggcagtaagggcgagctctacaggttctactcgctcctcgcgggggtctgcctcgccaacttcgtcgtctacctctttcgccgccaatgtggtacaagtacaaggccggacggcccggcgccgacggcagcgtcaacggcgtcgagatggccgacgccgagccgtgcctccactgactgaccccgcgacgcgcctgttcgtccgttcgtgtttctcaatcggacggccttcgatttcttcgcatgttgtaccatacatatacttagtattggatggatcgtcgcgcggtcgtccacgtgtgcctacgtgtagtataatgggattaataacttcttagaggtgggaaatggaaaagctggcgaaagggttagcggggcggggaaagggtgtcggtgactgaatgtcgctgcattttgtgaaaattcccgcccagatgtaaaatcacgcaaatgaatgaaagaaaaaggaaaacttgtgctcttttggtaaaaaaaaaaaaaaaaaaaaaaaa

SEQ ID NO: 20172 - DNA, 694 bp, Triticum aestivum
  Clone ID: PAT_TA_20172
cccacgcgtccgaatcacgaacaccaccttacgagcagtccacaacgtttcccagttgaggttgtagtagcaacgcagagagagcaatggcttccggccagcaggagaggtcgcagctggaccgcaaggcccgcgagggtgagaccgtcgtccccggcggcaccggcggcaagtccctcgaggcgcagcagaacctcgccgaagggcgcagccgtggcgggcagactcgcagggagcagatgggggaggaggggtacagcgagatggggcgcaagggcgggctgagcaccaacgacgagtccggcggcgagcgcgccgccagggagggcatcgacatcgacgagtccaagtttaagaccaagtcctagatgatccgctagcttagcaagcaagacgactctgcttaggtcggctgttggtttgccctagcgtccacgtaccgaataatgtagttcaggcgcacgtaggcgatcgtacgttgtatgatcatgtgcgctttgtagctggtagttgcttcgtagctggtagtctgtaggtactctacggtgacgtcggtcagtagcgtcaggttaagtcggaagcgtgctgtggcttggtcaggtggctggtctgcctctgggcccaggagtgtcgcagtgtccactgtatccttgcttcttcagtaatgtatgtcggcttgctcaaatctgaagcc

SEQ ID NO: 20173 - DNA, 769 bp, Triticum aestivum
  unsure (1)..(769): unsure at all n locations
  Clone ID: PAT_TA_20173
agcaaccacaagcaccgcacaagctgaagcggtagagcacacacgctcccttccagttgaggtcgaagtagctagcgaggagtgagcgatggcctccggtcagcaggagaggtcgcagctggaccgcaaggcccgcgagggcgagaccgtcgtccccggcggtaccggcggcaccaacctccaggcgcaggagaacctcgccgaagggcgcagccgcggcgggcagacgcgcaaggagcagatgggggaggaggggtaccgcgagatggggcgcaagggcgggctgagcaccaacgacgagtccggcggcgagcgcgcggccagggagggcatcgacatcgacgagtccaagttcaagaccaagtcctagatgatccgttagcctagcaagcaagacgactgcttagttggttggtttaccttgcaggatgaataatgtaggtcagggatcctgacgtgtgcacgcatgtaggagatcatatgtactagatcatgtgtgcttggtggttaatagtagccggtagtccgtactaggtactgatggtcagtcagagtcgtgtgtccgtgtcagtcggaagtgtggttgtggctccggcggctggtccggcctctcttcccacaccagcttttccgctgtatccttgtgtttacagtaatgcaagtcgtcgtgctgaaatctgaagctttgtagtgtgctgnnaaaacaagcccggggcaaggcgggggaaatgatggagaaggccaaggagacgacggggcaggcgatcga

SEQ ID NO: 20174 - DNA, 705 bp, Triticum aestivum
  Clone ID: PAT_TA_20174
cggtcgcgattccggcccgacaccaacaccaccttacaagccagtgacacaacgtttccacagttgaggttgtagtagcaaggcaggcagagagagcaatggcttccggggcagcaggagaggtcgcagctggaccgcaaggcccgcgagggcgagaccgggcgtccccggtggcaccggcggcaagtccctcgaggcgcaggagaacctcgccgaagggcgcagccgtggcgggcagactcgcagggagcagatgggggaggaggggtacaggccagatggggcgcaagggcgggctgagcaccaacgacgagtccggcggcgaccgcgccgccagggagggcatcgacatcgacgagtccaagttcaagaccaagtcctagatgatctgttaccctagcaagcaagacgaatctccttaaggtcggctgttggtttgccctagtgtctacgtaccgaataatgtagttcaggcgcacgtaggcgatcgtacgtagtatgatcatgtgtgcttcgtagctggtagtctgtagctactctacggtgagtagcgtcaggttaagtcggaagcgtactgtggcttggtgcaggtggctgggctctggctcggcccaggaggtctacgcagtgtcgcacttttatccttgcttccttctgtaatggttatgcgtcttggctcaaaaaaaaaaaaaaaaaaaaaaaaaa

SEQ ID NO: 20175 - DNA, 747 bp, Triticum aestivum
  unsure (1)..(747): unsure at all n locations
  Clone ID: PAT_TA_20175
ctacctcctcaaaggcttgaacaagactccatatgagatactcaccggcaacaagcccaacgtcaagtacttccgggtgttcgggtgtaagtttttcattctcaagaaaggtgtttgtttgtctaaatttgaggctagagctcatgagggcatatttgttggttatgctacaaactcccatgcttaccgtgtcctcaataagtccacgggacttattgaggagacatgtaacgtggagtttgatgagaataacggctcccaagtggagcaaagtggcacttgtgatgtaggtgatgaaattcctccccaagccataagaagaatgggtgttggtcttctcctccccactggggatccccttctggtcgcggccgatggtccctgctccgcccacgcgctgccgcccccagccccacgcccacgcgcttccctagtgcggcccgggggccctcaacctcatgaacaaagaccaagggcaatatcaacctcaagatggtgttgaatcacaagtgatgcccaaggtcaagttctctcatccaagcaagttcaagatnaagaacgagctcaagacgacctcaagatgatcaagtaaccgcttctcaatctctccaaaggagaattaaacgtcngccgccaagatacatcaagctancatcaaagtnatccaanacaatgtgctngaactaagaaagggtaagancntaacatnacaaatatgnaaanaacttgccctgttnaaccnaaagg

SEQ ID NO: 20176 - DNA, 614 bp, Triticum aestivum
  unsure (1)..(614): unsure at all n locations
  Clone ID: PAT_TA_20176
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcacaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaactgcctatgttcgggtgactgacgcacacaggtgatcaacgaggtgaggaggtaagaaggagtacctgacgcgtatgtccgatatcggattcacaaatgcgtagtcagtgcgtacttatgcttaagcacgggtgcgagatcggcaaggctaacagtacnacgacaggcatantaagtgcatncagttttanttaattcttggtttctctcattacttctattgtcca

SEQ ID NO: 20177 - DNA, 686 bp, Triticum aestivum
  unsure (1)..(686): unsure at all n locations
  Clone ID: PAT_TA_20177
cgtggttctacatcaccgagccgtgcgacaccaactgggtggctgcccccgaatttcgatccggaatccccacgcggctcacctcctggaaagagaagggcctgtcctggggttcatcggtggagctagacggactccagaagtgtatccggaacatggcgagcaagaagctcaagcttgccaacatagtccaggtcatgctcttccgccggatcctcccgtgtcaacaacgggacttcaacttgtgggagttcgacccggcccagcaccagactctgagcgagctcttcgacacgacgcacaaggacgtctggagggtgctgttcaagggcgccgaggtccctccctctctcaccgaggaccgcgggctaagcgcgaacgcccagcgcatccggtgagttctgtacatccggtaagatatttattcccctagcttaacatgtgcggggccgctctccccttccttgtctcgtgactcggtgggatcatccctggccggccctcgcccctgcccccctcttccggacgcaccgcgtcgctccctnacgggcgatctgatcccgtcccttataaagngccggagaaagacaanaanaaggcaanggaaccccaatattcccgggccagtggtaccgnccaaanccgataanccctaaaaaccnccatatacaggggaaaataaannt

SEQ ID NO: 20178 - DNA, 1589 bp, Triticum aestivum
  Clone ID: PAT_TA_20178
gtcgacgacctcgccctcaaaggcccacttcacctccaccgtctcctccgccaccgcctccgccccgagcacgcggccgtcgccgtagatcagccgctcgggtacatcggctccgtcgacgaggcgacgggggtgccaagggagctcggcgctgttgaaggccggccgctgcagccggacgggcgccccgggcgggtcgcctcctcggaccccgccatgttcgccagcgacatgcgctgcatcggcgcctgccacatacaaccgccccgaagcatctccgggagggcgttcagctccggctgcgcgtcgcccatttgccctgactacatggtcgagaccatcttcgctaccttccacgtcaccttccacctccaccccgcaacggacgaccccagctcgcaattaaggtgattcggcgagaggttggctaattggagccggtcggattctctggtcctctctaatccatacaaatactacagatagaattcgcccatcctggcaatgctcgacaaggacgttcgggaggagcatgggcatgattggcagatgtctgaaattatttcattgatgtttatgattatcgagggtctgaatgatcgaaatcttgcaactcgttctaccaggttgaccatagtgtccccagattccactcaagtgattgatcccgtatttgcctcctacgcgccgatgggttacgacattggggccttcttggggaacctgattctggcgtactttgcacaggatgggcatgctgatcaaacgaatgaccgtaaagcttataagcaatggatattgaagaccatcgaagaatcatggaatttgttccagcagaaatttttgggactctggaataaacacaaagatgggaatggggaggcatacctgcctgccatatacaacaacccggagcttttgagcgatgtacagaagaagtacatgacaggtctacttcatgatagtcttggatttggttcagccaaaatgatcaggagaattgttggaattgcccatgtcgaggattttgactcaattgaggatgccagcaagagagcatcatgtgagcgccgtgcgcttgattgtgccaaggcaatcctgaaggggcgacgccaatttgagagcatcgagcaggttattgtgcatgtccaatcagtaaatcatgactgagaaaaccagccgtctgttctgcgtttccagttgaggagacctcggttgattgttattgggattgagtacccacgctcaagtatcgagatgtgctgctctttgtaaaacatccatgggtcagtgtggcttatatgtattgtgtagtgggctgccttcagagatacctatacttgggtcgagaacatcctgtgtgtatttctagtgcaaggcaggctgccttgcagcatagctgcgagttgaataacagaatgtacaatgtatctcaacgttgtacaattatccatagatacaggcgcggtcgccaccaataaaaccctatctggggtaagggtttggccgagctggttctgtgtactgtaacacctcccgggggggggggccctggctaaattacacatttaaaaaaaaaaaaaaaaaaa

SEQ ID NO: 20179 - DNA, 1085 bp, Triticum aestivum
  Clone ID: PAT_TA_20179
ccacgcgtccgctctctctctctctctcctaagccgcccctcctcttcgtccccaccgccggcgcgaggtctcgcactcttcccactcttctcatcccctcctcgtcgaatcggtcgccaaagtgcccgaggatccgctcaagctcggtctggttgctgggcgccggacgaaggctgacgcggaggcgcgggaattgcctccaccagatcggcggctgtggcaatcatgtgtcgcaacctccgcgcctggtgccttcctttccatctcgctcgtcggcggctcccaccaccctgtgcgtgcgactgcgctgcgccctgtaatgcccatgtgcggcagctgtgccgcggtggatggtcccctgcaagtgcaagccggtgccggcttacaagaaatggatattgaagaccatctaagagtcagggaatttgttcgatcctaaatttttgggactctgaaataaacacaaagatgggaatggggaggcatacctgcctgccatatacatcaacccgaagcttttgagcattgtacagaacaagcaggtgcgttgcctgaggagttcgtcggcgccgatgtcggcgcctgtggaaggcggcgatggccaacagtggctgggcggcgagggcacaacagtggcttggcggcaccgacgtctgactgtagtgtgcatctaaacggcgacatcaaagaagacatcgagattaattgggatggaactggccacgtattgcgcacaagaggatagtctgcacctgcattggcgagaagcgcgtcgtcgcgggcgtcgtccgctacgcatggcggcgatggcgcaggacaggctgggcggctgcgacgtacgtccgggtgggcaaaggctggtagatcgagctgattcccgtaagtttagacatttattgtgaggcagatgtgttaattcccattaattgtggctaattttctgtagttgattggacgcgaacgcaaagggtggaactgttttttttcgggggaggtgcaactgtttgatcgatggcagagttttgtccgctaatgtaaatcgctaaacgtacacaggggaggtctgacttttatgtggacggtt

SEQ ID NO: 20180 - DNA, 599 bp, Triticum aestivum
  unsure (1)..(599): unsure at all n locations
  Clone ID: PAT_TA_20180
cctggctgcatncagcagcgaagcattgtcatacacaaaagcatctacaggtccagagtgacagagaatgggaagatgcctctcttttctactcctcctgggcgtcgcgcttaagctcgccggcccggccaacggcgacatgtcggcggcgttcgccggtacaggggcggcgtacagcatcgacggcgcggtgcggcagctgatgtcgccgccgttgatgaagctggaggacggcgtggaccctgagcttaagtatcgacctggaggtgcaccgccgcgtcctcgccggcatcagccccggtgccctgagccgcaacaggcccgcctgccccggcgcgtgcccggcgcccggaggatcgtacaccaaccggggatgccagaagaagtaccagtgccgtggctgaatggagcagcagagcactctggccggcaacctcctgcacgcatgcacgttcgaccggcgtaaattttcatttcacatttatatttcgttccgctatcttggaataatgtggcagtcttgttggaacaaaaaaaaaaaaaccggtnttctttttcanaaancntttaaggnngaaatttngttttngggccccttc

SEQ ID NO: 20181 - DNA, 514 bp, Triticum aestivum
  Clone ID: PAT_TA_20181
aagaagctcgtgctcctacgcctcctactcgtggggttcataataaaccatgtagcccgcaccgccgccggcgccggtgacgacgaccaccagttcgtctactccggcttcgccggcagcagcggcctgctcctcgacggcgcggcgtcggtgacagagagcggcctcctggagctcaccaacggcacgctccgccagaaaggacacgccatctacccgaccccgctgcgcctccgtggccgctccttctcgtcctccttcgagttcggcatcctgtccgcctaccccgacgagagcgccaacggcgtcacgctcttcgtcgccccgaccgcaaacttgtcgggcgccatggcggcgcagtacctcggtctcctcaacaccagcaacaacggcaacgccaccaaccgtgtcttcgcaggggagctggacaccatgcataacaacgagttcagggacctcatcgacaactacgtggggatcgacatcaacagcgctgtcttggccaaactcaccg

SEQ ID NO: 20182 - DNA, 512 bp, Triticum aestivum
  unsure (1)..(512): unsure at all n locations
  Clone ID: PAT_TA_20182
cgccgtcgtcgtcgccgtcagccgtcgccgccgcatctcccccagccgcagccctcacgctccgattcgtccgtccgacggtcagcagcagcacaaccgtagtcgtcgtcgatggcagggttcggcagcctggcgcccaagacgaagaacgtggtggtggcgggcgggctgacggggttcgtcttcggggtgtactactacaccatgtgggcggtgggcagcaccgacgagctgcaggtcaccatcgacaagtttgaggacctgaagaagaaggaggaggccgcctccgcaagctcctccaccccaggatcatcataaacaagcacgcccttaactttgaaactagctactgcctgcctctcccaggaccatgggttcggtttgtatttgataataatgggtgctgttagttagatggagcattttcattcatggcatggatggagcttggagttgatgatgctttttgtttgtgtgaatcgtagctgcggtgtctggaaattatgntnnaa

SEQ ID NO: 20183 - DNA, 745 bp, Triticum aestivum
  Clone ID: PAT_TA_20183
cgtccggtcggcggggtgccgccggagcccaccacaggactcgaggcccagcccagcccagcccagcgcacctaccaagaccgaccgactttccccttccctgctcctccattcctctcctcctcctccggccgccatcgccgttgccgtcagccgtcgccgccgccgccgcatctcccccgcgccgccgccgcatctcccccgcgccgccgccttgacgctccgatttgtccgtccgacggtcagcagcagcagcagcagcagcctagtcgtcatcgtcgccgatggcagggttcggcagcctggcgtccaagacgaagaatgtggtggtggcgggcgggctgacggggttcgtctttggggtgtactactacaccatgtgggcggtgggcagcaccgacgagctgcaggtcactatcgacaagtttgaggacctgaagaagaaggaggaggcaaccttcgcagccgccgcaagcgcctccaccccgggatcatcataaacaaatgcgcccttaactttgaaactagctgctgctgcctctcaacctgcccgggaccatgggtttggtttgtattgataataatgggtgcttttagttagatggagcgttttcattcctggcatggatggagtttggagttgatgatgctttttgtttgtgtgaatcgaatgttagccgcggtgtctggaaattatgatatgatattgcctccgcttcagaatataaggcgtactgtttttgcc

SEQ ID NO: 20184 - DNA, 767 bp, Triticum aestivum
  Clone ID: PAT_TA_20184
gcgccgccgcccccgaagaagccaccagcctcctcctccctcacccgccgctcgccgcccgccgaggttggtcgccggacgccatggctcccaccaagaagtcgaagaagagcacggagaacatcaacaacaagctgcagctggtgatgaagagcggcaagtacacgctcggctacaagaccgtcctcaagacgctccggagctccaaggggaagttgattatcctcgcaaacaactgccctccgctcaggaagtctgagatcgagtactatgctatgctgtccaagatcagcgttcatcatttccatggaaacaatgtggatcttggaactgcgtgcggcaagtactaccgggtgtgctgtttgagcatccttgaccctggtgactcggacatcatcaccaccgttcctcagtgaagacaagcttacctatcctagcctaagatgatgtagtgtggagagtcgtgcttacaaggccgatggccgtctcgttatcgagccggagctgccaaatgcagtttcaaaccaaacatggctgtttttgtaaggcattcctatgggttttgttttgatgagatgtttattcctatcgtccttttactgtgcgcaattgatgattagttctgtcaacattgttttgcctatgctcctccagtgaaacggaactataacaactagagttgctcttttttccccgcaagaaagggaaataggacacctgtgttgctaactgaagaatgcgtgaaactgggtggctgatgcttgtct

SEQ ID NO: 20185 - DNA, 934 bp, Triticum aestivum
  unsure (1)..(934): unsure at all n locations
  Clone ID: PAT_TA_20185
ggtccccccccgcccgcgcccccgccctccgcgccgccgcctcccccggcgccctccggcacccccttccccacgctcgcctcgcccgacgcgatggctcccaccaaagaaaggcgaagaagagcggggcagaacacacaacaacaagatgcagctggtaatgcagagcgggaagcacacgctcggctacaagaccgtccccacgaccctgcaaggcgaagaaggggaatgctgatcatcctcaagaacaacctgccctccccgttaggaagtaggattggttgagtaccacgcatagttttggcgaaaaatttagcagtcgcacaatcttccacggaaacactgttgatgcttctaactgcctggggcaatgtactaccgggtgtgctgcctcggctatccgttgaccctaggcatcctctcggactctcatcagcacaaccatcaccacccagtaaaagccaacagagcgtactacctattttattagtcgagttgtagggttcctgttgtgctcgtggaacgacttcgttgttcttttcgggttgcttaccaccttgcgtcgctgagttggagctggcattaaggattttcctcgatatggtttgatctgttatacaggattatcttttgtgtctcgaaaccacgctgtgttatcttcggtttatgtacctttttgcgacgctgagttggagctgtcatacagataatacttcatatggttgttccgctggacattcatgtggttttgttttcatgatatcgttgtttccatcttaaaaaaaaaaaaaaaataacaatgggtgcttttagaggaaatacccaatggttcctgggtacatatgtaccctatatggggatttatttttaatagttaaacaaaaagtcaaaatagttaagaaactatttttagaataaagtnactacttacgca

SEQ ID NO: 20186 - DNA, 448 bp, Triticum aestivum
  Clone ID: PAT_TA_20186
ccgcagccggccacactccctcctccttctcctccagctccaagaactccaaaaggttcagccgagctccatcgatggcgtcgctctccgtggccacgctcccgcagctggccggcgcgccggcggcggcggcggccaagaagaggtccggcgtgacgtacgtggagggcatgaacgcctacagcggcctcaaggggctcaacaaggtgaccatgctgggcgtgcgcaagagcgccgactacaagttcgccaggatcgtggcgtcgctgagccccgcggggaagcggcgcgggggctcgttcggcgcgcagtgcaacgccgccggcgagatcttccagatcgccgtcgtcatgaacgcgctcacgctcgtcggcggcgccgtcggcttcgtgctgctccgggccgaggcggccctcgaggagtcggaggagtgagtgaaacccaaccc

SEQ ID NO: 20187 - DNA, 755 bp, Triticum aestivum
  unsure (1)..(755): unsure at all n locations
  Clone ID: PAT_TA_20187
gcgcgcccctcctctccctctctccgttccatccaaccccaagcaccgcagccggccacactccttcctcctccagcgccaagaactcgacaaccaccggaggttcagccgagctcgaccgatggcgtcgctctccgtggccacgctcccgcagctcgccggcgcgccggcggcggcggcggcgaagaagaggtccggcgtgacgtacgtggagggcatgaacgcctacagcggcctcaaggggctcaacaaggtgaccatgctgggcgtgcgcaagagcgccgactacaagttcgccaggatcgtggcgtcgctcagccccgcggggaagaggcgcgggggctcgtttggcgcgcagtgcaacgccgccggggagatcttccagatcgccgtcgtcatgaacgcgctcacgctcgtcggcgtcgccgtcggcttcgtgctgctccgggccgaggcggccttcgaggagtcggaggagtgagtgaaacccaacccaacgccgtgtgcctgccctgaccagccgtttcagttcagttcagttcaggctgctgtttggctggcgcgtaagccgtgatatataaaacgtgatgtatgctattttacatttggttttgtatcaatgacaatcgattgatgaataccccggaaacacatttttggaggctcagccttgcctgccccctgtaggaggaatacagttccaaagggaaaatgttctgccaagataataacacgatattcagaaatcataanan

SEQ ID NO: 20188 - DNA, 738 bp, Triticum aestivum
  unsure (1)..(738): unsure at all n locations
  Clone ID: PAT_TA_20188
ganggtngtgnacnaccncgntatcgnngggntcatcatagtgnattgaaggaanggnggcttgtntacngtgaaagggtttngagngtagtgnnaccaggtttccgtagagttaaagagccgtgggggntatagactcctntggngattggtacggccccccttttttttgattcaacttgcttcattgtattgatgaggggcttataaagccaattacaaatcggagtaattccaaacatttcaaattgattttggagactgcaggaaaaccttgttcggggcgaacctttccatatccaaactcttatagtattctaaactaacaataataactagggataactagtcacggcatgggttcgactttgattgtagtatcagacacactaacacccctataaatgccatctgtgaagtggtgagtaacttcgtgtccattcagcagaacatccttctgcgtgtatgagtatgggacatcacatataccttgtgactgagtcgccgtcaccaagaccttggacattggaggcacaatgacttgatatttcatggtggtctctcgtgtcctcgttatagtttctccccagctatatcctccttcaaattcagcactaattcgtatttcccctttcactatgagtgggatcccagagtcaatggttgactttgacagccactttcaatgaaacactagaaccccgggccccctcccccgggacttgaatcnaacctgnt

SEQ ID NO: 20189 - DNA, 840 bp, Triticum aestivum
  unsure (1)..(840): unsure at all n locations
  Clone ID: PAT_TA_20189
cacgcgtccgcagtaagaagcaaccatggctgatgcagaaccatggaagacagtcaagatacccccgatcgtgcaggagctggcgaccggcatgcaggagccaccgagccggtatgtgatcgctgagcagaaccggcccaccgcggctggttttgagatgcccgatcccatacccatcatcgatctcagccgactgtctgccaactgtgctgatgaggttgccaagctgcggtccgccttggagaagtggggtctgttcctggctgttggccatggaatggagcaaagttttcttggtgaggtgatgggagtggctagggaattcttcaagctcccactggaagagaagcagaagtattcgaacttggtgaacggcaatgaagtcaggatcgaaggttacgggaacgacatggtcgtgtcagagaagcaaatcctggactggtgtgaccgcctctacatcatagtggaacctgagaatcgaagaatctacagcttgtggccaacacagcctccatcgttcagagatattctgagtgagtacacagtcaggtgccgtaagatcgccaatcttttcctccagaacctggccaagctactagatttacacgaggactacttcgtcaacatgttcgacgagaatgccttgacatacgccagttaaactactaccctaacgtccgaagccggacacgtcttcggcataagcccacacgatnccngtgatacaacgtctcacnatgataatgnancnggctcanctcagaaaatgggtctggacacataccatctccaatgatancgtaacgtggaattatgnnatatggangggtctcagaccgg

SEQ ID NO: 20190 - DNA, 667 bp, Triticum aestivum
  unsure (1)..(667): unsure at all n locations
  Clone ID: PAT_TA_20190
cgaaagatgacatcacagatccaagggcgtcgcacactctcaccaacaatgatgatggatccatccgtttacaatctgatttccagagcaagttttggagacgcagcccggactggatttgggccgactcacacgacaccaccaacagccgcccacactccccgtccgtggtggtggtccccgccgttgacttgctggcgccccgagcccgtggtcgaggcccattccggtctggggctggccccactcgcccggctccaccgcctccatccgtgtccccttggccggggcggggcgcgccggggaccacctcgtagcgccgcgaaaccttggcaatggcagcttctgtcagaggctaaccgcagacggcaagattgactgcctcaatgctagtgctgatagcatggtaggacgagcaagattccatctggaagagccggttatttctcgagagatctatgacattgagttccacctggatgaggctaagggtcagctcaagaaactcgaggatgtaaaaactgctcatcttatcaatgacatccctacacccggcacacaaagacgtggattttcctcctccgacagggagagnnctgagtcngtgttattgaagtggttcagtcaccattgcttggatcatcatgtgaagggaatcaattgtcta

SEQ ID NO: 20191 - DNA, 726 bp, Triticum aestivum
  unsure (1)..(726): unsure at all n locations
  Clone ID: PAT_TA_20191
atcactagatggcgctcctcccagcactccaccagtgacctttcttctagctagtcctctcctcctcttgcagcatcagtgcaataccagcactctagtagatcaacactactggtgacactgcatttttagcgttgccgtccgagcacgaagcaggagcacggccggacagcctctggtttacgccgtaggctataacatccatatctaccgggattgatggcgacggttggcatctccgcagcaagctgggtggtgggcaaggctctgagcccactgtctggaggcgtgctggaggcatggagtgcaagctccatgctcggatcaaacatggaggccttgaagatgcagctgctgtacgcgcaggcgatgctgaacaacgtccggggcagggagatccacaaccctgccctgggcgagctgctagacaagttgcggcacctcgcgtatggagccgaggatgtgctggacgagctcgactacttccgcatccaagatgagctcgacggcacctaccatgccgccgatgcgcatgatgcaggcttcgtccaagacctcgccctcaatgctcggcacacggtgagagcatgtgtgaataagctcaagttacccgtgtgttcgcgtgctgccaggaaggttgagcaagacgatggtggaaaacaaggatacctctcangtttccgcttttgtggangtcatgagattagctcctcgncaccatcaccc

SEQ ID NO: 20192 - DNA, 1016 bp, Triticum aestivum
  unsure (1)..(1016): unsure at all n locations
  Clone ID: PAT_TA_20192
gaattcactgctgtgttcgagcggccgcccgggcaggttacctactcctaagggtcaaagcaagccctttaattcaattctttattcttacattaaaattcttacattaaggattgattaaaatctccccaagtaggattcgaacctacgaccagtcagttaacagccgaccgctctaccactgagctacttgaggaacaaggggggattcgacctcctagagttcaactcccgctctcaacccatgaacaatatgagtccgaagcttctttcgtaactcccataatttcttcgtagtggctccgttccatgcctcatttcatagggaagcccaaagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctatttagtagtctaagtttctcgatgaggataattaattcggtcgttgtggtcggactctattatggatttctgactacattctccataggtccctcttagatcttctttctccaatcttgggattagggaagaaggagatattcgcgactactggcgatttcattatggggcagctcatgatcttcatatcgatctattatccacctctgtatctattctttcttagctaaacaggtggaagatctatccaatttggttatattatatcatggactcgaaaaacggatctgaatttgactgaaatgcacgatcttcacaaggtatcacttttcacgatacctaaaaggtggaatagcgattttcgaaccatttcctatnagngaatggttccattactttgaganatggatctatatcaanctatngctattcattnagaggaaagaactantagngtcgagn

SEQ ID NO: 20193 - DNA, 704 bp, Triticum aestivum
  unsure (1)..(704): unsure at all n locations
  Clone ID: PAT_TA_20193
ctcgtgccgaattcggcacgagctcttcctggncatcanggccttcctcgncccttttcttgccatgtccatgcagcctctcacggacgacatggccaggcccagccacctcatggcgatcaggagcaccggcccctttagcgccgagcacgccaggctcctgaatgagataaaacaagatgttatgaagttcgtcgtcatcaacatcgccctcctgctcgtcacgctgacgcttggtttcgccaagcaggccctcacattcttcttgcgctccatgggctacttcggtggtcgctactcactcgccgatatcatccgcaaggtgatcaaggggagcagtctgaagggcccttcgatcaccatcgacgttgccgacgtgcttgggttcacgtgcatggcacttctgggttccatgctttttgccatgacgtgccgccgctctggggggttctctgtcgagggtctnatcttcctcctnanactcgtcgtctacctttatctgaatagttagcactattgggattattttaatctataaataagatatgactgtgatcatagcaacatcaagtatggagtattggacgtaaactcttgacattgctaaatagtacaaacattttatctcacagtattagtacatgattcatgtgatgtcccactgtaaagaagtccacgatgccattggaantaaaaaaaaaaaa

SEQ ID NO: 20194 - DNA, 703 bp, Triticum aestivum
  unsure (1)..(703): unsure at all n locations
  Clone ID: PAT_TA_20194
gaggccgagttttactgcagtaactccctcgccagtagcgcttccccaagacccgcgttgaatgcgcgacatgggggtcgtgtgtgacatgggggtcatgcatggggcggttgctgccctcatgcgtcacatcatggtaaatggtaaagaggcggcccgcgccttccccataaaaaggaaaaaccgcaggcgcgctgcccatttaccctctgcgcctcttccaatctcggaaccgccgttcccctcttcttcctccggtgaaagattcgaagatcttgcctctgcttgctgccgctgcgcccccattgctcttgatccttcgccctctcctagccgccatggcaccaaaaaccagcaagggcaagggagcggcaaggatgccagggagaaggaggcccggagagcaattggtggtgcggcggacgcaactcgcctatttccttcgacggtcgatgcgtcaactcaagaacttattttgccctgtggggaagaagacgacgggcacctgcaagcgcgtctcccgccgatttcccaggcgccccaatctaccttctcgccattccccccggggctcgcccccttcccgaccctagggggttgcaaatacgttcacacggttccctatcatggtgaggtccttcactccaggcttccgggccccaaatttccncgaattcccccccgacgggggcgccggggtnat

SEQ ID NO: 20195 - DNA, 345 bp, Triticum aestivum
  unsure (1)..(345): unsure at all n locations
  Clone ID: PAT_TA_20195
ggaagaacctggaaatccctgctacttccaaaaggcgtgtcgtgggcaagcattcgggtgattctggggagagtgtgtgctctgttgcatcagtggaaaatcttatgcgacagggatcaatcgatgctactgcggcgttgtctcctgttgttggaccgacgaagaagtgagctggtgcgcattncatgggagggaccaaggatggtgcaaataagggactagatggactcatgctgaaggcgcacactggatgatctctccctccctgcgtgaggatgtcattctgttataggacacaccttacttagatcccttnatncaccctgaattttttccgaatnaatt

SEQ ID NO: 20196 - DNA, 574 bp, Triticum aestivum
  unsure (1)..(574): unsure at all n locations
  Clone ID: PAT_TA_20196
ctcgcgccgttgcatccttgctccggcgagccccaccactagccacgcgaggagctgcaactggaggacggaggagctgctaccggccactccgggggccgcgaccggcgggcagaggagctacaagccgggaactaaaccgacgaccgccgtgctggattcagcacgccggggtgctgcaaccggcagatcaaatagctgcaactaccttttgtttttgctgggaccggtgaggaatttcgctgcgaccatcgacggtgagccggcttcctccttcggaaccggctttctcctcggcgcggcccacgtcttgggttggtccgggagctgctcccgcccgctcaagtgctggcaccgccggcgaccgctctgtggcgcccccggcggcgcgcgcccatcgcgggctcctgccccatctgctgctggctccacctttggcgttggccgcatctccatgtgcggcctgctccactcatcgtgggggcgggcggctgatgtcgctctgccccctaccggcatggctcctcgccggaactggctttccnggttgcggcactcatctttctcagatngg

SEQ ID NO: 20197 - DNA, 578 bp, Triticum aestivum
  unsure (1)..(578): unsure at all n locations
  Clone ID: PAT_TA_20197
agactggcatgcttcaacaataccatcttaccacccttcatgtcaccacatgatcatgttatcttccatcaaatgacacatcaagtttcgaagctcacttgtagttgccttgcatgcaatataacacttaccgatgcttatataaacatgccatgaaataactactcaagcaaacatgcaaaacactcatcatatcaaaggttcaaacatgcttgcctggtttcgagtagtcggagtctagctcggtgaagtttgcggctccgtcacctcctttggtatctacgggttcactgagtccttccgcacctgtggatggtggagttggtcgtcgatgggtctcatcgaggagggctataaccttcaaattggaggttgggatagaattgtgggtgcactaggagttgctgacagggtatgggaggccgggttgccctcaccggagcggatcttgccggagccccgaagcggatcgggggcggccggagtcggggaagaaaggccctcccccgaggtcttcctagtagcnaaggcgtgggctctggtgangttggaaggggtgatgcttggtccaaatccat

SEQ ID NO: 20198 - DNA, 444 bp, Triticum aestivum
  unsure (1)..(444): unsure at all n locations
  Clone ID: PAT_TA_20198
gttcgccgtgatggcgctccaccttgcctgcggctataggtacggtgcgctgctgctggctttcttcgtcacctcgtccaaggtgaccaagatcggcgaggaccgcaagcggcgcgttgaggaggatttcaaggagggtggccaagcgcaactggatccaagttcttgcgaatagtgcaataccaactgtattggttatcctattggcgataatgactgggggtcaagatcaatgcttggactcaaatggttcaaaggttataactggtataataggtgctattattggccattattgctgctgcaatggagacacttggncatctgaaatccgtgtgcttantgatgaacaaccaaagnttgtcactaacctnaaacctgtcangaaaggtacaaatnggggagtgancttaaaaggactctgctgccanaacanggtggtct

SEQ ID NO: 20199 - DNA, 863 bp, Triticum aestivum
  unsure (1)..(863): unsure at all n locations
  Clone ID: PAT_TA_20199
nnngggaaggatggaaggatnnnnnagaaaggtacattcttcaatgggngnctaagcatataattgctgtgagtacagcaatacaagatnngctgacatcaagacttgctctggaactgatgaagcaaggcgcaatgagaacagttttaagtggttttcttgcagcatttgcatggcccgctactctgcttgcagctacggatttcattgatagtaaatggtctgttgctattgacagatcagataaggcagggaaaatgcttgctgatgtacttatgaagggatcacaagggaacaggcctgttaccctcattgggttttcactaggggcgcgtgtcatattcaagtgcttacaggagcttgctttatcaagcgacaacgagggacttgtcgagagggttgtactcctaggcgcgccggtttcggtgaaaggcgagcggtgggagcccgctaggaagatggttgctggaaggtttgtgaacgtgtactccaaagatgactggattcttggtgtaaccttccgcgcaagtctactcacgcaaggattggctgggatacaggccgtcgatgtccctggcgtcgaaaacgttgatgtcaccgagctcgtcgatggccactcttcgtacctgtccgccgcgcaccttatcctggagcacctggaactaaacacctactatcctgtcttcgtccccctaccaccggcagttagcaagtaacgggcgtaacagttgcctagaaaaggacacaaatttcactcgagagttcgacgaaaatgaagtgtcgacattctgtacatatagaacataacgcggcgagccttttgctgtatgcaagcgctcagtcgacagactaaaaaaaaaaaa

SEQ ID NO: 20200 - DNA, 761 bp, Triticum aestivum
  unsure (1)..(761): unsure at all n locations
  Clone ID: PAT_TA_20200
caatttctagctatttaaacccttttacgcaccataacctagcaggcacaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggatgtccctggccgactggttcaagaaggaggaggacgaggaccgccagccgccgttccccgtccgacgccctgcacgggtgcccctcgttcaacgagagcaccaagctgctggacaaggagctggacaggtcctcgaggaaggcgtggcccccacagaacgctcggccttcggggcgtcataagggantncggcncganttttnagggcttcgttggnnaactattnntnggaagcagggaacgcnacgggncgcatgnaaagctttccagaataaatncaactgntaan

SEQ ID NO: 20201 - DNA, 574 bp, Triticum aestivum
  unsure (1)..(574): unsure at all n locations
  Clone ID: PAT_TA_20201
gtttgcggctgtgaccgtgccacttctctacgggtcgtccctggccgagccgaagtccatcccgtccaagtccatgtacccgaccttcgatgtcggtgatcggatacttgctgagaagggtctcatacatattccgggatccacaaatttcggacatcggtgatcttccgggctcccccaggacttcaggtttatgcctacagctcaggtgatgtgttcatcaagagagttgtggccaagggaggagactatgttgaagtgcgtgatggcaagctgtttgttaatggagtagttcaggatgaggattttgtgctggagccacacaactacgagatggaaccagtgcttgtgccggaagttatgtgttcgtgttgggagacaaccgcaacaacagctttgatcccacaactggggtccantccagtgaggaacatgttcgggagattatcctccggtattgggccaccatcgaagatcaatgatacaattatgagcctgangtgtcccgctcaggtgccgtcctcgtagtagtcgctgcatgatgctgganaaccatgtgtgtaaaatgacttat

SEQ ID NO: 20202 - DNA, 607 bp, Triticum aestivum
  unsure (1)..(607): unsure at all n locations
  Clone ID: PAT_TA_20202
ctcgtgccgcacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaactcttcttcagcactgatgttgagaacacgtccctgaggctgacatcactttgtctcggtgaacaccccaccaagaccgtggcttgagctggaaggtgccgactcactacgggaaaccgcccaaatctcgccgctccagtcgcaattcggtctagttgcaccgtccgtcactcctgtgtatcgctgtggtccgnaantttgncaaacacaaggnataatacaatcttcaaccggattctncaaggaa

SEQ ID NO: 20203 - DNA, 1351 bp, Triticum aestivum
  unsure (1)..(1351): unsure at all n locations
  Clone ID: PAT_TA_20203
ctgcgacgcgagccctcaccgcccccatcacgccgggcccctcgttcacgacctcctggcgttccaggagagcaacgtcgactatgcccaggtccgcaaggcgtggaaccgcggggacctcctttcttggaccgcccgccaccggcacgtccaccatgaccgccgccatggccaacttccttgactacgacgtctacgatctcgagctcacagctctccagagcaacaccgggctgcggaatctcttcattaagaccactggcatgtccagcatactcctagagaaaacaacaccgagttgcgaaagctcctcatcacgacgaagggcaagtaaagcatctagtgacaagacatcgactgctccggagacctcaccggaaaacgccgcaaggacaaggaaggcctctagcgacaaggcactccgatggcaacgacaaacccaagctaccaatcgagccagagaaggatgacgccaccaaggtgacgctctctggcctcctcaacttcatcgacgggctgtggtctgcgtgcggcggcgagcggatcatcatcttcaccaccaactacaaggagaagctggagccgtcactgatcccggcggggcaggatggacaagcacattgagatgtcttactgccgctttgagagcttcaaggtactgaccaagaactacctagatgtcgtcaggcatgagcggattggggagattcagcagctgctcgaggagaccgacatgtcgcccgctgacgtggcggagaagctgctgcccatgacgaagaagaagaagagggagcaggacgtgtgcttgacaggcatgatgaaggagctgacgcagacgaagaaagacacggaggtagccaaagcgaaggaggaaacgtcagccaaggagactggagagaagaaggcaaaggagaaggagcaggctgaggtgaagaaaacataggagaaagagaaaaggaagggacaaaacatcagtaggacgccattggcagacaacatgcaagctgacaaggatacaggagtagagtgagcatgtccactacatgctccgtgaccaagagatgcagtgttggttcagataagacatatatcactcaactgaaataaaataatgtagcttccttttctcatttgctaattcacacatgaagcgactgttgtaatgttgctataggtagagtaagtagtacaatactacataatcccaacactgtgtatttgtaaatgcagaacgaaacttagcttgtttgcaaaaaaaaaaaaaaaaaaaaaaaaaanaatcaaaaaanaananaaaaaaaaacataaanaggaaaangaanantaantaaaaaaaaccccnaaagtgtat

SEQ ID NO: 20204 - DNA, 590 bp, Triticum aestivum
  unsure (1)..(590): unsure at all n locations
  Clone ID: PAT_TA_20204
gttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtgggcgctgcgcgagatccgcaagttaccagaagagcacggagctgctgatccgcaagctgccctttccagcgcctggtgcgcgagatcgcgcagggacttcaagacagaccttccggtttccagagccacgccgtgctggcgcttccaggaggccgccgaggcttcctcgtcggtctntttcgaggacaccaccctgggcagcccgtccgccctaaccgcgtgccccagcatcgcccgccgccgtccggcgggcccgccgcatcgttcgcgtgcgcgatttgcgttcatatccgggggtatgcgcattgtccgtttccctttcgattcggtctgtttagctcgttgttctgaaatcgtaattttggattngtttncattaaaaaa

SEQ ID NO: 20205 - DNA, 607 bp, Triticum aestivum
  unsure (1)..(607): unsure at all n locations
  Clone ID: PAT_TA_20205
ctgcggcggcgtgcctggcagtgaagcgggtagcaggtagagccagccagtctagcttagccaccacactagtgtgatggcgaccaccggcggcggcaaggcggcactggtgctggggcggcttctgcttctgctgtgcgtgctcggccatggagctgcgcagcggttacaacgccatctggagcttcggcgactccatctccgacaccggcaacctctgcgtggggggcgggtgcccttcctggctcaccacggggcagccgcccttacggggagaccttcttcggccgccccaccggacgctgcttccgacgggccgcgtcatcgttcgacttcctggccgagcactttgggctgcccctgctgccggcttcgaaaccggcggcgacttgaagaaaggggcgaacatggcgatnaatcggcgccacaccatggactttgacttcttcaagtcatcggctcaacgacaagttctggaacaacgggccgctggacaccaaatccatgggtcaggaactgctccctccgtgtgcggaaggatgcaagaatactgtcaaatcctttctggtgggcaattcgcggaacacanaaccgggctctcccgggg

SEQ ID NO: 20206 - DNA, 689 bp, Triticum aestivum
  unsure (1)..(689): unsure at all n locations
  Clone ID: PAT_TA_20206
gctaaccagaagctagcttcagtcggcaaacgngaggaagagaatgccaagctgaaaactgcccttgatgaagccaacnnggaggcgactcatctgaagaaggacaagaacaatctgaccgaaaagatggaaggcattgctcgcaaacggggcgatttggagaactatctgggagggcttgccaagaagatgttcatcatgcttgaagaattttgccagaacttcaaggaagaaactgggcgagttgagacaagcttggaccccatcctctctcctgtgaaggacgaagctgccatgaatgtgctctgactggaatcccgtgtcgctggtgttgtcgactaccttgctcgactgaaagtcgcggtgtcgcgaatcgacacagcactctggccaagggcgacgctccaaaatgacctcgagtctctgatggctcgacttaacgaggttcctggtcgagtgcaggaatggagggtccctctcctcgcggcggtgcggctgccggctgtccctggctggtgcccactgcggggcagcgcgagttgggtactagccacctccaggttgcgatcccaaaagnacgantccatcttcatgggaacttcattgctgcgcantcggatgctgacggatngactggacattcgtcaaccgctaccactcctgcggatgaanaacttatgctcacttaa

SEQ ID NO: 20207 - DNA, 818 bp, Triticum aestivum
  Clone ID: PAT_TA_20207
gccggccgggcttcgaatacccaaccaaccgcctctacaagcgcagcccagatctcggctccttcccttcctcgaaccaagcatcagcaatggcgaccacggcagccgacgccacggccgcggttcccaaggagcagcagcccgccaacggttccgcggccgccaccaccggcggcgagcaggtcacgcgccactccgaggtcggacacaagagcctgctccagagcgacgccctctaccagtacatcctggagacgagcgtgtacccgcgcgagcacgagtgcatgaaggagctccgcgagatcaccgccaaccacccatggaacctgatgacgacgtcggcggacgagggccagttcctcaacatgctgctcaagctcatcggcgccaagaagaccatggagatcggcgtctacaccggctactccctgctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctgcccgtcctggacgcgctgctggaggacgaggccaaccacgggaccttcgacttcgtcttcgtggacgccgacaaggacaactacctcaactaccacgagcgcctcatgaagctcgtcaaggtcggcggcctcctcggctacgacaacaccctctggaacggctccgtcgtgctccccgccgacgcccccatgcgcaagtacatccgctactaccgcgacttcgtcctcgagctcaacaagccctcg

SEQ ID NO: 20208 - DNA, 1163 bp, Triticum aestivum
  unsure (1)..(1163): unsure at all n locations
  Clone ID: PAT_TA_20208
cccccacccgacgcgctagctagttctattgccgcaccccagatctccaggagggactcgttcgttcagctaactacaccgcaccacatacccaccccaccacctctgcacgcgcagcccaggatctcgcccccttcccttcctcggacccagcaccagcaatggccaccacggcggccgacgccacggccgcggcgcccaaggcccagcccgccaacggttccgagcaggtcacgcgccactccgaggtcggccacaagagcctgctccagagcgacgccctctaccacgtacatcctggagacgagcgtgtacccgcgcgagcacgagtgcatgaatggagctccgcgagatcaccgccaaccacccatggggaacctggatgacagacgtcggcggcacgagggcccacgttcctcaacatgctgctcaagctcatcggcgccaagaagaccatggagatcggcgtctacaccggcctactccctcctcgccaccgcgctcgccatccccgacgacggcaccatcttggccatggacatcaaccgcgagaactacgagctggggctgccgtgcatcgagaaggccggcgtggcgcacaagatcgacttccgcgagggcccggcgctgccggtgctgggacgcgctgctggaggaccgacggccaaccacggcaccttcgacttcgtcttcgtggacgccgacaaggacaactacctcaactaccacgagcgcctcatgaagctcgtctacctcggcgacgtcctcagccacgagaacacgctctggcaacgcctccgtcgtgctccccgccgacgcacgcacgcgcaggtacatccgcgactaccgcgacttcgtctcagacctcaccaaggccggcgcaccaacccggccgcgggcacctgccagccccccgtcggccacggcatcaccccccgccgccgcgcgcagtgaaccagaaaacccgactcagcccccctgtcatagaccctacgcacatgaatttactaattaatccccattttgtaattcctcctagcctttcttactctctatctatcttcagtaattcgcatacagatttaaccagacaaaaagattactacagacaaatgatcaaatagtattactcctataaaaaaaaaaaatgttgctgcanaatg

SEQ ID NO: 20209 - DNA, 199 bp, Triticum aestivum
  Clone ID: PAT_TA_20209
gaatctgagatgttttattcctgtgtacgtagcactatatatagaatgatgatgtcgatcgtctgtacgtacggtttttatacatatacatgtacacggtatgctatgaacagtactaatggacatggtatgtatggtcgatcatgtgttagtgcatggtgcttatagtatatgccaacagtgtttgcacttgcgaacc

SEQ ID NO: 20210 - DNA, 548 bp, Triticum aestivum
  unsure (1)..(548): unsure at all n locations
  Clone ID: PAT_TA_20210
ggcagccccgtccgtccctccacggctcatctcctctcagtccacacaaaatcggatggtgaagcagcagtagcagccggagaagcagttcccctccccagcagctaagcaccagccggccggacccgccccttctccaccctcctcccctctccccgctccgtcattaccaaggcaggaagatgtgctcgttggaggcgacgcgggcggagctggggctggcggtgctgtacctgaacaaggcggaggctcgggacaagatctgcagggccatccagtacggctccaagttcatcagcaacggccagcccggcaccgcgcagaacgtcgacaagtccaccaccttggctcgcaaggtcttccgcctcctcaagtgggtgaacgacctgcatgctctcatcagcccagcccccaaagggacccctctcacgctggtcttgcttgggaagtccaagaatgcgctgctgtcgactntcctgttcctggaccagttcgtgtggctaggaagatcggggatttaccagaacagggagcgcacggaccgcatc

SEQ ID NO: 20211 - DNA, 1303 bp, Triticum aestivum
  Clone ID: PAT_TA_20211
cccgtccgtccctccacggccccgcctcatctcctctcagtccacacaaaatcgagtagcagcccggcaggcgctgcccgtgaacccggtccccgccccagccgctaagcaccagccgcccgcacccgccgcctccccactctcctcccctctccccgctccgatgtgctcgatggaggaggacgcgggcggagctggggctgggggtggtgtacgggaacgaggcggaggctcgggacaaggtctacgggggcgtccagtacggctccaagttcatcatgcaacggccaggtccggcaccacccaccaacgtcgacaccgcccacaccgtggatcgcaagcacttccgcctcctcaagtggctgaacgatccgcatgctctcatcgagccacgcccccaaaggcatcaccctcacacccgtcatggggacccatcttaagattgcgttgctggggaagtccaagaatgcgctgctgtccatgttcctgttcctggaccagttcgtgtggaaaaaggagcgcagggactgcatcaccaggaaatgcatcgactgcgggacggcctcctctgtctattccagcctagtcgagcttggcgagctcagtctactatcgaatgcgatgaggaagcgcgcctaggagctcaggggcacgcacgaatacgaggacgagcagtacctcgggaagatgaagcagtcggacgcccggctgctggcgctggtgaaagcggggatggacgtggtggtggccgtggggctgctgcagctggcgcccaagaaggtcacccccagggtcaccggggccttcggcttcgtcacctccctcatctcctgctaccagcaactcccgtctcgggctcccctggacaaactcaaggcgtgagcaatcgcgaggaacgctacaccgctccgctccacagtccgcctccactcaattggagtcggtgctgtgctcgagcatggaatccgagatgctttattcctgtgtacgtagcagtatagaatgatgatgtcgatcatctgtacgtacggttttcatacatatacatgttcacggtattctatgaacagtactaatagacatggattttctcggtaaacacttatgagtagtagtaatggacatggtatatctgttctgtcacttgcgaaccaaaggtaataattaagtacacggagagtactcccacttgccgaaaatacttatcctaaaaatggtttaaaatagatgtatctataactaaaataagtctagatacaaccatttctagaacgggtatttccgcacggaaagagtacgtatt

SEQ ID NO: 20212 - DNA, 1435 bp, Triticum aestivum
  unsure (1)..(1435): unsure at all n locations
  Clone ID: PAT_TA_20212
cccctcgcgcagggggccgcggctcgcccccccccctcgccgctgcctccgatagtagttcaggagctcgtgggactggcaaatgtggcgccagcggtcgggccgctgagcccactggtggctccacggggggcccaaccggaagagggggcagtggtgagatcaaggagccctggcctcatcggctttcctcggtgctcgctggcgcccacggcctttgctctggggttgtcccttgccgcagtagcgtggtacccccttcctggggcttgggccagtctcttgtcggacacgctgctgtctgtcctgtgctctgcgactcgcgcgaggggcctgcctcgagctctccgtgtggggtgcgtgctgcgactgcatgtcagtgcatcagctgtggtgcttgcgcagagcctccccctgctgggcggcaccctactgtgcccttgggtctgcgcgagggccgccgtggtgggcgggcctcttctcacagagtatcttggttcgccacagcggcacattgcagcttctgaaagtaattcagaagttaatggtacaggaaaaaaagaggatatagttggtggtgcagagaataatggtaaaagtacggagagcttaacagaaaaaaatgagagtggtgagataaatgaggacttggatgatggggttagcaaagagttggaaggtggacatgagcaatgcaatgaggctgttcgtaaccaaaatagcgaggaagcatcatcattggtcaatgaggagtccattgatgcaaaagcagctgactgttcggagcacagcaaaacacgcgaggaaggttcttcgatttctaaaaatgatgtgcttgcagctactgcatgtcagttcaagaactttgttgctattgtagaccctccacgtgctgggcttcaccctactgtgatcaaggtattgaggactcatccacgcatccgtcgcctagtgtacatttcctgcaatccagacactctagttgccaacgcgatcgagctctgcaccccctcaaccgagcacagggaaaagaacaagggccaccgtggatggcgaaacatgagcagcgccggcctcgcgaggcagaggaccaagtcgatgcccaactcggagccctttgtccccaagagggccatggcagtcgatctgtttccccacacctcgcactgcgagatggtcatgctcttcgagaggtgaacgaagcagccgttgttcatttaatccttgtgactagcgaggttgtttaatccctgtctgaggaccataccaaaattttcttcggtctcctcattttgttgtaccaaatgtacttgacctagaaccctgacagtagttgagtggagaactgtgttgctgttataaaaaaaaaccaaaaaaaaaaaaaaaaaaaaacncccaaccagcccgggngttcncccgcnttccnccccgnccg

SEQ ID NO: 20213 - DNA, 607 bp, Triticum aestivum
  unsure (1)..(607): unsure at all n locations
  Clone ID: PAT_TA_20213
ctggtgcctagagttgcgttgtcaaatcgaagcttgctgtgggttcggaatttactttttgaaagggatatgaggattcgttcgagctgctaaccggactagtgcaacatgagaatcatcagtagtgtcactatcaacactgtcaatgctttgtcgattgaattattttgaggtttatcgttctgatttttaatgatttagatgtattagttggtacagtacttccagtgacttggtccacgaagcattcagaaaaatgccactctgaagcttgctggtcactagtcacacatcctgtttccggcagcttgggtacgccatagccgcatcacattcatcagagataaaagtgtaaactgagaggcatgcaagcctgcaagacattctcctttgttgtgtatatagcaggtacaatagtgggagggtatgtccatgttcccttgtgtgcagggagtggtcatgttctcacaaaacaagcantacttatcgtgttgcgtggggcctcaanaaaaaaaanggggnaganaaanaaanaccgnggggccggaccattccctanaggatngantaccgnccatggcngntttanacgcgnacgggaacctgn

SEQ ID NO: 20214 - DNA, 1008 bp, Triticum aestivum
  Clone ID: PAT_TA_20214
cgcctcccgcccgcgacgcggccgccccccgtgccgggtcgccctccgcgcccctccgcgcgcgcctcgcccgccggcggccgcggcctcgtgggcccctcttggctctcgtcctgccgtcgccgcagaggaagacggagacaccgtcggagggaggagcgccatggccggctctgatctcctccgcccagatccagccacagggctggccatcgtgatcatgggcgtcagcggctgcggcaaatcgaccgtggcggcgatgctcgccgacgcgctgggctgcggcttcgtcgaggcggacgactaccactcccacgccaacaaagagaagatgagcaggggcgtcccgctcacggacgaggaccgcctcccgtggctggagtcgctgcgcgacgccatccgggagcgcctaggccgcggcgaggacgtcgccgtcagctgctcggcgctgcggctcaagtacagggaggttctccggcagggggacatcagttacaagcccgggagctatgagacctgcagagtcaagttcgtgtgtctagaggcgtcggcggaggtgatcgccgggagggtcgagcgcagggcggcggaagggggccacttcatgccggcgagcctggtgcggagccagctcgacctgctggagatcgacgcggccgaggggatcaccgtcgtcgacgccacggtgcccgcccacgccatcgtccaagccaccgtcgcccagttcagggacgagctggcatccatggcgtgctgagaaattcagttgaatccagctgctctgtttcttatttctgaatccagtttcatggctgtacaagttatacaagttttaaaggctcttcaaaccccggaaattgcttttggagacggagctccgtggaggcctccaaatgcaaaattcaaaattcatatttttatatctgaaaaaattacagagatagttgaaggcatagagcacaagtgtgcacatttttagaacgaaatacactgaaatgagggctgcgc

SEQ ID NO: 20215 - DNA, 650 bp, Triticum aestivum
  Clone ID: PAT_TA_20215
cgtccgcggcggcatgtcggaatacagcccccccgagatccacctcggtggcgtctgttcaaaacttgggtccttggccattctaattatcttgcccagagacgtatatatagtataactgatgtaagccccaaacttctgtaccaaagtctcaacaattacaaggggcgcccagccgttttaccttccagtcctacagtcaaaacctaaggagttctatccgacgaaagaatggtgattcttcccttcccaggtataaagcattcaggcaccatgatttgaccaatgttgccctcaagcgtctcatggacttgaacccagctgcaaccatcaccaggtcatgatgtccgagcggaacgattctgtgccccctcgatgatgatctgagcggaatgccgtcggcggcagacctgagaggaattccttcggtgcccctcggtgacctgagaggaatcctatcagcagcagacctgagaggaattccttcagattcatacgcatcctcatccgcgtgtttaggaattcggataggtaaattctgttggagaccatccacctttccgttttcgcttgggtagctgttgcggcccaccatccaccgtgtcttttcccctctgttccgggacaatttagagtcggattttgacgat

SEQ ID NO: 20216 - DNA, 660 bp, Triticum aestivum
  Clone ID: PAT_TA_20216
ccccggcctaccgcgcccgcccgccccccccccccccccccccctcgccgccgcggcttgcccggtgcgatcgcccgaggaagacagggagggagatgaggagcagcgaggccatggagctcctgggcttcgctccctactcccgcccgtccccttccgaggtgaaggctgcgtatagaagaatggtcatggagtcccatcccgatcgtgtcccgacgcatcagaagcctcaagcggagtcaaaattcaagcagatagtagaagcatattcttgtttgaaggatggtcgaagatttgggaacagaatggaagtacatgtaatgaggtctggtgttccaacgggatacagaagatcaaacaagacattgagtaaagccccctttctgctctttattcgtgccgcaatttcctttgggtcctacagcgcttccagggcataccagcggcaaaaggagctgtgttcctctcacaaccctttgcttccatattggcaatccagtgaactgtccgtatcgcatatatatatctaacctactccgagcgtacacctgtgggtcgcagggtgtgatgcgaagcatgctcgccgctgattgagggccccaaccaccgcgcgcggtttcaaggaaccggcgcttgcttggtagatgttcagtttagctc

SEQ ID NO: 20217 - DNA, 1210 bp, Triticum aestivum
  unsure (1)..(1210): unsure at all n locations
  Clone ID: PAT_TA_20217
cggcacgaggcacacgtcttcctcacctcctctctctctctctccatccaccacggtcatcctcgcacgaacccctttcaaaaaatttaagactacgccccagatcacatcgaattcaccaccaccgcctccctccctccctccgtgctttcattttcttttctcccctcgtgcgcctcgtcacgagccgacaagccgcgggccgggagagatcgatcgcgatcgtccccatccatgtcgacctcgcgcaggaggaccctcctcaaggtcatcgtcctgggcgacagcggggtcgggaagacgtcgctgatgaaccaatatgttcacaacaagtttagtcagcagtacaaagctaccattggcgcggatttcgtcaccaaggaagtcctcattgaagacaggcttgtcacattgcagatctgggacaccgccgggcaggagagattccagagtcttggtgtcgcattctacagaggggcagattgttgtgtgcttgtttatgatgtcaatgttaacaagtcatttgatacgctcaacacatggcatgatgagttcctcaatcaggctagcccctcagatcccaaaacattcccattcatcctacttgggaacaagattgacgtagatggtggcaaaagcagagtggtttctgagaaaaaagcaatggagtggtgttcttcaaaagggaatattccttattatgaaacttctgcaaaagaagactacaacgtcgatgaagcatttttgtctgttgcaaagcttgctctagagcatgagcgtgaccaggacatctacttccaaacagtcgcagatcctgtccccgagactgaacagagaggcgggtgtgcatgctagcgattagccgtctttgtccttccagattttgcctactgtgtgtggtattattctttttaagtgatgctgggcattccttttgagttgacaatgtacactagggtggctatgcagccactcaattcacttttgtaacccatgtaagatagttagcaactatggtttcgattcacggagtactgatgagcagcctgccctgtttcttgagtcggcaataagagtgcacagtggtactactgatacaatttgggatatatatggcctaagcctcaattatattcatgcagcggtaacttattgatctccaaagcgttatttggtcgaggcgggcanattcttctaaatgttnggaata

SEQ ID NO: 20218 - DNA, 584 bp, Triticum aestivum
  unsure (1)..(584): unsure at all n locations
  Clone ID: PAT_TA_20218
caccgcccacgcctccggacgggtcggggtaccttgcccgatggacggtcgccgagactctggggccacgcccaacaagcacaccccgcgcgctgtccgcatcttcgacgaaggcggtggcagcgccctgcccagagttgaccgcagcgagcgcgaggagctgtggcgagagtccgaacacaagcagcctgctgggcgcgcgcgcggccacgacggagcggagcagcgggaaatccttggcgttgaggccgtccgtggaccacaggtgaagagcgaggaggtggtgatccgggacacagcctaggtgcatcctgcgcatcaatcagagacgaagctggccaggcatgtatgtgctacttctgttgctggttgtgctggggcaggtagtggcggtggctgctgcatggcattgggcaatatcgtgggattgttgtgggattttggatgtctttgctgtttcagagaaatagatgtaggtgagtttgtctgtcttatgattgtgtctgacaatgnttgttcaatgaattgcattgancaattgttttatgaattcaataaacttgtgtacatagtaagaaaaaaaa

SEQ ID NO: 20219 - DNA, 656 bp, Triticum aestivum
  unsure (1)..(656): unsure at all n locations
  Clone ID: PAT_TA_20219
aagacggcngtggcgcgcttatnggcgccggtaggcgtcttggtgccggccccccccggccccccttttttttcgcttttgaccggagagtattagatgtgcatgtacaaaattgtctttgtataactctggtgttacaaatttcatacaaaacacactcaccaaactaataatttgtctaaaatacatcactagaagaattgaagtccttttcttgaggactttctgagaagggcagctcatgtgatgtcttagtctatacaatgaactgcccccatgaatatggaatctgaaattacaagaacttattccacagtaggtatgaccatcacacaattttttggagaaaccatcacacattcttatatttgtatttcatcgcacaactgatgtaaaccagcaaattcacaaagctgatccctgcaatcaaccaaaagaaccggtcaagatggccttcattcatgttatccgggatccatccaggatctccacctcgagttgtaacatacgacaccagggtcaatatgaatgagcttaaatagctccccgctgagaccatgacgagcgcaaatgcagtacataaactcctcatggcatctgctgatcgncgaaactcagtgnctatatagtgaaactggngcgcacaggaatctgtg

SEQ ID NO: 20220 - DNA, 791 bp, Triticum aestivum
  Clone ID: PAT_TA_20220
ctctccctctctctctctctccggcggctctgccgtccggtgtgaggatgggttaggtggtcggtctccctctgttcatagtagtcttaggtttaggtgtaggttgtgtcttgcctccgtggcgtctggcgttatgccgtacttgagctccccatcaacaaatccaggcagtgtttggtggttaccagtagcctcccaggccggccatccatggtggatggaggcagatgggagtggatctggtgcgagctctctttccccaataagcctgaggtcttccctgatctggaggatggccctctactgctgcttgctctttcaactcactttggtggtggatgaggagcgggggcgttgcagatacttgaagcctgcagatcgagttcgtgcatatcagtagttgattccatggtggagcgacggcgccctcgattggctgccggtctccgctggttcactgcttcttctggccgaatggcggccgactccattcctcccggcgtgcgtgccttatgggaggcagatccagctgttgttcggaggctatggtgtgcaggtgttgcggccatggcgatttcttcgcgccaagtggttcgtcccctgaggttcaatccgggcggtggctgatagggacccgatcgcgtttcgtgctttcagtttggggtcctccatgtaaaagccaggggcttgtttgttacgtattttactttggagtccttgtaggagctttgtactttcccccctttggtgttaaacgaaagctcggggtcgttctagacccctcttcagtt

SEQ ID NO: 20221 - DNA, 1032 bp, Triticum aestivum
  Clone ID: PAT_TA_20221
ggtcatccgcaccctcccagcccggcccccctgagagtcttctcgcgcctcacggctctgcccctctccctctctctctccggtggttctgccgtccggcgtgaggatgggttaggtggttggcctcctgttcatagtagttttaggtttagtagtactgtgagacttgcctccgtggcatttggctttatgccgtttttggatctctccatcgacgcgtccgggcaccgtctggtggtctccggctgcctcccaggcttgtcgtccatggtggacggaggcagttgggagtggatctggcacgagctctcttcccctaataagcccgaggtcttcttagatatcgaggattgccctctgcagcagcttgctctttcaggtcacttgggtcgtggatgaggagcaggggtgttgcagatacatgaagcttgcaggtcgtgttcgagcatatcagcagctgattccatggtggagcgacgacgcccttggttggctgccggtctccgctggctcgctgcttcttctggctgaatggcggccgaatccattcctcccggcgtgtgtgccttatggaaggcagatttagctgcggtgcagaggccgtggtgtgcagctgatgcaggccatggcgatttcgtcacgccaagtggttcgtccccggcggcgccctggttcttcccgggcggtggcggcccacgccccgcccgccggcgtgcgtgtcttattgggggccgccccggctgttgttcggaggctatggtgtgcaggtgttgcggccatggcgatttcttcacgccaagtggttcgtccccgactgaggttcaatccgggcggtggctgatagggacccgatcgcgtttcgtgctttcagtttggggtcctccatgtaaaagtcaggggcttgtttgttacgtattttactttggagtccttgtaggagctttgtactttcaccactttggtgttaaacgaaagctcggggtcgttctagacccctcttcagttaaaaaaaaagacggggcagcgcatacc

SEQ ID NO: 20222 - DNA, 702 bp, Triticum aestivum
  unsure (1)..(702): unsure at all n locations
  Clone ID: PAT_TA_20222
gtgcggtccacgacgagcgccaatgcagtgcggtgctctccaattcttcagatttgttttgggcaattcagtttggagcttcgcgtccgccccacagcctcggtggtctcccacctccctacttccatcctcggcggccgacccacaactgaggacgcacggttccagccacctgcccctccccacgccgatgcgctggacgacaacagcacaacagcaccggaggnggcgacatggccatctcaatcttgtccttgcgccacaccatggaccccgttcgatagcgacctccccgacgaccaagtgttgcagcccacttttttctttttgcaattcgcatgttaaagtttctttttgcagtgcgtgtgtgttgttcggtgtgagctcgaacgaagacacagatcagtccactctgttctctaatgcagaaaaaggaggaaaaaccaattataaaaaaagaaacgcaagactcgctctcctgcatgcagttcgtttagagtttgattgatgtccggttttgtgggtcatggagttcgattggggctcacctagtaaagttcataaaaaaatgtccatcgagatttgcagtgtagtgcatagtatagaggagtttatgttgtaaaaacttctacaaagcatgatgtagtttcnctgttaaaaaccccttggtggttatgacaaagaaagcatgcagtttgtttc

SEQ ID NO: 20223 - DNA, 1023 bp, Triticum aestivum
  Clone ID: PAT_TA_20223
cgctcgcatacgcgttttcccatcagtggaagaacagttcaaggtcctccaacccaatgtttgtagacccaaacaacccacactggggctggagctggctggagcgctggatggcagcaaagccttctgaggccggccgcactggaaccggcaaggaaagcaacattgaccagggatcagtgaagagcacgagtttgaaccttggagagggcgagatcactaaagccttcaaccgtaggggctccaagccagacaagtcgtcaccgacgactccaaagctgacccgcccagcctcccggctgtccccttccacacccactgccaaagtgacaccaatagttgtgaagaagaaacctgctacaccgaagaacgggatttcacaggtggatgacgatgcaaggagcgtgctcagtgtgcagtccgagcgaccaaggcggcacagcatagccacctcaacagtgcgggatgacgagagcctcgcaagctctccatcagtcccaagctacatggctgccacaaaatctgctagggccaagtcccgcctccaggggtcgccactgatcgatagtgcagagacgacaccagagaaaggaggctctattagcgttgggtcagccaagaagaggctgtccttcccagctggaggggtgcccccctcgccaatgaggcggcattctggccctccgaaggtggagagtgtggtgaaggacatcgctgtgacaccgcagccagaggccctggcgatcagcggttgagacaaacaagcaactcatacaagtggagacgggactatggattatgcagatacacatatttcacccatgaaaaaaaggtcaaagttcttcgaattgttgcattttgttttcatccaattattattgtgactacattgtcggcttcattagggaagactctcggtgtcgtctgtcggtccattccatttgttgcttgtgtaaaaccatatggggtttgctgtttgtatgtacacaggtcttctatttatgcgagcaatatatttcttcc

SEQ ID NO: 20224 - DNA, 652 bp, Triticum aestivum
  unsure (1)..(652): unsure at all n locations
  Clone ID: PAT_TA_20224
cccacctgattcatcagcatatcgatcctagtagcaaccgcaggtagccacccaccaccatggccatggccaagctcgccctcctccttctggtcgccgccttcctcgctggcaccaccaacggagattgcaactaccgtgtccaggtcaggacggatggctttgtttctaccttcacaggtacaggggcaggtgcctaccttgagttgtacaaccaggaccgcgtacgcttgaccgcgggtgacaggttcgacgagcacagcgaaggcaccttcaccttcacgaaccaggaatgtttgcagccgtgccgcctcgtcttcaccctttttgcaagcaattttcccggaacagaggttctgccagtacgtccaagtcagcggagtcaatgatcaaatctcgcacttcgaggtcaataaggtggttatctctggccagctcgtcgacgtcgacaactgctagctaacacggcggcgccttgggccgtcgtaatattaattgcactgcgtgtgctcccgcgctttccattgtttgttaccgttacacgtttaggttggttaatttcccgggtgtctgtccttgtttaatttcaattctattcaagcgttgttatttcctcatttgaataataagcgggaagangttcctctcaaaa

SEQ ID NO: 20225 - DNA, 562 bp, Triticum aestivum
  Clone ID: PAT_TA_20225
cggacgcttccgcccacgcgtccgcgggcgcgtccggtttctgcgctcgaacaacccgggacccggcggcgaggaagagagagcggcggagatggcggtgatggacacggcgttcaaggcgctgacggcggggctgggcgtggcgacgctctacctggccggctccttctccttcaacgtctaccgcggcctcgcctggcactccgagcaatccaagctagaaaaagaaaatgagaagagccaagattgagagggaaggacggcaagttagtgtcggacattaccaatcaaaaggatctgcaagaaatctcatcttttgatgatgagtggtcattcgtggttgattttcggacagttcctttgatgtaatatagattcagggatttggatgaccattcatctctatgtgcgctctattttcacacatttcttctttgtactaagcataagggtgcgctgagattaaaaacaaaatattggtgttctgtgtctttttcctcgagcattagacgctcttacaattagctaaattaaattcaagtatacgaatgttcttatgttt

SEQ ID NO: 20226 - DNA, 583 bp, Triticum aestivum
  Clone ID: PAT_TA_20226
ctcgagggccggcctctcgtggcacgcacgcagaccaacggaatcgggcgacgagggtttctgcgctccaacatcccggcggcgaggaagagaaggcggcggagatggcggtgatggacacggcgttcaaggtgctgacggcggggctgggcgtcgcgacgctctacctggccggctccttctccttcaacgtctaccgcggcctcgcctggcactccgagcaatccaagctagaaaaagaaaaggagaagaatgaagattgagaaggaaggacggcaagttagtgtcggggattattaccaaccaaaaggacctacaaaaaatctcgacttgtggttatgttttctgggactgatttccaggcggttcctttgatgtaatatagattcaggatttggatgatcatatctctttaagtgctctcagtttttacagattactgagatgaaaaaaaaaatggtgctctgagatggtaacacaaaacatgtgtgttccgtgcaattagccattcgggcttcatgtctcccttaggatcagttgaatgaaacatatgaaaactgctcaagtgtttccaaaaaaaaaa

SEQ ID NO: 20227 - DNA, 605 bp, Triticum aestivum
  unsure (1)..(605): unsure at all n locations
  Clone ID: PAT_TA_20227
gtcgtggttgaatgctctcttggtgcgtctctgctaggcggtgccctgcagctacgccagtggcacagaggggccgtggcgtcgtctcggcctcgtgcaacctttcgaatgtacccccgacacaggtggtgtcgtggcgttgtgcagtctcggttgtgtggagcctttcgattgcgtcgacggtgcagtgtcgtggtgtggtctgcttggcaatgctcttcgactacgctggtggcacacaggtgccgtggcgtcgtctcggatccgcgtgtcccttccgaatgtgcctccgtgacacagtggtgtcacgaacgttgtgcagtctcggaatgcgcggagcctttcgattgccgtcgacggtgcagtgtccgtggttttgggtcttgggctgggcccgatgccgttccgcctccatcatatggtgctctttgttgtgtcctccctccctgtaccccatgtatggtgttgttgtggcgtgtgtttttttttgcttttctccttccttctcctgtgccccctggtattcccggttcacttgnaacctatcccctgcgacaggctgcaaagccttaataaggcaaatggaatacattccaaatggggaa

SEQ ID NO: 20228 - DNA, 523 bp, Triticum aestivum
  unsure (1)..(523): unsure at all n locations
  Clone ID: PAT_TA_20228
tgggagcacttcaactctggttcatctggccgaccaatgggcaccccttgctcaaccttattcaacccaacattctgcaatgagctctggctctcctgcatctcatctgtataatcaagacactagtgttgtccatcctaacccgtcttcatctcttatgaacgatggaaatttaggcataaattctgcatctggcagcgcaattctgtccaatttgttgccatcatttgcatcgcaatttctaatgggtaggcctccaatgtctagtccatttttcggaacacctctccaacatgttcaactctcatctggccttccacagagtggttccaatcctcagccttctgtttcttcaatgcaagcacgggcaacttcaacggcaacaataactcagcagctnatcaatccngaaccagcaanaanttgcttctcttcnatggnagnaacagcangagcagctcantcatatncaccaaatagttccagtncgngatgntttgcagttnagaacaattcntgtccc

SEQ ID NO: 20229 - DNA, 782 bp, Triticum aestivum
  unsure (1)..(782): unsure at all n locations
  Clone ID: PAT_TA_20229
cgccggcaagcgaacctgagctaccacagctccagccccggcccgctaactaacccgagcaagcaatggcggcgtccaggacgagcggcatggccgtggcgctggtcccggtcgtggccgggctcctgtgcccgggcctgcggcgcggggaggcgtgcaacggccacccgtgcccgtcgcccgcggccaacggccccgtgaccgcggtcaagctggccgtgggcgcggacgtgctggacgggctggtccacgtggtgctggggccagtcggccgcccaaagcacgcccgtggctgctcccgtccatctccgggccgtggttgggacctgggacgccggccgccctggcgtctgcctcggccatccaacgcccaacgtcctctccggcatcgaacctccgacgtcagacgtctgaccttcacgctgctgttcaatctactgcgaatgcaaggtgcccaagggcttcccgctccgcttgcattaaatcaaccattctgcatggatgactgtgcatggccatgtacgtcttaggttgtgtttaccgtgtatttggttgtcttctgctactatctattccttacaacatcaatatccggtcctgtgaagtcccaacttgtgtgcgttgtgttaaaagcgacatttttctttttctccaataaaaagcactgtacttgtactaaaaaaaaaaaatatcccatcgatcggaatggaacancaagtcaatatagccnangctanatagccagaggtctcgggacggngncgcttctcaaaaaaaaaaaa

SEQ ID NO: 20230 - DNA, 2328 bp, Triticum aestivum
  Clone ID: PAT_TA_20230
gacgcggctcctcctcccctcccctcccctcccctccccacggccgccctccaccacgccacaaatcccggcgacccaccccgtctccgaccccgcctcggccaccacctccgaatcccctccgtctccgcgccggctccggctccgtctccgtctcgtgggcggtgacgacccgtaccctgccccgcgtcggggaggggcggccgaggctttttatccttcgcgccccatatgggccggtcgccagccatatattactaccagctcatcgaccggcggaagggcatcggctcgcgttggcgggagctctccagatctgccgcggacgctcgcctcgtgtagatcccgtccagatctcggcgcggcgtcggcttgctctctcctcacccagcggctctcggtccggacatggtttgggtaaatctgattggaagagttttctctgtacatgtaatttctgttaaaagatgacttcactgaataaagttgttccaaataatggtgatgcaaggtcaatgttgccaaataaattcactgcattaaatcccaatgcagcagagtttgtcccttcatgtgttattagaccatcctatggtaatagcacagcttcagatgcaagtaagtctgaacttagggggtcccctggaaaaaaaattctagataggtctgagtcgtccaagtctaataactcacacgatgaggcacaccagttctggcgtaagcagctcccagatgatattattccagacttcacttctttcgagaaaatcgaacaagaacctgaagagctgtcccttgctggattatccttgaatgcacctccgttctatgggacaaaagctagccgcttgtcaagagaacaccaagagttgtcttcttcagctagcaacctggaacttgggcataccaatttattttacgaggataattcacaggcaaccttttcaactgttggttcaagtaattgggagcaaaattacgtgggtgatctccactttgctaatgaaaatcaggaccttcagtatgatcctaccacgggctttactgacggttttgctagtgagtacgttgcagcatcagatggcctctttgaccccctagagtatttagcgtctcagtttcctggattttcagcagagagtcttgcggagctgtactatgcaaatggatgtgacttcaatcatactattgaaattctcacccagctagagatgcaagtggatcctacttccaatcaggcaatgaatttgacccccagctcaccaaactttagtacgggggactttcctgccctgccaacagcagaagatcaaaacggtttctccaagggagatatggatatccttggcttcttcagtgggcgcaattcttccaccatatctagtggtactggtgattttgtttcagctgttcggaaacttgcatcgcagaattctggccacaacaagttcaaaaagggcctgattacggcaatggtgtttctaccgtttctgtacccaagcagtacatgttttggttctaaaacatcttctgggaacaagtatcaaagtgttagtagtgcacgtgcagctgcaactccatggcttgataccggcgacgcagtcgcaaacatgtattcagaatcgagggaggaagctcgtgattttgcccgtgtccgaaatgcatgttttgagcaggctagacaagcttacctaattggcaacaaagctctggccaaggaactaagcatcaaaggtcaggcctataactcgcaaatgaaagcagctcatgagaaagctagagaagctatttatcgacagaggaaccctggttctttgcaacgggggagtgatcgtctgattgatctacacggcctccacgtgagcgaagcaatccatatcctcaaggtcgagctcagctccctgaggggcatggcgagggcttcaggcgaaaggatgcaagtcatggtatgcgtcggaacaggccaccacaccaagggctctcgcaccgcgaggctgcccatcgccgtcgagcagttccttctggacgaaggcctccattacacgcaacctcagcccggcctgcttcgcatcgccgtgtactaacatgatctcttaggtgagcaccacagagaaaagcaacccacaaaaaaaaagaggagaaagagatgcaggagaaaaactaaaaaggtccgctgttggcgcacttgtttgttcttggtagttgtatattaaaaggagccagcaggagaatagcctgacaaaacagaataccagtgtaaaattatacatagatccattcaattcacattccattccccttcaaaaaaaaaaaaaaaaaaaaaaaaaa

SEQ ID NO: 20231 - DNA, 572 bp, Triticum aestivum
  Clone ID: PAT_TA_20231
ctgctatctaactaagcagccacttgtgcttgccaagctaactgttgagagcatcaattgccaccggtgcaatgcttaagaagatggcggccatctgcatgatcgtcctgttcgccgggcatctgcagacaatggcccaactgccccaactgccccaagctgcctgacgtcggtgggctcgtcacaagccacccaagatcatcgtcggcggggctcttcccggcgacgtgggcggcggggacaagctcgcttcctgctgcggccgagccgtagccagtgtgttcccccgccaggccaagtgcgaggaatgcaaggctgcctttcccaaaggttgcgtgcaggacccgtgcaagtgtccttccgacgcttgcttggctggatgcgtgcaaagcaaagtggtggtgtgtgtgtggccgtctgtccccggccgaattggtggtgtgttggcttatttccgtccgttgggtatttttgttagctcgcccgccctccctacctgtttgcttctgggcgccggcgttcttcgacctttccagtcttgtgttcccgtacgttgcttatgtgatatgaaa

SEQ ID NO: 20232 - DNA, 691 bp, Triticum aestivum
  unsure (1)..(691): unsure at all n locations
  Clone ID: PAT_TA_20232
ggtgatgaagctgcccgctggcgcctcaccgggcatagcactggcgacggagatgctccacaagaccttgcttctcctcctgctggcgacggcgcacaccacggccgcagagtggctgggcgaggatgttgttctgctatgcttgccggaggtcatccctgtgcttctctggttcagcctccatctcgaccgtaaaccaggaagcagctccatcatcagcgttgacaagttgaaaccacacagaaattggttcatcttcctcggtgcaatggtggtagctcctccttttgcttacctggccaactccatggatgaagttgggctctccggctggtctacgacattccaggtgtcatgtggcgtctcagggattctgagctactaccttgtgttcatgctaagtcactggccgaagaaacaagtagcagctgctggcaaggatggtggggcttccggtatgctcaaattatgggcatacgctttactcatagcggcggctgcgtccctgctgctcaggtgtctggtttctgcccggttggtctgaactaccactgcatgaacggttatatatgtngtatgctttggtttactactcaattagtaaatgatttgttgtgaacaatcagtgtgtgtgtgttgtaaancacgcgtctgattgtgtgaactgncatacatgancatatacatatcg

SEQ ID NO: 20233 - DNA, 621 bp, Triticum aestivum
  unsure (1)..(621): unsure at all n locations
  Clone ID: PAT_TA_20233
aggcacggaaccaacaaatccccacccaatctcgtctccgatcgactccacgctcgtcgaatactcctcccccaccgcctcaaggtaccgagcttgcctcccctctccccgtgtcgtctagatcggcgttgattagatggttggatggaggtgtagtattgtggaatttggtcggtttctgctccgatctgatgctgtgggaacgaaatttgttgtccgatccgttcgcgcatgttaggtcgatgaagcttcggcgaattcttagggatttttgcgtgtagattgaaggggtagattgaagggatagatacgtctttaacccgttattatgtcggaattcaaaattagctttgtgtcgtaattctctctccaggcgcgtatacctttagatctttatttcggtctaatattctgtacccttactgtcgtaattctctctcaaggcgcgtatgctgcttgaatttgtcncctccgtgctcaanattcggtaaccgagatngtcctaaanaccaanaaggattgggaaaattgantttcccctgaaanaaaccaaagcttcccctttcccttgggtgnanaaacaaagttccgtncaaccaaagtgtgggattnaattgacaa

SEQ ID NO: 20234 - DNA, 601 bp, Triticum aestivum
  unsure (1)..(601): unsure at all n locations
  Clone ID: PAT_TA_20234
ggcgccggtgccgacgaggaagcgggcgccgctgcagcagcggctcttcttctacccggtgccacacgacctggccaccgtcttcgtcgccgtgccgcagtgcccgccgcccgccaagaagatgcgggcgcacgtggtggagtcatctgtgcctctaggcacgtgagaggcgcaattcgcgcacacacatcctctgtctcgttcatgtagttcagcacttcacacgctgacacgcatgctgatgctgcgcgccattgtcgcgaccgcgagtggacgaaggagttcttcagagaagcggaagcgagcaagtccatacacgagcaagggctctccagcggacgagcgcgcaagacaagaagacttgtagttgaatcactctcaactcccctcacacgggctgaagtgaagctcaactactactactactactactctaccagtaacactccgagttaagctcaaccctccagctcgctcgctcgctcgtctctctctctctctctctctctcccccccccccccccccccccctctctctctctctctctctctcttgttctcacatgtncaaatacacgactgtttggtgaaaaaaaaaaaa

SEQ ID NO: 20235 - DNA, 1644 bp, Triticum aestivum
  unsure (1)..(1644): unsure at all n locations
  Clone ID: PAT_TA_20235
cccaatcgtccgcaaaagagtccgcaataacttcggagaggcgtggcggggaagggaaggaagggaggaagctcgtcggcggcggcggcggcggatggcggtggagtaccggtgctgcgggggccccttcttcgagcacatcgccgtcatcgtggtgctggtgctcttcgcggggctcatgtccgggctcaccctcggcctcatgtccctcagcctcgtcgacctcgaggtcctcgccaagtccggcaccgacaaggaccgcaagtacgcagctaagatattgcctgtggtgaaaaaccagcaccttctgctatgcactcttctgatctgcaacgctgaagccatggaggcattgccaatcttccttgatagcctggtgactgcttggggtgctgttttgatctctgtgacattgatcctgctgttcggcgagatcataccacaatctatctgctcacggtatgggctggcaattggtgcctcgtttgctccattggtccgagttcttgtttggatatgtatccctgctgcatatccgatcgccaagctgctggaccatgtgcttggccacggtaaagcagcacttttccgtaaagctgagctacacacacttgtgacactgcatggaaatgaggctggtaaaggtggagagttaacccacgatgaaacaactataatagctggagctcttgagctcagtgaaaagaaagctaaagatgctatgacaccgtctttgtgatacgtttgtgattgatataaatgcaaagctcgacaggaacccaatgcaagaggtcattgagaaaggtcatagcagagtgccagtttattatgaaaaggatacaaacattattgggattgatattggtgaagaatttattatccattaaccctgatgatgaaattcccataaagagcgtaaccatccgcaaaattcctcgcgtttcagaagacatgcccctgtatgacatcctaaacgaattccagaagggccacagccacatggcggttgtcataaagcaaaacattccaagctacccagctaagcagcccagcatcgatggtggatctcttgaggtcgccatcgccatcgatgagaagcagggtgagaaggttgcgaagagtctcaccccgctgcggaggtggaagagctaccccaacaccctcaactccaacacgggaagcaggagggggaaatggtccaaagaccagtcggacgttctccaagtgcacgaagagccgttgcccacgctgagcgaggatgaagaagccgtcggtatcataaccatggaggatgtcattgaagaactgctgcaggaggagatatacgacgaaaccgacgtacatgttgaggaacaataacacattgcttgctagggtttacgcacgccagtttttttgtgatgaggggaagaagaaacaatatatgtatgtataatagcgtaatgttgtactgcatgtgaatagacagggatgccgcgaatattattagttcgtttgaactgctgatacgaatgccgggtgcatgcgtttgtaggagaggatcgatgtcctgcagaaactcacaaggtttnctgaaaacttgtaccgaacatgtactgggatgttacatgacactgacagtggaggacaccgatctncttctgg

SEQ ID NO: 20236 - DNA, 1034 bp, Triticum aestivum
  Clone ID: PAT_TA_20236
ctgatgttggtctttacatgctagccaacaagtggatggttgatgagaaggaacttagagttattcactacacactaggtccccttaaaccctgggactggtggacagcttggcttgtaaaacctgtggagatatggcaggatgttaggcaaaaacttgaagaatctcttccgggaaccggtgggggaaggaaccctcatgatcagctggtggtcaaatttttattcattcttcccttctgcctgctgttatttggttattaccaatcatgctttcagaacaagaaggattttccaagtgtgcagtctttatgtgcgtttgctaggagaggccgtcataagtacaagtctgaagaggcacttccatcttatttagcagttggtgtttcatcatctacattttcaacttcaaatcaaagaatctcaaacgggccacatctgaagctgccttcttatttcggggcgattgctgtgctaatctgttttatgtctgctggtgtctctcttgcctttgctttcactatcattccacgacaaattatgccatggacaggtctgctactgatgtttgagtggaccttcgtggcattcttcttattgtttggtggctatctccgttttgtctatcgatggggaagtatcagtgcaactcatgtgggatatagcaattctgattcatcagagaatcacatggctacaggccatcatcagcgcaatatatctgacttcgacatggaggcgacattttactggacagggatggctgtcatagctatcattactgtattttcaccaactatcttgggtataactgcattatttacaaagcttaggttggtggttgccggtggtgttctgctggcatcttttatgacgtatgcttcggtgcatcttgctatctcagccttccacaagggtcaaaaagataggaatgggtcgagaactagaagaatttgtttctggtgtttgtagtaagctttgtgcctgcattgttaatttagttcatgttgttgtacctcggccgcgaccacgcta

SEQ ID NO: 20237 - DNA, 717 bp, Triticum aestivum
  Clone ID: PAT_TA_20237
cggacgcgtgggcggacgcgtgggcggacgcgtgggggagctgagctccttcgtcgcggcgagagggaaacccaaatcaatcaaaccgcgccctcgaagcacgcgcagcagcagcagaagcaatggcggccctcgccgccctcttcgcctccccggccctccccttcccctccacctccgcctcctcctcaccgtcatgctcctgccgcttccgccgcgccgtcgcctgcgcgccgcgccacccgcccgcctcacgccgcgtcacgcgccgcttcgacgaggtggagggggcgtcgaagaagcggcggggcggcggcattggtggcggcggcggcggcggagggggctctctggcgtcgtcaacgcgcaaggataaggggctttccgtcgacttcaaggagtcgcaggttgctgatttcgaggatcttgaagaggacaaattccttaatgctgttgttaaggtctactgcactcatattagacctgattatgggcttccttggcagaagcaaaggcaacattcaagcactgggagtgcctttatgattggtgataacaaactattgacaaatgcacattgcgttgaacatgacacccagattaaagtaaagcgaagaggagatgacaaaaagtacgtcgccaaggtcttagctagaggcacaaaaatggatcttgcgatgctttctgtcgagaatgaagagttctgggcaggtacac

SEQ ID NO: 20238 - DNA, 508 bp, Triticum aestivum
  unsure (1)..(508): unsure at all n locations
  Clone ID: PAT_TA_20238
acgtctcccgcagctctccgccgagcaagtcctgaggcatccgtggatcgcnagctgcggagggaatgcggtggcgggctgaagaaatccatggaccaacatgctgcacctgcacgcactccatccatctgtagatagaagatcttctccacagacgacgactcaatatctgcggctctgctctgtttctccggcaaatcggtgatggacagaagcagcggtggtgccggagttgagttgagtcagtagaactagcgctagttccttccgtgatcctttaggtcgagaggtctcccgtgaagctgggaattgcaaaagctttcacctgagttagcctgaacctgtttgttctctgaatctctgtagtagggcttggtagatacagtcttgttcatttctagctgaagaagaagagtggtttagtacctagtggtacttacttaggtgaggtttgttagaatatgaaaattggagagaaatgtgatgttttganaanaaaaaaaaaaaa

SEQ ID NO: 20239 - DNA, 643 bp, Triticum aestivum
  unsure (1)..(643): unsure at all n locations
  Clone ID: PAT_TA_20239
ccgcaccaagcacccactgttgcttcctccacccagaccactgctgccgtcgcccccaaccacaacagagcggcaccgccgagcaccaattgacacggagcatcacatcgccgagccactccaccggtgaccatcctcctccgctgtacgccgtcgtttatcagctaccaccctcctcgcgagcttcctcccccaagctggccctctgcacaagctcacccgagcaccaaggagctcctccgttggaagtcaattaatggcaaatgcagcaatgggttgcgaccacaagcaagctgaggaggtttcccaaaggtgcacaagttcactaagatttggaagatctttaagctgctaaagatttggaagacctaaaattaagttggtggagtgataatgacctgtgtcctgtttgttgaacttgagacttgctctgctcattttggtggttgttaattagctcatttaggttgtgtggcacaatctagaaacatatgtacatctctagtggactacttatttttgttgtgtggcaacatataaatactctttgtggaaaactcttaaaaggcgtangatacgatgattaaggttaaaaaanaaaaanaaaaaaaccagggggccggacaatcccnaagattnttac

SEQ ID NO: 20240 - DNA, 323 bp, Triticum aestivum
  Clone ID: PAT_TA_20240
cccacgcgtccgggcaagcctgcagagcttgatttccaaacagttgattgcgccgaactgtacagctactgcaaggctgaatggggctcctccgtcggtggtgaacgcgagctcgagcgaagcatcctcggatgagaagaaggtcacaaaaaggagattggcactgcttggtgctggggcattatccactgtcctgttaaacagcagctctgcatatgctgaagaagtaccaaagaactaccgttcttacgtcgatgcatacgacggatattcgtacctctacccagctgaatggagggatttcgacttcttgggccatgatt

SEQ ID NO: 20241 - DNA, 989 bp, Triticum aestivum
  Clone ID: PAT_TA_20241
gccaaccaaccaaccgcaggcaggcttcagagctccactcaaggtgaatgggctggcaagcctggcttgatatccaaccaaacagttgcgcccgcctgactgtacggctagtgccaggctggggggggctcctccttcggtggtgaacgctcgagcgaagcatccttcctcgagaaggaagtcagtcacaaaagattggcaagcactgcttggtgctggggcattatccactgtcctattaaacagcagctctgcatatgctgaagaagtaccaaagaactacagctcttacgtcgatgcaaacgacggatagtcatacttctacccagctgcctggcggaattgggacttcttgggccatgtttcagcgttcaatgaccgtaatgtgaagctgcagtctgtccgtgtggccttcgttcctactcagaaaacagacattcgtgacctaggcccaatggatgaggcgatcttcaatttggtaaccgaagtgtacgctgccccgaaccagataccaacgatctattgaaatgcaagagcgtacggtggatggcaggaactactggactgtttgagtacgatctggaggcgccgggctaccggcgtgtcggcgtttgcgacggtcgccatcgggaacgggaggtactacacgctgatcgtgacggctaacgagcgccggtggagcaggctgcgcaacaggctcaaagtcgtcgccgactccttcaagatctacgacttgaacgcctgattgcgcaagctcttgatgtccgtcggcaccatccgaccgttgcaacgcgggcgaaacctggtgtcgcctgaggccgagaggaacccaacccaacgaatctgcattgctcagacatcgcgctactcatgcttgtacgaatctagtggaaccagtacacatgaattagtggtcaaaatgtacttctttaaaaccatattgaggaaccagagcgggtatgattcccagcaaaaaaaaaaaaaaaaaa

SEQ ID NO: 20242 - DNA, 644 bp, Triticum aestivum
  unsure (1)..(644): unsure at all n locations
  Clone ID: PAT_TA_20242
tgcacattccctatggaaagactattgcactcgttggagagagtggttgtggcaagtcaactgtaatctctctgctggagagattctacaatcctgattcaggtaccattttattggatggagtggaaatcaagagcttgaacatcaactggttgaggaagcaaactggactagtgagccaagagcctgtactcttcaatgacacaattccgtgccaacatagcctacggaaaggatgaggaagtcagtgaggaggagctcattgcagcggcgaaggcatccaatgcgcacgagttcatatcaagccttcctcaaggatacgaaacatctgttggggaagagagggatacaactatccggtggccagaagcagcgggtggctatcgcaagggccatactgaaagacccgaagatactactacttgacgaggcgaccagcgccctggatgctgaatctgaccggctcctgctcctggccttgggtcgggggatggctcctgccccgccgcgcccctgcgcaccgcgcccggcgttcatccgcgatgtcattgtgtccgggggctgcctatttggagatggggncccgagtccttatgacanaaagtgggtgacgctcacagttaatngcnggnaccataaatctn

SEQ ID NO: 20243 - DNA, 464 bp, Triticum aestivum
  Clone ID: PAT_TA_20243
cttcagtctgaccgtggccaaccgtggcagcagggacggcacccacgtcgtgatggtctacacggtgccgccggccgaggtggacgacgcaccgctgaagcagctggtggcgttccggagggtgttcgtgcccgctggagccgccgtccaagtgccgttcacgctcaatgtgtgcaaggcgttcgccatcgtcgaggagacggcgtacaccgtcgtgccgtcgggcgtcagcacggtcctggtcggagacgaagcgctgtcattctctttccccgtgaagatcgagctggctgtatagattctttacatgtccattgaattttttagtttctttacataccaaagatgaaagattgaaggccaaaccgttagatactgtgggcagcacgtataataccttctccttttctttgcgagaagtgtaatatcttctcctccgctactataaacgcacattttcacaa

SEQ ID NO: 20244 - DNA, 1468 bp, Triticum aestivum
  Clone ID: PAT_TA_20244
gaatgggccggcccacgtcccgcccaaatctgccgcacgacccaaacaaaacccttgcggcggcgacccaccccatctccggcggccaagcggaatggagcgctcggcggcgggcgcctcgtaccagcgcttcccgcgcgtgcggatccgcgagctcaaggacgagtacgccaagttcgagctcaaggacaccgacgcgagcatggccaacgccctccgccgcgtcatgatcgccgaggtccccaccgtcgccatcgacctcgtcgagatcgagagcaactcctccgtcctcaacgacgagttcctcgcgcaccgcctcggcctcatcccgctcacctcctccgccgccatgtccatgcgcttctcccgcgactgcgacgcctgcgacggggacggctcctgcgaggtactgctccgtcgagttccacctcgccgcccgcgccaccgactccggtccccgacgctcagagggtcacctccaccaaacggacctccgctccaaccggcaccccaatggtctgccctgtcgaccatgcaaaggaagtaccaagcaggccctcggcaacgtcgacgcctacgagcccgatgctgccggtgaccacaggggcatattaattgtaaagcagcgccgtgggcaagagctgcgtcttcgagcaattgccaggaagggaattggaaagcaacattccacatggtctatagctcctactgtcaccttcatgtatgagcctgacatacgtattacccaagaactcatggagacacttacacttgaggagaaacaaagctgggtggagagcagccctacaaaacctatttgacattgatcctgtcacccaacaggtgacgattgtggacccagaggcctacacatatgacgatgaggtgatcaagaaagcagaggccatggggaagccaggattggtagagatcaacgccaaggaggacagctttgtgttcactgtggagacaacgggggccattacagcctatgagctgattatgaacgctatcacggtcctgaggcagaagctggacgccgttcgcctgcaagacgatgacggcgatctgggcgagctcggcgcccaccttatcggaggctaaccaccgcttgtctgggaaagaagtcgccagcggtatctttgtttctccgtatctaggctcgtctcgtctaactggcttgcctgtggcaagtggtagttgatgcctcctttgatatgcagcaccagaactctacggtaatcgcctttgtatccctcttcttatgccccaaaaaaccatggaccctggaacttagcaaaagccatggacaaggaagcttagcggcactgtggaacaagagaatagctggtagcccatgattggccgtgccgtgcggtggtgatacggcgtggtgtcctgaatgcagagttattcgcaggtctcccgcccccatacccagattcataagctttgtgtgggattaatg

SEQ ID NO: 20245 - DNA, 1030 bp, Triticum aestivum
  unsure (1)..(1030): unsure at all n locations
  Clone ID: PAT_TA_20245
cacccggggcagcgcccgcctcccctcctagcgtccggcgccgacctcctggacctctcctccgccatgatggacctggatccccgcctctacgaggacgcatctgtcagcgataacgatgttcgcaacatagtgctatcttatcttatgcacaattgttttaaggagaccgcagagaccttcctatccagcactgggctaaagttacctgttgattatactgtagatgtggataaacgtaaagcgatcttaaattttgtggtggaaggggatgccgtgaaggccatagaactgacagaagagttggcgcccaacttgctagagaatgacatggatttacattttgatcttataagtcttcacttcattgagctaattcgttccagaaaatgcacagaagcacttgagtttggccagaaaaagttgacaccctttggtaaagtttccaagtatgttgagaaattagaggactttatggccctcctagcttatgaagagcctgagaagtcacctatgtttcatctactagccccagagtataggcagaatgttgcagatagcttgaatcgggctattctcgcacatgctaatctacctgcatattcatcattggagagagttatacagcagtcgaccgtggttagacaatatctacagcaggaagttgacaaggattcttacccaccgttttgtttgaaggcctttctggacaagtaaggcgcaaccatggtcagaaaggaaagggctatcatcacccctagactcgtgtgcccttctcagagtgcggaaacaacaccgagagtttttcacattttccgttaaaagaacagcgagatgcacatatctgcagcgacctgacattgttggcagtgttgtactttgatagagtggtgttgtatgtgtttttttttccgtcgggtcgtcggtattctgctcccccttagtcgtcgttaaacatgtacatatggaagcgccgggtcattctgtattatccgttcagattgctttagggtgcccctgtgcgcncaaa

SEQ ID NO: 20246 - DNA, 846 bp, Triticum aestivum
  Clone ID: PAT_TA_20246
cggacgcgtgggtggctttgctcctgacatctggctgtggatcagaagcctccccgggcattggagggcagacgaatcccactctctccagatatgcaattctccatcgacaaaccaatccctcaacctcgtagtcaccagacaatctgaagaaacccatcccttcagtttgtctttctccatctgtgacaagtcccgtgatcatgatccagtctcgctctggagctcccattattccaagctgaaacctgcgaataccacagacgttgcggcccagttcttgctcgagatcgtctgcggggtgctcagatacgggccttactctagcagcagggccatcttcaggctaccggccgtgcatgtgtctgaaggttcgggcaagatcctcagcctgtccgtcctggccctggcgttcctggtctgcatctacgaggctccgtccacgccccggcgggagttcatcggcgcgatcaccgcgcggttgacccgcgacgagatgcgccacgcggcgagggagcttatgctggccctcgggtccgacctggaggagcagtggatgcgctcactgaatctgggcgtcactaactgggccatggaggctctccggtcaggcgccggcgcgtcgtccccgctgcgtttcgcggtgttctcctatgctctgtcggcgagcaggctatggaaggtccagctgtactgcccggtcgtagccatgaccatggagcaccacccgtcccatcaccaccagcagcagcagcagcaccagctggtcaaagacgagagactgctcttctcgctcaactaccagcagctcgagagcgtcatccagttcacgtacagagtcgcgtt

SEQ ID NO: 20247 - DNA, 763 bp, Triticum aestivum
  unsure (1)..(763): unsure at all n locations
  Clone ID: PAT_TA_20247
ngccggnggattgaanagnggcttggggnggnaccccgnctccagnctganttactggccagtatccggggttganaagagactgnccgggngcctaagggtctcgggccgaatccggcgccctccccggccactcccccggccacaccaacggccccccggcgcccgcctcgccgcgcccgcgcacctgccccgccgcggcccccgccggcgacgccaacctggcgccgcttgacgcgcagacccagctcgtcttcgacaacgcctactaccgcaacctggtcgcccagcgcggcctgctgcactcggaccaggagctcttcaacggcgcctcccaggacgcgctggtgcgccagtacgcctccaacccggcgctcttcgccgccgacttcgtggccgccatgatcaagatggggaacatcgcccccctcaccggggccagcggccagatcaggcgcaactgcagggtcgtcaacagctgatcaatcgtccaaatggtcattgatatgctgcgtgatgatggagatgtctcaatttggttggctacaaaggtacccaaccagcagcatgcatgcatggcaaaataagacctttggtaaaggttaaatgttctccctttgccggtgcccccccgtgaatttgcccggccagatatttgnatcaacaatctgaatgtgattnnncaaaatggggggaaaaactggtaatnaggattntganaatgngacttgttttaggaaaaagactatggaaaaaaaaaaaa

SEQ ID NO: 20248 - DNA, 388 bp, Triticum aestivum
  unsure (1)..(388): unsure at all n locations
  Clone ID: PAT_TA_20248
ctgcaggcagcgcccgccgcgcccctcctcgtcctcgctgcccttcgatctgaacctgccggaccccgcggccgccgccgacgagatggactggcgctgcgacacgctgctccgcctctgatcggcctcccgcctgcttcggatgcgtcacctccctcccccttcccgctcccggactaaccgcggcggcgcggctgcctactgcgaagtgcttcttctactatctcgatagaattggatttttggtctccgttttactaccactcaagttctgaatatctgatactctgccttatgtgataatgtgaataagctcatcatcatcatatcatcatgtaatccacggngaaatagactgataatttttgccatctttctctgttcttaa

SEQ ID NO: 20249 - DNA, 574 bp, Triticum aestivum
  unsure (1)..(574): unsure at all n locations
  Clone ID: PAT_TA_20249
tcgccgtcgccctcggctttgcgtntccgagcctcgacgacgggtgcggccgccgcgtggaggagtccaccctcttctacatgccccactgcgaggcgtcgctctacgacgcgctgctcgcagccaactgggagccaccgcgctcagctccgccgcgtctgcntcctcggcaacagcttccggcggtatgctctgcaggcggaagagaaccgctcgggaccggccgccaaggccaatctcgttctaaaggcagggcggttcgcgtgggagcagcggatcgacgacgccggggatgtggacgacgaggactggttcgcccgtgcgttcaacgagacgagctggcatttcttcgaggtggaccaagacgtcgaccagaggaaggagataagttcccaagctttgtccttcgagaaattatcactgtaacccaatgtattagtacttgattcgagatgcatttggagattcagggttggcatcctcacaaaatttatcacttcaattctgtgattgtatactagtatttgattggaaatgaattcacaagattcagagtaagcatctgagcataatt

SEQ ID NO: 20250 - DNA, 1336 bp, Triticum aestivum
  Clone ID: PAT_TA_20250
gctcccttaaagaaatacaagatcgtttagatcagtacttacttccgtacgcacgtccgcggtgtgaagaagctctagcctctagctagctaactaaagatggctgccatgccgacgatggtgttcgaggcggggccaatggaggtggatgtgaagcacgtggacaagagcatgatcccgaacctggccaagccgttgatggtggtggcgcccaaggaggccggcgcgtaccccgtcatcgtcttcctgcacggctggaacatgctcaacagctggtacgagcagctcctcacacacgtcgcctcccatggtttcatcgccgtcgcaccacagctctactggatggtggtgtccgagcccgatgcggacgacatagacgccacaaaacgaatcaccaactggcttgcagatcatgacaaggggctcgcctacgtcctcaaggacgtgttcaaacttgagcatgtcgagcctgacctgtccaagctggccctagccggccacagccgaggcggccagacggccttcgccgtcgccctcggactaggggacgccaagaccaagctggagctcaagttctccgccctcatcggcgtcgaccccgtggccggggtttccagagcccaacagttggagcccaaggtgctcacttttgaacctgactgtctcgacgtggggatgccggtgctggtcatggggactgggctgggtcccaagcacatcggcggatttccatgcgccccggtgggcgtgaaccacgccgaattctacaaggagtgcgcgccgcctcgctaccacctcgtggtcaaggactacgggcatctcgacatgctggatgacaatgtgccctatatcatcaacaactgcatgtgcatgaggaaccaacacgacaccaaagatcttgctaggaggaccatgggaggagccatggttgccttcctcagggctaaattgcgaatcgatgttcgtgatctcatcgccatatatcataatcctgagatcgcgccagccgtcctggaccaagttgatgagtttcttccttgcttcgttggacggccaaatccgtcgtctgtgtgagagttatattacgtgcctatgcctatctattactcctaaataaggtgtgttggtgcatggccttgtcatggctcatgactactatagcacgtccagtcttcctaattactaaataataagcactaatgtcatgtgtgcatgtacctaggtagaatatagtgggggggcgtgctcttcctcaatccgtcattgatgttcatgtaccctcaaaacaaaatgtatttattttgttgtgaagtttcctaaaaaaaaaaaaaaaaaa

SEQ ID NO: 20251 - DNA, 1238 bp, Triticum aestivum
  unsure (1)..(1238): unsure at all n locations
  Clone ID: PAT_TA_20251
cggcacgaggatcaaagccatccaacagcaaagtttcacaagttactaactccggcatttttcatatgccaatttactcaaaagaaaatgcactctactgtgatgtatgcatgcggggtgaaactgtgttgaaccgagtatctgtctgctccggatgcaagcaggctgctgtccacatagattgctataaatatctagagatatgcattggccgctggaaatgtgaactttgtgaagatatttcaccagaagatgctagctctagtgatcaatctgacagtaatggcacaaaattatccctggtacgatgtgctctgtgccatggaacatctggtgcttttagaaagactatagatgggcagtggactcatgcgttctgtgccgagtggttgttggagacgaagtacatgagaggacaagatgatccagtgagcggaatggaaacccttgtaaaggagaaagatacnttgttgtgtctgcaacatcaaagttgngtgcgtgtctcaagtgcaacagtgaggactgccacaccacttttcatccttcttgtgctagagatgctggtttctacatgaacactaaaggatttgggactgtggcgcagcacaaggcatactgtggcaaacacagcagcgagcagaaagagactgatgcctggaagtactggcccgaggaagtcaatagcttgaaaaggacgagggttgagttggagaagttccgcctcttatgtgagagggtaattaagagagagaaggtgaagagagagacagttctgtgtgaccatgacatactccccaaaaccaaggatactgttgttttcccctaccgaacacccggagctagttcagatcctgcactacttccgttaataataatcatgcagttggaccatgcacattctgatgatttcaccggnngtancatttttcccgggaaaatancgtcaantttccccttaaanacanaattccttaaggaacacaacttatncncaaggnactatctttcnaacggtttcattnnaangggcactttccgggnaantttccncaattnanttgatnccnaccgaatttgaaatnggaacanaaacnnagtatagnagaacntcaaaagggcggtatacncgtnaantccaacagacaancctcaaaggatatcatatgtcccntganctcttctagnaacatgaacaattccagnccatacccaaacccgngtaggaaactaattccaaa

SEQ ID NO: 20252 - DNA, 734 bp, Triticum aestivum
  unsure (1)..(734): unsure at all n locations
  Clone ID: PAT_TA_20252
gacgagagagggctgagaaagacgagcagcttgagtacctgatgctgctaggggtcctagctgcaagtgtgacgtaccagagtggcctgcgaccgccaggtggcgtgtggcaagaggacagcgccgcctattccgccggcgacccgatgctattcgacatcaacaggcgccggtacgacatcttcttctacagcaactccgcttcgttcattgcttccgtcgtcgccatcgtcatgctgctcccgttgacgcttagcaacctagagcggctacggcactgcctgccgttccacaccggtgaccccaagtgggcgctctggccggtccacgctgcccttttgctgggacatgctcggcctcctggtggcctacgtggcaggaagtaccaggaattgggagtcgtccaaggaatgtgacattccctttcgtccccctgctcgtctacatttcggcctacccactagtagtggcgatattcattcgttacaaacaccccggatccccccagcagtcaaggatgcaagcagtagaacaaatgcggccagaagtttagtattcaatcctgtttctccctcttagataccctgtattgtattgttttatttgcacgtacatgcatggagctgttgtgttcttgtggtcgtgnatccgtcaccgcaatctctttcctaggtcagtattgtttaagctgggaaactcaaatgttaatggacatttttctacatgcaaaaaat

SEQ ID NO: 20253 - DNA, 597 bp, Triticum aestivum
  unsure (1)..(597): unsure at all n locations
  Clone ID: PAT_TA_20253
tctcaccaacataagccttcctcattcattcattcagctgtacaactctgatcatcgaccagcagcgggattctcctcgtctgatttgttcatccgacacccgatcgatccgcagcagcaggtgatccggctacaatggaggcagcggtagctcgcgccgacacagcagcattcttctcgggccaggaggacgcggccggggggagcatatccagactaccggctcgggtcgccggctcgatcgtccgcggcgtgatcaccttcatcttcgccacagggggcacgattctcagcttcatccacagcgggatcatttctcggagccctcaccggcggctcgatcgggccgggggcggcgaggggcctcgtcccccggggctgggcatcgcggccacctccgcgggccgcggctcgggccaataggagggttgtccacaaggtccaatgggcattgtgggccctcccgctcgggcgggggcctccgggaggcgtcccccgcagtcaaacgggcnaagcaaataacccgnggggagggttagaacacccccgaccncccnaattttncnngcccctcntaagggnggtcanccacccccc

SEQ ID NO: 20254 - DNA, 380 bp, Triticum aestivum
  unsure (1)..(380): unsure at all n locations
  Clone ID: PAT_TA_20254
ggancgnttggggcntggggttgncccaggggttcangcttntgggggagnaactttattcncccggngcgggccaagggttccccagttcgtgntggttgcccgtngttgnacnagncgtngggggggttgnagccnntggaggcggacggcaaggtggaggaagccaaggccgcgctcaggcccatgctcgacgaggtcatggtgctggacttcgtcgtcgacgatgcggcagcggcgagcctctgatgatttgggaatagtaatggcatcctttgtgaaatttgtatccatcttgagatgaataagaattgcatgtcatgattatactttgtacgtatactacagtttagctttttttttcaactaaaacaaaaaaa

SEQ ID NO: 20255 - DNA, 473 bp, Triticum aestivum
  unsure (1)..(473): unsure at all n locations
  Clone ID: PAT_TA_20255
ataagcagacctgagtaatggagcatgtgacaacatgttttatcgttctgttgttagcatgatttgattctgcaaactgtgcatcatctggaaaggaacgacacttctgatggttatgctcttaactttttcgtcataacctttgcaaccaactccccattccgcagattgtgcctctttcctcctccgatgaacaaccattgtgaacatgctgaacatgtagacgtgtccgtggccgttccaacgggaatcgtgacgcatactatgtggcgttggttcctcgttggtctttagtttgcaacatcaaattagaaaggactcatggggggcttcccagccattggatggcttgtgttccccgagtttaacaatctgggtggagaaccattacctaaaatgacaattgcagtcaatggtggaatttaaattttcccggggnccaaaaagggnnttttttttttnaaaaaaaaagn

SEQ ID NO: 20256 - DNA, 734 bp, Triticum aestivum
  unsure (1)..(734): unsure at all n locations
  Clone ID: PAT_TA_20256
gcgcaaagaggattttggcaaaccggcagtcggcggcgaggtcgaaggagaggaagatcaagtataccggtgagctagagaggaaggtccagacactgcagaccgaggccactacgctatcagcacagcttacacttctccagagggatacttctggtttaactactgagaatagagaactcaaacttcggttgcagtccatggaggagcaagctaaactacgggatgctctaaacgacgctctgcgagaagaagtccagcgacttaagatagctgcagggcaagctccaaacatgaatgggagtcaattcaacggcggactccagcagattccatcctatttctctcagcaacatcagcgccagcggcagcagcagcaacagcaacagatggcttacttaggtgggcaccaagctcagcgtcaccatccaaaccatcaccagagcccatcgaatggtggcatcgctgagtggtctgtccctagacgatccatggatttcatttgaggaggaaaactagggccctcctattaaatcatacacaactgcaactcagcattgtacagatagctaatgtactatctatgcatatgaatcattggtagggtagctagccgtcctttgtatttcatcattaatcagaaacatgctctggtgcacatcccctcctctttccatcttgtcgttctggagacaatgtgatctggaacctactaatgtgtttcagtnaaaaan

SEQ ID NO: 20257 - DNA, 535 bp, Triticum aestivum
  unsure (1)..(535): unsure at all n locations
  Clone ID: PAT_TA_20257
agacagagcaccaggatcagcaaagaaacattcaagaacttcaatggctgatgaatcatggaggctaccgaattcagtgcagcaactggctgccaacatgcaagaaccaccaagccagtacttgctcagagagcaagaactgcttggtgcgcaccttgctggtgctgagatgcctgagcccgtcccaacaatcgatcttggcctgctgtctgcatccaacgatcctgaggaagccgccaagctgcggtcggcgctgcagacctggggattcttccaggtttctaaccatggaatggaggcctctatgatggattctgtgttcaccgcatcaagggaattttttcacctaccgctggaagagaagaagaaatgcagcaacctgatagatggcaagcatttccaggtagaagggtatggaaatgaccaagtgaggactcaagatcagagattggactggtctgatcgactgcatcttagggttgagcccganggtggggagaaaccttgtccattggnccacacatcccaaatcttg

SEQ ID NO: 20258 - DNA, 1193 bp, Triticum aestivum
  unsure (1)..(1193): unsure at all n locations
  Clone ID: PAT_TA_20258
gcgcggagcgccgccccaatgggacccgccccctgccggcggattgcgccgcgtgcgccactcaaacacaggggaaggggtagctatccttcgaactcgccgcgtgtaggaatcttgtacagagttcgattcccggcggtggacttgccatggacgagcagttcatcctccgcgtgcccccatccgtggcggagcagatcgagcggcttatgaacgaatctgccgccggctcatcctccaaccccgacgacgcctccctcgacctctccttctcagaggatggaaggagtggcacatttatgattggtaaccagaggtttcctgcatctctcttggatctcccaaccgttatggagtcatataagacatatgatgattcctttttagttaaaactgctgatattggtcagatgataatggtaagagaagaagatgatcctgctccagaaggagttgaatacaagcatggacttactcctccaatgagggatgcacgcaggcgacgttttcgcagagagcctgacctgagtgcagagcttgttcaccgagttgagaaggatcttataagtattatgcaaggagtgcctgtcaaccacaatgttggtctagctggaggcggtgaaggtggtgaccgcaagaaggctgcaccagctcctgcacccaagcctgacgttcaagagcctgctgcaaatggcgaagaagctgaggctgatcggagcgactctgatgagtcggacagctgaagtggaccagaataggtagtgcagcctcagttggctcttcaaccccgctgtatgtattaggcgattcagatcaaagaacgcacacttttaccaagcaagtgtgcttgttgtcttctactgtactgattatcatctcatcagtaacaataagagtgtgactttccatcatggtggaagagtgtccgtatcctcccataaggtggtgctcgagtccttatttgttcagccagatgttgattacaacagtgcctcgcgcctgattttttcttggggtgcgcttctatgcctcagggtgcatgaggtcataagggtgattgtaactgctgctagttcctgaattttgcactccaattctgttacttcgaacgacggattggatgagatatcaccataattttagtcggccaatgtgcaagaagataaagggcagctcagggnatatcccaagat

SEQ ID NO: 20259 - DNA, 643 bp, Triticum aestivum
  unsure (1)..(643): unsure at all n locations
  Clone ID: PAT_TA_20259
ggaaaatactcttcatttcaaagtggtcttagttgtccgatatcttgtacttcttggagtggtctcattagttgaatctttgtgtggtcaaaaggggaaagggatatgttctcactaaagggaatttttgaataagctcgaaagagaagagaggtaaaagatctttttgaaagggaaagttgtagagaaaaatctttgctatgggcttgccagtttctagggtcacgtcctatagtcaacatgtgctctaataccatcgagatgaaaatacttcttccaccaagatgatagagagataactgggaccatggataatcaccacaatagcaacatttcttagggaaggctttaggtgaaatatgacacaagataactccaacgaaaagattaatggatttaaaatacctcaatcctgacaacatgtggaatagcgaaacatgaagggaaattgtcaagaatggatattaacaccacctccaaaagataagatagggagagtgcactccggcatgctggaggagcttgaactcccaaaataaacattctgacacagttaattanagtaaactggnggtntaactcagagaatctgagacaatcagataaggatcttgcaacacaagtnacctccgaaatcgtaaaa

SEQ ID NO: 20260 - DNA, 685 bp, Triticum aestivum
  unsure (1)..(685): unsure at all n locations
  Clone ID: PAT_TA_20260
agcgcatgcacccaacggtgcccttcatccagcgccacgtccatgccgacgccgccgggtttctcggagtcggaggaacaaccagcgacttgctcatgcaggtctccgtgggagccatcgggcggtacaccaagacatggacggatcccgacgagttccgacctgagcggttcctgccgggcggcgaggcagaggatgtggggcctttgccgggtcccaaggagatcaggatggtgccgttcggcaccgggcataggttctgccctggcgtgggtctggccatgatgaacatcaagtgtttcttggctgcgctcgtgcacgagtcccactggaagccacccacggtgggttgtgctggcgtcgacgtgactgagctcaacaccttcgtcaaggggatgaagacgccgctttccgtgcgtctcacgcgacgcactttatcctcttgagatctacactgtcatccttgatggtaagcgtggtggattagtgttgctgaataagtttggtgaaataaatgtttgtgtggcgtcaagtggaaataaaatggaggtgtaccttgtccatggggagaacttcttgagaagaaaagagagagttaagtgaatgggtcagtgaattgaatgattcatctagtattactactcagtactcttttnaataaagggggtaatccgctacatgcatc

SEQ ID NO: 20261 - DNA, 513 bp, Triticum aestivum
  unsure (1)..(513): unsure at all n locations
  Clone ID: PAT_TA_20261
tttgcancctgcttcgctccctccctcggctctttccctccaccctcccgcttcgccgtccccgctgaagatgctcgccgtcgtgtgcgtccttgtgctggtcggcctcagcttgagccagcaggcgacggcgtcgggctgcgatgactgcgctgacggacacaatccggcggcttgtgctcccaggtgcactgaatattcccgcactgcaaattcctgcactggctgccccatgctacagagcacctcgtgctcgcagaaatgcttggatggttgctatcacgagtgcagtagaaggccctgacgatcgcgtcgttcaccatcgaccatcgttttcctcttgtttcctttcggccttccatttcagccaaacatcccggcgcgcgtgtatgcgtgttgattggtatgacgcaaaatggcaataaagctcagtcgatctggatcactgtaccgcggggtttgtaatcgaattcgtgtgtttctttccttattgttgttcttaaaaaaaaaaaa

SEQ ID NO: 20262 - DNA, 659 bp, Triticum aestivum
  Clone ID: PAT_TA_20262
aaacaaatgaaacattatattatcgcagctcagaaacatccagagaaatgccatcatcagcccccgagaagagcatgagacaacagcagcagcaaagtgataagtccattagatcgccgcaagacatgggcaagcaaggttctgaagcttcaccgccggtgtctggaaccgggaaacctgggagaactccaggacaagatttactagagtctcaggaacaagcctcccctgatactcagcaagtaaaaaacaacagagataacagcaaatcggatggctcaagcaaacccacctagtttgatggtaataaaggtgatgtccctgagtcacagaggggtggctcgtcaaccaaacctattacacatttctatcacgtcatctggttgcagcttcgttgttgtcgtcttatctacctccctagtttaacatgctcgttaataaggtccattatctatcacctttggaccaaccatgcctgccaatttgtctactccacctggtataatgttactacttttcaatggtgcatttctttgctgttcttttcctgaaaaatgacttgtttagatggtccttgcattagtattgttttgaataatgtgagtgcaacagtttgttctacataagaatcatatgcctttgtatttaaaaaaaaaaaa

SEQ ID NO: 20263 - DNA, 530 bp, Triticum aestivum
  unsure (1)..(530): unsure at all n locations
  Clone ID: PAT_TA_20263
ccgactagaagtagtagcgccggcgctactagtaccaccgcagcggcggcagcaacgacgacgacgacaacgagagggaaggagaaggaagcggcagaaggatcagcgtgataagtgtagaccatcaaattacccttttgattattccatcacatccaaattctaatccctgcaccatcataattttagttgtttgttattataattactgtgctgttatgatttgttggatatatatataagagagaggtctaagtagttcgtataggatcatgatatgacggggtacatcatatcatcaaagaaaatccgtgcatgaaaacttgataagaaataattaaccttcccaaataggtgaaagagataacttccctgcgcagtttgtctgctcaatcacgctccactgttgttgattgggtgcatagggcacattgatatgatgcctagccctataggtcctgtgattagnanccaacaaattgctagtgnctcccaatcgtggcatataaacncatattncccncattctg

SEQ ID NO: 20264 - DNA, 609 bp, Triticum aestivum
  unsure (1)..(609): unsure at all n locations
  Clone ID: PAT_TA_20264
ccgctcccgtgctcaacctcgacacctgctacgacttcacacgctcccccaaggtcacgctccccaaggtgtccctggtcttcgccggcggggctaccgtgccgcttgatgctgcgtccatcatgctgggcggctgcctggcgttcgcggccatccccggcaatggatcccttggcttcataggtaacatccagcaacagaattatgaggttctgtacgacgtcggcggcgggagcgtgggattccgccgtggcgcgtgctgatgtggcagtggcaatggcatggccagccaatgtgtgatgtctgtgtgatgaccccctaatatatatctggggtccacaagctagctcgcccaggtccatggcactagtttgttactttctccgtctcaaaataagtgtctcaactttgtattaattttagtataaagttatattaaaccaagacacttattttacaacggagggagtataaaataaatgtggggacaaaatgttagatgtgtaatgctctttgtgtgtaatctgtgtaaggtttttttagtagccttccggccgagccctcctcatctcaaagtggatatcttagccgtccagttaaataaaanan

SEQ ID NO: 20265 - DNA, 998 bp, Triticum aestivum
  Clone ID: PAT_TA_20265
ctcggccacgtccttccctgtacgcgctcgatcttgccgaccgaggcgatggcggcggtacccgcggtgaggttcccgttgttcggcctcgtacggctgcttggcgtggccgcggcagcggtcatcctcgtctgggccgtccacttccgcggcggtatggcgctctccgccgagaaagacaagctcctcatcttcaacgtacaccctgtgctaatgctgattggattggtagtcctgaatgctgaagctcttttggcgtacaagacagtgccaggaaccaagaaactgaagaagttagtacacattacgttgcagttccttgccatgtttttgagtctagttggcctctgggctgtctggaagttccacgatgaaaaagaaattgaccacttgtacacactccactcctggttgggcctttcttgcatcatcatcttcagcttgcagtgggctgctggatttttgaccttctggtaccctggaggatctagaagcgacagagcgtccctgctcccctggcatgtgttcttgggtgtatttctctatgttcttgccatcgccacaagcgtgactggacttctggagaagtcaatcttcatgcagagtgcaaaaatgatcgggcgcttctccacagaagcgatgctgatgaactcactggggatgatgctgatactactaggagctcttgttattcttgctatttttaaccctggagctggcaagatcaacacgtaccgaggttcttcagagtgagagggattggaagggatatgtgagtatgttgtttggctgcagctagtcataaactacacctttcttgcttcaacctaggaaattttatatgtatgtgtcattgccctctgggctgttattttttaatctgcgaattgaacggttaaccctgttcctgtcaggaattgtttccctatccattcttgtggcaaactgatcagtcaagctgaccgaaattacaaatgaggatgtcttttgaaggtgct

SEQ ID NO: 20266 - DNA, 662 bp, Triticum aestivum
  unsure (1)..(662): unsure at all n locations
  Clone ID: PAT_TA_20266
tctaggttgagcataaattattgccccaagttgaggatggggccacttcttcctagagcaggttgcaggttggagataagaaggagtgataatgtgctgtcatcatggggagagtgtacaacatcaagcaccggtgcttcctcctcctctgcttctccagtattaactcctacagatactctgatagttgaatacagtgagctgcccatgcagcagtggagactgcttcgccacctctctggcctcgatcatttaggggctcgcgtctccccctgttcggtcccccgcccctgccccccatcccacccttttcctccggggaagctccggggtctctttcagctccggcgctcggcattcccgccgtcccccgagggacttaaaccgttttcganacttccgtacaatgggtgtnnaagcacaagcttncccggagggcatacaacaatcaccaantccaaatacttaaattgggcggtgcatattngagaattggacganccgaggaaacaagagaactggtcacataaaaataaggttttactgaacaacacacagagaatttaccaagctggncgatgggaactgccaatcacaaaantcaccacaatcaggatcncaaaatntcatgatcaggggttantnaatccgtacaagacatt

SEQ ID NO: 20267 - DNA, 747 bp, Triticum aestivum
  unsure (1)..(747): unsure at all n locations
  Clone ID: PAT_TA_20267
cgcctttcctctctctccctctctcctcgccctctcctcctcctcctcctcttctcgctgtgagttgaggtgaggtgaggattttgggtggacgcgtcgtttgatggacgggaagggcgcgacggagagctcaaaccctaaccgcgtcgttgagagcgtaccatcggccgccgtggcgtcggcgtcggcgccgacgaagcgcatgctggcgttccacttcctgcgcgcgctgtcccggatccacggcgcggccggcccggcgaggcgccgcacgcgcaccatccgccgcgctgcctactcctccatggcgcgggccaccgggccccgccgcgcatggagccgcgcactgctgctccaggcccaggcgcgcgcgcgcagatccagggcggagacgtcgaggcgggccgcggtgctcgtccggaggcgcgtcgtcgccggaccggcagcggcagcaccagcaagcgtcgccctcgctcctgttgtcgggcagccatcgtcggcggctgctcgtgcggcgctggtccctccggcccctccggcgcggcaggcgggggagccggcgaggagcgacgcgctgcggcggctcgtccccggcggcgccgggatggagtactgcagcctgctggaggagaccgccgactacgtccgctgcctccgcgcgcaggtgcagctcatgcagggcctcgccgacctcttttcctgccaatgatccatncagtcccatcattgncatattattatgcatcc

SEQ ID NO: 20268 - DNA, 631 bp, Triticum aestivum
  Clone ID: PAT_TA_20268
cagaagaagacgacatcattcatgatggccagcgtattccgacgggtaccaatgtgctcttcccgctgaagtctctggcgcaagacaaggcgacgtgggctgacccggatgagttcaagccagaacggttcctagccgacaaaggtggggaaaatatcagccttgttgcggctgccggaagcggcggggagatcaggatgataccgttcggtgccggccgaagggtgtgccccggcatgggtgtcgccatgctccacatgggatacttcactgccaacctcgtcagggagtttgaatggagggaggcggagggggagctggctgtcgatctccgcccgcattttgggttcttcactgtcatgaagcacccgttacgtgctcacctcgccgtgcttccgtgatggagggggctcgaaaggaggagtaaattagaaatgatataccagcttgtaagattgtaatttcctttgtgtaagctgcaacttttgttgtcgtctctcttgcatgcataatgcattgcatgctcaaaataagcttaacctctatgtagggattgggttctgaacatctaaagcacatcgttgttggttgtccgttatttggcatcatgatatttaagaatgaaaaaaaa

SEQ ID NO: 20269 - DNA, 710 bp, Triticum aestivum
  Clone ID: PAT_TA_20269
ccagatctcgatgcggcgcaagctcgccggcgacgcgccagcgtcggcttcggccggcggctgctcagtcccgtccgaagcagatctggcgcagctctccaccgccatctcggcgggggaggacctgggcccgtttgtccggcgtgcgttcgcctgcgggcggccggagccgcttctatcctcgctccgcgccgtcgcgcgggaccgcgagtccgagatcgaggagctctgtcgcgcgcacttccacgacttcatccgcgccgtcgacgacctccgctctctcctcgccgacgccgaggtgctcaagggctccctctccgcctcccactccgcactcctgtcatcttcagcgccgctgcttgcctcgctcgagtcgttccttgccgcgcgagctctcgccgggaacctctcatccgctctcgctttctcccaccgctgcgtccgcctgctcgcgctcgccgctcgggctaatgaccacctccaggccggcaaccacagtctctacctcgcccttcgcgccgtcgatgccattgatctcaaccttgcctctggccccgagccgctgcctcttcctgcccttcgccgcatgctgctcagcctcgtacccgcggtgcgcgtccacgctgagcgcgagatctccagggagttcgccgactggatggtcagcatccgggctgcttcgcggcaccttggacaggtggccattggcc

SEQ ID NO: 20270 - DNA, 881 bp, Triticum aestivum
  unsure (1)..(881): unsure at all n locations
  Clone ID: PAT_TA_20270
ctcgtgccgaattcggcacgagcttaagcactttgctctctcaccacacangaggcttccggaaagccctagccagatngacatggcatccccgtcgccgtcgccgtcgccggactgggccggcctccctgacgatgctctgcttacagtgttcgagcgcctgggcgcgccggaggtgctcatgggcgccggagtcgtgtgccgcaactggctccgcgtcgccaccggcgagcccgacctctggcgccgtgttgacctgtccgactgcttcgaccccaccatcgacatggtggccatggcgtgcgccgcgtcgaccgcgccgacggccgcctcgagcacttcgccgccgattgtttcgtcaccgacgcgctgctcttctacatgggcaagagaactaatgggttgaaaagccttcggctagttaactgcatgaaagtctcacacaaaggcttggttgctctgggcaagagatctccccatctcgaggaacttgagcttactacctgctccatctatatttcaatgaaggctgttggccaagcattcccacagctgaagcggctgcgcctgaacaaccggtgggtcaatgttgagtgtgaagaacagttcgataaccaccgtgccctcgacatcgccagcaacatgcctgagctacgtcaccttcagctcttcgccaatcggctccgcaacagtgcacttgctgcaatacttgacaactgcccccacctcgagtcccttgatctgcgccagtgcttcaacatccacatcgatgcagagctgcgagcgaagtgcgcaaggcttagagacgtgaggctacccaaggactcgaccaatgactacgatcacgaggcgtacattgagacgctcgagcttaattccct

SEQ ID NO: 20271 - DNA, 363 bp, Triticum aestivum
  Clone ID: PAT_TA_20271
acggcaacggcggccatgtcgacgtcgagacgcccgcgaccaatgggcactattagcaagggatcgattggagtggttacgtgttatacgtcctccagtcgttcatcgaccagtatatgcatgtctagcgtttttccttgtagtgcatgtagtgcatggtccatcgatcgatcattcatggagacgattttttttctctctctctctctctatattttcttcctgccagcttctccctagctacgatcctatcatgtaactatgtgagagtaagcaagtgctggttatccctgtgacggttatacctgatgctgttgtcagtagtcactactaagtttttttttttgaacgaaaaaaaaaaaa

SEQ ID NO: 20272 - DNA, 418 bp, Triticum aestivum
  Clone ID: PAT_TA_20272
ttttttttttttgatcagcaggtactattgcctccttcatcatcattatcgattcaacaagtgctaattcatcatcatcatcatcatcattgagcaacaagggctagggtatgaatcaagctaatgaacattgagtagtactgctataagtgataagctggcttgatcatctagcagtagcgagctatgaatcacggacatgcaaagttgaattccaattgcaagcacgacagaaaggtgaaagaattccaaaggaaaggaaaagaaaggggatggaggagtccatggaaagagttttattacaggcagcacctcaggaatcacacctattcgaagcccctgcatgcgtcaattcgaagcaaccccctcccgagaaaaagcaaagcgtatcacagcatccggccgccgttattctgcc

SEQ ID NO: 20273 - DNA, 781 bp, Triticum aestivum
  Clone ID: PAT_TA_20273
ctcgtgccgaattcggcacgaggcttgttggggcgaagacatgaggcaagctgatcctgaaaagaaacgaccacacagatcaaaggtttcgcggccgcctcgcccgtccttcgtcgtggctgatgctaaaaataaagatagaaataagcgcctggatcgattggagaatctaataaccgaacgaccagagttggcacaaaatttgaatggaagagtcgcatgggaaggtgatgccctgcaggaagtgttagggaaagaaaagattggacaagtgcatggcatgggtttgcttccaactcctaagcaagtctacggtcggacgccacggtatctaaagaacatcaatatgactagaactgatggatcaccatatgaagttgaacatgacgtttgggaggtaatagcaaagatgcaggagcatataaaaaagcaagaccagattattaaagatatgaataacaaagaaggctatgtcaataatggcatagaagaggaaaacctccaatcaaatgataatggtatttctcgctcaccagtactgcttggtgaaacaaagagaatccagtgcaatggacccgttgaggcatgctcgtctatgcaacatcacattcctgaggataataatttatcatgttcgcatgaaaaggttatgcctgtagttactcttactcatgtcacaaagatagaatataaaataattgcttgcttaccattgttgtgtcatggaactaggttggcgaccatgatgtcaaccgattacaaattcaacaaaattcatcat

SEQ ID NO: 20274 - DNA, 760 bp, Triticum aestivum
  unsure (1)..(760): unsure at all n locations
  Clone ID: PAT_TA_20274
tcattttgcaggaaccacctgagaatgctgttataacaacatgctgccatattttctgctatgaatgtgcacaagagagcttaagtgaagaggaagtctgccctgtttgcaaacagaaattaagttctgaattgcttttttcacgcccagtattaaggctctgtatctctgatgagttggagtcatatgcaataactagttctgcagcagcagcagcaggaaatagttctgcagcgtcagcatcagcatcatcggcagcagtagtagcagcagcaggagcagataattctgcatcatcggcagctgcagcagcagcagcaggagcagatagttctgctgcagcggcagcagcagttgcagcagccgcggctggcggtgccgctgcagctcctccggagatttccggcggccgcgtgacacgctcatcccatccttcatcacgcgcggcccttctcacgcgttgctccctcttcaactctcctccccccttcggactggcatgctcctcggcctggagcctcctcccaatacatttcataaactncaaaagnttgatgggcaatgtcccccgacatagagaanagcattcaagatttaaggtgaccaacgtaaatgatccantcactgaagcggnactgggcaaacatatacncaacagtataagccnatncggngaacctancnagncaagcggtgcaacnannaacgcaaccttcgtacgcancattcatcatgccatggagtncactacctgngaaan

SEQ ID NO: 20275 - DNA, 564 bp, Triticum aestivum
  Clone ID: PAT_TA_20275
ttaatatcaagtataacagtgaaatgcactactgtttgttcgtcgtgttattcagttaaaggttaatatctccaaacttcattttatctttttgtagaagctctcgcctaacaacttattttctaggactgttagtatttaacaaatttgcatcttgatgtggctaatcggtgaagcaattccactgtaaacataagtgcgtatgtagctcttttattgctactaaaattagtctgctcattaaatttaaatgcaatatcaattcactctgaagaggcttatcctctttcactaactacatattcgtttgacctgtcaaacaatcctaaggatccctttaaattggttctaaatgtttatgcagcatcagtgttatatggtaccagaaaacatgtggagagaatacttagttccgttgagaaaacaatagctgaactcttccagggtttgttagatcaactgggctactttgacagattcttgcgtggctgtgaccgggaaggtaccaggccctctccctcatccttcctggactcccccaatcccttaattgcgaaacccccc

SEQ ID NO: 20276 - DNA, 933 bp, Triticum aestivum
  Clone ID: PAT_TA_20276
ctcgcctctgtcaaccctcgttctagcggcggcgctgcagtggagatgggggcgtgtgcgacgaagcctgctgatctcaaggtaaaaggtgaggcgccggtggttctggaggacgccgcggagaagaaggtcgcctgtgtggctgtggctgaaactgaaccggccgccgatgggagtcgccggaggtctctcagcgacctgctcaaagagaacgacgagagtgacgtcgaggctccggaggcagagaagaaggctgttggacccgcgccggcgaccgctggtcctactggtgccgcagagctgcagcgaccgctgcggcccgccgcccccccggccgacccgcctctcacggccgaaatcctggagccagaggatgcacgggatgcgcaggtggtggaaggagggaagcgtgtggatcctgattcagttcagaacgacgagagtgacgtcgaggctccggcggcagagaagaaggctgaagaacctgcagcagctaccgctgatgaaaatgaagcgacggaggagcagctagcagttgagccctccattgcgacgaccgagccaaatcacacggccgaaatcctggagcctgaggctgcagaggatccccagacacatccacaggtggtggaagaagagaaacatgtggatcctgattcagttcaggttactgttgttgattctgctgaaagtgttgaacagagcaaggtcgtcgccgatgcgtctccctgaattattatttatttattttgaggaaatatttgtgcccctgagattgataatggggttttcttgttcaattccgtgctgtaacgctcagtttctttttcccttttcgtttcctgtgtatgcattgcatgcccggtggtgtatatctagattttattgtcatttctcggtttacaactcatcactagatttaactcgaaaaaa

SEQ ID NO: 20277 - DNA, 593 bp, Triticum aestivum
  Clone ID: PAT_TA_20277
gagagaattcccattccgtctgatgaattcttggcatcaatggaaggtacggacattacaaatcagatggcggtggggcacttccaccacattttttatgagggttgctcaacagactttgatatagaggaggatggagaggaagcttctctactctacccggaggttcgctgcaccaggatggaggactacatgaaacgttatttgtaattaagaaactgtatgaaccttaactgccttactagcacaccttgcacaccacatatgttactccctccaacctaaatatacgaggctaactagcctactagaacgtcatatatttaggtacagagggagtagaaaagaagtgtttttttaattgtttagattgcttgccacatgtgtcacgtggttaaaaaaaagaagtggttttatattcgtgaggaaaataagggttcactacaccacatatggaggtgcaaataactatttgtaattaagaacatgtataaaccttaattacctttatcagcgacgcagcacaccacatatatgtcagaaaaaaagtttgttttatactattcatgaagaaaaaggttttggcttacctt

SEQ ID NO: 20278 - DNA, 1403 bp, Triticum aestivum
  Clone ID: PAT_TA_20278
gcaaggcgatttcccaccaacttcttctttctgatgcatgaagcagggagaagagcaaggttctgggtagttggtggcacaggatacatcggcaggaggattgtgcgggcgagcctagcccatggccaccgtacctttatcctgatgcggccggagatgcggcctcgtacatcagataagctccagctggctgtctgtcgttcaaaggcgcatggagcgctcctcagtctgaggcgtcgatggaggaccaccgggcagcctcgtcgccgccgtcggcaagcaggtggacgtggtgggtgttcggccatctccggcgcgtcacttcctgcctgcagctgcaagctaggtggaggccatcaaaaggaagctggaaatatcaagcgtttccgtaccatctgaatttcggcatcgacccagcaaggagtggggaacgctcatagaaccaggaaggatcacattctgacgagaagatggaggataagaagggcaatagaagaagacaaacattccacacacctgcgtttctgctaactgctttgctgctttctttgttcctaatctctctcaaatgcgcacccttctcccgcccaagaagaaagttcacgtgtacggagatggcaatgtcaaagtgatattcatggcaattttttacctaacgaagaacacaatcaagtcctttgatgatccaagggccttgaacaagacaatatacctaaggccgccggaaaacatccttagtcaaaatgagatgattgctaaatgggaaaagctctcaggaaaggtccttgagaaaattcccattccgtatgatgaattcttggcatcaatgaaaggtacggaccttactaatcaggtggcggtggggcacttctaccacattttttatgagggttgcttgacaaactttgatatatgagatgatggggaagaagcttctctactctacccgggggttctctacaccaggatggaggactacatgcaacgctatttgtaattatgaaactttatgaaccttaaccttatcacaagcacaccgtcagcaccaccaatgttcctatgtttgaaggtagttccactgatatgctatttctagcaaacatcccctagcggcaataataaaattccatagcctatacatatgaagtgttttgtccactgatgttttggcaggccacctgtcctacgtgattgaaaaatatttgggttcagaaggaggagaaaagaagggttttttttttcgccgcctatggaggtcctactacatatttcaacttaataacatgtaggaacagcaactacttttgaagaaagttccattgatatgttactcaacatgggcatagttattgacattgtaatcaagttaatgatgtgttatgtaccatctgtaagttccgtgg

SEQ ID NO: 20279 - DNA, 644 bp, Triticum aestivum
  Clone ID: PAT_TA_20279
ccccaccttgcaagcacaagcgcaggcacctcgatcccacgcacttgcctgcacgctaccacctgctccgtcgcagatggccatggcacccagagcgctgctcctcctggccgtcgggctcgtcctcgtcgcctcggcgagcgcccccggcggctgcgagggggtcgtgccctacggacgggctgaagctgaaggcgtgcgtggacgtgctgggcctgctcaagctcaaggtgaacgtgccgcgccatgagccttgctgctcgctcctggacgggctcgtcggcttggacgcggcgctctgcctctgcgcaaacatcgacgccaatgtgctcggcctcaacctccacctccccgtcgacctccgcctcatcctcaacaaactgcggcaaggtctgccccaccgatttccggtgcccaccacgccactaaaactaaaagtcgtctcgactgagtatcgtgatgttgtcttgtctgcatttttaaacgccgtttgtatatttcttgggtacaattgatgtcccaatcttttgtttccactttttttggtttcccttccctatgattaatcaagataaaatgaattgtatttgtatcatgaagaaaaaatttgggacgtagacaaggcactcgttaaaaaaaaaaaa

SEQ ID NO: 20280 - DNA, 792 bp, Triticum aestivum
  unsure (1)..(792): unsure at all n locations
  Clone ID: PAT_TA_20280
tagcgtggtcgcggccgaggtacatggcacagttctatcagtatttggaaatgggacttcagaactttgaagagtatcaggtgtgtgccattacggtgggtgttgtgggtgacttgtgcagggcactggaggacaaaattttgccctactgtgatggcatcatgacccagctcctgaaggatctatccagcaatcagttgcacagatctgtaaaaccacctatattctcatgccttggtgatattgcactggcaattggagagaactttgagaagtatttgatctatgccatgcccatgctacaaagtgcagcagatttgtcggcgcacacaactgcaactgatgatgaaatgcttgactacaccaatcaactaagaaatggcatcttggaggcctactctggtattcttcaaggattcaagagttcccctaagacacagttactgatgccgtatgctccacatattcttcagttccttgatgcccttcataatggaaaggatatggatgattctgtgatgaagactgcaataggtgtcttgggagatctggcagacacattgggtgtcaatgctggtcctttgatcaatcaatccacctcaagcaagcaatttttggacgagtgcttatcatccgatgatcccttggtcaaaaaatccactgaactgggcaaggattgcaatcagccggcgggtctagttgatgtggattgggtgtcnatctgcacatgcatccatccacgtgtcnaatccgggtctcnggtaacatcgtaccttggggaatccacaancc

SEQ ID NO: 20281 - DNA, 316 bp, Triticum aestivum
  Clone ID: PAT_TA_20281
gcctgcgccccctcctccccccctcccccccccggagcgccgccgcccccccgccgcccccgctgccgcgcgtccccgcccccgcgccccgcgtggccgccgcctcgcccgccgctccgccgtcgcccgtccgcgcggctgggccgttccgctccgcccccgcgtgcttgcgccgccgcccgcctaggaaccgattggccgcactcgctcggcccccctccccgcccctggcctgttctgcgcgcttcggtgcgcgtcggcccgcgttggctcgcagcggtaacggtgtccgtttcatgcagttaaaaaaaaaaaa

SEQ ID NO: 20282 - DNA, 935 bp, Triticum aestivum
  unsure (1)..(935): unsure at all n locations
  Clone ID: PAT_TA_20282
tngaaantgagncatttgttgctncgatgngatttccagagttagacgacttccgacgcctntcaagtgnccgacttagttacttntganccaggatctttgtgctnagctgattaaccatccgtaacgccatcaattgacagagcaagaagaggaagttgttttctagtgatattttctggcagagcttcccgaagccgcntccaggaagttcctcaggatcaacacccaagagtgctgaggagcagtctgctccggcaaaccttagggtttgttccgttgaagcagacgctcccgacaagttttgctccgacaagcatgccggggaacatcaagctccggcagagccacaagttcttgccgtagaagcggatgttcccgcagcagcagatgtgcctttagtccttgttgtcgagccacaagctccagcatgggcacagcagattgtccatttccttcagacaggagaacttcccgaagagcaagaagaagcggaaagagtagcccggcagtcaagtgtgtaccagtttgtcgacagcatactgtacagaagaagactcaacggtgtgaaattgaagtgtattcgccgggaagacggacaaaagctgttggcagagatacatggaggcatatgtggccaccacattggcgcaagagcacttgccggcgaantttccggcaaggtttcttttggccgacagccctccaggatgcaactgcacaagtaaccaagtgtgaagcgtgccagttccactccaaacagtacaccagccagtcaantctccagacgatcctttatctggcatttttgtctggggtcgatatctcggcctttccccgagctgtcggggtttagacttgtacatcgaatcgacaagttacaaatggccgaagtcancagtaggaagtncacacagnagcagcaatttcagnat

SEQ ID NO: 20283 - DNA, 355 bp, Triticum aestivum
  Clone ID: PAT_TA_20283
gaggaagaagggcgcctccctgtacctcgccaagatcgggctcgccttcgtcttcctcttcctgctcggcgggctcttcacctacctgctcgagaccatccccgacatgatcctcgcctccactcctcctcagtccatttagcaggattttcgatccattctgtcatctttgggagaggaattgtgttcttgtgaaccttgtatcaaaaaccaccaagctgatcaaacaattcccgttgcacgttcggaacaaaaacaaaaaatctcctgtacaattttaattttcttgtgtaattgttagcccgcattgcgaagtccaatttggtgtcctcatcttcaggataaaaaaaaaaaa

SEQ ID NO: 20284 - DNA, 899 bp, Triticum aestivum
  unsure (1)..(899): unsure at all n locations
  Clone ID: PAT_TA_20284
gcacaccattttacacgcccattccaccaccattcaccgtattactcatagacacacacacacacacacttcgtatcatctccatctcatcactcacacatacacacatcttcatttcccgtttggcgtttccctccgtggccgcgtcgatggcacaaccatatggtgagtaaatcatatgaaggttgcatatgatcatttatctcttttatttagttttcttttctttgttcacttctttttgtggcatctcgcggctctacatggcgatctaatcgtcgccgtggatgtctcatcgtttgatctacaacaaaaatcggcggtgtcccgcggctctacatgacgatctagtcgtcgccggggatatctcattgtttgatctacaacaaaaatcggcggtgtcccgcggctctacatggcgatctaatcgtcgtcgcgggtgttccttgtttgatctatagaaagaattcggcggcatccgcggctctacatggcgatctaatcgtcgccgcagacgttctatcacccgatctacagaaaaacagtttgacggcatcccgtggctctacatggcgatcaagtcgtcgccacggatgtttatggtttgatcagtaaaaggaaaagggaaggttatgatgtttcgtggctctacctgacgcttcaatcgttgccgtaaacatttcatggtgtggagtcacaagggaaagcaatatagctgtacctgcccgggcggccgccgtccaacatacacatatattcaagangtaacaaaggggcacgtngatatacaaaggaggttctcatcatgagataatcaatattaataaagacaggctacctaccccgaataaaaaagacccaatgacaaaattcgcagaacaagtttccatcagagangg

SEQ ID NO: 20285 - DNA, 465 bp, Triticum aestivum
  Clone ID: PAT_TA_20285
cccacgcggacacccacgcggcgagaaattcgtcaatccgcagcaccaaagcaatggccgccgcgaccaccaccgcctcccgccctcttctgctctcccgccagcaggcggcggctagctccctccaatgccgcctcccgaggaggcccggaagcagcctctttgccggccagggccaggcgtcgactccgaatgtgcggtgcatggcggtcgtggacacgccctcggcgccggcggtggcgccggctaggaagaggagcagctacgacatgatcacgctgacgacgtggctgctgaagcaggagcaggagggggtcatcgacaacgagatgaccatcgtgctgtccagcatatccacggcgtgcaagcagatcgcctcgttggtgcagcgcgcgcccatctccaacctcaccggcgtccagggcgccaccaacgtgcagggcgaggaccagaagaagctggacg

SEQ ID NO: 20286 - DNA, 1441 bp, Triticum aestivum
  Clone ID: PAT_TA_20286
gggccaccaccacggtgcgcgcgaagaaaacgtcaatccgcgacattcgtgaatccgcagcagcaaaccaatgcgcgccgcgaccaccaccacctcccgcccgcctctgctctcccgccagccggcggcggctagctccctccaatcccgccagccgaggagtcccggaagcagcctctttgccgacccgggacaggcgtcgcctccggatgttcggtgcacgccaggcgtggacacggcctcggcgccggcgccggcggcggcaagaaagagaaccagctgcgacaggagctcgctgaggacgagccggagggagtcatcgccgacgaggtgaccatcatactgtccagcatctccacggcgtgcaagcagatcgcctcgttggtgcagcgcgcgcccatctccaacctcaccggcgtccagggcgccaccaacgtgcagggcgaggaccagaagaagctggacgtcatctccaacgaggtgttctcgaactgcctgaggtggagtggtcgcaccggcgtgatcgcatcggaggaggaggacgtgccggtggccgtggaggagagctactcgggcaactacatcgtggtgttcgacccgctcgacggctcctccaacatcgacgccgccgtctccaccggctccatcttcggcatctacagcccatccgacgagtgccacattggcgacgacgcaacccttgacgaagtgacgcagatgtgcatagtgaacgtgtgccagccagggagcaacctgctcgccgccggctactgcatgtactccagctcggtcatcttcgtggtcatcatcgggctcaccatcggcaccggggtgtacgtgttcacggtggacccgatgtacggcgagttcgtgctgacgcaggagaaggtgcagatcccaaagtcgggcaagatctactccttcaacgagggcaactacgcgctttgggacgacaagctcaagaagtacatggacagcctcaaggagcccggcacctccggcaagccctactccgcgcgctacatcggcagcctcgtcggcgacttccaccgcaccatgctctacggcggcatctacgggtaccccagcgaccagaagagcaagaacggcaagctgcggctgctctacgagtgcgcgcccatgagcttcatcgccgagcaggccggcggcaaaggctccgcacggccaccagagggtactcgacatcatgcccacagcggtccatcagagagtgcctctgtacgtcgggagcgtggaggaagtggagaaggtggagaaattcttgtcttcagagtagaacaagaacgagggagggatacacaggctgtttcttccaagaaattattgtaactaatatataatgtagcccttttcttgtgatgcggaaaatatatttgaagaattccaattggattgtgaggtcaaaaaaaaaaaaaaaaaa

SEQ ID NO: 20287 - DNA, 1135 bp, Triticum aestivum
  Clone ID: PAT_TA_20287
ttaaatccaaaattcctagagcacaagatctagtccaagatcttagataataacgccaagttctactataggtagtggggtacatagtctgcctacaaactaggggtagctagaacactctaaactaattctgtggagaaattggaagataattggccaaatcaagggatgagatctatattgaaacgtatatgaagtatgtgttcatggccacatggccggaataaaaggggaataattctcaatgcccagctcagccacaactcggctgttgtataggttaagaattaaccatagatgacagtaaacagtaacttgtcttaaatgatctccgccgtcaagtgaggtttaacctgagcgaagctagccgtccgattccacgaagcgttttcggaagcgatacagttaactgaagaaacatgacagtttgtcaggctcatgttctgacaatgtggtcacacatcccagcttgttttttcttttgacggggttttttcttacggtgatcctagcttgtggcatatacaactgtccttgcactcaagtatttcgtgttcaggatatcgcagagcatttgaccaccatacacttatcacgatgtgaacgcgcacgacgcggccgcggtgaacgctcctcccctctgggagcttcccccctcggtgggtgtcccgccgcttggtgtgctgctgctctgtccactcccgagctgtccgtaatacacatttgggacaagggttttgacgacgatgggagccaggtttggggaaccaaggctggcccttacgagtttaagcctgctcccaagtccaattatgatgacatgttctcccctttaaatttctctgcccccttgtcactagagaagatggaaagttcacatgcaattgatgaccagtagatgagcattgttaatacattttgttgttagagaaccccataagaatagcatgtgtttatacattttgccagtatctctgatcatcaacaaatggtaattctgtgggtgaacacttccaatgcctgacaacatagtgagatataacaattgtcatattgcagctaacgtgagttatgtaggcaggcggagcattaattctaacgttcgttgggtggaaaaaaaaaaaaaaaaaaaaaa

SEQ ID NO: 20288 - DNA, 836 bp, Triticum aestivum
  Clone ID: PAT_TA_20288
aatttcagctgagcaattgtgtagacttacgaagctatcatgacggatgttagtgatttctgtattggggccatgttacatctctagggttgaattaatggctagaaattcagagttacatagctgaaaacagggttgctcgaagcaaacaagctgcttattcagtatttttgacactcatggaaaaggtatatgctcatcctaaattcctaattattattatatcacataactgaaagtgcattagaccaatgggtgttatcaagaaataaataattttgccccatacctgaactgtgtcctcatgtgtgtatacatgctagctgctgtttcagcatgtttttctctcatgggttagctttaccctcgtcctactgtccgctctttttgtttttccccttccggagagcgcattccgccgttggtgttatcgcatatttccttctgcccctgagcggcaccctgcctgttctccgtgtgcagagtcgtgagaggtgtgcccgcttcggatatttctcgtcagctgttaactcttccattgttcggctgactgccttcatcatgttttctcccacccgtaagtgcatcagtccgggggtttattacaatggataatttcggtcaaataattgagttcttttcttcggtgtatatacaagttacagatgtgcatgattatgtttattctctacatttggtaaattcacctatgatggctgacatacttcttcaggtaatgttctaaagctccatgcttaatcatcagaatgttccccaagtgactgcttacacatggagactggatgcatggaggagttccaagaagctggtgttat

SEQ ID NO: 20289 - DNA, 195 bp, Triticum aestivum
  Clone ID: PAT_TA_20289
cgctcgtggagtagcaagcatccaagaaccaatgaaaccaaaaagaacctgatggtagtctcatctagtttcctgcctttttttgcaattttccttccgcctctgtaaatatgcatgccatgtaatcgcgtttctagcttaggatgatgcagccgtgagaggaataaaaccaatgtgtacagagtacatacagta

SEQ ID NO: 20290 - DNA, 818 bp, Triticum aestivum
  Clone ID: PAT_TA_20290
ttttcggcacgcggcagagtccccaccccacactcacgcacactcctcctcatctcgcccggggcgaaatcgacgccacagcgggagggaaaaagcttccggggttggcagggattccgcctcttatacgcctgcccgcctcgccagattcctcacagcttccctgccccgagcggagatcctgaattccggaggccgtcgtcgggggtaagattcggcggccatgtcgggcgccgtgctggtcgccatagcggcgtccatcgggaacctgctgcaggggtgggataatgcgaccattgcaggtgccgtcctgtacataaagaaggagtttagcttggagacccagcccttgatcgagggcctcatcgtggccatgtcgctcatcggggcgacggttatcaccacgttctccggggcggtggctgatgctgttggcaggcggcccctgctgatcgcctcgtctgtcctctactttgtcagtggcctggtgatgctctgggcgcccaacgtctatgtgttgctcttggccaggctcatcgacgggttcggtatcggtttggctgtcacccttgtccctctttacatttcggagaccgccccgactgacattagagggctgctgaacacgctgccgcagttcagtgggtcaggagggatgttcctttcttactgcatggtgttcaccatgtcgctcatgccgcagcctgactggagaatcatgcttggggttttgtcgataccgtcgcttatgtacttcgcattgactgtcttctatttgcccgagtcgccgagatggcttgtgagcaaaggaagaatgg

SEQ ID NO: 20291 - DNA, 717 bp, Triticum aestivum
  unsure (1)..(717): unsure at all n locations
  Clone ID: PAT_TA_20291
ctcgtgccgaattcggcacccgcggcctctcggagccccgaaggccactctgtctcgcgctcttctctctctgcccctctggttcccaaccaagaaagagcgacgacggcgacacgcctaggtagacggaacggaaccggttgcgtgctgtacggggcatggggctcctcgaccagctctgggacgaaacggtcgccggcccgcggccggaccacggcctcggcaggctccgcaagtactcctccttctcgacctccaccccggcggccgcggacgtcgcgccggcggtgacccgcagcatcaccatcgcccggccaccgtccctctctctcccgtccggcgaatcaaactccgtgccgtcatcaccggccagtgggccggactctcccttggcagcagcttccatagcccgccgacggggttggccggggggcgctcccctgcccccaagccggcaactccaatgccaattcggcaacacggccggccaccggcccacgtacacgaccgttcccacgggtgcgagcagctgcacaaccccctcggtgcgcagtccccgggtcccgacgccgcctgggcggtaggcggcggctgcccctcaactccccctcacttggttgttgtgctttccgaaactttatgctgcagtaacagtagcacggcganggtggaacgctgaagggcttccnccaaaatccaanaatgggcaaacgttgt

SEQ ID NO: 20292 - DNA, 572 bp, Triticum aestivum
  unsure (1)..(572): unsure at all n locations
  Clone ID: PAT_TA_20292
accgacccgaccctggacggaaggtacgccgacaggtgnagaatnacgctgccgcggccccgccgtcgcggcgcggcggcggagatggacgccggtagctgcgggacgttcgacacgagctactatcggcaggtggccaggaggcgcgggctgctccggtcggacgccggcctcatggagcatcccttcgccggtgcctacgtccgccgcgccgccactggcaggtacgacggggaattcttccgggacttccgcgtctccatggccaagatgggcgccatcggcgtggctcaaccggcaaccaagggaagatcaggaccaagtgcaaccttgtcaaactgaatgtactctaggctcacgcatgattgcattgtcacgaactaagttgtgccacgatttattttactcttttgatttgtttattatctccagcgggcggtaatactccctcttttnccaaatataaagtctttttaaggattccaaacaaatganntatattacgaaggcanaatgagntgaatcnacanctgtaaaanatgtctaacatacatcntttattttgtaagttn

SEQ ID NO: 20293 - DNA, 563 bp, Triticum aestivum
  unsure (1)..(563): unsure at all n locations
  Clone ID: PAT_TA_20293
gcagagcagggccgaccagcagtagcagacacagagagaaagtagaaaggcaaggatgggtcagtgcccctccatccggcagcctgaggcggagtatgttcgcctgctcgcggcggcgcccggcggcaaaagcaggaacgagcagttcagcaaaccaacaaaggccatgaacaaataccaaaaaagatcaagcaaggacgatctagttatgagggcgactctccgaatcaatcacaagaattggataaaactgcaattctgatgagaaaagagcgatgccagatgccagagtttcgacccggatattataggcatcaattgtgaaccttgatgccggtaaaagtatggtgaacccgagggtggctttccatttaccaagctttggtttatagaggcctttaaagtaatcgtgtgtacaagtctaccagctttcttttttggagggtanagtctactacctaacactacacatgtccggganttgcttcacaatgntttggaaatattagtgatatataatagtttaaagccttggaattaaaaaaaaaaggggggccnnacca

SEQ ID NO: 20294 - DNA, 958 bp, Triticum aestivum
  Clone ID: PAT_TA_20294
gccggccgcccccacccacacgcgacccaaccccgcccccacctaccttccgttacacgctgccgctgcgcgcgcgtcgccatggtagcagccatggaggaggaagcgtccaaaggaggctcagaggaaactttcgccgtcgtgaatcctgcgggccaggccgccgtcacggggtccggcgacggcgcgaaccatcagaccggcgaacacgacgcgacgattacgaggccgccgccgccccgtagtaataattatggggccgtcgtcatcggcggcaccttcgaccgcctgcaccgcggccaccacctcttcctccaggcggcggcggagctggcgagggagcggatcgtgatcggcgtctgcgacggcccgatgctcgccaagaagaagtatggttacctgatacaaccaatcgagacgcggatggaaaatgtcaaggattatatcaagtctgtcaagccggatcttgaggttcatgtcgaaccaatcatcgacccttatggcccctccattgtcgacgaggctctcgaggcgatcgttgtcagcaaggagacattgccaggagggcatgctgtcaacaggaagagggccgagagaggcctcacacagctggagattgaggtggcggaactagtgccagagaaatctacaggaaacaagatcagctctacagcattcagaaagatgcagcaccaaaagctggaccagcaggaggtgctacaaacagttcagctggagtgcacagttgagttggacatcttatcatatgttccgctggcagattaatccattgcaaatcgtgtgcttacaagttctactttacatgcatatctttttacaaaagagtaatatatatacaaaaggatagcagcagagcactgctttggctctgctgcagagcgcttccttgcctctggtttacacgggctcctcgcttgggggggtacccaattttctc

SEQ ID NO: 20295 - DNA, 467 bp, Triticum aestivum
  Clone ID: PAT_TA_20295
gacggctgcacggaagctctccgggtcatcatctgaggtcgtaacctgccatgacctgaccttcccgtacgcggtgtactactgccacacgtccagccctacggctgcgtacatggtgacgctggcgagcgtggaggagggtgcctcgccggcgaccatggaggtcatggccgtgtgccaccttgacacgtcattgtggagcccgaagaacccgttcttcgagctgcacaacgttagaccaggtgatgtggccgtgtgccactttctcactaagctgagcatcatctgggtgacagtcgatgagcatgccgacacactgtagaaggaaatgctcacgcccggccgcacctacttatctgtttatgttagctatgtagggcctatggcatgaatacatgtagcctgatccacgtgtatccaagatatgtggtatgacataattgagtgttgcctcctgtgtacttaaa

SEQ ID NO: 20296 - DNA, 1411 bp, Triticum aestivum
  unsure (1)..(1411): unsure at all n locations
  Clone ID: PAT_TA_20296
tcaaacctaattgcgtagcttttcccaagctcgggatgaaagttgaaagatgcgcacggacttacagcacccctcgggtgggacatgccgccttgcagggtggatcctcgccaaaggagaagtatgggcactatgatcgcccggtggactggacttggtgacaacagggagataatctccaaagaagagcccacggggatgggggtgcatggtatgagttagctcaaggctcgaaccgtcctcgacggatcaaaagcacattcctcagaccccgctcccccggggntgccaatagacggcccagagagagcagagcagacaggcgcggcctgcgggctgggggcgcggtccgggacctggctgcctccgcgtgctcccccacctctgctagactgctgcgccgccgctcgccggcccctctcgaccccggccctcagctgcgctacccgggattctgcgagcttgccatcaacaggtcacgataagcaggggcgcaagtggttttactcaatggttcatttcaagaacaggtacatggtgatggaggtctttatcgacgctagcagaggagaggctgatcctgtcatcctcacccagttcaacataaccaaagtgatcagagacagcatccagctcaactttggggaatgtggcctagctgcatctcttggatcattgcaagtgaagtatgtaaatcctgtgacgaagctttgcgtaatccgagtgtcgcgtgaagatcaccagaaagtgtgggctgctatcacaatggtgaagagcattgggaagatcccagtatcgttcaacctcttggatgtgagtggaagtatcagggcctgcaagaaagccgcgctggagtgcgaagaagcgaagtttgagcagtacaagctggctgctggtgaccgtatgacgcaggagatcatcgaatccatgcagagttgctttgccaaacttaaaggattagacagttagtaaattaagtttgttccatgccagcagtctggaaaagaaccagtaatctagacaaacgggattgtcgttgctcggtccaaggcgccacaagaagccagcttccatgcccaaaaaaggcccattctggagggagcttgtggaaaatgatgttcttgtgcaagaaatgttgtgtaactaatcatgattaagccagcatctggtatgtcacaaaagaatgatgcagtgtcgccaaaaggcagcttccatgcccaaaaaaggcccatccttgagggggcttagggagaatcatgttcttgggaagaaatgttgtgtaactaatcatattaagccagcatcggtaggcacaaaagaatgtggaagaaatgttgtgtaactaatcatgattaagccagcatctggtatggcacaaaagaatgatgcagtttagcccatgtttcctgtt

SEQ ID NO: 20297 - DNA, 990 bp, Triticum aestivum
  Clone ID: PAT_TA_20297
gcccggcgcgctgtcccggcccgggctgccggtgtccgtccccgtctccggcgcccacttcaccccacgcgtccgggactaccaggacaagctgttccacaacgacgacggccgcctcgagttcgcgggcgacaactgggccgcgctctggccgggcaccggcaagccggggctgtgggtgagcgccatgtccaggctcgccgcgctgtaccgcctcatcgccaccgacgagcagctccgccacatggaagaagggtcgacgaagacgacggcggacgaacaggacgcgggcctggagcttcgcatcccgcccgtgttcgaccggtgcagcaaggtgctggaccccggcgagcagatcgcggggagggacctgtactgggatgcgatccgacgcgacggcaaggagggcgcggagtcgctgctgcggcggtgcatcgcgaagaacccgtacgtgggggagccgtggctggtgctggctcaggtgctgctcaacggcggagggaggtgggaggaggcggaggcggcggcggcggaggggctgaggctggtgctggagtggggcagcagctgggacaagaggatgtcgtgggaggggtgggtgtcgtgggggagggtgatgagggacaaggccaaggagaaacaatggccgcgctctgcctggggcatcatcaacctcggactcgtcaagcacatccacgaccacgactggccgccttttttaccccccccagctctcgtgctgtcgtggcgcgtgcctggcgccagtggctctgcgttggtgtgctgtgtgagggtgtggtacctgagtatgtgacctatatatatttctgtcaatgtggggtgatctgtggcgggatgttgtggtttctgagtgtatgtgacctatgtttgctcgtatggttgaatagctactgataatgaaatgaatggtgagccaccatgactgtcaaaaaaaaaaaaaaaaaaaaaaaaaaaaaaaaaaaaaaaaaa

SEQ ID NO: 20298 - DNA, 1335 bp, Triticum aestivum
  unsure (1)..(1335): unsure at all n locations
  Clone ID: PAT_TA_20298
ggccggggagctgaaaaatccacttgcgtagaaggaagcatggagaccaagacgactacttggttcctgactccgcacaagatgggccattacaaccaggcgcataagtaacgctgattactgacgaagacgagtccgctcctgacttagacaagatgggcgacttcaacctggcgcacagggttgttctcgcgccgctgacgcggtgcaggtcgtacgggaacctcgcccagccgcacaacgcgctgtactacgcgcagagggcggcgccgggcgtgctcctcgtcgccgaggcctgcgccgtctccgaggccgcgcggggctacccgcacgtccccggcctgtggagccaggagcaggtggaggcgtggaagccggtggtcgacgccgtgcacggcaagggcgccgtcttcttctgccagctatggcacacgggccgcgtttcgcccaccgagttccagcctaatgggcaagctccggtgtcgagcacggataagcaggtgccgcctcaggtcgcccatgacggcagtgtcctggagttcgcgccccctcgaaggttggcgacggaggagataccccacatcgtcaacgacttccgggtcgccgctaggaacgccatgcgagccgggttcgacggcgtggagatccacgccggcaacgggtacctgatcgaccagttcatgaaggacggcgtcaacgaccggaccgacgagtacggcggcggcctggacaaccgctgccgcttcgccgcggaggtgatcgcggccgtgtgccacgaggccggcgcgggccgcgttggcgtgcgcctctccccgttcgccgactacgtcgactgcgtggactccgatccggaggcgctcgggctgcacgtgatcggcgtcatgaacgggctcggcgtcctctactgccacatgatcgagccgcggatgtgcgtcaacgagcggatgatcccgcgccgcctgctgccgttcaggagggcgttcagggggaccttcatggtgaacggcgggtacgaccgggaggaaggggacaaggccgtcgtcgaaggctacgctgatcttgtggcgtacgggcggctcttcctggccagccccgacctgccggagaggttcgggaggaacgcagttctgaataagtatgacaggagcacgttctacacctctgatcctgttgttggctacaccgactacccttttcttgatccggaggattagctaacgtagctaactggttggttcactgttgtcgtgcttttttttgttgaacttattactgttgtcntgcttgggacttgggagttctaccatcatcgttgattaagaagtaactcaaagc

SEQ ID NO: 20299 - DNA, 1067 bp, Triticum aestivum
  unsure (1)..(1067): unsure at all n locations
  Clone ID: PAT_TA_20299
tcccgcgcgacacgcacacacacatgggagcaggagaagaagctcaaggtgctttgcctccacggctttcggacaagtgggggtttcctgaagaagcagatcagcaaatggcacccttccatcctccagcagttcgacacggtcttccctgatggccagttcccagctggggggaagtccgacatcgagggcatattccccccaccatactttgagtggtttcagttcgacaaggatttcaccgaatacacaaatttagacgagtgcattgcctatctgtgtgattacatggtgaaaaacgggcctttcgacggtctgcttggattctcccagggcgcaacactttcagcccttttgataggctaccaagcacagggcaaggtgctgaatgatcacccaccaattaagttcatggtgtcagtatccgggagcaagttcagggacccaagcatctgcgatgtggcctacaaggacccgatcaaggcgaaatctgtacatttcattggagagaatgactggctcaaagttccttccgaggagctggcttctgcctttgctgaccctctcatcataaggcacccccagggtcacactgtccccaggcttgatgaggcatctgtgaagcagctttctgaatggagcgcaagcatcctggcaagaacccaagaacgcagacgctcccaaggcctcagattcagagagtccagtagataaggacaatgtcggcgtgcagtcagcagaaaacctgatgggaacaagttgcagcttgaggcagtagctggacttcgccggttgagttgcgttggtgtctgaaacctgttgcttgcttgctttatccagatggcataccttgttcaccgtattagcctcattgagagatgagaataaatcagtcccgattgccttctttcaaaaaaaaatcaccttttaacttgatacatacctcgatctacacaacaaattttaacttcctcctcaagggaaaaaagaggactnaactaaagggggccgtaccaatcgcctaaggatctatagncccacggcgtcnttaactctgacggaaactg

SEQ ID NO: 20300 - DNA, 448 bp, Triticum aestivum
  Clone ID: PAT_TA_20300
agcatggccatggcgacgagtgtctgcctcccccggccactagcaaccggcgcgcgcgcctccatctctctccccgcccgcccccgccgcctacctcgcccacagcgcagaccccaccgtctcggcggcgccgccgtggggatggatgccctccacgtgtcctcgcgggacgcggagccgctcctccgccccgtgtcggccgccgccgccgccactgcgcaccgtcggctccgcgtgcggacgcacgcgcagggcgccgacgagtcggcgaaggacgccggcgatggcgcggcggcgggagcggactactcgctggcggccgtcatcctcccgttcgtgttccctgcattgggtggcctccttttcggttatgacatcggcgcaacttctggagcgaccatatctgtgcactctgctgagctcagtggcaccacctggttcaacctct

SEQ ID NO: 20301 - DNA, 665 bp, Triticum aestivum
  unsure (1)..(665): unsure at all n locations
  Clone ID: PAT_TA_20301
tgacagcagtgctcctccttgtgattttcatatccgcaaacttcattcctagcatctgggatgccttccagtttaccggggctactgctgctgtttgtatagccttcattttcccagctgcaatcactttaagggatccgcacagcatagcgaaaaagtgggacaagattctggccatcttcatgattgttcttgcagtcacttcgaacgtagtagcagtgtacagtgatgcatattccatattccacaagaaaagtgcctcctccaatgcctgagctgcataacctattgagggagtccagggcgaaggagtgaattcatatgaatggtggtttgtacattacttagtccataagaacatcatttaagagggtgcctggggtccggctccgcgatttgtttgctgctccaccgtcgtctctagcccgtgctgtcccttccttgggtcttcgggttcggcgtgccttttgccgacgtggttcttttgtgcaatgtacattacaagagnagtcctgtcaaatgtgagattacngttattacngtgaactgtaaatgggttgtttttgccggttgccaggacattggattcgttaatcagatactttttggaatnatgaattcccataaggnggtgggcctaattngcctatggaaangtnaagggn

SEQ ID NO: 20302 - DNA, 664 bp, Triticum aestivum
  Clone ID: PAT_TA_20302
cgggccgggagcaatcccacgcacccgcatcttccccccctccaagcttccaatcttccttctcgcctgtcgctgccgagatgacggtggagaaggtcgacgcgacggtggccgacttcgacggccacttcgagaggctcttcgccagcgacgacggcggcaagctgaagctgctgctcttcctcgccgaccgcgagccctcctcctccctcacctggtgccccgactgcaacgtggcggagccggtgatctacgagaagctggagtcgctgggcaaggacgtggtgctcctgcgcgcgttcgtcggcgacaagcccacgtggagggaccccacccacccgtggagggtggacccgcggttcgcgctcaagggcgtgccgacggtgctgcggtgggacaagggcgccgccgccggccgcctcgaggacgacgaggccaacgtcggggccaagatcgatgccctgctcaattgagtcgtgaattatgtgctgaccgcagtctcgtctgcttaatccaagtgccaatagaatgctttggcggcagatgttagctatctgaagtcgtgctgttcttctaaccagtcagcttgagccatgaaccaaataaaacaggggaacacttgaactcaatgtctactgccatacctagctggtgatagggaacc

SEQ ID NO: 20303 - DNA, 531 bp, Triticum aestivum
  unsure (1)..(531): unsure at all n locations
  Clone ID: PAT_TA_20303
attggctcacaagtgcaaaggaaccagtgtcaaggatggcacaaagttgtacaaaaatgctactggtaaagatgccgaacttcagttcactacatcggccgaggaaatagtttcagattcttcatcagcacagaatgtggcggagaaagccgcggatcttatcgacggcaaggtggaagcggagggaagcaccggaggagaggaggaggaggaggactccgccgacgagggcgcgctgcggaccataaagccgtcggccgcgctcggctggaagtacgtcgccgcggcgctcctcgcggtggtggccgccgtcgtcgtgtgccacctgctgcttgagaacggctgggaagggcgcatggcctaacgacgtttcctttggtttcgccgccgtctgtctgtgtttgcggaataatggcgcagtttcagggtgctgtgtgtgcgtctcttcatgtcgtttcatttcttgtgctggaactgaatcggcgctgaatgtatgctgatgctctcatccggcccgaanacttttgggan

SEQ ID NO: 20304 - DNA, 1188 bp, Triticum aestivum
  Clone ID: PAT_TA_20304
cggacgcgtgggggagaaggaggaggagatggggcaggaggaggaggcgcagtcgctggcgctcacgccgacgtgggtggtcgcctccgtctgcctcgtcatcgtcgccatctccctcgccgccgagcgcctgctccaccgtctcggcatggtgctcaaattcaatggacaagaagaactattctcagccttgcacagactcaaagacgagttgatgattcttctgcttattgttggcactaagctggagcacatcagcactcgattggctcaagaagcagcggagtgttccgatgaagcatcaggaaacccctggacgaagccatgcaaggagcacttttggtttagccatcctagggctgtcctccatctgatccatttcatcttgttccagaactcgtttgagatggcatttttcttctgggtcttggcaacatatgggttcgattcatgcatcatggagaacagatcatatgccatccccagacttgctattggcatcatcgttcaggtgctctgcagctacagcaccctgccgctgtacgccattgtcacccacatgggcggcgacatcaagctgcaggcgttcggcgagcacgtacacgtgtccgtgcacagctgggcgacggacgtgaagaagaaggcgacgtcgctgccggcccatccgcacccgcaccagcacccgcactcgcacctccggatcccgtttctcaacaagaagcggcacagcggacgtgaccctgcaaccgaggaggctgcagccgcggcgagggcgacggagcagcgcgctggaagctccagctctcccaccgcaccgccgcagcagcgggccgacgacctagaggagatcgtgacgaccacggaggaggaccatcgtcgtcgcaacgccagtttctcgtagctgcgtacatgctcgcgttactaagtcctaacggtaggccgggcgcatgggccgcgtctcgctgtcgacgttgtcgtcgtcatccggcaggccccaggccgaagccaccgccgacgtcgtcatcgttggcgttctaagcagactagctatgacatgttctactggaccgtcgcgcgatctcaacactttgaaactttgacaatataatatcgcctcttattaccttaattaactcttatgtaccgtatttctgagcagtatatttgctcctatcatgatttttctct

SEQ ID NO: 20305 - DNA, 572 bp, Triticum aestivum
  unsure (1)..(572): unsure at all n locations
  Clone ID: PAT_TA_20305
gctcatcacccgcttcgcgtccaagaacctcaccgccgacgagatggtcacgctctccggggcccactccatcggccgctcacactgctcctccttctccagccgcctctacccgcagatcgaccccacgctcaacaacacgctcgccaaggccctccgcgccggcaagtgcccggcggcgaccgggccgctggaccgcgtcgtgcagctggacgccaagacgccgctccagctcgacaaccagtactacaagaacatcggcacccacgaggtgctcttcaactccgaccaggcgctgctagaccagagcgacacggcggcgctcgtcggccagtacgccgnccaaaccggaagctagtggtcgcagaagttcgcgcccgccatggtgaagatgggctacgccgacgtgctcaccggggccgcccggggagattaggaagtctgcagcagcgtgaactagctatatccgggcaaactgccaaattcagacatctgcaatgtgtatccggcatgtncatgacatgttgccactacattcactagtaactcgacgcgcactngattgatcatta

SEQ ID NO: 20306 - DNA, 639 bp, Triticum aestivum
  Clone ID: PAT_TA_20306
gccccgtcccggtggctttcttcttaatgtggaaattgcacgatgtaaacactctgatagcaggaacggcgttaattggcctaagctcaggtttcatcttcgctgcggcagtgtccgtgacatccgagctatttggaccaaatagcatcggtgtgaaccacaacatcctcatcaccaatatccctcttggctcactcctctacggacagattgccgccctggtatatgatgcgaatggcctaaagagtacagtactggacaacctcactggcacggttgacaccatgatagtgtgcatgggtgcgaagtgctactcaaacacattctttgtgtggggctgcatcacagtgctgggcttggtatcaagcatagccctattcttgagaacaagacaggcttatgctactgctgctggtcaatctaagttgtaagcaccatagccaagttttgagttgagaaaggacctcctttgtttggtcctcactgttgccgaactgtccgggtcaagcttgctgcaaagttggggggtccggtgctggttaggcatacaggtattcccaccagatcacagggccaacttgcacccagcctctacgagagcgggtagctaggactttcaggttggcgcggcccccactt

SEQ ID NO: 20307 - DNA, 1188 bp, Triticum aestivum
  Clone ID: PAT_TA_20307
gcggcacgacgtctgcctctctctgtcttacaagtgggggaactccattgttcggggcctttgccgccctacaacaccagtctgcttcgtttttcgctccagctcgcccttgtgctggcccggagacttttcctgtgagctacgggaattacgtgccgccattcttcaatcccccgatccacccaagaaactcaaaatatctcgtgaagtggatatcttcttttccaaatatctgaggaagcctatcttccaagaatacactctttttgttgacatagagggttttcctgtaagctatgagaattacttaaattcattcaaagcgaggggtgagattggagatgaagtgatgaactcatttattcaagttcttaactatcaatcaaagatgtcatctgaagtaaacccttctctcaagaagtactgtttcacttccgtacttcactgataaattgttggttccccctgagttatttgatccagttgcgtgcatacgagaatttgacaggatcaatctaggaagaaagccccatggacaccaggcctgagagatctccctcttattatcccaaaccaacgagttagacttctcctcaactagaacttgttgacatctcggtttgtatttattgagacataatatccttggattaccccggaaacacccataatcctcctcttccacttctgaatgtctttcggtgtgccagtgggaacgccactcaaacatgctttacaagctgagtaaaaagccattcaagaatgtattctctttcaagcttcaacctataggaccttaaccaacaaactgtctcatgacaacattcagaagtacagaatgatctctgtgttcaagttatttaaaaccaccttgaacaagctgaaagaagaagatctgtcaagaccaaattgacttttccgcaagatgcatctgcaaacattttgaatgtgtaattgatcagagaaaagcatccattttcacatctgaaacagtttcatctataatcgtatggtagtagatgcatagtactagttgtttaaacatatgttaccgcgagcaagtgctatagtcatggatatctacttttcttcgtgaactatatagtacttctgttgcaatcaatgtgcatacgaagcgtatctttttcggcgcgagctcgtgccgcaaaaaaaaaaaaaaaaaaaaaa

SEQ ID NO: 20308 - DNA, 687 bp, Triticum aestivum
  unsure (1)..(687): unsure at all n locations
  Clone ID: PAT_TA_20308
cgatgncggccgcngccacggnggcctgaccgcccacaccggtcgactggcgcggcgcggacgcaagcttgtcacgccatttgccccttcgtttcgccgcgcagaactcgtgaactgcactagtgccatctagcgtgtatgttgggatttctgtggtactacgtcttgctgcaatttgcaaaatgatctacctacagtattggtattgcagtattgctcaagtgatcttccgtttcttcttcctcttacgcattttaatccgtaaaactggtgcggaagcctcggaagctggctgtgctgtcggcgattgtttactggagttcgcaggattttgcgggaataagtttcaagtttgggtccgtagaaacatggcgtttcaagccgtggcattttaacggttggtcgcatataattaagcgtggatggtaacagaattaatgtgcaagaacaagaaaacggagaatgcgcaaccttttactttaagaatatgttgcggtgacgtgcanccataaaactgcaaggcgcnatattaaagtcaatacgcacacaactantggtgaatggatancggngctaacgccgtaantctccaantggtaaaaaatgtcggnctagtcangtaggtcgtgntaccacngnatatnaacacggaattagcaacaggtccctagaaagnncctatgttan

SEQ ID NO: 20309 - DNA, 444 bp, Triticum aestivum
  unsure (1)..(444): unsure at all n locations
  Clone ID: PAT_TA_20309
gaatatctccggtgcgtaccggaggctgagaggagtcgtagccgccgtgtcagaaagccacaccggcgccgcctgcccccctctatctccatctccgtctccgggaagcggcgaggagccttgcgctgcatcgccgtcgagatggatctcctgaggaaggagctggagaagaagcggaaggcggcgacggccgacttcggcggtaagaactttgtccggcggtcggagctggaggacaagcagctccagaagcgccgccagatccccgccaaggttccttctgtgcccacccccaacttctccgccgcctccgaccctaccaactccaacgccgaccccgcccaggccgggggcgggaaccctaaccctagctcctncgccgccgcggcctctgttccacccgccctcgcggggaagaaggccccgccggaggatacgcttcac

SEQ ID NO: 20310 - DNA, 1700 bp, Triticum aestivum
  Clone ID: PAT_TA_20310
ccacgcgtccgagaaggaccgcagcctcggaggagtcgtagccgccgtgtcagaggggcactccggcgccgcccgcccccctctacctcccagaaagccacaccggcgccgcctccccccgccccatccatagccccgtctccgggaagcggcggggagccttgcgctgcatcgccgtagagatggatctcctgaggaaggagctggagaagaagcggaaggcggcaacggccgacttcggcggtcagaaatttgtccggcggtcggagctggaggacatgcagctccagaaccgccgccagctccccgccacgattccttctgtgcccacccccaactcctccgccgcctccgaccctaccaactccaacgccgacccagcccaggccgggggcgggaaccctaaccctagctcctccgccgccgcggcctctgttccgcccgccctcgcggggaagaaggccacgccggaggatacgctccactccgaggagcgccgcattgatgagctcgtcctcccgcggaacgaggtcatgcggcgcctccgggtgctccgcgagccggtcacgttatttggggaggacgacgccgaccgccttgatcgcctcaagctcgtgctcaagtccggagccatcgacgacattgacgacctcgagatgacagaggggcagaccaacgatttcctccgtgacatgattgagctccgcatgcggcagaaggctggtcgagatgcctacggcaagggtaaaggcaagcgtgtaggtgctggtgatggccggcgagggtggcgccccgggagaggatggatatggggggtgtgaggatggcagggggggatgcccccaggaaggaacggggggggggttgaagcctctacccccaaaactaaaggagcgccgcaagccagaaaaggtaatagtcaaagtcatgagtgtgcgcaatgagtggaaccaggagctggatgatatgacagagctggagaagcgttcggcaaagggaaagtcaatgtttgcaacgttcaagcagtgtgcgcggtatctcagtcccctgtttgagttctgcaggaagaaggttcttcccgatgacatccgtaaagcattgctctttattgtggactgctgcatgaagcgtgattatttgcaagcaatggaccaatacatcaagctggccattggcaacgcgccatggcctattggagtcactatggttggtatccacgagcgttctgcccgagagaagatttacacgaacagtgtggctcatatcatgaacgacgagaccactcgcaagtaccttcagtcgatcaagaggctcatgaccctttgccagcggcgttatcctgctctgccctccaaatcagtggagttcaacagcctggcaaatgggagtgacctgcaggcccttctatcggaggagaagaatccgacgaaaggtccttctgaggacaggctccggctgatgccagcatcaaaagagtgatgcttcaacccacaagctcggatcacaaatacaaagtttggggtctttgtgtaatctaaactaaatgcgacatttcctgttatgtttccatttttgtactgacgcggaacaacagaagaatcatgtatgttagtcaaaattgctaaagaagctatgattatctgtaccaatagaattcactgtctgaggtttcacgaaaaaaaaaaaaaaaaaaaactcga

SEQ ID NO: 20311 - DNA, 372 bp, Triticum aestivum
  Clone ID: PAT_TA_20311
ggtgttaaattgcaacacatacgaagttgcgacagcatgtgctttggctatcgaggcggacaagcttatctgtgttgtcgatggccaaatatatgatgagcatggccgagtcaatcgtttcatgtctatcgaggaagcagatatgctcatcagaacacgcgctaagcagagtgaaactgctgcaaattatgtaaaggttgtaggggaggaggacattagttatgcccacaattttcctatcaaagaggagaaagagcaagtatgagttggaagagatttcatcagtgattacactgcatcctttcggaatggtgtgggtttcaataatggaaatggtctgtctggtgagcaagggtttgctattggcggggc

SEQ ID NO: 20312 - DNA, 610 bp, Triticum aestivum
  unsure (1)..(610): unsure at all n locations
  Clone ID: PAT_TA_20312
ctcgtggccggcaacggccgggaggccgacgtcgacgtgtagagacccgttcctttcggtgaaccacctagtttagccctacgtgcggtgcatcgcggtgacatgctaaaatcaagccaaaaactagccattccactcgtagggcagccgtagcatctttgcagcacctagctggctagctttagttattgcggtgagccacacagctcacagttttgccgagcctaataagcggtggtgtgttgcattgaagtggtaccgttgctgcttggagaaatgggctagctagctagcaagctaatcaagctagagatcttgatcgagctaaacaagtnaatcccaagtgacacgcactccttttgtgnactagctaaacaattcatatcacttgantttgggatcgatggggatgcatgcatccttggaanaaaaaaacgtannangcggtctcntctgnagatgattcangaannaacccagggggggcccgtaccaattnncctaaatgatccatacngcgctacggccgtcnttaaangtctaatggaaacccgggntccaataatnctnaanaatcccttncatggntancaaaggcgacgtgcctcaa

SEQ ID NO: 20313 - DNA, 511 bp, Triticum aestivum
  unsure (1)..(511): unsure at all n locations
  Clone ID: PAT_TA_20313
gcttactactgtaacacagaaagaatcgatagaccgagagcaagtcatggagaggaagagccatgctgccttgttggctgccgtcatcgtcctcctcgtcgcaagccgcggtgggcgaacagtcgatcagttataagtccctagaccaagcccaccaaggcgtgcccgaagcatggcacctgcgctccgcgtggatcctccctacaccaaggggcgctaaatgttaattttacaacggagaatgtctcccgctagctagctagctactaccccaagtgggccggtggccatgatgcatgcacgctcaatttacccctggggtaagtacgtactgctacatggggggaacactagctagtcctgcgttgtttactgggatgagtttgtaaccggacactagctagccgtaccgtgtgtatgatngatgttcagtttctcactacttatatagatgtccgtaccccgcatgtattgtgcgtnagttattgtgcattataanaaaaaaaaaaaa

SEQ ID NO: 20314 - DNA, 741 bp, Triticum aestivum
  unsure (1)..(741): unsure at all n locations
  Clone ID: PAT_TA_20314
cccagccccatcgtcaccaacgaccccaccaacctgctcaaccgcgtcgcccccttcccctccgacgccgcgttcctcacctcccggctcacgccgaccgtgctcttcgtctccgccgccgccccccgcacctcggggaagacggcggccaaggcgatggtcaacgcggccgcccccgggcgctgggccgcggccttcgccaaggcgatggtcaagatggctgccatccgagctcaaggaccgctgccaacggcgagatttaggaggaactgtgagggtgcgtcaagcaaatagggttgctggctatttgtatttaacactccgaacgtgcatgcgttcggttctttcgtctggatgcattgcattttgttcctttcatttccttttgctgcattcagctgatacaggtcgtaatccgattaacagggcttttttcacgataagtgatagatgcctgaataaaattttcatttccgacttaaaaaaaaaaaaaaagggggcccgnaccaatccccctatatgatcctattaccgcctcactggcgtntttanaactntgacgggaaacctgcgtaccaactaacgcctganaaatcccttcgcactgngtatacaaaggcccacgttncttcanattccacctangcatggaccccctgtcggataccggggtttggtcccactaccnaatncagccaanccnccttcttttctcttcnattcngttcctanaangggctt

SEQ ID NO: 20315 - DNA, 558 bp, Triticum aestivum
  Clone ID: PAT_TA_20315
ggcggaaggcgcctgcgggagagcagctgtcgtccacggcggggccgcggaggatgctggtgcacgagtcgagcgggcagccggtgtcgtcgttagaggagctggaggcgctgctggcggacctggggtgggagcgtgacgaggacgacggcacggcgctgctgaagttttacaagccgggcagccagccggaccctctcaccctctcgctccccagggacttggccgacttcacctcggtccacatgcgcgacgtcgtcgtcaagaacaggggctccttccacgtcgtggaacgctagcctagcttgttcttggacggccggcgatcccatggccatgtccggtggtgtaataataaagagcatatatatgtttgggtgggtgctcaatttgtctgtacacgtttgtgtttcgtcggtgcagcgtgttaacgacgttacaaggtccttcattgtacgcatgttacgtgacctaatgttgcatctatgtttatgtggacggtccagtgctcatgaataaattgttgttatataaaaaaaaaaaactaaaaaaaaaaaa

SEQ ID NO: 20316 - DNA, 557 bp, Triticum aestivum
  unsure (1)..(557): unsure at all n locations
  Clone ID: PAT_TA_20316
gccactttcagtctccggccactcaacacaactcggctctagtgggtcgatagagctcaaggatgggtagggttgcgatctggatcgcgtgcgtgctgctcctggcggcgacatgccagggcaagggggcgccggggcatagggtgagggtcggctactacaaccggaagtgccccgcggcggagagcatcgtcagggccgtcgtcggcaaggccgtctcccggaaccccggcctcggcgccggcatcatccgcatggccttccacgactgcttcgtccagggctgtgacgcgtcggtgctgctggacgctacgccggcgaacccgcggccggagaagctcgggccgcccaacttccccaaccctgcgcggcttccaggtgtcaacccgctgccgaggccggtccgccttgccgggtcccgcccctgcgcgccgctaccgcnttcgcgaaaggnantcggctanttctaagggntaaanatgantaaaatccggggggccgttnnacggaacntttcctcaaaannattgttaanttcttccccggnctttttaaac

SEQ ID NO: 20317 - DNA, 562 bp, Triticum aestivum
  unsure (1)..(562): unsure at all n locations
  Clone ID: PAT_TA_20317
aatagagaggagggaagaaggtgctttgtccattgcaccattgcttacgagttgccccaatgtgcaagaactttctgtgtcggtcgtgccatcgcagtccaagcggagacggtgcagcgacagtgaagttcagtatcgtgttattggtggtagagggatgatcgtcaggaatctcagggaaattaggatggagtacattgatgagagcaagagtggattggatctggttaagcttctgctcaagaaggctcagatgttggagatgatgacaattgtgccttccatggatggccttgagcaggccaagttcaggcgcagggtgttgaagttcagaaaagcttccaaggaatgtcaacatccagttttgtgccactgcatgatgggatgattgtaattggtggagtctcatgttctagtccctgaaggaagaagtggcttgcctgtcatcagtgagctcctccagtccctgttccgggcacttctaaagatctaacttgccccgacgccgctaacgtcaatttaatcaatgccgagctcattagctcantgtttattagtttga

SEQ ID NO: 20318 - DNA, 472 bp, Triticum aestivum
  Clone ID: PAT_TA_20318
cggaccatcagcatctctctgaccagggcggcgcccccctggctgaagagatatctcgttcgtgcacccttgttctgcagatccgtcctcctggtggtcaatgagatggatgtaaatcagtccttggctggtggtggtgttagtgagagctcagactcggtagaggctgagtttgaagcgctagtttagcatgcgtggggtcattttggtacaatgcagggtgtaaaatgaatggacagttgtagtttctgggctggtaacaagagtcactcgcaacgctgtgtacgtaggtggggtttctgtgaaggtgtgagcacttgatgtcaccgtgaagcttatggtgtcgttagcctaacatgttactatgttgagtttggtagtattaaggagagaaggatatatattcccttgatgcccagaaattaactgttgatgagcattgtgctgctctgttttgcctaaaaaaaaaaaa

SEQ ID NO: 20319 - DNA, 880 bp, Triticum aestivum
  Clone ID: PAT_TA_20319
ccgggctgcaggtatgcgtcttctacttcactagaaagccgccaacagcgccattcgacctcaggtttgatcctggaggcccccaaggtggcgcttccacagggcatgatggcgcccgtgaactccttcaatacattgttccacgcccagggctttctggcggcctgatgatgcctgtttcagtgagttcaatggcggcagatgtcatccgtgggtactgggctcagcggatcttgtgggagattggtgggtacgtggctttctatccaccaactatttaccggaaggatcatgtgcaggcctacccatttgcagaggagaaggatctgcatgtgaatgttggtagactgatcaaattcttgaatgagtggaggtcaaacaagcagagcctgttcgagaagattcttgatttaagctacgccatcccacgcgtccggttctggatggagcaggatgtgagattgacagctgcttggctgcaggatcttctggcagcagggtatcggcagcctcgcctcatgtcattggagattgacaggcagcgggcaaccattggggagggtgacatgaaggagtttgtgcccaagaagctgccatccgtgcacctcggggttgatgaaattggcacagtgaactatgagattggaaatctgattaagtggagaaagaactttggtaatgtcgtgctgatcatgcatgttagtggacctgtagatcgtgtggccttggagtggaggctcctatatggacggatattcaagaccgttatcattcttgccgagcatagcaatgcagagcttgctgttgaacgctgccctctgtcacacgcatacaagtatcttcccaaggtgtttgcaagatacggtggtgctgatggatt

SEQ ID NO: 20320 - DNA, 439 bp, Triticum aestivum
  unsure (1)..(439): unsure at all n locations
  Clone ID: PAT_TA_20320
acacggtctactgtctgctcctacctcagccttctggggatggtcaccgacaatgatactgatgtgcaggagctgcgaaataagcttatactgcaaggaggaggaggcctcaccaacggggacgcactcaagctgttcaccgggcttgagaagtacctgcgccccgggaactgctatgacaacatcattatagcgattgaaaactacaggtcccataggcggttgcggatcaaggtgtacaggttctgttacaggaaccgcacggccatcatcgccacggtgtccgccattgctggacttgcaggtttcctcgggacgctcaagtctttcaagtaagctagctgcaccgcctctcctgccatggcgagcgttgtgttgtaatcttgtacttggngtcctttccttgctaaattaaaattaatcantcatgtaaaaaaaa

SEQ ID NO: 20321 - DNA, 605 bp, Triticum aestivum
  unsure (1)..(605): unsure at all n locations
  Clone ID: PAT_TA_20321
gcagcagattccagtcgccgtcgccctcgtggcgctccaggaaaagcagatcccagtcgccgtcgccgtcgtggcgctccatcggcagcaggttccagtcgacgtcccggcaacctccggcccgggcagcgctctgttttacatgtcctccagcgacttgttggagctcgacgaggagcagtggtttggcggcatggacgccgggtcgtactacgcgagcttggcgcaggggatgctcgtggcaccgccggacgaaagagcgaggccggaggacggcgagcagagcggcgtccagacgccgctatggagccagagccacttgttcaactaatttagcagtgtaaagttgtaccatagtccatagatagtcgtgttcttttcaatttggtgagaaacacagtaccctcttgtcccttggtggtaatataagctcccggtttggatgtgtggaagacaggggattggcgagttccccaattattggtctttggtcgccttctccctgcccggggcaattctgggcaggcggtgggtgcctttacacaattttgggacaaaaaaaaannaanaaaaaaacccaggggggcccgttcaatnccccaaat

SEQ ID NO: 20322 - DNA, 743 bp, Triticum aestivum
  Clone ID: PAT_TA_20322
ctcctccgcctccgacaagttccccaccttcatcgccgtcgacccgctctaatggaggcggagcagcagaagccgcagcgcccgcggcgcaaggcgcagaagcgcaggattgacgacgaggccgtcgcctcggccgccgccgccgccgccgccgtcttgtcgccgctcggcagcgccgatgccgacgacgacaacgaggacgacgagggctccgtcggccccgagatctgctgccgccagtcccaggtgcggtcgcccgcgaggtccgcacgcaggtcgacgccctccaccactgcttctcctggcgccacgccgaccgcgccaccgctaagcgcgccaccagcgtcctcgcggagctcgcgaaaaacgaggagatggtgaacgtaatcgtagagggcggcgccgtgccggcgttggtgtgccacctgaaggtgccccctatggcggcggcggtggaggaggagcagcaagccgcggccgttcgagcacgaggtcggagaagggggctgccttcgctctcgggctcctagccgtaaagcctgaacatcaacaacttatagttgatgctggggccctaccccttgctgggtgacgctccttaggaaggcataaaaatgctacaaattcggggggcggttaacagcccgttctgatgagcagctgctccatgcaccttccctgctcttgggctcagcaacatcaagacctgcattacttgtgttcgcggttcccaccctctcttg

SEQ ID NO: 20323 - DNA, 862 bp, Triticum aestivum
  Clone ID: PAT_TA_20323
aacaagcccacgcgtccgattgaagaaagcatacctactcaagatgcttctgaactggagatggcaaacgatgcctccgtacacgggcatgaatgtcatgaagaaaaacatgaaggtgaaacttctgttatagaatatagaactgaatctctaaatacagttgcccagaacatggaaaccagattatctcaggctatagcagagaaaaagaaggctgaaaaacttcttgaggagctagaaaaggcatctcggccttcaaaagctgaaacaagagagacaatctcagaagaggagaggtacatgttgaggaaagttggtttgcagatgaagccatttctgctgctaggaaggagaggagtttttgatggaacaattgaaaatatgcaccttcattggaagtatcgagaacttgtcaagattatatgtaaagaacacagcatggaagatgttacatatgctgctcgaacaccgtccgctgagagtggtggtattttggtggcagtggagagagtgagcaaaggacatgcaattataatgtatcgagggaagaactaccagaggccgtcagctctcaggccaaaatctttgttgaataaaaaggatgctctgaagcgttctgtagagcttcagcgccacaagtccttgaagcttcacgtacttaatctatcaaagaacatcgactacttgaggggtcagatgcaaacggagggtcatccagtggctttgtctaatcagatgaactcaggccatgaaaacaaaggcatgcatgatctctgtgacaactctggaacatcaggggagacaagcaaatgcctgaagttgctcctgagtgttttgagcccagaggtgaagagtgcagttc

SEQ ID NO: 20324 - DNA, 507 bp, Triticum aestivum
  unsure (1)..(507): unsure at all n locations
  Clone ID: PAT_TA_20324
ttttttttttttagattatacaatgatcagatatcaccgttggtctttttctctctgttccttgtcttccccatccatcgccatccatccatggcctattcagtcacataagtacatactgcgatccatgcatgtcgagtagcgaccgagacgagctaattcaatgtagcaagcacgattgatcgctccatggcatatgaacacggcatccatgcgtccgcatgcacggatcgacacacctacgactaatcaacaacgtatttgaggtccaacaccggcacgcacgtactactcacaatttggcgcactgcacgggcgcgaaggagagggtgttctcgcccacgtcgtacacgaactggatgttctgctgctggaagttgccgatgatggacaggccccgcgaccccatcaccgtcacgcacagcgcgccggacccggagtccagcaccatgtagttccccccggagtccaatcnggccgtcgantggaaaccagcntcggacngac

SEQ ID NO: 20325 - DNA, 477 bp, Triticum aestivum
  Clone ID: PAT_TA_20325
gaggtcaaagctgctggcgataatatagtgggtgttattcttctacaagaattacctcacctatcacatcttggtgttagagctcgtcaagagcaagttgtatttgtaacttgtgaagatgatgacaagattgcagatatgaggttcgtcgagggaaaacatgtcaggttgggagcatcatccagtgatgttgagttgtcagtttcagatgaagaggccagcgacatatcttcagaggcagccattatacagaaaccatcaaatgagttctcttcagcattgactacagacgagtcgtcgcttttgtctgagcccaaaagctacacttcaggagaaaatggtagttccagtgttctggagcttgcagaagcatcaattgaatcgtctggtgctaaagctaaaacgtagtggacgctttctgtcctggcctgactgtcaaataaagtttacatcgatcaaggaattgcggctgcattt

SEQ ID NO: 20326 - DNA, 798 bp, Triticum aestivum
  Clone ID: PAT_TA_20326
cccacgcgtccgctcatctgctctcccccatttctgtgtgagaacggcggctgattgatttgcggtagcgccggcggcctcaagtagggctatgaggaggaaggaagacgattagcacgcgggaagcaagaatagatcggggccagggcgtgaggaccacaccgtcatcacggcgagcaagccggcaacccgttcgtgtttctgaagcggttcggcatcatggtggcgcagacgaaggccttcttcgattccaggccggccgcagccacgacgtcgacgacatccagatcaagcccgtcagctccggcatttggatcgaccgctgctccggtgctccgccagagcaccgacatcacccgtaccaagttatggctcatgttgctgtgtatttggctgctggtcatcgccactacctcagcaaagtcactggcgaccaagtggttcacactatctccaaagcttttgaagcagcgtacatgttacatgaatctggggcaaaatggtagatggcgtcatgaggttgtatgcctgcagcgcatgtgtcagttagtgatggttaatcaagattgagcaaaggctaggttcaggtgtcgctgtcgtgacctgcttggcattactctggtataagttacgcagtggtaaccttccttcttttgatggttgtcgacacacatcttcagtcacacatacaccatacgagttttggccctgaactttagaatctccatgtctgaagttagtcctcatccaactgagcaatatgcagagcctctggtacgtgcagccgcgcttcgtcgc

SEQ ID NO: 20327 - DNA, 544 bp, Triticum aestivum
  unsure (1)..(544): unsure at all n locations
  Clone ID: PAT_TA_20327
gggttctactttttggagtgctttgaaggggagggctactattaccaaagcgaagaaagtgactactttcacaccggacaaagtctatatgacaaggattacggcctgcagacccttgattctgagctacaggcactctccctccacagcgacctcggcaagcggggccagctcctggaggagcgctgcaaggggagcaaggcgcgggacgatgactgccgcgacggtggctctccttgcctgaaagttcttgaggcttcaggagtctccgggcatcgtcatattgccaggcgtgagccaaagaaaggtgtctagttcctgctggcagaagtggataatcttcttgttggcgaaacccatgttctgatcactcagtagcgctctagtttggattttctagccgtgtccactttcacttcctatgaagtgatatcctcaactgcgtcttgtaatcagcctcaaaagatctacacagacagtagatcttcagatgaagtcttcagaaattttcaananaaaancaaaaaaaactccganggggggg

SEQ ID NO: 20328 - DNA, 704 bp, Triticum aestivum
  Clone ID: PAT_TA_20328
atggtcacttcccgatcgaggtacattgcatcatcttcctagctagctagctaaaccactccttggcacctaggatcaatggcaggatccgcgctcaagatggcggccatctgcgccgtgctggtcatcctcctgtctggcgtggggcagccggcgatggcctacgtcgacgggctagcttgccctagcgcggccacgccatgccgcgcagactgctttcctgtgtgcaacgacagtgcgccgttggtgtgcaacaagctctgcggcctaacgccttcagggctcggcgtcgtggacaaggcctgcgtggaccatttcttcacagcttgcatggccatctgcaagaacatgtgcgagccctagactccctgatcggcgcccggtgactgccacggccatgcatgcaacttcagagatttcttaccatcgcgcggtgaacgcggcgtacgtatgttggcaatagccaactctttgatgtttccttcctcaatttttttacacttccttccgcaattatttctgtcacgcatcactggtcgtctatccattcatggatcgacagatggtggtgttctgttatgctaccgtatgcgttaccactcccggtaggaagtggtgtgtatcggttcattgctgcggtgtaagaaaagattatggcattataaatatataaaagatgaagcatttccgccaaaaaaaaaaaa

SEQ ID NO: 20329 - DNA, 1270 bp, Triticum aestivum
  Clone ID: PAT_TA_20329
agacgggaggtgggaccccgagtgggctgcatcgtggcagcagagttcttcacgatggagaacctgggccaactgctaaaaggcaacgaccatctcatttaatgccttcgcattcttcaggcctccagtcccctgttatgtcttcacattctgtcccctcttcgtcaaagtggggaccatcttcagcatcaagggggaaaagagcaaagtcgactacgccactggcattaccatccatggatccgacctcattgattagccggaaagtttttacaagatggccagatgataacaacttctatgaggccactataacccgttacaatcctgctacaggcgaacatgctcttgtctatgacatgggcaaaacaactgagtcatgggagtctgtcaggctttgtgatatgagacctgaagatataagatgggaacgtgatgatcaaggcatctcaaatcgagatagttggggcccttctggtccattgttgaacaggaaccaaaacaacaatggtagagggagactatctcagaatgagcatccaaataaatatggtccacctcaaaatggcatcaacaggaatattggtgaaattgacgtgcctaacactcagagtgtcgtgattgaggtcgagagggtattgtcaaatccaagtatgcatgaaattgaaaaggcaaagaaactgctaccagaccaggagcagtcattacttgatgcaattgccagtcttgatgatgcatcagatagcgaaagtgaggataaggccatggaagcccaaatgggttctggtggtgatcacacgggtaggaacggcattgcctgttagttgatatgagaagtatgttggaagattgccaccttcctggatcatcactggacaaagaagccatgtgatggaaaactggactaccaaaagaaggtggatttggcagttgctgctccatgagatgagtttatttgcctgctcaaaattcggacctggcaaggatgaatccagatggaacgaaaaagctttaatggcgcctttcctctctgatggactacaagtgactaattttctagaaattgttgttaacataaatcagctgaagattctttgtgttcggtgccgacagctgattaaccttggccgaaatctccgtttttctttgcctctcctatgcgcactgagttttgcagtgggcatactggctgtactgtagtgtactccctccggtcctttttactctgcacattggatttgccgaaagtcaaacttagctaagtttgacc

SEQ ID NO: 20330 - DNA, 1949 bp, Triticum aestivum
  Clone ID: PAT_TA_20330
ggtcgcccgccccaaatcctcatccgattccacgccgcaaaacctccccgaatctgcctccggcgcccccaggcacgcctccgcccggccccgtgctgctccatatatcctcggatccgttggcgctcggtccggccgcgccgtcctcctctggtccccccacgtcccgcgccggagctggggagggaggggggaaattcaaccccgcgccaggcggattccgccccggatccccgcgtcgggcaggccggccttctgatccggcaggttaaccaagtacggtgcattctgaacggtagcctgtaactcttattgggtaattctaccacattatggcctcggttggtgcggtgcgtccttcctcgcgctttcagaatgacacgagtactagtggtgatgccgaccgacttccgaacgagatgggcagtatgagcataagggatgacagggacactgaggatatagtagtcaacggcaatgggacggaaccaggccatattatagtcacaagcattgagggaagaaatgggcaagcaaaacagaccattagctacatggctgagcgcgtggttggtaatgggtcatttggaactgttttccaggctaagtgtcttgaaactggggagacggtggctataaagaaggttcttcaagacaagagatataagaaccgtgagctgcaaacgatgcgagttcttgaccacccaaatgttgtggctttaaagcattgttttttctcaaagactgagaaagaggagctttacctcaacctggtgcttgagtatgtgccggagactgctcatcgtgtcattaagcattacaacaagatgaaccaacgcatgccattgatatatgcaaaactgtacatgtatcagatatgtagatctttggcatacattcacaacagcattggagtatgccacagagacatcaagcctcaaaatcttctggtgaatccacatacgcaccaattgaaattatgtgacttcggaagtgcgaaagtgttggtaaaaggagaaccaaatatttcctatatctgttcaaggtactatagagccccagagctcatatttggtgctactgaatacacaacggcaattgacgtttggtctgctggctgtgttcttgctgaactccttctaggacagcctatattccctggcgacagtggtgttgatcagcttgttgaaatcatcaaggttttaggtacccctacaagagaagaaattaagtgcatgaatccaaattatacggagtttaaattcccacaaatcaaagctcacccatggcacaagatcttccataaaagaatgcctgctgaagcagtagatcttgtctccagactcttgcaatattcaccaagcctgcgttcaactgctttggaagcattaattcatccattcttcgatgaactccgggacccaaacacccgtttaccgaacggccgttttcttcctccactctttaacttcaagccccatgagttgaagggcgtgccgatggacatcctggtgaagctcatccctgaacatgctcggaagaactgtgcctttgtaggatggtgatccgtcagacggctgcttgaagtttagttcagaacaaatccagttgtcgtctactagaaaccccaggagtttgagattgcctgcagccacatgggatataggcgatgacacatgtgattattattctttttctcgtccgagacctcgatgtcatgtattctttccccctactgccgatgtaacaaaccacccatgattctgtaagtagatgagaagtgtttcgaccgttttcccctgagctcatgtgctatgcaatgaaggatgcaccctatgtaccgccaatatttggtccagtatttgttcatggatcgaggctataattcatttgtactcatcaaaaaaaaaaaaaaaaaaaaaaaaaaaaaaaaaaaaaggagctagatg

SEQ ID NO: 20331 - DNA, 923 bp, Triticum aestivum
  Clone ID: PAT_TA_20331
cccccccccttatctcccgcgctcctcttcctccactccccatggctgccgttggcgtcacctccccggcggcgccggccaccgtatccgccgccgtatgttcctcgtccacgcgccgccgagtccatcttgtccctacccgattcttcgcagcagcgtcgttcagcgggcgatgtgccgctgcggccgacggcggggccgcggcctcggaggacctggctgcggcagcggatgggtatcccgacgctggaactgacgtcgccggcggcgctgccacttccacgcggcctccctactcgctcatctccgccgccaacgtgcagaaggcgatgcgcggccttgcaattacagatgctgatcactatgggaggcttggaattaccagattagcgtcaaccgatgaggtcaaagctgcatatgagaaaaggtgtgaacaactaaacaagcaaggactggaagaagaggaaatcagcaaggaacatgacctattgaaggaatcttttaccatattatcaaccgaggaagagagaagattatatgattggagcttggcgaggaatgggcagcctgagcgatatgtttggccctttgaagttgaccccatggagttggcaccagatcctcctaaggaaccggaagatgagtttcctacaaagcttgtcggctacttcttgttgacatggttcataatttctgtagcctgctcgctgattctcaacagatcatgaagttctccgtaaacgaagatgaataatagctcaacagtgtttttctaaattagtcgaagtacataactgcacagtttgtacagataaactatatgaatctttaattaattattcacatgggctaaaaaaaaataatgactatgtactgcactgcacatgattagaacaatagtctatgctcctgtagcgcaaaaa

SEQ ID NO: 20332 - DNA, 399 bp, Triticum aestivum
  unsure (1)..(399): unsure at all n locations
  Clone ID: PAT_TA_20332
ggcacctccacncacgcgggggcgctgtccccctcgccggctgccgacaacggcngccanttctcgccgccatccccgccccctcccttcggcatcaacatctcgcccacggggaaccccgaccagcagaacgccgcggccggcaaggcggcaggcattgccggcacggccgcgctcatcatcgggaccatgctctactcgcttgtttgaataatcacgcctttgtttttactgtccagatttattggggggttntaaaaaccattgngtttgattaagcttgttcttaatactatgttgtatcaacatttcatgtaaactgtgtggctgaaccattgcaattgatctataatatgtaaatgctgggtacttttttttaccaacaaaaaatgtaaagct

SEQ ID NO: 20333 - DNA, 245 bp, Triticum aestivum
  unsure (1)..(245): unsure at all n locations
  Clone ID: PAT_TA_20333
ctgacgcgagactgggcgtccggcgagagcgcgagaaggcgatttcgcttcacgtgtaacgacgatgtggagtccttgtccagtacgggattggagttggagccttggaggccatcacccagtaggataggtactggctagtttaggttcctttttatactcttgtaaccccgtgtaaacaaccagatcaatcaatcaaagcaaataatattcccacgaaaaaaaaaaaaaccnaaggggggggg

SEQ ID NO: 20334 - DNA, 459 bp, Triticum aestivum
  Clone ID: PAT_TA_20334
ggattagctaagctagcatgggcagaaaggtgtgcatctatcttgccatcctcgcgcttcttctggtcgctggtccgggcgcgaaggctgcaaccttcgccggcggccccgccagcatggacgcggcggtggcgatacggcagcggatgtcagcgatgaagctggaggacgtcgtggcgccggagctcacggtggacctggaggtccaccgccgcatcctcgccatcaacgtcggccagagcgccctggacggcaacaggccaagctgcatccaaaactgcccggcgcgcggagactcgtacaccggccggggttgcctgaaaaggtatggatgcaatggaggaagctgaatgcaacggcaccgccggcgtccgtacatgagtattggctttcatgtttttttttcatttcacttccgcatgcatttcaatgctgtagggtcgtcctccttttctaaaa

SEQ ID NO: 20335 - DNA, 1051 bp, Triticum aestivum
  Clone ID: PAT_TA_20335
ctgaggtacagaacacacgcgcgccccacggtttacagatagccttcgcgcctctgccaatcgtcatgctcgcctacctcctccacgcgcccgccgccgccgcgcccagcccgctcgccctccgcgggccgccggccgccgcgtccaagacccccttcctcccgccctccttcgcccctccgcaccggcgcgccgccgcggcggtcgccttctccgccgccgccgtgggccccatcgcggcctcgctgctcgagggccccgtgctgctctgggccggccgcctctgcgtctactacgcgctcatccacatcggcctcgcgggatccccgcgcagccccttcctctcccacgagattcgaggcgaggacggcgccggggagagcgacctagggttctccaagtgggccgacaagctccgtggcggcgcaccaggcgacaaagaaggccaggataagtggaagctagtcagtaaatggaaacccacaaccaaaggcacactgaagaggatgtaccgagttccttcaaaggaagaaggtcgccgaattcttaaagaaattgctttggttctatctgaagatgacaattttgtggatgcttccactcacaagggttgtcaaatcaggagggaaagcgcgcatggagagagcgtatgttgctacaatgtaagagccttgtttgatgagctccccggccctcacctagttctggagattacaccttttcctgttggaaccctcactgagagtgactaccgcaaggccgagaggcttgaaatggtgctgaggatgagtgcctccctttaaaccagaagagccattttccacttccacctcataactcctttttgcccagattgtaaattgtctaccattgggtctgtaaattgatgttgtgtcgctaaaacctctcctttaaacctgagttctgctcagcattttgagatatttgaggccagaactcttttgttttttgtactcaccggccttccatattgagggcagaatttccatttcccagtaactaatatgcaagcaatttattcctagatttt

SEQ ID NO: 20336 - DNA, 545 bp, Triticum aestivum
  unsure (1)..(545): unsure at all n locations
  Clone ID: PAT_TA_20336
tcgcacacgaacctctctagaagaactctgaccggccttgccagggactccaggaggtgcacggcccgcccggcgccaccgcccccggccgccgcgccaaacgccgccgggccaccgcccgcgcgctccgcgtcccgccgcccgtcgcggccccggtgccgggggtccgcgtgcggcctgccgcacgcgccgtcgccggcgcgcatccgcggccgcgcgcgcgacccccccccgtgcgccccgttctcctccctctccgtgccgcacactcggccgcgggtcccgcggctgcctctcgctcgcacgctcgccgctgaccacgtgtggatgtctgtcccacctggcctgttgggccccttggacttcttcatatctgcgcgtgggtaccctccccggtgtgtgcgtgtgtgggtcgcgaggagtactatagatgtcacgcgtgaggcactgtgtgggcgtatgaagtgacagtttcaaagccttacctattctgtccatattatttacctaaaattatggtcaaggtgtgacgggaagaatganaa

SEQ ID NO: 20337 - DNA, 444 bp, Triticum aestivum
  unsure (1)..(444): unsure at all n locations
  Clone ID: PAT_TA_20337
ccgcccacgcgtgcgcaaggtgtaggacaaatgaagaatgagctagctttaatagctaagctgcagcacaagaatctagttaggcttgtcggtgtatgcttggaaggaggagaacatttgcttgtgtatgagtacacgcccaacagaagcctagataccattttgttcgatcctgaaaaaagcaaacaactcgactggggagcaagatgcagaatactgaatggtattgccagaagcctgcagtatctccatgagcattcccaactgaagatagtccacccggatttgaaagccagcaacatattacttgatgcagatatgaaacccaagatttcagattttggtttggccaagatctttaccgatgatgaaactagaaatgccacatgtcgcgccatcggaacacttggctacatgtctncagagtatgccatgcgcgggcac

SEQ ID NO: 20338 - DNA, 658 bp, Triticum aestivum
  unsure (1)..(658): unsure at all n locations
  Clone ID: PAT_TA_20338
gtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactgggtgtgaatgttgcggttatggttggtggattccccaaggaaggaaggaatggaaaggaaggatgttatgacgaaaaatgtttcaatctacaaagctcaagcatctgctccttgaagctcatgcagcccccaattgcaaggttttggttgttgcaacccagcaaacacaatgctctcatcctgaaggatttgctccatctatcctgagaagaacatcanttgtttgacccgcctagacacaccagggcactcggtcagattcggagagactggtgtcaatttcgacctgaacagcgcaacagccccggctaccctcccgcgcccancattaaanccatgnaaaccgttnaattt

SEQ ID NO: 20339 - DNA, 679 bp, Triticum aestivum
  Clone ID: PAT_TA_20339
caacaacagaagttttcctctgttctggtgaggaagccctagttcccaaatcctgtctgccccgccgccgagtataatggagggatccttccccgcctcttccttacacccccccgccgtagcacccgccaccacccgctgtgccccatgggttcttcttgacagtagggcctactttgccgtctgcaagaacgccaccaccgctgaagccaccaccagcaccagtcacatggtcaaggtcagtttctgcctctcagatccgccggcaatctcacacttttgcgtctttggccccgagttgaagcacgaagatttcatgatggaacccctggttctcttctcggcgaaggacctcgtactcctccgcctcgccttcaccgtcggtccacgaagcacccataaggattctcgtaccagtctcttctgagagagtctgtttattcaagccagacttcctcccctgtacattctccaaatatcttgatgcaactccaaggtcatgtgcagaggaagtcatccctactgcaaatgtggttcagaaatctctacttaatgatcatgtttcatcaagcaatttttctctaataagctgtcaccgctgcaggatacacggcagtgctatggggggttcgactgaatatgctggtccatacgcaggctaccgcaactatcagcagca

SEQ ID NO: 20340 - DNA, 994 bp, Triticum aestivum
  Clone ID: PAT_TA_20340
cacacggcaaaggcccggtggtgcccgcggggaagcagccgagccgaccgacgcccacaatggccgcgtccctccgctcgccgccgcccgtgcccgccgcctccgccttccgccgctgccgcgccgccgccgtcgtctgcgcctcctcatctccctcctcgtcctcctcctcggccgtgtcgtccgctcccaaggcgcgcttcgtcgcccgccgctccgagtccacctccgtccagcagctcgcccgccccctcgcggagtacatgggcctgccggcaagccagtactcggtgctggacgcggagcgcatcgagcgcgtcgacgagtccaccttccgctgctacgtctaccgcttccgcttcttcgcgctcgaggtctgccccgtcctcctcgtccgcgtcgacgaggagcccaacggctgctgcatccgcctcctctcatgcaagctggagggatcaccccttgtggaggcgcagaatgacaaattctcggcttccatggtgaatagggttttctgcaacagcagttcagagggttcgacgcttcaacaacttacatccgatgctataagcgaggttgcaattgacattccctttccatttcaagcactaccagttgaagctattgaatcaagtggcaggcaagtgcttgagcagttactccgagtcatgcttccacgatttctgaagcagcttgataaagactaccaagcttgggcttccggcgattcttcaaggaaaccacttggcactggggaaatatgaagctgaccataggcataagatagcttttcttgtttaatctagttgatgtggtcgtacatgatccacttcctcatgatagtctgtccttggaaaactctcgtggttgtatattatgatcccaccgtcatatgatcgatccatttgcttctttctgctggttcgtttaactgcttgtgggcttgtggtcatcggccgcactttcagtaaaacacaggaattgcattctgcct

SEQ ID NO: 20341 - DNA, 500 bp, Triticum aestivum
  unsure (1)..(500): unsure at all n locations
  Clone ID: PAT_TA_20341
ccgtggccatggaaaccttggagggggtgttgagggagtccaaggcgaggttcttcagcggcagggatggacccggctacctggacatcatgctcggcggcctcctcggctcgatgcgcgcgacggaggagatgtgtgggctccagaccttcgacccgaccaccacgccgctcctggccgcatgggcggagctcttctgcgcgctggacgcggtggagccggtcatgccgcgcgtcgagaggctcgtcgagtatgccgaggcgacgcagcacctcgcaccgccgtgtccagcaccaccaactgaggcctgacgagccccccccgcctcccccgcgtgttctgcactccccgcgcctcgtccgtccttggtcttcacctaatacgctctcttatcctggtatggatacatttttaatatttttaaatttaaaaaaancnatttttttttttttttttttttttaaacaacaactttttancncangacanatacatgtnac

SEQ ID NO: 20342 - DNA, 1122 bp, Triticum aestivum
  unsure (1)..(1122): unsure at all n locations
  Clone ID: PAT_TA_20342
tgcaggcttgcggnctaccacagttacgtacaatgcggtgattgatgcatgcgggaaagggggtgttgacctcaggttcacgctcggatattttcgtcagatgctacgggatgggctctgtcccgaccggaagactttcaattcacttctttctgcatgtagccgcgcagggcacttggaggatgcccgtgctgtctttgatgaaatgatccatcttggcattgggcgtgacatttatacatacaacacatttatcgacgcaatttgcaagtgtggcaacatagagcttgctatgcaggttctgctggatatggaagcgaaaaagctgaagccaaatgttgttacatacagtaccctgattgatggatactccaagctggagaagtatgaggaggcactcaagttgtacgaaaagatgaagtctttgggaattcgattggaccgagtttgctacaacacagtgctggctatttatgtgaagaccggaaagtatgccgagattgccattgtgtgtgacgagatggaggactctgggattgagaaggatactgtcacttacaattctttgattaatggatatggaaagcagggacgcttggacatcgtctctttcctcgtccaagatatgaggagacgcggggtagctcctagtgtactcacatactcaactttgattgatatctattcaaaggcaggaatgcatggtgatgcatttaatgtctatttagattttaaggaatctggcctaaaggccgatgttgttctgttcagctctttcattgacacattggccaagaatggattggtagagtgggcattatctttgctgaatgatatgaccgagatgggtatcaagcccaatgtggttacgtataacacaataatcgatgcatttggcaagtctaaggtacacgctgaggaggatcctgaagttggggacatgggcattgttggggtttataatggccagatcataagggctgctaatccagtgacaagaggncactctgccattgatgtccggatgaagaggnctcaggnattatatttcaatcnggaantnttttcagaagatggggccaacaaggtgnnanggccaaatgttggtaaanttttctgcga

SEQ ID NO: 20343 - DNA, 729 bp, Triticum aestivum
  unsure (1)..(729): unsure at all n locations
  Clone ID: PAT_TA_20343
tttttttttttttaaaataataatacacttttgtttcagtaaatatcaatctgttccagtaaaagtgtactaatcaaagttgacacgaattttaatttgactagacaatttcacgtcaagaaatcacaataaattggtccggtaacccagcggtcagggccgcacactcaagctgtactcagcatacaagataggaaaagaacattgtcatcagcatcatcaacagaaaacagattgggcaacagctacattttttttaaagagaaatttctctgttttacatcacttggatacatttgggagcaacgtttattatcctggaaaaaaaaatgagatgataaacacatattcatgtgccatgttcaggaacccttcctactgctcagcccaattggacattttcccaagatcctatccatggtaaacaagagaattgcacattagctccctaagtccagttgaagagtttaatcactgcaatacatgtctgggatcgtccaaccaagtcgtgacatgatactaatcagtgaacggtcacccatcgatctcgtgggccatcngaggcctcgcaggtgtaaactcgtgaacacccgaccctggtgcacgatcaccttccctaaggagccccacggnaacaaanacttcccgtcaatattgcngaaacattncaggnaaggttccactnnccttgccgaancaganttncggaagaaancctaggggggaaat

SEQ ID NO: 20344 - DNA, 587 bp, Triticum aestivum
  unsure (1)..(587): unsure at all n locations
  Clone ID: PAT_TA_20344
gtggccatggccatggcagggcgtgcccgaattcctaccccgtagtggctagggtttcggtcgcctccaacccgatccggcgctgctccggtgaatcccgagccctcaagcaccgatccatctcctggatgcgttgatctgctcgaggacgaccatttctttgtcaacctgcaaggacgcgcgccaagtagcaggcaatctcctctccgacgagcccacccatggtgaccaggatggtctccccctcccaaatctagcacggtctcccaaatctccctctgctcctcaagagcacggttctgggggtgcccatcaaggggaccagtcttgggcgaaggccggtggttccttccagcaagatcccgtccgggtgggcgccgcgtcaagcttctcctccccaacgtgtggaggaaggcaaagttgattttctcaagattctgaagaatgccaactccgttttcgccatgcaatgctanggagttgattttctcaagattcggaaaatgcaatccctttttcgcgggcgtgcggggnaaatttnncggtgtnccacttcgttaatggtaaacaacnanccggtgttttgg

SEQ ID NO: 20345 - DNA, 351 bp, Triticum aestivum
  Clone ID: PAT_TA_20345
agttcgacgacgaggtcatctgcccggggtacgagaaggtgatcaaaggcgaagggatgccgatcgccgagcagagaggcgcgcggggcgacctacgggtgaagctcgagatcgtcttcccggagcagctcaccgacgagcagcgtgccggcctcgctgagatcctcaaggtctgcacctgagtgagtctgcaatgttgttgctaggcccagctgtatgtatgagttttcccggccgtgctgttaatacctctccagagggtgtgagtacataaagagatgggtccttgtacatacagttcagtttttctctctctctatatatgatacgtgaggcaacctgtggctggct

SEQ ID NO: 20346 - DNA, 562 bp, Triticum aestivum
  Clone ID: PAT_TA_20346
ggcagcagaagctctcttggactggatagtaatggagttatccatttccatgggaggctctgccgcggcaaccagcctcgtgaatctcaagatggtgaatcacaaatgcaccagggggcttggacctcaacttcagttttcgcatgatgtaccatcttctgcttgtctgatgatatttaacaaagaatgttcaaaacgaatcaaccacaaagtttgcagagcgcttcaggcagtatctccactacaatgtacagaaaatcccacgcggggccggtagcctttaaagattttcatgtgtctgtgcttactgaagaagatggagtgatagagacacagatacgagtaactattagcagtaaaatgacggattctgtctttgagaaagtcttatcaaagcatattgccgcggcacaaccacttccaggatttcggcgactgaaaggagggaaaactccaaatgtaccaaaagaagtcactctgcacttggttgggaccgtcaaaagtgaagagagcagccatgaagaaaatgatcaaccgcgcagtcgctgaatatgttgaaaag

SEQ ID NO: 20347 - DNA, 446 bp, Triticum aestivum
  unsure (1)..(446): unsure at all n locations
  Clone ID: PAT_TA_20347
gtgaacgtggtggaccaggacgggcgggaggaggaggtgcggcgggcgctgccgatgatgcccgtcagggtgctgctcgccgagggcgacgactccacgcgccacgtcatctccgcgctgctccgcaagtgcggctaccacgtttctgcagcttctgatggtgtcaaggcctgggaattactaaaggaaaaatcgttcaaaatagatcttgttctcactgaagttgaacttcctttgatgtctgggttcctcctactctccacgatcatggaacatgacgccgtgcaangaatatccctgtcataatgatgtcttcgaatgatgcagttagcatggttttcaaatgcatggtgaagggcgcaagccgatttccttgtcaagcccgatacgaaaggaatgaagttacngaacttgttggcaacnacgtttggngaaaancactttng

SEQ ID NO: 20348 - DNA, 514 bp, Triticum aestivum
  Clone ID: PAT_TA_20348
ggcctgtttggccacctccaccgttgcggcgcatcctctgacatcttcgtctaggattgtctcaaaaaaagaaaaatcttcgtctaggattaggttaatgcaaaaccgcctccccggagcttccagaacctttcgggaggaggggtgcgatgtggcacgaggcgcggcggtcggagcggaaggtccacgacctcatggacggtgcgcggcgccgggcccagcggcgctacgcctacctcgcccgccgccgcggcgatccgcaccagtccctccaggtctccggcgcccggtgccgcgtccaccgcgacgactcactatatcaggccaccgaagaccagcagggattgataccatggaacgggaaacaagatattctgattgacagatttgatggccgggcactacttgacttcatccgggactctagctctcgggcttttcaaactcaggaaaaatctgaagaagaggagtagctagaggattttgttaattttgaacgttaccgggacttgat

SEQ ID NO: 20349 - DNA, 603 bp, Triticum aestivum
  unsure (1)..(603): unsure at all n locations
  Clone ID: PAT_TA_20349
tcaagctcatccacacaagcacctctcggctctcccggtcgaagcatccgcatcctcatccatggcccccaaggcagccgagaagaagccggtggagaagaccccggcggggaagaagcccaaggcggagaagaaggtgccggcgtccaaggagggcggcggcgacaagaagggcaagaagaaggccaagaagagcgtggagacgtacaagatctacatcttcaaggtgctgaagcaggtgcacccgggacatcggcatctcctccaaggccatgtccatcatgaactccttcatcaacgacatcttcgagaagctggccggcgagtccgccaagctggcgcgctacaacaagaagcccaccatcacgtcccgcgagattcagacctccgtccgcctcgtcctccccggcgagctcgccaagcacgccgtctctganggcacaaggcgtcacaagttcactccgcctgattggccgtctccgtttgtcctcttgatggagtacggtgttccccgtatagttactgtcgtgctcgtctgttgtactgtgccggtggttggttaattctgatcggngaatatattcagtctntaaaaaaaaaaaa

SEQ ID NO: 20350 - DNA, 750 bp, Triticum aestivum
  unsure (1)..(750): unsure at all n locations
  Clone ID: PAT_TA_20350
cggcacgaggcaaagctctacaaggtgatggagctggagatgttgtgtatttccagtctcttgaagaacgaatcattaatatgaagattttgcagggatgtatatatatgatcatgtttcactgggatcctcaactgttccggttcgtatttagcaggatcacatgttgaccaatgactcaaattaattttctcactgatcccgttcactcaagaacttgtgacccagttccaggacaactatggactaagggatggaggttgatttatcagcggttacaggcatgcatgctttatggtggcaagcattatatatcattgaagactttccatttgttcaagttcctgatatgctaatcggaaattggaacgactggtttatgtgggaaactgacgggctaaagctcaaaagctcacacctggatgttttttgtcacaccttcaaaatcgtgtagaagaaacgcttacaaaaagaagaaagagacctggtttgccttccttgctggcgtccttgtcatctccgacccgcccacggggtgctcaaggggttcggcccagtcggatgcacggcggtgcgcgcagctgaggagcactggcagcagggcttcccgtccccccgccccccctcgccgcgcctcccccgcccatcctcccccgcccccccggctcacgcctgcacctgccgggggccaccacccccgcgccctcacggcgcgcggccccctctccggtnacgctntcgancagtact

SEQ ID NO: 20351 - DNA, 985 bp, Triticum aestivum
  Clone ID: PAT_TA_20351
gatacggctacttggctacttgtgttctgtgtgatgcatttctctttattttgagatggcagatgagtatgatcgcagcagctacggaaggtcaggcacaggcagtgacgaaggcgggtacaacaagaccagcgaggaagactatggccgcagcagcgatgaatacggccatggtaccggcggcttcaacaaatccagcaacgacaacaatgatggtgcgtacaagaacaccaacacggacgactacagtagcagtggcggctacaacaagtccagcactgacaatttcactggcggcttgaataaatctagccctgatgactacactggcggtggcagctacaacaaaactggtgccgacgactacagtgccggtggcgactacaacaagtccagcaccgacgatttcagtggcggccacaacaagtctagcacggacgactatgatggtggctacaagaactccagcgccgatgccggctatggcgaaggcggttacaagaaacccaagcaccgaggactcccccgcgtacaacaaatcaagcatcgaggaggactacagcagcggcaagaacacccccaatactgatgactatgacggcagtggctcaaacaagtccagcactgatgtggctacaagaagcccggcgccgacgagtacagtggtggctacagcaagcccggcgccgatgggtatgccactggagcaggcaacaccggctctgatgattactagacaaaaatcgtcgtgaaagtgagtgtgtttgcgatgctaaatacgtatgcatgtgtggttgctactgctactcgcccttgctaaatgatttagcatttgtattcttactattttctttatggtggggttcgtttatatgtatactgtgatgtgatcccatcatagagccgcggctgttgagatgagtgtgtatatatatgtagcagtcttgatgatgaatgtgagatttgtctagatacatataatcct

SEQ ID NO: 20352 - DNA, 446 bp, Triticum aestivum
  Clone ID: PAT_TA_20352
aacatagcaaagaaaagagactgaaattcaaaacaagccaccgtgtcttccctcgttcatccgccgaaaacctcgctccccgggggattatggaggcgtagggctcgggatccaccggagcaatcaagcttggattgggaggacggccagggatgtcggggcccgtcgaccggtccgggaggcccggtgcaggttttgagggcttcactcatgatgatgagaatgaagagagcaaatccgatgaagataactccgaaggtgacaacaaggccaaaaaggggtccttcaagaaaagagcgattagtgccggaaataaatttaggcgttccttgaggaggaagagcaaaaagaagagtggcaatctagcctcaatagaggatataagggatgtgcaagagctggaaactgtggaaagatggcgacaatgctaacttgatgggggctgg

SEQ ID NO: 20353 - DNA, 737 bp, Triticum aestivum
  unsure (1)..(737): unsure at all n locations
  Clone ID: PAT_TA_20353
gctagccggtgctgcacatgtctaacactatggctccgaaaaactcagctatcttcctccttgggcttcttctctcatgcgtggccatgagtagtgcggcgagaatccttgaggaggccgttccgtcccaggaggagcaccagcccgaggggccacagattcccaaggttggggctcccaccgttcccgggaagtccccctcccccctaaccccgacttccccaaggggaagctccccccggccccggggggcccccggcctcctaaccttgacctccccaggggggagcgccccccggcccctgaggtgctcctcacccctaacccgaattgcccaaggtggaactaccgctggcccggaggtaacctgccccccccagccggaatgcccaaagtggcctccccactttcccggagtcacctgccacccaaccccaactgcccaaggcggcctgccaccgaacccgacatcccgtgtccccgtttccattccccaaagtcggcaacccccacgtcgtctcctctcgttatttcgctcgttcnacttgcttgtcatgtcctcctggggcgtcgccccgtcgtttgtccccgggctcttaatgtagtacatggtcataccttaacccctttcnaaaaaagggggccgtaccantcnccaanatcttacccnnaaggcgttttaactcgangaaaccggtnccaataancttaaaacccttccatggaaanaaggccnc

SEQ ID NO: 20354 - DNA, 727 bp, Triticum aestivum
  unsure (1)..(727): unsure at all n locations
  Clone ID: PAT_TA_20354
attgtggtttatcaggaatcctctcttttcatgggactatcttatgcaatatcatcagtatccatctttgatgagtatacaaatgatgtacttgacatggcaccaggatcttgctttcctaggtttgtataccagaagaatgaagcttccgtggaaagtacccgtggcccgctgtcaaggcccgcctcattcagggataagcaagatggaaagaaagctccagcacgggttacatcatttaagagtagctttgatgagttcaatccatttaagttgctagatcacctattcgaagagtgtcaccaccgtggcgaggctctggtcgctgaaggagtgataacaccgaaagatatcgaagaaacaaagtcaggcaaaggcggcagcggagtgcttaatgtgggtttgccagcatatgttattctcaatgcaccctacgatctgcaaaggctgattccgatggcctgatcctgagagatggctggtgaaatcacatctgacaacaggcctaagaatacactatttgattgggtcnttgacctcctgatggcacaaagtcaatcaaancgagaatttacagaagaggaggagngtacttcanaaaccgtacgttgataacgaccgaagccctcaaggcaccttcgcattgcatcctgaatgagnaaacaacagaatagatcattgcccgaaatnanggatacaatcatanaggacccantcaaccccttca

SEQ ID NO: 20355 - DNA, 517 bp, Triticum aestivum
  Clone ID: PAT_TA_20355
cgggaacattcacccaacgaagctcagagacctctgttgagcgctccatcgaacaagcctcgccgcccctgttggctgttgccattcgccgcgaccggcgccggccatgggtctggcgatgggcaagctgatgctggggaagatcatcgtggagacgcccaagcacgaggtgctccacgccggcgacggctacgagatccgcaagtacccgccgtgcgtcgccgccgaggtgacctacgaccccaaggagatgaaaggcgaccgcgacggcgggttccaggtcctcgccaactacatcggcgccttcggcaagccgcagaacaccaagccggaggccatcgccatgacggcgccggtcatcacctcctccggcggtggcggcgaggccgagccgatcgccatgacggcgcccgtgatcacctcctctgagccggagccggtggcgatgacggtgccggtcctcacggccgagggccgcgaggagcacgcgggcaaggtgacgatgcagttcctgctg

SEQ ID NO: 20356 - DNA, 1031 bp, Triticum aestivum
  unsure (1)..(1031): unsure at all n locations
  Clone ID: PAT_TA_20356
agaaggcggagggccccagggccccgcggccgcggcacggggatccagtaacccaaccccccctgctctgccgtccgacgaacaagcctccccgcgcgccacgccgcaccaaggtctggcgtgttgcccgttaagggttgatcaggccaccttatgtatgccgatgccgtgtgctatgcattccattggcgggtacgtatttcggattcaccttaaagctgggcacgtcacgtgtacggttaagcacaaggaaatgaagggcgaccgcgacggcgggttccaggtcctcgccaactacatcggcgccttcggcaagccgcagaacaccaagccggaggccatcgccatgacggcgccggtcatcacctcctccggcggcggcgaggccgagccgatcgccatgacggcgccggtgatcacctcctccgagcccgagccggtggccatgacggtgccggtcctcacggccgagggccgggaggagcaggcgggcaaggtgacgatgcagttcctgctgccgtccaagtacgccaaggcggaggaggccccgcggccgacggaccggggggtggtgctgcgggaggtgggggagcgcaagtacgcggtggtgacgttcagcggtctggccggagacaaggtggtggccgagaaggcggaggggctcaaggccgcgctgcagaaggacgggcacgccgtcacgggccccttcgtgctctcccgctacaacccgccgtggacgctcccgccgctgcgcaccaacgaggtcatgttccccgtcgggtcgtccgtccgcccgcccgcccgcctgatgttggctgctaccgtctgcgtgcttctctttcgcttgcttgccgctcctccctttcgttgcacctggcgcgtcacgtgttgggttcgttggcacaataaatagttgaataatctgntgaatatatttttaacaaaaaaaanaaaaactcgagactagttcacctcggcccgcgaccacgctaatccaaattccccgcgggcccgccaatggcgggccggga

SEQ ID NO: 20357 - DNA, 598 bp, Triticum aestivum
  Clone ID: PAT_TA_20357
ccagcctccggtgacccgcgccgccgcctggagcagcgctctacagccgtcccaggaaaaatggccgagcatctctttgaggacatcttcaacgtgaccaggatcgatcctgatgggaagaagtcgacagagttattcgcattgaggctaaaagcgagcagttggaaatgtacatgcaattagatgtcgctactgatgtctacccaatgcatgttggtgacaagttcaccatggttttagctcctacactgaatctggatgggactccagacactggcttctatacacaggctggtaggaaaacacttgctgacaagtatgactatgttatgcatggaaagctttacaagatttcagaggacatttccagtgaaaaagaagctactaaagtgtatgacttctctgaactctagattagtgattttgtatgggtttctaatcttgcaggatttgatttatgctatatatttgagtaatatatgatttaatgtgagattgatttcttaccttcatatagccgaggaagaatttgctctataaccatgttgctgaagctctttagtttgagagtaaataatgattctctgatttgcccttc

SEQ ID NO: 20358 - DNA, 899 bp, Triticum aestivum
  Clone ID: PAT_TA_20358
cggacgcgtgagcccctacgttgcccccatcgcctccgctcctcgcagcgcaacccaccccgatccgcgccggcccctccccgggccggctcctccccgtcgcttcaggaaaaattgccgagaacctcttcggggacatctacccacgtgcccatgacaagaagttcgacagagttagatcgcattgaggctagaagtgagcagttggagaagtacatgcaattagatatcgctaccgatgtctacccaatgcatatgggtgacaagttcagccatggttttagctccgacactgaatctggacgggactccagacactggcctactatacacaggctggcaggaaaacacttgctgacaagtatgactatgtcatgcatggaaaagctttacaagatttcagaggacaattccagcaaggataaaggacctactaaagtggagatctatgcatcttttggcggcctcctgatgttgctcaaaggtgatccttcaagtgctgctaacctcgagctggatcaaaagctgttcctcctcatccgaaaggtgtaaacgtgtcatctaccatgataaccagcgcttgtagttcactcaaggctataaccaagcctgtgattgtttggaggctaatcgtcctacacccttatgtactcttttggcggtaatacgactctagattggtaccatggcttctctgtagcaccagtcgcttattcctgttcccctggagcgcattatgcgtgttactaacggagggcatcgttgttccgcgtattatattgtcgatgttccgggtaaattacgatgctgcgtgaatgttatctttggtaataattattatcactgtgtgaatgtgatgctggtggtccggttctactgcaaaaaaaaaaaaaaaaaaa

SEQ ID NO: 20359 - DNA, 759 bp, Triticum aestivum
  Clone ID: PAT_TA_20359
ccggaagcttgaaagtttcttttgtagaccttggaactgaatgcaaaaacaggcgtttttgttggcatatgacagcagttttcgtggggttgatggggattcccgatcccctgaaaagagaggccgcttgtagtcgtggaaggactgaagaagatgggcattcatccagtgatgctcacaggtgacaactggaggactgcacaagctgtcgcgaaagaggttggcattgaggatgtgagagcagaggtcatgcctgccgggaaagccgacgtggtccggtcgctccagaaggacgggagcatagtggccatggtcggggacggcatcaacgactccccggccctcgcggcggcggacgtcgggatggccatcgggggcggcacggacatcgccatcgaggcggccgactacgtgctggtgaggaacaacctggaggacgtgctcacggccatcgacctctcgaggaagaccttcaaccggatccgctggaactacttcttcgccatggcgtacaacgtggtggccataccggtggccgccggcgcgctgttcccgctgacggggctccagatgccgccgtggctggccggcgcgtgcatggccttctcgtctgtgagcgtggtgtgctcctccgctgctgctgcggagatacagaaaacccagctcacaccgtgctgcagataactgtagagtagattaatggatggtgttgtgaatactgtaactgtaatccccttcacattttacagaaatgaaatg

SEQ ID NO: 20360 - DNA, 681 bp, Triticum aestivum
  unsure (1)..(681): unsure at all n locations
  Clone ID: PAT_TA_20360
cgcgaaatgctgttgtccgtgtccatgatggcggagctaggttttcgtgcgaatgtgggctcttcgagcacatggggatgctttgttgccatgcaatcaaggtcctaattcaccttggggtgcggaaaatacccagtttccatgtcctcaagaggtggacagtagatgtccgcgaaaatttgccactacacttcctgcattaccaaaaggatcaagggcctccgcggttatcctcctacaggcatacagcactacacctgaccgctctcgagtttgtgcagctgggggatagcaacgtggatgcattcgacagagcaatggacatactgatcgcaggcaacgcggaattaactgttttgggcagcgatcaaaggacggcaaaagtttggtgggaccaaactcaaattggggattcagcaantccaactcaaggatatgggagcagnttactcgcacccagacacatgtgtcccaaatgtcactcaaccgagtgtggcttaatccgtttcaagggaactggtcaanctctcactgcaacttgctcnccgataggaanaacanaaggtagcaacacnctagaacanctgatatagtcaagacncccgtcaggtttgtantcgtagganaaggcaaaaacacacttccccgagggtntntccanaacncgaanacaccncgaat

SEQ ID NO: 20361 - DNA, 779 bp, Triticum aestivum
  Clone ID: PAT_TA_20361
cccacgcgtccgcacccggctcacctctgcatttctagctacgctactcgcgggcatggccaccgttctttttgcctcggccgccgacggcgtgggcacgcaggacgcccccaaacatctccacttctacatgcacgacgcctacactggccccaaacccaccactgttctaatcgtcaacgggaccggccagccgctgaagggctccggcggcggcgcccggttcggtgacacggtggtcatggacgaccgcctcaccgagggccctacgctggcctcgagagtcgtcgggcgtgcccagggattctacgtgacagcgtcccagggcgaccccgcgatgctcgtcgccatgaacgtgctgctcgccgccgggccttacaacgggagctcgctgaccgtgatgggccgcaacaacatcgcgatgccggagcgggagctgacggtggttggcgggaccggggtttccaggatggccaccgggtacgtgctctggaaaactgcgagctggaccgggaggaacgccgtcctcgagctggatgccttcgtctacgtgagtccggcggccgccggtgcatgaagatgaacgaacacatggtttgcaggggttttctgtttgttgggaataacatgctcgttgccatcggcatgtgtggagtttgtgtcctactgtacttgacttcgctgtgttgaactcagtcattgtcacctttgctttctttgagtcagccctactgtacccaactgtgctgaaatcaatcttgtcactttcaaaaaaaaaa

SEQ ID NO: 20362 - DNA, 746 bp, Triticum aestivum
  unsure (1)..(746): unsure at all n locations
  Clone ID: PAT_TA_20362
gatagataagtgtttgaagggcataaacatacatcacatcctagaacccgaatgctcttctgaatacaatggaaattcagatagtggcaggacgctgtttgactatggtggtgcagagcttggcttgtctgatatttcttcagagtgcagagagaaaggatatagcatgtccggcatctgggcaaacaacaggtcagtgagagaggctctgggtgttcacaagggaacggttcctttgtggctaaggtgcaaccacggcacgccatacaccaccgacatcaggagcatcgtggagtatcaccggagcgtgaccagcagaggctaccggagcctgatctacagcggtgaccacgacatgaccgtgcctttcatcagcacccaggcgtggttccgctccctccggcttcgccgtccgtcgatgagtggaggcccgggtatgccaccggccagttgctgggttacaacgtttgtacgctaataactcacttttgcgacatccaagggtggtggcacactgctccaagatacatgccccaaggaatgcttggcatggtccataatgtctcccgcgtccggccctcccccccgcctcacgccccctcttcctcctcgcgctgcttgagttcttcacccttgcactccttcctcccgttaccactgcataacatgtctttccttacgctcatggatatacccgggccgtctctccccgacatacccangtnttaantngaacngtcntacnt

SEQ ID NO: 20363 - DNA, 944 bp, Triticum aestivum
  Clone ID: PAT_TA_20363
gtcaccaacaacacaggaaaattaattatgtggacagagaaggcagagccctcgagagccgtatataaaccgacatccgcggccgaggagttgtgatccacctccaacctccaattcctctgtgatcacttgcttggatgtgctgtgtcagttacagtgacccgtctcctcctcttcccgccgaggagaagagtaaagaggaggagcagcggtgcagcgcagccatggaggtggatgcagaggcctcctacagctatggcttcctcccccaaggcaggcaccagccctattatgctccacctcctcctccgccagaagatggtgaactgtgggagtacttcccttgccctttctgctacatcgaggtcgaaatgcccttcatctgcagccatctgcaggaggaacactgcttcgacaccagaaatgctgtttgcccgatatgcgccgagaatctggggaaggacatgtccgcgcatttcagattccaacactcccatcttctcaagaggaggaagccttcgaggcccagcagctcaccatggccagcagcggcatcgccacctgcatatgaagtgaacccctacatgatgagcagcaggccatgccaggaccctgagcctgaccccctgctctcccagttcatctgcggcagcggagaccaaaccgaaaccgagccgggatcgcgcgacaaaaaaagccagcgccaccgcccgagcagcggtcatccggcagcaggtgtccagaggcctgttagccagctggagctggaggagaggctgcagaggatcgagttcctcagggagatcatcacatcaaccattctttagttaactataagctctaattgtgttgctgtctagggtttcttgagcagttctaagcctgtgcaaaatggtccagatgtactatataaccttggctatccatctaccaaaacagcattt

SEQ ID NO: 20364 - DNA, 1728 bp, Triticum aestivum
  unsure (1)..(1728): unsure at all n locations
  Clone ID: PAT_TA_20364
cggccgcccagtccacactcctgcgcctcgagcgcgactcgcctcagcgctcagctcagatcgccgcaccaatcctcggcgaaggagcttttcgtgtgatatttgcggtatgtgctgcgcaatcttcgtttacacgctgtggtgaagcaccaaatttgtgcttgctgtgcttataatagacagagaaaatcccaacggtttcctcgggccaccgaagcttccgatttcgtctgttggagatatctttgagccaaaaactcttcagatatcttggaatacctacaatggcagcaacataccctatgcctgatccaccggtgctgaacaactatgctattactcaaagattcgacaactctgctacagagacagccggcagagacaagtccataggctacctggacatctttgtccaccaggcgcgcgacatccacaatgtttgcatctaccagaagcaggacgtttatgcaaagctgagcctcacaagcgacccacaggtgtcgtgctcgaccaaggtgatcaatgggggtggccagaacccgttgttcgacgagggtctacggctagacgtgcgcagcgtggaggcatcgctgaggtgcgaggtgtggatgctgagcagggtgaggaactacctggaggaccagcttctcggcttcaccctcgttcctctgtcagacatccttctggccgatggaaatctggcccaggagttctccatgtcgtcctccgacctgctccactcgccggccggttttgtgcgcctgtccctgtcttatgtcggtagctctccggacgtcatcgagatctcatcgctcaataaatcggcgtcggcggtcaccgactgtggaaatggcagcctggatccttgtgagatcgaaaagatggagttcccagacctgaacatggtgaacgagaatgaaatgatggtctccaagtatttcgagatggactgtgacagtgcagcaaaggctgagacctgcaagttaccacagcatgatgcagatgagcctggtcctgaggtctctaagatcactcccaaggagtatcctgacgaaagccctgtgagctgtgtctcgaccacaggctcctccccggagctgtcccccatgacgcaatcggtctctgagccgtccgagaccgccgtcgcggcggcatcctccaccggaagccagagggagaagagccagggtgtcactacgggatggcgaggccgattcttctgaggcgccatccaaggatgaggttgcccagcctgcagtgatcagcgtgaacctccagcccagggaatcggttgtccagcaggacatagttgacatgtacatgaagagcatgcagcagttcactgactcccttgcgaagatgaagctcccgctggatgtcgagaacggtagtccctcggctgataacatcgactcgagtgcaacagagaagccgttgccatcgccgtcgtcgaagggtcctagggtcttctatggaagcagagccttcttctaagttactgctgctagctaggctggctcatacatactctgcttgcctcactaaggaggctagactctcactgtaaacttgtattgctaatggtgttatgcttagtttaaaaagatggatatttcataataattccagagctgtagattcagcttgtgtaacatagtatactactgcatgtagttaaaaaagaggtacttccttctttcctgggctggccttgcggcttgtgtgcnn

SEQ ID NO: 20365 - DNA, 588 bp, Triticum aestivum
  unsure (1)..(588): unsure at all n locations
  Clone ID: PAT_TA_20365
ggggccccaangcgacggncttctcaagttcaaggctgttcgcttggganaggaatcatgggttcggtttctacagcgcagcgactgggagatactcataatggacgccatccttgacgttcgcgccgaagatggcaagcgccagacaatgagggtgacggtcgcagacaacacggcagctccaccaccaccagctgactgcaggacatgcaaggccccgggcaacgccgacaccagaaccgaagcctacaccattgccgacgccgctgcctacatcggcgccacctccggctcagganaagtgacgtgctcanctgganagatgctctttggtgggtgctctggacatagctagcgtggagtgattgtttcgccacgccccattcctgtgagagaaatanataatgcgcactggaccaactantcanaagatcngactggtttcncgtacnttgggccggtgatacanctaaaacangttaacggtgttgttcncgnnctggcatactcgaaatacgtcttctacatactaaaatgcctggactcaacaggcacaattgntggtncaaatcttgtggtcacagaaat

SEQ ID NO: 20366 - DNA, 520 bp, Triticum aestivum
  unsure (1)..(520): unsure at all n locations
  Clone ID: PAT_TA_20366
ccgcgccctggcctcgccttggcgggcctgggcttcgccgctcccttgccgcgccctggcgctcctcggccgcgtcgaccgaagcccggccgcagggcctcctccgccgcgtccacctttgctaagcccctccgcggccttcgggctgcgcacctttcctacggcggccagcttcgtggggccttgctccggccatgcatgcctgactccagcttccctggtcttgtcgcgcctcctccccccctctcgccaacctcccgttgctgggcgtgccttccccccccttctggccaagctcttcttgaagtggatcattggccacctcgactggctcgcgcggctcgaaatggctctgcgcacagctggtcctcctcctgcggctcggacgtgcacgctccgcacacatcttgcgcatacggcttccgaggcccgcatgctcatgtcacgttcgggggcacccccggttcatcggcaccaccgcatcatcgctttgggtgcgtcccctggtggatnggttaaa

SEQ ID NO: 20367 - DNA, 1072 bp, Triticum aestivum
  Clone ID: PAT_TA_20367
ctgtcctcccccgccctctccccccgggttataatctgcttcaccccgctgctgctgcttatgaggtctcgatcagccaggacctttctcggtcgaaacgacccaccaggttataagactgctgatggccctagctgctgcttattaggtctaggtcgaggcggccacggcctcctcggacctcgctcaagggtagggactcgagcccgggccaggcagccccagggcccgcgtcgggtgggtgtggagacgagcacggccaccaaggacatcgccgaggaaaaggccattgtgcccgtgcccgacaactccgaggccatcgtcgccgtcgtcaaggatgctgaaggtacaagaggttcatctgaaagagatgcttatctcaccaagattatgtctgagaagagaacaacgctgatcaacgcctgggaaggagagcgagaaggcgagagccgagaacagggctgccaagaatctgtccttcatcacttcatgggagcacgccaaggaggcggagatggaggccgagctgaaaaagatcgaggagcaactggaaaagaagaaagcggcgtacaaggagaagctgaagaacaagctcgcgatgctccacaagtcggctgaggagaagagagcgatggcagaggcgaagcggggcgaggagataatcatggcagaggagatggccgccaagtaccgcgccaaaggcgaggcccccacgaagctcttcgggctcctgaaagcatgatgaccgtgtatcgaggaaggcatcgacactcttgatctacagagcgtacatatgttgggattgttacttacagatttcgtgcatgacttgttagtggtgtgtgcgtgtacatggttgtgttctggaagccattggtgtgtgtgtgtgtgtgttttgctgttgggaggtttggtatctggttaaatttgtaagggagctgtgtataagcgtaggagtgcaggcctgatggattgatacatttattcttttgatgtaagttttgttcgtcgaagcatctgttagtgtgtagtatttaataaatacagtcttatttgccccaaaaaaaaaaaa

SEQ ID NO: 20368 - DNA, 1152 bp, Triticum aestivum
  unsure (1)..(1152): unsure at all n locations
  Clone ID: PAT_TA_20368
gtcatgtgtgattgtcatattgttactgcaaacaagcgaccagatgtgctgaaaataatagaccgaccatatnngtgactgaaaactattttatgtctgaaagaaagttgcaaatctatttttgacggttaagtacgcaaatttggactgagggcatattaacatgtttgttgtaagcgttctccatccatcttagaacctattaatggtactcttggccttattgatagctgatccaatggaaagaagtcggaatagcaaacttagccggcgtgatcagcttggcggctggtctgctgatgtgggtgacatcgcttcacccggtacggaagaggttcttcgagctcttcttctacacccaccagctctacgtggttttcgtggtgttcttggtgctccacgtcggcgacttcgtcttcagcatctcggccggcgctgtcttcctcttcatgctcgaccgcttcctgaggttctggcaatcgaggaccaaagtcgacatcgtttctgcggcctgccggccatgcggaacggtggagctagtcttctcaaagccaccaagtcttcggtacaatgctctcagtttcatctttgttcaagtgcgtgagctgtcgttcttgcagtggcacccgttcagcgtgtcctccagccctatggatgggaggtaccacatgtcgatcctcataaaggttcttggcacatggactgatacgctgaagcgcatcatcgccgatgtccaagagcagaagaccaggagcgactctgactctgatcagtcgcaaactggtcgcattaccgcctccatcgaagggccgtatgggcacgaatcaccctaccacctgatgtatgagaatctcatcctggtggcaggaggcattggcatttcgccattcttggcaattttgagcgatattatccacaggatcgggcaaggtatgccatgcgcgcccaagaatgtactggttctgtggtcagttaagaagacctcggagctttctctcctgttggccgtcgatgctcagtccatcagctcatccgtctgtgacaagttgcatctggacatccaagcctttgtgacgcaggaatccgatcctccactggaagatggcattgttggggatgaccagaaagcccccggcatattcgtcaagaacg

SEQ ID NO: 20369 - DNA, 775 bp, Triticum aestivum
  Clone ID: PAT_TA_20369
aagtgccgtatgacactgccgtgtttatcataacctctgtggttttgtctgggatggtattacccaattgcaccggcttgattcagctgtgtgcttgattttaaacgaggatttctgcaatgctttcttctctttatcgtaactagattatattgtcagtattttgttgattttgcttgggcccgatgccacgtctccattagcgacatgccttgactggagatgctacattgtgccaagagagagttcttggacttttcacatttgataggaacctgtggctgtgattcagtcggtacacagagccgttttttgtgattacacttcttgactgcatagccatagcataatatttgttgtagttgttttgaaatttggggaactcaaatggcgatgatgataaaactttggcttgtttctcaaaacattcgcagttgccgcctaagagctttcgccctgccaggcttgagagctaatgctgctaattccttccttggatgtctgagccatgttgatattacccatttgaatctttttttctctctgctttatcttcttgatttaacaggatattttgttgttatacttgctttgcatacttaacaataatatgtttttgctgtacttcttttaattgggtgaaatcagtggcgatgactccttccttggatgtctgagccatgttaatttaccttatttaatgttcttttttggtgtctgacttaatgatgttggttttaatctgatatatttgtaccaagccctgtttggaatg

SEQ ID NO: 20370 - DNA, 614 bp, Triticum aestivum
  unsure (1)..(614): unsure at all n locations
  Clone ID: PAT_TA_20370
tggcaggtgggggcttcttgtgaagaaggtgaaggctgtcagcgtcatgtcttctctcggcaagagaagcccgcctccgtgccagtgctgagcgaatggatcccctctctagggttgtgcttcaagtgcggcgagcggtgggggcgtaatcacacgtgctctaccacggttcagctccatgtcgcggagtagctgctgcagctcttcggcatcgacgtggtgttcggcgaccagccagccgccattgcccacagccgctgtctacgacacggggatggccatctccggtcaagctctcaccggcggtgtctcaccgcatgcatttcaattgcgcgcgtggttgcaaggccacgagatgacatgctgctgggattcggccagctccactctttcgtcgatnaacattcactgccaagcttgtgggtaccgtccctctgcttcaatccgggcgcatcaaattgcaagcggaggatagatcacatttacccagttagaacgtttccctataatttagaggaggatagaccgagtactttanatgacatattgccttcacacaaaaaaaagatagcatatttgcacttaaagaactgcattcattcaaaaaaaaaaaa

SEQ ID NO: 20371 - DNA, 549 bp, Triticum aestivum
  Clone ID: PAT_TA_20371
atcgtacaagtgggttagctttgcttccagtaagcgcaaaagataaaagtgacaggatgaaggaagagctccacaagccccccacgcgtccgctgatattttcatcacacatgatctttactcttgtgttcgtgcgtacataccataaatatggatcaaaaaggttgattaagctatttgcttggttgatggccatcatccaaagtcttcttatcattgcttctcgcgcccactacactgtggacgttggatcagcttggtatactatcaatttggttgtattctttgttgacaagaacctcccagaaatgccggatcgtacaagtgggttatctttgcttccagtaagcacaaaagataaaagtgacaggatgaaggaagagctccacaagcccgagaaggataacaaaatgaaggacgaacaccataagttattgaatggaaacaacgttgattctactgatcggcgacaatggatgccgatgaacggaaagcatggggaagacatgaaccacacgctctctgatgccgcacccaacggtacatgat

SEQ ID NO: 20372 - DNA, 1338 bp, Triticum aestivum
  Clone ID: PAT_TA_20372
gacctaccggaccctcaattccaaggtgggaaaccgcacgccgttgtccgtcgtccgcctgggcacatctgcgcccagccccgcgcccggccgtcgcccggggaagttgaacctccgtggcgaaggccttgaccgccaagaccgtcaccgccgggaggaactcttctgggcgaatcacttcttttcaccgagggggttggatccaagcgatcgcttagggacattgacctcaaaaggaacacttgctcggttggcattgtggaaaggattgagtatgaccctaaccgttcttctcggatcgctcttctccgatggatcgaaggggtaccacagaaggatccagcatacaaggccgagcgtgcacctgtcaattacataatagccagccatcaaatggaaccgggcagcatggtggtgaacagcgactcctccaaaccctccacgaccggctccttgatgcggcctgcccacaatgccaattccatccttcggttccaagagctgttccgcaaagccagccaagaaggcgaagagggcactgatgatcaagcaaaggatgcggcggttcctgcagcagcaccgctcatgccagccgatctactggacctcaattccaaggtgggaaactgcatgccgttgtccgacatccgcatgggaacatgggtgcacagcatcgaactgcgtcatggccagggggcgaagctcgtccgggccgctggagcctacgccaaggtggtcaaggagtcagccacgcagtgccttgtgcgtctgccgtcgggcgtcgagaagctgatagactcccgctgccgggccaccatcggcatcgtctccaaccccacccacggcgcgcggaagctgaggaaggcggggcacagccggtggctgggcaggcgcccggtcgtccgtggtgtcgcgatgaacccggtggaccatccccatggaggaggcgaggggcgcaccaagggcggcaggccctcggtgtcgccctgggggaagcccaccaaggctgggtaccggaccgtgcccaagaagccaaaagctcagttgtcccgtgattgattgatgatcttcatggaagccgtcagttgctgctccaaggcaaggtagtaggcaggatcttgatgtggctatggatcgatcacaaaggactatgactcgttttttccctttttgtttgcgagcagtttccgctgcagcactttgactttattatgtattaataataagcaggtgatgtttggacctgcctgcgcccagtttactgcattccttcctggcattttgacattaacttgtttaggcatgtttcttgtgattgataaaaaaaaaaaaaaaaaa

SEQ ID NO: 20373 - DNA, 828 bp, Triticum aestivum
  unsure (1)..(828): unsure at all n locations
  Clone ID: PAT_TA_20373
cgccgccaccctccctggatagcgttgtcgtcgccgccaccctcctggttcgcgcctccgccgcctccctccctggatcacagcgccgctgcccaccacttccacgacacgcctccaccgccacccaccccgtccccgacgcgcctgcagccttccggacggatccggtcgaggccggcgagatccacgcggccgaccacaagttctgccctatcccacgacatccatccatcgacatcgactgatctgaacaaaatcagtccatcgccacccgcgcacggcttggattctgcacgtcgccgccatgagatgcagtctactagctcacctccgccaccatgcctcctcacctctgccatcgacggtcgccactgtgctcgaggtctcctgtacatgccatggcctgggagccccaaccccttatgctaccggatcctggggtcgccgctggacccgtcgccgtcagcctccccgaccttctctgggttgcctgggacaggactgcccttgccattgagcgcgaccagtgcctgtatttcgtccacgaccaaccctctgcgctcctcttccggcccccgccgtgcataacagtacggtcaaagaaagangcaggtccacacgtgcctgcaaaatgcacttccnatctcgtctcctcggagcanaancgcgctgccgtagtgcttggcaanacgacgaacantctcctctcacacangaantcgtactangccagagtcatcacgctccgtnagaancatantcaaattcgtcanaatttcctttanacaaaatngtttaacgccgcggtggngttgttnaaacatggaa

SEQ ID NO: 20374 - DNA, 660 bp, Triticum aestivum
  unsure (1)..(660): unsure at all n locations
  Clone ID: PAT_TA_20374
gtcaccgtcgtcgagggtgagcacaaggtcccgctcttgcaagcccactcccattcccacgcgcagtcgcatggtcacgagctggtgcaaccacaaggacgcgagggggaggtgtcagaccacgtgcgctccgtcgtggtatcacagatactggaaatggggattgtgtcgcactcggtgatcattgggctgtcgcttggggtgtctcggagcccctgcacaatcaggccactggtggcagcgctctcattccaccagttcttcgaggggtttgccctcggtgggtgcattgcgcaggctcagtttaagaacctttcggcagtcatgatggcgtccttttttgccattacaacaccaactgggtacccccgctggggccggctgtcctcatttttacaacgccaataccccggggctcctggccaccaacctcgcccgggtccgcgtcggccggataccgtgctcgtggcccgccgcctttctcccggccattctgggcccgcgaacactgggcccatggcccctggccgcgtcgcccctttcccaagtcccccattaacnctgcaattgggctaacgttaacaatgagtacggacaccctagtccaantacgctgtaaaatgtcatacnatgatgtccntgtcactattcaanaacaca

SEQ ID NO: 20375 - DNA, 700 bp, Triticum aestivum
  unsure (1)..(700): unsure at all n locations
  Clone ID: PAT_TA_20375
tttcagttggcttggatatcgcacacggcatggggtacgtccactcgcaaggaatcgtacatcgtgacgtgaagccggagaacatcatatttgacggggattgcgccaagattgttgattttggaatagcctgcgaagaagcatattgtgatcctctggcgaacgatcctgggactttcagatggatggctccagagatgatgaagcacaaaccctatggtcgaaaggttgatgtttacagcttcggccttatcttgtggggaaatgcttaccggctccctgccttaatgaagattttgactcccgtcccaaccagcctttgctgttttttgacaagaatgttgaggccggccatccctgctacctgcccagctgcattacggntcctgatccgacagtgttgggcttgccaagcaagataaaagcctgaatcccgggaaatattcaattactgggacaattcaaagatggtccttgaaaganatgggacacttgacaatatccaaactcaaactgccaaggagaacatgatcccaaagaaatggctaaccactggcccacaagctcaaccaccccatcacatcatgatcccccggctccccccaaccatcctccgtcctcccctcatcgtcagccagtagcctaaagtatacaaattccttggaaaaaaaaatccaaacacgggtaccgngattcagga

SEQ ID NO: 20376 - DNA, 897 bp, Triticum aestivum
  Clone ID: PAT_TA_20376
ccacgcgtccggatgaccctgaggatgaggggtttgacataggaaatgggaatgacgaaagaattggtgcagctgaagcaaagtcttttaagttgcttaatgaactgagtgatctcctgatgaccccgaaggacatgcttattgaaaaatccatcaggaaagagatctgcccttcggtcgggcttccacttggccccacggcccgctccgacctccccccccccgcggcctgccccgatcctgtccctagcatagtcttagaggagctgaagtctgagagcttgctggagcgtcacaccgcaaaacacgcgatcagcgcattcccgtgcatcgctgctcctatcgcgtaccgcaccccttcccaactggatgtggaggagaaagtgtcggtagtcggaggcagcgcaaagctggacaggagagcctcaatggtccagaggagagggtacaccagcgacgacgatctagatgacctggactcccccctcgcgtccctgttcgacaagagcgccccaccttcgccgtcaaacggcaccacgcctttcactgctcagcagagaggagcttccatggagaacgcgaggtttgagctcctgagggaggtatggctggagcggcgcggcagtgatccggtgaacttgtgaagatcacctctatagttactccttatattacataaaaagaaaaaagggttgggaaaccctggagaggtgaaaaccgcgaaagaagttgcttttgcagcagaactagggccccttgtatgatatctttgtacatctctatatatatgttgtttcttttttctgtagtagtgtataggacataaaggacagcactatggccccctgggggctaaaaagatttggtctatgtcctttgccgattaaaaaaaaaaaa

SEQ ID NO: 20377 - DNA, 390 bp, Triticum aestivum
  Clone ID: PAT_TA_20377
gtataagaagcacaagacgcgcggtagaatttgtccccacgcgtccgattgctttcgatcttgactcgcgagatcaagccggaaagtgtggtgcacgcgcacagagggttatggcggaggaagataaggcgcccagcgacgcaatgtcgacggtggcggaggaggcgccggtgacggccgagcggccggtccgggcagacctggagccacaccttcccaagccctacttggctcgagctctggtcgtgccggatgtgtaccatcctgaaggagagagcggggaggggcacgagcacggacagaagagcgtgctgcagcagcatgtggccttcttcgatctggatggcgacggcatcgtctatccctgggaaacttaccgaggagtgcggg

SEQ ID NO: 20378 - DNA, 469 bp, Triticum aestivum
  Clone ID: PAT_TA_20378
cccacgcgtcctattgctttcgattccggtgcacacacagagagaagcgcgggttatggcggaggaagataaggcgcccagcgacgcaatgtcgacggtggcggaggaggcgccggtgacggccgagcggccggtccgggcagacctggagccgcgccttcccaagccatacttggctcgagctctggccgtgcccgatgtgtacaatcctgaaggggccgtggaggggcacgagcacgggcagaagagcgtgctgcagcagcatgtggccttcttcgacctggacggcgacggcatcgtctatccctgggagacttacggaggaatgcggtcactgggcttcaacgtgatcttgtgttttatagcggcaattgccataaatattggtctaagcttcccaactctacctagctggataccatctcccttgttccccatacacatcaagaacattcacaaggataagcat

SEQ ID NO: 20379 - DNA, 1037 bp, Triticum aestivum
  unsure (1)..(1037): unsure at all n locations
  Clone ID: PAT_TA_20379
gngtgcttccttcctcgcgtgtatagagaagacacgacgcgcggtagaatttgtcaccgccggtcctagattattgctttcgattccggacgcgtgggcgcacgcgcacagagggtttcatggcggaggaagctaaggcgcccgccgacgcaacgtcgacggtggcggaggcggcgccggtgacggccgagcggccggtccgggcggacctggagacacacctcccaaagccctacttagctcgagctctggtcgtgccggatgtgtaccatcctgaaggagagagcggggaggggcacgagcacgggcagaagagcgtgcttcagcagcatgtcgccttcttcgacctggacggcgacggcatcgtctatccctgggaaacttacggaggaatgagggcattgggcttcaacgtgatcgtgtcgttcgtattcgcaattgtctttaatattggtttcagcttcccaactctacctagctggataccatctctcttgttgcccgtatacatcaagaacatccacaggggtaagcatggtagcgattcctcaacttatgacacagagggaaggttcatgccggtaaatttcgagagcatcttcagcaagtatgcccgcacggcgccggacaagcttagcttcggcgacatctgtaggatgaccgaaggcaaccggctgaacttcgacttcattggatggattgtgagcaagggggagtggatactgctgtacgtgcttgcaaaggacgaggagggcttcctctccagagaagctgttcgccgctgctttgatggtagcctgttcgagttcatcgcccagcaaaggagggaagcccacgacaagcagcactagagttgcaacgctgtcatcttcgtgagtaggactgtagaccagatggattgcctcatgtatgcctatatgaaataagagaggaacgagtacaaagttcagagaataaagttgtacacttctcaactaaacttgagaacataagtactctgtactgtggttgttgaatttactgtgattgttgaaaaa

SEQ ID NO: 20380 - DNA, 898 bp, Triticum aestivum
  unsure (1)..(898): unsure at all n locations
  Clone ID: PAT_TA_20380
accttctcgacgacctatgcgacctcgccggcgttcattaacaacaacggcggccaggcgccgttcgtcgtggattgggccatcgggaacgagacgtgcgacgtagcccgcaagaagcctgggtcctacgcgtgcgtcagcgacaacaccgagtgcttcaactcgctcaacggaccaggctacatctgcaactgctccaatggcttccatggtaatccttacctgcatgatccggagcacggatgcaaagacattgatgaatgcaagctcccccaactgtatcgctgcacaaatggcggggtctgcagaaacaggctgggaggctatgactgtccgtgcaaatttagatggaaaggccacaccaaagcgggaacctgcatagtcatttccctctaacaacaaaggtcgcagtcggtgcagtacgtggctatcctgctcatgtcgataatatcgttccttataatcctttacaataagaagaagaaagtgaagaaatcctacaaaaacacggggcagcatagactagaccaagctacaatcctcaatacgcagtcccaagggtgggtcaacccgaattgaaagtggacccacgttatgggcctcggtggtttggaatttgaccagcgcggccggccaattacgattggcgagcacgcacccagcaccgggtttcgccgtctgttccacattcccgggggatctcaccagctcagtcacccacgggaacattgttagccattggtgttnctcgaagttgaaccccctgctggncatnanttatccaaaggtaccncatggtatctcaaacacataanaggngcnccactngaacctttanaaccnccatcactganggtacttntncccaacatntaaattccngattaacaaattacct

SEQ ID NO: 20381 - DNA, 703 bp, Triticum aestivum
  unsure (1)..(703): unsure at all n locations
  Clone ID: PAT_TA_20381
attttgaaggacaacgaaggggctcttttgaatttggatcaagagcagcctgcactgcggttctatgtgggaggttatgtatttgcagtcagcgtccatcgggttcaactgcttctacaagttctgagtgttaagcggtttcaccaccagcaacagcaacagcaagctcagagcaatgctcaggaggagctgacatctgccgagatcaacgagatatgcgaattatttcagcaggcgtgttgcctctgaaccatatgatgcttcaagagttgcttcttttatcactttgcttacattacctatatcggtgctgagagaaattttgaagctgattacttggaagaaagggtttcccaaggctcatggtgacattgcaactgctcagagggctcgcattgagctttgtttggaaaatcactcgggatcagcttcagatgatagaacagaaaccccttagctaagagcaatatcatcatgatagagccacagtcagtagagttgctccacattgtacttgacatcgctcatcccaatgaacgtactggtggactgctggctcgtatgttaccgtagacgagtatctttgnnnacagcatatacatcctnataatggancatgtganacttcngacatcganatggaagttacaaagngcaggattgaacgtatggaccgcgttaacgcaagaggncaagttcaatt

SEQ ID NO: 20382 - DNA, 843 bp, Triticum aestivum
  Clone ID: PAT_TA_20382
gttggtttctggggatctaagatgaagcaagctgcagaattgatacgcccaggtgaaaagggtcgaaaatacatatttctcctgaataacacatgtgttgttcgtcaaatggtgcggcgtccaggaacaactttccccaatgtagaacccctgctcacttcaatgatcaagcgatacacgaagtgctacttgggacgagtgttgggctccgctcaagtgtttaagctcggaggagtttaccgccgaatttcttgccgcctgtaatcgccagatgaagtggaaggttgcagccgaggtcaggtacaaactgcggcaggagattgcggaattgatcgttccaccgtgtgacggaagccatgtgatagaagggttatttgaaggatgagcagctaagcgaatggggaggacccgaggagaacactgggactttaaacggccgttgcactcgccggtggaggaggaaacgctaatcctaactgtaatttcaaaaaaaaaaactgtaacttcttgtatttagtatagtactactccctccgtcccataatataagagcgttttttacttttgtaaaaaaaaaacactcatatattatgggacgaaggaagcagtaaatagcttcctatcatatcttgctttttttttcttttgcgggtggctgtcatatcttgttagttgcacctctgcccgtattttctctctctcttgtatagggatgattttatagcacatttgaatctgtgacagaagtataggtacatagaaaactgatagttttgtttctattctcatgtatggctcatctgacaagtcgagatatgaaaaaaaatgactacaccctcgtgc

SEQ ID NO: 20383 - DNA, 776 bp, Triticum aestivum
  Clone ID: PAT_TA_20383
ttttttttttttttttttaggcagtataactgatgaaaattcagtagagcatggtatttcatatgcatttttgctaagtgcagacataagtgtggaatcaataattcatgggaggagccaccttttttcatcccccaagtctccagaaggtacagagcacaaattacaaatgttatcagcatccagggccctggctcagccacaagttttcagcacagatttctgctaatagctgcatacacacaacaaccatctaattccatataaatggacttcaattttctgacaacatgaactttgttattagcagaaatctgcagtcctggatggagtgctctcttggatgcctcacctatggctctgcacacgcacagcttgggctgtctaagtttgcatctctgtcaacgctttatacattaacatcaaacaaaaatttctgtcagtgctatagtatcatatctctgtgcaacaggtatagaaatctacctgaatttgagtatgtgactcgttttaagttcttcttccaattcgttcagctctcttgcattttatagtggtatttgcaagaatgaaatggattaacttactgcatgaataacatgataaatatcttaacataggtgctgtaaccagtgtaaacaattaatttacagctgaactgtaatagactgtattgaagctacttgattttggtttatgcagtcaatttgcagcttgtaagattattgctggtcattacaatttctatcctctttattatgtatttacttttacca

SEQ ID NO: 20384 - DNA, 1305 bp, Triticum aestivum
  Clone ID: PAT_TA_20384
cgcccgcccgtccgcgtgacagagccgacggaggtgagtgggatacgggataagcgcatatatagcccgcctgggcgctgggtgaactgaaccgatcgaccccgcggccggcgatgatcaaggccgagccggagctccgtggccagctacgcggaggcggcggcatgctgcagcagcgctgcgactcgtgccggtcggcgccgtgcgcgttctactgccgcgccgactcggcggcgctctgcgccgcgtgcgacgcggacgtgcactcggccaacacgctggccagccgccaccgccgcgttccgatgggcgccgcggccccggcctcgcctgcccgcgggccgttcgtcgtccgccccggcgccgtccagtcctcctggcccagccgcgaggggcggagttcctactacgacgccggcgagggagggggggaggtcctgctgcaagggacgtcgtggctgctgctctacgcgctccggggctcggtggctgacgcgccagctttcggcgacgcgctcgtcgctcacttccttgaactcggacgagcaggcgagaaggacgcgtcgagcaaggagtaccgcggccacggtgtcgagagccacgagggcagccacgagctcgtcgtgcccggcgagccggtggcgcagctgcatgagcggcagggcttcacggcggagatgtcgtacgatgcacaaaattctaaccatgggtacggatttggcgcaacattccaacgcagcctttcaatgtcatcatcaccggacaacagtagcaccgttcaggatgtgaccagctcgtacatgaggagcagcgagagcagcgtcgacctcttctcagcggcggcgcacatgtcgccgcagttcatgggcatggccatggacagggaggccagggtgcaccggtacagggagaagaggaagatgaggcggttcgagaagaccatcaggtacgcgtcgcggaaggcctacgccgagaccaggccacggatcaaggggcggttcgccaagcgcgccgacgccgacctcgaggtggaccagtacttctccgcagccgcactgtccgactccagctgcggcgttgtgcccactttctaggccggctcggtggagagaccatgagcgttcctccttccatggtcgatcgacgcctacatgttggttggctctccttaatctgccaaatattcagaaatttattggaggcgtcaaagcttcacctgtaaatatatggaaagatgccggatagatctttcttcttcttctagctaaggaccctcaaaaactgcgatgacctcgtgccgaattc

SEQ ID NO: 20385 - DNA, 953 bp, Triticum aestivum
  Clone ID: PAT_TA_20385
tcgcgatctagaacctaggcgctccccacctcttgtccacctcgcgcctcgtagtcgtactaccaaccaaccccggccgacgcaactccagtcactccccgcctcccgcgatggtcgccacggcgaagatcccgcagcggcagctcttcatcgacgactggcgctgctgaaccatcccacgagggagctccagcaaggccgctcgggtggtgcgttggacggtcgccgacctcgcgtaaccccggtgccgcacggctccgagcacccggcgacctcggcataccgcaggagcggacccgacccacaggcgaagggtgatcgaggagatgggaaaggcctgggcgagtggaccggtctgatcggttagggtggcgaccaaggagctgaggatgtcgaggagggcggtgaaccccggcggtcatggaaaggcggctggacatgtgtaggtggaacaaagaaacaatgagtttctgtgcgacaactttgaggattggattataacgagggcgagctggaggagcttgagaagggcgtggagcctgcgtgggaaagcttggtccacctgctcaagcgcatcgtcgacaggctgaacgtcattgaccacatcaaggctgtcaaggactcgctcgacctctgtgccgccgtcgaggatgtccagatgctggcgtttcatgtttcgtcacgagcatcaagatgaagaagtcggaagaagcatagtccaagctcatcggagctagttcaaggagtaatgaagcccttgatgctgatccgtattggaacaaattgaagcacgaactgtgacatatagagcttgttatactgtagagcttgatgctcatcggctcatgtgacatattgtacatctgtagagcttgttatattgtgatcgcatttgtatgtgctgatgtaacagattgttgcttcttgttatttgaagtattacacctgtttac

SEQ ID NO: 20386 - DNA, 759 bp, Triticum aestivum
  Clone ID: PAT_TA_20386
ggccattcccctaaattttcctttacgggctcatggtgggccccagaatatgcttggagcgtccaagtaaaacatgttaaaaatatatgttacagaggcacatggatctgtaaaagaaacgtcgctcctgatcatccatatctgtatttgttacagtacgtatatactagtagtacttctctctgaaggagtcaatttgtgggtatctgtccttgaacagcggggtgccttccttgggttttgaccaagggtacttcatggttttatcccttgggaactttctgaagttgacgaacggtgcccacagcatcaacccggggaagaagaggtaagtgaacatgaactgcaggtacgtctcgacgaacttgcgcttgaaccacctcagcctcatccagttcatgataatcgggggagcaacgaagaggtagacgaaggcgatcgcggccaccggcggcaggatccccaggaggtcaaggtcctcctccccgctcaccgtcgccagagcagcgggggcctggactgctgcccagacggcaccgcactgcaacacggaggccagcttctgcagctgcgagctctgggcggtaggcgcaggcttgtcatggagaaggcagaggatcctggacttggagatcgccggctgttcaagagacgaagggaaggacgcctgccgtctggcttggagcagggagggacgcggcgaggacgcggccgggaggaggcgccatgaggcggtggtctccattggcggacgcgggg

SEQ ID NO: 20387 - DNA, 1067 bp, Triticum aestivum
  unsure (1)..(1067): unsure at all n locations
  Clone ID: PAT_TA_20387
gnattagcttccctgacttgcttagagcttggtgatgtgtgtaaagagattggtcttccatcaggtgtcttaaacattgtgactggattaggtcatgaagctggcgctcctttgtcgtcacaccctgatgtcgacaaggttgcatttaccgggagctatgcaaccggtcaaaagattatggttgctgcagctcctacagtcaagcctgttacattggaacttggcggcaaaagtcctattgtagtatttgatgatgtcgacattgacaaagctgttgagtggactctatttgggtgcttttggaccaacggtcagatttgcagtgcgacatctcgtcttcttatccataaaaatatcgctaaagaattcgtcgacaggatggttgcatggtccaaaaatatcaaggtgtcagacccgctcgaggaaggttgcaggcttgggccagttgttagtgaaggacagtatgagaagatcaagaagtttgtagcgaatgctaaaagtgaaggtgccaccattctgactgggggtgtcaggcccaagcatctggagaaaggtttcttcattgaacccacaatcatcactgacatcaacacatcaatggagatttggagggaggaagtctttggtccagtcctgtgtgtgaaggaattttctaccgaagaggaagccatcgaactggccaatgatactcattatggtctggctggtgccgtgatctccggtgaccgtgagcgatgccagagattagccgaggagatcgacgcgggatgcatctgggtgaactgctcgcagccttgcttctgccaagctccgtggggcgggaacaagcgcagcggctttgggcgtgagctcggagaaggggggatcgacaactacctgagcatcaagcaggtcacggagtacacatctgatgcgccgtggggatggtacaaagctccggcttgagagacttggatctgttccatcaggataaatctgtgcgccggcctttgtagtggtgaataaatgtagtttgccatgtactgctgaaccttctttgcaaaataaatggcatgagttttatggcc

SEQ ID NO: 20388 - DNA, 1836 bp, Triticum aestivum
  Clone ID: PAT_TA_20388
cccagcccccgcccgtcccaccgccccggtgcctccccgcctccccgcggcggccaccctcgcgcagatcccgaaccggcaactcttcatctacagcgaccgccgcgagctcgcgctcggccgccgcctccgcttctccaaccccgcctctgaggccgaaatcggccacgtccagtacgtctcctcgaaggacgcggacgtgggggaggcggccgcgccggcggatctcccttagatgcgtttccgcgaatgctactgcacgctgggctccgtcggggccaagcagcaattctctagcgctgccaacatgatcaacgcggagacctgatcgggtttggccagaggctcctgattgggtttagccccttgaggaagtggcataagatgtgggagctgttgcccgccactttgaattccgcgcgaagaagtgctaagtcgatgatgaaatgcaaatacgcctcggttactctccccgcctgattcaactccgctcttcatccagaaccattgagtctggggggaccaacgaagccttagaaggaacgtcacccgcgggcagcctcggaaggatcccctgcaggtgcagggggctgctccgcggtccgggtcgcctcagtcatagggggcctgcattgcttgcacctagggcgccggcgtttgcaaaacggacgcccgccagggcagctgcgagctgtgggtgggtaggggcaggcatgtcgtggacaatgcaggggacacccgacttgcggatcgcatggctgttcaagggacgaagtaaacgtccagtacattatggtttgtagctggacgacactcaggcatgtcgcatacgtgggtagttgccaacaaacggtcgtatttattgttggatgacacctacactgaccaattgattgagcgctatctatttggttgctattggacctacagtctcatatgctgtcaagcagtcagactccttcgccaaaaaaacctcgctagagccagttgttagtgaaggacagtatgagaaaaacatgaagttgttagagaaccgctaaaaaggaaggtggcacgcttcggcctgttgttagtgaaggaaagtatgagaagataagtttgtttgtagcgcatacaataagtgaaggtgccaccatactgactgggggtggcaaggcccaagcatttggagaaatcttgtttgagaagacattcactactgacggagatcaacacatcaagggagatttggagggaggaggtctttggtccagtcttctgtgtgaaggaattttctaccgaagaggaagccatcgaactggccaatggtactcattatggtctggctggtgccgtgatttctggtgaccgtgagccgtggcgcgggtacaagcgggagattgacgcgggatgcatttgggtgaactgctcgcagccttgcttctgccaagctccgtggggcgggaacaagcgcagcggctttgggcgcgagctaggaaaagggggcattgataactacctgagcatcaagcaagtcacggagtacacatctgatgcgccgtggggatggtacaaagctccggctaactaagatgtaattgagctggttcgaggacctggatctgttccatcaggataaatctgtgcgccggcctttgtagtggtgaataaatgtagtttgtcatgtactgctgaacctttcttgcgaaataaatggcatgagttttgtggacataaaaagaaaataacatggatttacttttcaaaattaagatggttagagtatctccaacaactcccccaataatatctcactctatatccatgatctgaatatcaaaaaaaaaaaaaaaaaaa

SEQ ID NO: 20389 - DNA, 385 bp, Triticum aestivum
  unsure (1)..(385): unsure at all n locations
  Clone ID: PAT_TA_20389
gcccatcatgcatagttgtgtcctggttgtggtgtagccatccgaccctgttcgtgcccggacacgcgcagagctcagccagcggcagcagtgcagcgcggcgccgtcgccgttgatggagagcaggcgtccgagctccgtgcttctcttgctggtgctgctggcggcgccgctcatggtggcgtcggctggcccctcgtcgccgacggcgttcctggaggacgacgtggtcctcggcgccgtggcgaggctgggcaagggcgccaacgccagcgggcggggcggcgcccgctgcgacgtcgacgtcgacatctccgccgtcgttggcgggccgtcgcgcgagcgcggcgcgtccgggtggaaggaggagatcgcggngctggcg

SEQ ID NO: 20390 - DNA, 2440 bp, Triticum aestivum
  unsure (1)..(2440): unsure at all n locations
  Clone ID: PAT_TA_20390
ggagcggcggaggcccgcccaggnaagcgcaacttcaagatcgagatgttcaagcaccgggtggagctcgaccccaagtacgcggagcggacatggaaggtcctcgagcacgccatccacgagatctacaaccacaacgccagcggcctctccttcgaggagctctacaggagtgcttacaacatggtgctgcactcggctcgcgcgtcgctccttaggggccctgggagccccttggcgtcgcgtccggagggattgtcagacccagtggaggctgctcagggcgggttgtttgtggaggagctgcatgcgaagtgcatcgatctcgccttggccttgcagatgacccgccatattcctctgtactcggcccggtctgttctccctccaccccatcggccgcccgcccgtgtgcttggtctctgtttggggggggaccatctccgccacggcccgatgggccctggtcggctgcttggacacccttctagtgcttattcacagagaaagatgggtgaagtgatcaatagaggcctgatgaggagcattacaaagatgttaatggatcttggtcctgctgtgtaccaagatgattttgagaaaccatttttggaagtttccgctagcttctacagtggggaatctcaagagttcatcgagtgttgtctccatggtagagggtatgttcactgacatgaagacatctcaggacaccatgcaggtgtcctatgccaagaaatccgaggaagttggtgatggccctacagcgtggtggagcattctcacatagccaatcacatgcatacaaccgtccacacggagcactctggccttgttaacatgcttatagatgacaaatatgaagatttgggtaggatgtacgccttattccgaagggttcctgatggtctatcaacaatcagagatatgatgacttcatacctgagggaaacagggaagcacttggtgacagatccggagagattgaaagacccagtggaatttgttcagtgcttgttaaatgagaaggataagcatgataagatcatcaatgttgcttttggcaatgataaaaccttccaaaatgctctgaattcatcctttgagttcttcatcaacttaaacaacaggtcacctgagctcatatcactgtatgttgatgacaaactctggaaaggactagttcacaagccagcttgttaaggtgaagatcgagacagtggtggcatgatgctaatctgagccagacaagcaggagatgcgccagcgggttgaggaggacaggaaacctcagattgaggctggcctcgtcaggctcatgctgatgatgctgggcggggttcgttactctatcgcatctcgggttgccgggcccttgcaagctcggttcttgccgaaccctgttatcataaagaaacgcatagaatctctgatcgaacgcgaattcttagagagggacaaagcagatagaaaattatatcgctatcttgcataaaaagccagcatgtgaatgttaagagatatttcatgagcaggtggcttccttgtattcctgtaaacatttccccttgggcttgagttcggttttatctgggtgcgcccctgtccactgaaaatcacatggcagttatttaagggaacagctgatataaaggccacatttgggaaaagccagaagcatgagctgaatgtatccacttaccagatgtgtgttctgatgttgtttaacacttctgatggacttagctacaaagacatcgagcaagctactgagataccttccacagacctaaagagatgtctccagtctcttgcttgtgtcaaggggaagaatgttctccgtaaagagcccatgagcaaggacatatcagaggatgacacattctacttcaatgacaagttcacaagcaagcttgttaaggtgaagatcgggacagtggtggcggcaaaggaatctgagccagagaagcaggagacccgccagcgagttgaggaggacaggaaacctcagattgaggctgccatcgtcaggatcatgaaatctaggagggtcttggatcataacagtattgtatctgaggttaccaagcaattgcaagcacggttcttgccgaaccctgttatcataaagaaacgcatagaatctctgatcgagcgtgaattcttagagagggacaaagcagatagaaaattataccgctatcttgcataaaaagccagcatgtgaatgttaagagatatttcatgagcaggtggcttccttgtattcctgtaaacatttccccttgtgcttgagttcagtgttatttgttgggcactgtccactgaaatcaatagcagttattaaattcggttatcagtcgattgaaatggaggctttaccccaatccctgcaacaattctactactagccaagcatttatgttatgcaaaanaaaaa

SEQ ID NO: 20391 - DNA, 691 bp, Triticum aestivum
  unsure (1)..(691): unsure at all n locations
  Clone ID: PAT_TA_20391
gacgggncggcggcggcggcggagcacaagtcggtggagatcatgcgcaagttctcggagcagtacgcccgccgctccagcaccttcttctgctccgacaagtccgtcaccgccgtcgtcatcaaggggcttgctgaccacaaggatcaactcggagctcctctctgcccctgcaggcattacgacgacaaggccgccgaggccgcgcaagggttctggaactgcccgtgcgtccccatgcgagagaggaaggagtgccactgcatgcttttccttacgcccgacaacgattttgccggagaggaccaggccatcagcttggaggagatcaaggaggcgacgtccaattttttaccacacaacatcctcccctcccttctcattggagtacgctttacgccagcccaaacacgcaataaatcgcaacattgacgagtcgggaacacgaccatcaggccttaatttctctcaagacggatggatgacaacagatatcattccagacagacatttcttatttcctgctgttacagagatactacatacacaggtcccgacaacgacgaccgactgactgactatagccccctctcgagcaaaacaggtgttgtgtggttagtacttggacgtcgcctccttgatctcctccaagctgatggcctggcggacgcgtgggcggacgcgtggggaa

SEQ ID NO: 20392 - DNA, 935 bp, Triticum aestivum
  Clone ID: PAT_TA_20392
cccgggccggattcggcgcgtcatccctctccccccctcctcctcctccttttccccttccccgctcgacccaccccaccgcgccggcgatgatgtcgatcacctccaccgccgccgccgggaccccggtctgccggccgtccgtctccaggggtggacggcggagcaggtgcgccgtccgagcccaagcggccggagacggtggagccgccgccgacggggcgtcgtcggagcagaagtctctggagataatgcgcaagttctcgggagcagtacgcccgccgctccagcaccttccttctgctccgacaagtccgtcaccgccgtccgtcatcaagggccttgctgaccacaaggatcaactcggagcacctctctgcccctgcaggcattacgacgacaaggccgccgaggccgcgcaaggcttctggaactgcccggtgcgtcccgctgcgagaaaggaaggagtgccattgcatgcttttccttacgcccgacaacgattttgccggagaggaccaggctatcagcttggaggagatcaaggaggcgacgtccaagtactaaccacacaacacctgttttgctcagagaggggctatagtcagtcgtcgttgtcgggacctgtatatgtagtatctctgtaacaacaggaaataagaaatgcctgtctggaatgatgtctgttgtcatccatcttgagagaagttaaggcctgatggttgcactcccgactcgtcaatgttacgatttattgcgtgtttgggctggcgtaaagcgtactccatgacaagtgaagtgaaggatgttgtgtgagacgtcgtctccgatgcctcgtgtcctgcctgaatgaatgaatgatgtgtggaagggaagcaacagcgacgcgccattgcccatgtccgtggcacccaacaacttatatttcctcaatg

SEQ ID NO: 20393 - DNA, 774 bp, Triticum aestivum
  unsure (1)..(774): unsure at all n locations
  Clone ID: PAT_TA_20393
gagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctgggtgacaatgtcggcttcaacgtgaagaacgttgctgtcaaggatctgaagcgtggnttgttgcatccaactccaaggatgaccctgccaaggaggcagccaactcacctctcaaggcctcatcatgaaccacctggtcaagatnnggcaacggtacccccaatgctgggctgncacactcccactgcgctccattgctgctctcggggcgacctgattgcggccggttgggaggtagttgccccccctcttccagcgtgacccgtgacctggatcntgaagatatcccaccaacccaggtngtggagacttncaactaccnctcttggcgctgcttgctgacatgagaaaacgtgcgttgggtnacaagttgaaanaagaccacgggcaagtacaaggtgcacagaanaatagngcncanctcaangattttacgcattcttttgctcaacctaccnnacaagatggcggctaaangnnttaaccggtggaacccgnccnan

SEQ ID NO: 20394 - DNA, 275 bp, Triticum aestivum
  unsure (1)..(275): unsure at all n locations
  Clone ID: PAT_TA_20394
gtgattggttaccgtagctgcaaagatgcgtctgcccattcgtttggtttgcaatgttgcaaacatatctcatctgcttacttaatttgctgcaaagactcgtctgcccatttccttgtcctttcggcgcaaaccaaacctatttgcttaccacatttaattgcgccgaaagggctgaaatgtaggtcccgagtaattgtgaacatgtaacatttgattatttttttggttcgtttgaattgcttaccacatttgacgtggntgtcctttgatcg

SEQ ID NO: 20395 - DNA, 704 bp, Triticum aestivum
  Clone ID: PAT_TA_20395
tcggcacgagccgctgttttattgcagtaagaaactaatggaggtcgacgtggcagcaactacactcggagtcggaggtgatgtgtcttctccttcatcgctgagcctgctctgcggtctcgctgcgctgctcgtcctcctgtgggcggtctcccgggccgccgagacatgctggctgaggccacggcggctcagccgggcgctcagggcgcagggcctgggcggcgcggcgtaccgctttcccgccggggacctcgcggacaacggccggctcaacgaggaggctcggtccaagcccatgccgccgtgccacgacattgtgccccgtgtggcgccacacctcctcaacatcgtcaaggaacacggcaacgtttgcatcacctggtttggaccagtcctaaggatggtcatagcagagccaaagctagtgagagagatcctatcagacaagtcgggccatttcgaaaaattcaccaacaaacgtctgggaaaactgatagcccttgggcttgcgagctacgacggtgagaaatgggcgacgcacaggaggatcttgaaccccgctttccatctcgaaaagctcaagagcatgttgccggctttctcgacatgctgcaccgagttgataagcagctgggaaagtaaactagccggttctgatggatcacatgaaatagacatatggggaggatttccagaacctc

SEQ ID NO: 20396 - DNA, 1821 bp, Triticum aestivum
  Clone ID: PAT_TA_20396
tcgacgggtgctgcacacttgttacaccaaggtgtctccctcggcgcccgtggagaaccctaagctcgtggcgtggtccgaatccgtggctgacctcctcgatctggatcacaaagagtttgaaaggcctgattttcctcggttcttctcaggagaaactccgttggtgggaagtgtgccttatgcccagtgttacggtggacaccagtttggttcatgggctggtcagttgggggatggacgagcaataactctcggagaggttctcaattctcgaggtgagaggtgggagttgcagctcaagggtgctggaaagactccttacagccgatttgcagatggcctcgctgtcctgcgcagcagcatccgtgaattcttatgcagtgaagctatgcatggtctaggcattcctacaactcgtgctctttgtctagttgaaactggcaaatctgttgtgcgagatatgttctatgatggtaatgcaaaagaggagccaggtgcaattgtttgccgtgtagcaccatcgtttttacgttttggttcataccagttacatgctacaaggggcaaagaggacctggaaattgttcgtcgtttggcagactacacaatacgtcatcactacccacatcttgaaaatattaaaaagagtgaaggtttatcttttgaggcagctatgggagacactccagcaatagatcttacttccaacaaatatgctgcctgggcagttgaggttgcagagcatactgcttacttgatagccaggtggcaaggtgttggtttcacccatggtgtgcttaacactgataatatgagtgtgttgggcctaactattgattatggaccctttggtttcttagatgcttttgatcctagctttactccgaataaaactgatctcccaggtaagaagcatactgttttgcaaatcaacctgatgttggtttgtggaatattgcccagttcactgggccattgtcggctgcggatcttatcagcaaggatgaagcaaattatgtaatggagaggtatgggacaaagttcatggatgaatatcaatctataatgacaaagaaacttggtctgtcaaaatataacaagcagcttattagcaagctgctgaacaacttggctgtcgataaagttgactatacaaattttttccgtcttctttcgaatgtcaaagcagaccgtgacatcccagaaactgagctacttgttccaataaaagctgcactcctggatattgggaaagaaagaaaggaagcatggattagttgggtacaaacatatattgaggagctggtggctagcggtgtctccgatgaagaaaggaaagccacaatgaaccgtgttaacccaaagtatgttcttcggaactatctttgccagacagcgattgacgcagctgatctaggtgattacgaggaagttcgccggctattgaaagttatggaacatccatatgacgagcagccgggaatggagaaatacgcccgcttgccaccggcctgggcatacaggcctggggtgtgcatgctatcctgctcgtcatgagccacatccagctatgacccaatatacagtgttgtatacttttttggttgtataggaggtttaccctgtaatatgtaagtgttccgagcgccgcattgttttattactgtggcgcgatgtccgaaacttagtcatgttgtttgttgccttgactttgagtagcagaacgttcagccgttcaggagcagttgggaaatgaagcgctccatacctaaagtttctgagtacggtaatgctatcagtggaaaacccttgtgttgg

SEQ ID NO: 20397 - DNA, 750 bp, Triticum aestivum
  unsure (1)..(750): unsure at all n locations
  Clone ID: PAT_TA_20397
ccccccctngggtttttttttantnnttgttgataacattaccctaaaaatgagctacatttttttctcggaaaggagggaaagcattcagtaccactttcaataaaaccgaggaattactagctcgtcaattttattcattcatttccgttaactttaaccaatacaataccataattactctctctcataagtacaatatatacccaaatgtagaaatgcaaaactatagttgttgtatgtggtacaattcctttgccgatcccattagatcaaattaatgtgtgcttgtatgtgtgtattaagtatcagtagtataactatactcccggatataataaccgtagtaggtaaccgttgtcacacgtccatgtccagcacgagaggcgtgtcccccttctcgacgctgaaggccttgtgcatcttccccgtggccgtcggcgagctgcacgacgtacgaaccgtgggacccctgaacttgaagttgccgtcgctgccgatctcccgcgcgccgtgcgacgtcaatccntgccgcaggtggatgaactttgggcggcgtccttgatggtgcctcggattgancaggaagcgccggcgcacatgggcccctcaaatccggaaactctggcttganccaaatgggcaggtccaactaatcaccgccaccaacatacgatnatnaatacggaagaccntaaatnacatacggcantccccgtagaagnaatngctaaaagcnnttattttaat

SEQ ID NO: 20398 - DNA, 608 bp, Triticum aestivum
  Clone ID: PAT_TA_20398
ccggcgtctccaccgccaccatcgttccagttccctcatctgccgccgattttctcggcaccatcttcgccgccgcccccgccgccgccgcctgcattcccgttccctttgccgccgtttccacagctacctccttttccgcattttccgcctctgccatcgttgtattcgccaccgcctcctccgccaccccctccgccgccttcctttccttggcctttcccgccattgccattcttgcctccaaccgcaagcccttcggtcccatctcctccaccttcaaggcattaccggaaagatccgagcacctggtcctcttccaaaacccaaccataaataaagcaataataataagtatttcaaggaaaggattaaaagtacataatagcaatttatctgctcgtgctagggacggatagtgggtgtactaggcaagatggatccctttcctgtttgattcacaagtgtgagtccgtgcttaaaattataattatatgtcagattgtaaaaagaggattcccctttgtggggatgtccttactcctccggggtgttgcgctttatggcgttcattcaacagatacatttccaagttaaaaaaaaaaaaa

SEQ ID NO: 20399 - DNA, 811 bp, Triticum aestivum
  unsure (1)..(811): unsure at all n locations
  Clone ID: PAT_TA_20399
ccagagttaacagcatcaggcctgtatttgaagaggcagcaactgatttagggaagagtgaaatagattcggaggttgtggagaaggtttgggacaggatagcacctgggcttgcttcacggtttgatgcaccttactcggttcccctgattgcaccacgtccgctcctcctcctaaatggcgctgaagacccttgttgccctatcgctggtctacaagagcctgcttcccagagttgctgaagcttatgaaaaagctggttctgcggagaagttcaagttcatcgtggacccgggagttgaacatatgttaacggcgaacatggtgaaggaagcgagcgaattggttcgaccgattcctgcagtagctcggggttcgggatgcttcatggagtgcacggcctcaataaattgtcctcactttcggatcactgtcgttgttgaataaatcccttcgccgtgatggtgcgtgcgcggcgagttcgcctagaccacggtgaccgcgctcggcactcgttggatcgtgggatggcgcggtccgcaaggaggccgggtactgcgcgatctcgtggccatttttccgtcgttgctactaataacaagaggagtgcagtgaaaagccgtgaggttttacgcagcacaaattctgtgtgctccacagacttgatttgttccatcattatctagctaatcgctacgctatatttctccatttgaaacgacacagcatatgtgagcatttttttatcacgcaacataaaaattcctggggactctgcatttactgaactgtatttacagtgttcangaaa

SEQ ID NO: 20400 - DNA, 1125 bp, Triticum aestivum
  Clone ID: PAT_TA_20400
cccacgcgtccgagggaggcggggccggccatcagcccagcccaccccaccgaccggctcgctcccctcccccagaaatccccaacccaggcggcgagcgacgaccatggagcccgtcggcggcggcggcgggggcgcgtcctcggcggcggagcggtaccgcgcggaggcggcgcgggcgttccagcactacctggaccgggcggcgccgcacacggcggggcggtgggcgggcacgctgctggccgccgccgtctacgcgctgcgggtctactacgtccagggcttctacgtcgtctcctacggcctcggcatctacctcctcaacctcctcatcggcttcctctcccccatggtcgacccggagctggaggcgctcgaccaggccggccccgcgctccccacccgcggcaacgacgagttcaagcccttcatccgccgcctccccgagttcaagttctggtatgccatcacaaaagccttctgtgttgcttttgtcatgacattcttctcggtatttgatgttccagtcttctggccaatactactctgctattggattgtgctctttgtcctgaccaatgaagcggcagattttacatatggtcaaatacaagtatgtcccattcagcatggggaagcagaagtacggaggaaagaaaggcccatcaaccagtggatccaaagattgatgcgcagatgccaaatccctgtgtcgctcttctgcgaggcgacagataatcagatgatggtgctggcatggtggttttattagtacaacctactgacagtgaatgtacaaactagtaactttttcattggttggtgataccttgttctgcgtagtagatcagtagtagcttccgtacgctgatcatttgtcacgtattctgttgtagtactgtgagagtgtgcaatgcaaatcaaaaccgttgggactcgtgcaactctttgttgctaccacctactccatttcctggaggatctctgcaatttgcttctgcaacacttgatctcagtgactttcttatatgttcatcttttgctgttcaaatatatgtgaagttcagatttggtccgtgaaaaaaaaaaaaaaactcgactgtgccgataaaaaaaaaaacc

SEQ ID NO: 20401 - DNA, 1379 bp, Triticum aestivum
  Clone ID: PAT_TA_20401
cccggggcgagggagaaaaaaaaaccacccgaaaaataacgcaagggcgagtgaaaaaacaaaagaacggatgcatcccgtgtcgacgcaacgcctggcgcccgtccccaacgccaaccaccagcgcgcgcttctcccgccgtctcctctgctgcttcggccacggaccagcaccaggtcctcggcgtccgccagatcggcgccgcgcgccgtgtcgcccgcgaccccaaccaccgcagccaccaacgacccggacgccggcgcgcagccagataagtgggaggagttcgcggcgcgggtgtccggcgagtgggacggcttcggcgcggacttcacggtggccggcgacccggtggagctgccggccaacgtggtcccggacgcgtaccgtgagtggggggtccaggtgttcgactggcagacgcagtgccccaccctggccgaccccgccgcgccgggcgcgctccactatcgcctcgtccgcctcctccccaccgtcggctgcgaggccgacgccgccaccgtgcacacctcccaccagcgccacgtctcctccgccaccgccttcgcctacggcggcgccgggggctcctacgtggccacgtggcccaagggcccctcggccgtgctcgaggtggagcactgcaacgcggaggtgcgggtcaggctggtgcagacggtggcgctggccaaggacgcggcgcggctgcgcggcgtcaaggtgttctccgagcagtggtacggcccgtaccgcaacggcgaccagctcggcggctgcgcgctccgcgagtccgccttcgccgccggggagaggctccccgcgtccgaggtggcgggcagtgggagagcgccgccaggtcctccggcgcgctggaccccgtgacgggcaagttcgcggggctggagccggaccacgagccgcggaggacggcgagggacggtgccggcgtcgtgacgctgctgccgaagcagctgtggagctcgctcaaggtgagcggcggcgacggcgacggcgacgacagcgacgtggtgtgcgaggtcgggtggctgctgggccacggcagcgcggtcacgtcgacgtgcgtcctgtccagagacggagacgtcaagatagctgctgcgcaggagacccgggtgtcggaggccacctgaacagagccaagaactcttcaggtttcatcagatctttacatagaaggaaattatacttacacatctagaatagccatactcatactgtaaatctgtcatccaactagaagatgatctactaagcaaattggtctctgcaaagacatgaactggtgtgctgtgcctaccctttgttgctctggtttaccaagggtagctacagagctcctgaggctgcttgattaaac

SEQ ID NO: 20402 - DNA, 513 bp, Triticum aestivum
  unsure (1)..(513): unsure at all n locations
  Clone ID: PAT_TA_20402
gccgccaacgctgccttctcgacgcccttgctcggccaaatctacaaccccgtcaatcagagcggaatggatgggagccagaggcccaggttatgaggtgccaacttgtctgtttgtcgtcccttccaaaaagcaccagcagccgccgcccaacgtctaccacgtccgttcaatttttttcttcgaaggtcatgtgatttgctcatgaatggcacaatgtgctttcatttgttacatgtttgtttccgatcttgtatttgggtattcctaatctcccaatctttgatcttgtttttgctccgaatgatgaccgacaaaagaatgttcacttaatcacaaggatagtctaagaaacaatttgtcaactggtgttaatcttttcatagtgtttgtgtgttaacatttgcatcaatggtacaaattgctaactggggggggtaattgggtggttgatggacattccgttagtatcaagggaagcaaacatcntattgggnggntaaaaaaaaaaaa

SEQ ID NO: 20403 - DNA, 1319 bp, Triticum aestivum
  Clone ID: PAT_TA_20403
ggacctctgacagggacgagaaagtgatatgttacattgtaaataccgcagaatattgtcaccaaacgtctggtgagctagctgagaatgttgctaagataattagttctcagttttctgacaaggtggacatgtctgacgttcaggatgaattctcagctgtgatcacaaaagcattgatgacacttgtgcatggcgtagaaaccaaatttgacgctgaaatggttgcaatgactcgcgttccatggtcgactcttgaaagtgtcggcgatcaatctgagtacgtgaatggtatcagctctattttgtccagtaccgttcctgcgctaggtagcctgctttcacctacttacttccagtatttcctcgacaaactggctgcctcgcttggtcctcggttttatctcaatatatacaagtgcaagcacatatcggaaactggtgcacagcagatgcttttggacactcaagcggttaagactgttctattggacatcccagctcttgggaaacagactacagttgcggctagctactcaaagtttgtaacccgggaaatgagcaaagctgaagcactcctcaaggttattttgtcaccagttgattctgttgctagtacctaccgtgcgctccttccagaaggcacgcctcttgagtttcagcggatacttgagctcaagggcttgaagaaagcagaccaacaagctatactggaagacttcaacaagcacagccccagcatcaagcaccctaccattacccccacagccgcgccaccagttccaacagccacagcatcagtcccgatggcaccagtcccgctcccaacccaagccgtcgcagcgtcaccgagcatgtccaccgccttgacgggcgccctggccaaccgggaggatgtgctcgcccgcgccgcagcgctcgggcgcggcgctgccacgacggggttcaagaggttcctcgcattgacagaggcggccaaagaccggaaggacgggccgttccgtaagctgttcaacgcgtaaagttttgcccctgcttgttgatagtttacgcctctctttgcagtgcacatagctataggaaattcttcccacaccgtgtgtgttccttgtgtgtaccctgaccgtcagtgtataatggttagatcttttttgacgtgacgctccccattttgcggaggaactggtagctcagctgtattgtggacattctgtcggaggaataaggttccattgtatgtgaaggctcaagatcgcccattatttgaagtcgcaattgcactattttcatgcaaaaaaaaaaaaaaaaaaaaaaaaaaa

SEQ ID NO: 20404 - DNA, 962 bp, Triticum aestivum
  Clone ID: PAT_TA_20404
cgattccgtgggagcagaccaaacaaggaggccaccagagcatggcgaccgcggcggcctcgtcgttgctctccccggcggcaaagttcgcgctcccgagccggtgcccaagcgccaaaactgcaccacgtagcgtccggttccccccggtgcgagcccagcaggaggtgaaagaggaggagcccgcggcgaccgtgccgccgctgcaggaggagcaggcgacggcggcggcggcggcgaagggccccgcgcagtcgctgccgcggcagcctctggcggagagcaagaacatggggcgggagtacggcagccagtggctgagctgcacgacgcggcacgtgcgcatctacgccgcgtacatcgacccggagaccaacgccttcgaccagacgcagacggacaagctcacgctcatgctcgaccccaccgaggagttcgtctgggaccgacgagacatgccagatggtctacaacgagttccagaacctcgtcgaccacctacgaggggagctccaactgtcagggagtacacgcttcgtcacatccggatctgatcttgagcactaccatccgcaagctgctctatgacggggagatcaagtccaaaattcggtacagagtaaccacctttagcatggaccaaccgccagatacaacaacaaccagacacctgccgtaatgtaggagtgtactactcggcgagactcggcgttctacacactcgtacacacttgatcttccatcagagagtagaaaatacgaaaccattccaacacatatacacaataatgcactgtacacgcttaacaagcaagtcccatagaaatgtgtatcaaaaacaacgcttataagggtgtgctcttaaaaatgttctctacaacaacacctttgcgccacataggcaacagaaagacatcaggacatccctctcacccgcgggcagcccgccttacagttctatt

SEQ ID NO: 20405 - DNA, 722 bp, Triticum aestivum
  Clone ID: PAT_TA_20405
tggaaggccgccaaggtgctcgtccgcaggggcgccaactggaagatcagcgacaggaagcactccgagatctcagaaactgaggatctcagcaagggcaagaggagggccggccttgttgccaaggtactgagagataaaaagaaggggaaaggcgctgccttgccgggaaacattcatcctagtagtggaattctgattaaggtaccggatgatgctgccattgaagcaccaaaaagaccaagaagctgcgaaccagtaccaatagcccaaagtgcacctattcttcagttaccaagttcaagtacctgtagccagccttgaaggtggctttaaaacagaaatgaaggcatgaagccaggaatcgcatagcaacatattttcattactttgggattaacaaatttagcaaactcattaagtttgtgttatcctcttcatctgttgatgtcttcattggtccctactagatataatgattcgcatcattcatggtatcttaagttggaacctgcaataatttcatgttcgaagatgaacttttgcaacttcgtctacataccggtgctagctaatgtggcattaggtatgggtttgatctattttaatggatggagtagatgatgtttataccgttagctcagttattgacttattgtacaagttcagttgctactatcggcaaactgttgcctgtaagttataaagaattgactgggggc

SEQ ID NO: 20406 - DNA, 745 bp, Triticum aestivum
  unsure (1)..(745): unsure at all n locations
  Clone ID: PAT_TA_20406
ccgacaacgctctctaccgtccgagaccccaggcaccaccgcggcggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtattgaattttaccactgataaactcagattccctaatgaagaaactggcagacattaatcgaatgcccattgttgatgtcaagacaaccgacaactacatgttgcgtttgttctgcaccggctcacaagagagcccaacaagtcaagataactgctagctaggatccagttcctacctccccaataaggtgttaatgggtcagatcacctaaacctttgaactttaataattttcaaatggtcgcaccgaacgcctccctccatttcgctttccgggcacacggccatccctggccngggtaggataaagattgtactagctcgaangngaagtccctattccngtcgangagttagatatcggatttcccattt

SEQ ID NO: 20407 - DNA, 289 bp, Triticum aestivum
  Clone ID: PAT_TA_20407
gaactctgctgcgtacctacaacagcgacaacagttacttaatccactagcggtggctaacccattggtcgctgccttcctacagcagcaacaattgctgccatacaaccagttctctttgatgaaccctgccttgtcgtggcagcaacccatcgttggtggtgccatcttttagattacatatgagatgtactcgataatggtgccctcatagcggcatgtgtttcctagaaataatcaatatattgattgagatttatctccgataaaaaaaaaaaaaaaaaaaaaa

SEQ ID NO: 20408 - DNA, 551 bp, Triticum aestivum
  Clone ID: PAT_TA_20408
cgtgggttccccggcgcacggttcctccccggcatccccatcgagcgcatcgccaaggcgttcgggccgagctcggcaggcgagcgctcgccggttgccaagccgacggaacctgatgcccagacttccaaggagcgctcggcggatgccaagccgacgggacttgatgcccagacttccgaggagcgctcaccggatgccaagcctatgggacttgatgcgcagaccgcggaggagagctcgtctgatgccaagcctgtgggacctgatgcgcagaccggggaggagagctcgccggatgccaagcctgtggaatctgacgcccatgccgccggggagagccagccggaggcggccaagactatggatcttggggcacaggcctaggtgtgcctctaatgataatgatgttgtactagctactatgcttttgtgtggtgcgcgtctctaatgttctccgtgcttttgtacaaaagttgcttgatgtcgccttcgtcgacttgatccaatgcaattgggttcgtccttctatggattcgcgagttcgtctg

SEQ ID NO: 20409 - DNA, 1551 bp, Triticum aestivum
  Clone ID: PAT_TA_20409
gaagccccctggcccgcatcgcccccgactcccgggaacgaacggcagaccgagcgccgctcccggacgcccacccccgacgggatcctgatgccccccgcttgccggaggagtgctgcagccgggctccaccgagtcccagtcgcattgcccccgcacccccccaccagctagcttccagaaaccccccgttcgttcgttccttcgattcgcaggcggttcgcgagcgatggcggacgccagcccgcaggcggagaggccgaggctgaggcgcctggggttcgtgcacgtggtggcggtgcaggcggccgtgtgcatcgcggcgctctacgcgctcgccagggaccactccggctcgctccgccccagagtcgacgccgtcgagtccgccgtcaggcgcgtcgccggccccgtcgcccgccgcctccacggcgtccccctccacgtcctcgccttcgtcgaccacaaggtggacgacgcggtgcaggagctgggccggcacctcccgccggcggtgaagtccgcgtcggcgcaggcgtgccacgcggtccacgccgtgccggagctggccagggagatcgccgacggggcgaggcggtccggcgtgaagggcgtggccaaggacgtgtacggcatggtccagccggtggccaagggcctctacgtgcgctgcgagccggtggccaaagacctgtacgtgcgctacgagccggcggccgagcacctcgccgtctccgcctggcgctcgctcaacgggctgccggtgttcccgcaggtggcgcaggtcgtcgtgcccaccgccgcctactggtgcgagaagtacaacagggtgatctcgttcgcggccgggcgggggttccccggcgcacggttcctccccggcatccccatcgagcgcatcgccaaggtgttcgggacgagcccgacaggcgagcgctcgccggatgccaagccgacgggacttgatgcccagacttccgaggagcgctcgccggatgccaagccgacgggacttgatgcccagacttccgaggagcgctcgtccgatgccaagccgacgggacatgatgcccagacctccgaggagcgctcggccgatgccaagcctatgggacttgatgccaagaccgaggaggagagctcgcctgatgccaagcccgtggaatctgatgcccagaccgccggggagagccagccggaggcggccaagactatggatcttggggcccaggcctagggtgtgacgccgtgcctctaccctgccctgatggacgaggtctgtcgcccttggccggaactgaataagataatgtggatccagggctaagaagatactggtatcctgggtttagcgtctcatcttagatacgtgctcacgggtgatgataatgataatgatgttgtactagctatactttacgtggtgcgcgtctgtctctaatgttctccgtgcttttgtacaaaagctgcttgatgtcgccttcgtcgactttgatccaatgcaattggattcgtaaaatcctgcgttacccaacttaatcgcttgcagca

SEQ ID NO: 20410 - DNA, 448 bp, Triticum aestivum
  unsure (1)..(448): unsure at all n locations
  Clone ID: PAT_TA_20410
agaggggagggtccgtaggctctcgtagcctccgccgcccatccggccggagcctctaccagcgacgccgcctgcctccccgcccgcccagcagcgactccctccccggagcaaccgccccgcccaaatccgccgcccggagccacgccgccgcgcgctccctcccacatccctcttctcggtgactggattggggccgaggaggagcctgcccttgtcgcccagcagctcccgctccaacggcctcgcccacaggcccggcagcgccagccgctcctccctcccctcctccgctcagccaaacacaaccttcgtctcgccggcgaagagcttcttgcgatgccctggccacgttgatgcgctggcccccctccctcgggcggggcggcaaattggggattccggncctccngaaaaaatccttctcnttcctccccgcaatttgntc

SEQ ID NO: 20411 - DNA, 1056 bp, Triticum aestivum
  unsure (1)..(1056): unsure at all n locations
  Clone ID: PAT_TA_20411
cggcacgaggttcttcacaaatcctaggaaacctttgattctggctgttgctcgtccataccctngaaaagaatagttctgctctggtgggcgcggttggtggccgctccccagcctcggagcttccgccccttgggtccgagattatccgggttctcacaaatcctaggaaaagctttgattctggctgttgctcgtccataccctgaaaagaatattacaacacttgtgaaagcttttggtgaatgcagaccattgagggagcttgctaacctaacactgattatgggtaaccgtgaagctatttccaaaatgagtaatatgagtgcagctgttttgacatcagtacttacattgattgatgaatatgatttgtatggtcaagtggcatacccaaagcatcacaaacactcagaagttcttgatatttatcgtttagcagcgagaacgaagggtgcttttgtaaatgtagcttactttgaacaattcggtgtcaccttgatagaggctgccatgcatggtttacctgtaattgcaacaaaaaatggagctcctgttgaaattcaccaggtgttggacaacgggctccttgttgatccccacgatcagcatgcaattgccagatgcactcctataagcttctttcctggacaagcaactcctgggtccaagatgtaagagaaaatggggctggaaaaatatacaccggtttccttggcctgaacattgccaggattcctggccgagggttataanccttaacccaagnacctgcttttcccgggcaatggaaaccaagattaaggacctatcaaaggaaaggagtgtacatccttattgcgtaatcctgccaacaagaantctggcctggtacaataaaatcctattggaggtacacttaagaaacgtgtcaagtcaacaagttgtgtgccactcctgacaatgcagggatcatccaataaaactgagnatggtccaagtttgagcntcaancatanggaggattattacctccggtgggttacagaattnccngaatnatnaccnattcatcaa

SEQ ID NO: 20412 - DNA, 782 bp, Triticum aestivum
  Clone ID: PAT_TA_20412
gctcaccgtcgccacctgctcccgtcctcagcatggccgcgctccgccccgccccccgcgccgccatcggcgaccgcgggccgtccgccgtccgccgcggctcccgccggccctcgtacctctccccggcgtccccgtgctggcagcagggaaatatcttgaaccgaaaatccaaatgcactaccagaaagctactgactactgttactggtgcaaagggtgatgaatctgaatttgatagcgtcaatgcaccacttgagccccaaacatgggaagggagcttcttgtgtggcttattgaagaaccagcctcaaattttcctagtagctgcagcaaagcaacttcagcgactgtctattcaaaggaaagacacactgacccgctgggaacatagtatcggttcttccgaggactgtcttcacaggagaattgctgaaatgaaggaccaggagtgcaggactgctattgaggacgtcatgtacatgttgattgttcataaatattccaagattgaggttccgatggttccgaacctatcaaaaatcattagtaatagaagattacacatatggccaccaagggaggcagatcttgaatccattcatggacctgaggtgctaggtcaaattaaggagcacttgactagcattatcagatgggtgcacaggaatggccccaagatcaatcgctcaacctttcgggtcaaagacttgcaattagaatttttacagccaattcagcttctcaatgctcaacttgcaactacccgtaaaaagaacagc

SEQ ID NO: 20413 - DNA, 556 bp, Triticum aestivum
  unsure (1)..(556): unsure at all n locations
  Clone ID: PAT_TA_20413
taatgctgctgtggccacggcgccgggcgacgacgaggatatcgacatcgtcgccattgtcaccggctgctgcctcgcctccgaggaagaatctaaggctgccggcggcggcgactacccgcacttggacctcaacctcatcatggacatcgtgaggatgaactagatagctacaaattaaagatatacctgccagtgcatggcgtccatgcgtgcgcttggatggtgcccccccccgacaggtggaggaggcgccgccgaaaaggagggacgggacgccagccgcagcagcaagcatcatcgcctcgtgcccctagctagctangtatacactggcacggcagtatccgtataatacatattattatactagtataatgtaaggtgtcatgtcctttaattttgaacttaactggattagtaccagatggagttttggacatgtattgtggtgttggttccgtctagctatatatgtgatggatctatatgttcggtaaaaattgagggcttctcgagtcgtgttccatgataatattgaattaaaaaaaaaaaa

SEQ ID NO: 20414 - DNA, 881 bp, Triticum aestivum
  Clone ID: PAT_TA_20414
cccacgcgtccagagacaaggtaggtaagtaggcaacttcctatactccctgccttcccttcttccatctttactccagtatattccatgggcctgcctaaatttcttgtcactctgctactgatctgccttctcacctatgaatcctatgtggatgcagcatcgggagaacaagatttcttaaggacttgttcatctcataggtgcagcaaacatggacctgagatccggttcccgttccggctttcgagccacccaccatcctgtggtgccccaggcatgcagttatcgtgctctggggatgacacaatctttgatcaccatgttcttggctcttgcagagtgactgagatctattacaggcaccgcgtcatcaacgtcgtcccgttagtggaaccatcaacacaatgcccacttcagaagctcatctcaagaaacttagcaaatgatgtctacgaacaacctcaatcatcatttcctacaaccctagtacgttgttcaaaagatttcataccaatagatcaagatagttggcccagcctcttgtctgggcaacaacgctagtcaattctggtatttggcatcagcttccgcatacatgtctgatgttccatgggactgtgtggccgtttctaaagacataccgatacccttcaccttgttgtgatgctctgctgatttatatttcctgcagtgcattattcctcactgggctcctcaggaaacacaattacaccctttgattgccacttccgttgtgctgagaatatcacaacatcattctacaggtcgactaatcatgccatgttccttcaaatctcagcagtccatagcactagcgtggaatatgtttcgatcttccccctcgattagcctcgtgc

SEQ ID NO: 20415 - DNA, 574 bp, Triticum aestivum
  unsure (1)..(574): unsure at all n locations
  Clone ID: PAT_TA_20415
ggaattatacctttttttttctctctctctcgcctcgcttccttcgaatccatccatctctcgcctccctttccaattcgatgcctttgtagcgctgctgcctcgcccccgccgcgtcgtcgcgggtccccggcttccgcttgctgctgcgcttccagcgccatggacggcgggggatccggcaatgcctccggcggcggcggcggcgcatcgacgtgctgctactacgcgctcctcggcgtccgcaagagcgcctccgccaccgacatacgcgccgcgtaccggaggctcgcgatgaagtggcacccggaccggtgggccagcgaccccggcgcggccggcgaggccaagcggcggttccaagcggatccaaggaggcctactccgttttgtcggacaaggggaagaaggccatgttcgacgccgggctcttcgaccccctcgacgacaacaacaagattctccgactcatgcaagagatctggtgatgaangataagtgaaaaacagaagccggacacgctagaggactgcagaaatctggnggacacgtgaacggnacggggggacgggtn

SEQ ID NO: 20416 - DNA, 902 bp, Triticum aestivum
  Clone ID: PAT_TA_20416
ccacgcgtccgctgcttgattctacaagtagatccctgaattcttcttttcttttagcctactttaatctttactcttctgttggatgatctgcaagccatctgttcgtaacttgatacgctgcaactgaaaagaacattcctagctttcctcagaattaggtgaatctaactactaaagctacaagaaaccacaagtgatttattcaataaaatataaaatataaaatcaacaatttacttgattaaaatcagtaatttactcaatggacggtcattttcgtggttaaggtttactagaagtactgtacatactaatctccaaccattctgttgattctgaagatcatgcatttactcagcaacaactcccagcatgcaagcctatactggcacccaatatggtcattcccattcttgtattcgtgggcttacttttcattccgattggtcttgcttgctacgcggcttcaaataaggtcttcgaagtggtttaccgatacgacacaaagtgcgtaccgaagaacatgcttcacaacaaagtgggctacatccagaacgcgtcgataaacaagacatgcacaataaatctcaagatccccaacgctatgaagaggccaatcttcatatactaccagctcgacaggttctaccagaaccacagaaggtacgcgacgagcttcaacatcgcgcagctgagcgaccccaaggaggaggcgaacgccgacataaaggactgcaagcctgaagcctacgccggcaaatgcatccccgtggtgccatgcggcctcgtggcctggagcctgttcaacgacacctacagcttggcccgccgtccccgtcgcgctggcggcatcggcggcgtcgaggcgctgagggtgatcaagagcgggatctcgtggc

SEQ ID NO: 20417 - DNA, 656 bp, Triticum aestivum
  unsure (1)..(656): unsure at all n locations
  Clone ID: PAT_TA_20417
gctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcactgcctactgcactggccttctgttggctccccgtgtgctcaagaccgtgggttaaataaggatatgagggaatgttgaggcactggtgagtttcccggttgaccaactgatgaaagagctttcctgcccccttggagttggccttatagacacgacgggaaccttcttgggcctcaaggacttggtggggctgattcccccagcaaaaagttctggtcaaaaggtgcaacactgatccgaacaccagttacacgtgcagtctcactacgataganccctaaaggcaaaattcnn

SEQ ID NO: 20418 - DNA, 632 bp, Triticum aestivum
  unsure (1)..(632): unsure at all n locations
  Clone ID: PAT_TA_20418
aaagctgatggatgacacagccgaggctaaggcttatcaagatgaaataaatgctgttctgggcgagcagctttcagctgaggatgaagaagctgtcatggccgagtttgaaaatttggaagctcagcttgccgttgagtctttgccagacgctcctgctaccgaagtaaggcctgaagagaaaacgaaagctccggctgacacagaagctgctcctgaggacatcgatgacgttattgagcttcctgatgtgcctacgaaagtgccagagaggcctgaactccaagaaaaaaacaaantttgggaggagccgctacctgcataagtggatggagctgagatgaatacggcacacttttagtttgcaggaaattgtaacatacccaccatttcattgtactatctcattctcagaatttcatcgtgtacagcaagaaaaatttgttgtctttgactatcagttgtcaccagtttggatttctcagtgcccgtttattatcctatcctacggggtaaacataatatttttccattgtgtttctttgtaaggcacaaatgctgaagtctgcaagcacataccttgttccgtatgaatatatacgtgagtttttttgggtccctaaaatcaaaaa

SEQ ID NO: 20419 - DNA, 637 bp, Triticum aestivum
  unsure (1)..(637): unsure at all n locations
  Clone ID: PAT_TA_20419
cacggttgaggatgaggcttttgttggcatgggggcaaccctattagatggtgtcgttgttggaaagcacgggatggtggctgctggagccctcgtacggcagaatactaggatcccttgtggagaggtatggggagggaaccctgccaaatttctgaggaagctcacagatgacgagatcgctttcatcgcggaatcagctgccaactattccaatctgtccaaggtccatgctgccgagaatgccaagcctcttgaaaagattgagtttgaagaaggtgttgcgcaagaagtttgctcaccaggatgaggagtatgattcctccatcgggcgtcactcaaggggccccaccgagagctcacgtccccaaatccaacccaatgaacctctgtttctgttcccccttcgccgcctcgccctatttctgtgggtcggcgccgctgcgttggtccgggccctgtcccaggccacggggggtgttgcttcccccccccccctgggtccccgggtttcaaactggctgtactcccaaatcgtatcgnagttaanagnccccggagatcacaaaaaagggggccggacaatccccaaaggatcttacccccangctcgttaanntcnacggaaaccgggtac

SEQ ID NO: 20420 - DNA, 672 bp, Triticum aestivum
  unsure (1)..(672): unsure at all n locations
  Clone ID: PAT_TA_20420
gagggccccgtcctcgccttccgcgacgtcgcgagctggcgagccgcctgggaggccgccgaggccagcctcgtctcccagtgcgaggccggtgcaaggtcagggtgctcagtcagcgcatcacgcaagtgcaagccaccctggtggaaacgcttacttgtagttgtagctgctgctcctccgacggactacgaggagaggtcgagatgcgaggagcgcgagatggccgcctgcctggaggcggcgagggaggcctgcgctaagttcgcgaaggcaaaatgcgcggggccattccaggacgcaaggatcgcccacgagggcgtcctagcgaacacgggtttcgatgtgtggggggccgctgctgacaagagttcctcaacggcggcggcggcgtgtgccctgaacgtccagcgtgtgtagcccaggtcctggcgcgacaaactacagaagggagcgatgtatgtgcttggcagattgtgcaaccaaaaggtgatagcggctctggacagtgaccgcccgaaggcgcgctggaacagtgtccagacatggcgtgagtggatccgggaatttggaatccggacgcggcatcatcaaatggcggaacacgcgagcgaagccccccggttttgttttgcatttgttctacactgaanggtattaanttcccggggt

SEQ ID NO: 20421 - DNA, 525 bp, Triticum aestivum
  unsure (1)..(525): unsure at all n locations
  Clone ID: PAT_TA_20421
cacacctggcggaagcaggagcccaaggagccgcagcccacaggatcaggtgatgagcccaccacctaaggataacggcgacaggaatggttcagaccgtggcgacagccccagagggagggaaaacagcaggagccgcagccgcagccgcagcccatccggtggtaaccgcagccctgcagctaatgggcgtagcccgagccccagaggtgaccgtacccccgagccccatggctgaccgtagccccgagcccaaagggcaatggtaacaacgatggtgggtgatgatgatactggccgtggtggttcccccacaggaagcaagtcacccctgaacgctgcaccgtctcagttcctaaggtgcttcctgatgcaagtgggcaaacataccaaagacgtgatactgtaccgtcccctacctgagcctggactttttagcttccttgggattggtgtctattccctataataattggacaccattttgtcgcctagtggtattactgaatcatagntcagtctgtt

SEQ ID NO: 20422 - DNA, 606 bp, Triticum aestivum
  Clone ID: PAT_TA_20422
gtgacctcctgcactccagcttccagcagactactcataactcgggccgctctctcggcgtacgtgtgatgatctcgccacgacagagcagcgaggccaccgaggtgaggcggggacgtagcgcacacatggcgaagtttgctctagggcaccacagcgaggtcaccgaggccggctgcgtgcgcgccgtgctcgccgaggccgtgctcaccttcctcttcgtcttctctggcgtcggctccgtcatggccgccgggaggctggccggcggcgccgacacgatcatgggcctgacggcggtcgcgctggcccacgctatggcggtggccgtcatggtgtcggcagggcttcacgtctccggcggccacatcaacccagccgtcacgctctccctcgccgcaggcggccacatcaccctcttccgctccgcgctctacgtgctcgcgcagctgctcggctcctccctcgcctgcctcctcctcgccttcctcaccggcggcgcggtgaccatgccagtgcacgcgctggccgccggggtgggcgcgccgcagggggtgctctgggaggccgtgctcaccttctcgctgctcttcacggggtacgcga

SEQ ID NO: 20423 - DNA, 1325 bp, Triticum aestivum
  unsure (1)..(1325): unsure at all n locations
  Clone ID: PAT_TA_20423
catcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggtgcactcacttgaagggtggtgccaagaaggttgtcatctctgctcctagcaaggatgcccccatgtttgtcgttggtgtcaacgagaaggagtacaagtctgacatcaacattgtctccaatgctagctgcacaaccaactgccttgctccgcttgctaaggtcatcaatgacaagttcggtatcgttgacggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtcagccacctatgatgagatcaaggctgcggtcaaggccgaggcagagggtagcctcaagggcatcctgggttacgtcgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaactaagatgaagaaatcaagtcaaggcctggtgatacgagcgatttgtcttcctcccccccgggacaaaagtgcttcccgagaataaatttttccatcggaatgtctgaaactatgttgggggtatcctaagtggttgggtggagcactaatggctcatatttgtcaagtcatttgtcccgtcccttttttaaaaaaaaaaaacattcagccggccgcccccgcccaaaagatctaaaccccnaggntctttaatna

SEQ ID NO: 20424 - DNA, 669 bp, Triticum aestivum
  unsure (1)..(669): unsure at all n locations
  Clone ID: PAT_TA_20424
gtcgccctctccatctgccgtcctctatgcgtgcaatgctaagctgcctctacgtgtagcggcagaccgagacgcgcgcatgccgcggtcgtccggttcccttccctccatcgcgcctcctcgccctgcgcccattccccccggaggccctcgcggctggtcgccgtcgtcgcccccgtcgcgagcctctgggaggcggccgccgcgggcgccgtcgccccttcgtaccagacgtcctcggggaggccgtacttgatgagctcctcgttctcgttcttgtcggcgcccatgtagatggtgtagtcgccggcgtccggcacgcgccttgaagtagagcaccatcgccggcgccgctcctctgctctctccccctcgctctccgcgtgcgggccgggccggctctcctcctcctcgagcttccgcgctgcccccctgtgtccacgcgcccctgcgtagcggggtcgtcccgcgcccggtgcagaggcagtcccccgcgggggtgcggcaacccccgcaggcgcggnccgcgccggaataataagcggangacaatngnggaanaaaaaaaaancaggggggccgtcaatngccaaaggncnatanccccaaaggctcgttaagtncganggaaaccgggttcaataccttgaaaancccttgaanggtatg

SEQ ID NO: 20425 - DNA, 547 bp, Triticum aestivum
  unsure (1)..(547): unsure at all n locations
  Clone ID: PAT_TA_20425
aggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaactgagcttgtatcctggtgcactctgcgctggaaacttttatgtcgctggcagtcgtatcggttcctgttttaccaatgtttagagttttttgagacctatatgcggtttgggtttcaagtgcacaattaaaattactgagtaatgtagttgattgggaacagaaatgtttgggtgcctggtttaccgaactccagttctcttgccatttttctctaccagccgtcggtaagagaataaatatgagtattgagatgatcctgcattngaattgtctgctttgtnccgtcgctngtatgcntaccaatggtaacaggtanttgtggaaattaaa

SEQ ID NO: 20426 - DNA, 911 bp, Triticum aestivum
  unsure (1)..(911): unsure at all n locations
  Clone ID: PAT_TA_20426
caggcctggagggagaagcaggagacagtttcatgataggatatggagcaagcagacgaagcatcgtcggtgaacaaggggagcccagagcggcttaccatcgaccaggacgacggcgcgtcgtggctgagcctcacggtcggcgcaaacgagtcgctggagacggtggcaaactgctccgagcctgagcctgatcctgagcccaagccttctgctaccccacacaaggttttctcatgcaacttctgcatgaggaaattcttcagctcacaggcgctgggcggccaccagaacgcccacaagagggagcgcagcgccgccaagcgctcctaccatgcacagaggatggtgatggggctgcctctcgaggcgcacgccgcctttgtgcagtccctgagagttagccagagctcggtgattcagaagtcgagccagccaacacaaatcaggacagcaccaaggttcatgaagatgggatgacctgggcaacaatccctgcgaggaggtgctcaactcaacatggcacgagaacctcaagagcgaggaccctaccgtccacgacctccgaccatctagatcgactgatccaaccttatcacctgctttcgactgtggctgttacatctctcgatctcctctgaanccctcatcaattttgtcctttccngaataaattgggcatgaagtgatnatttaactcaactcaacatcanaatccaaaatggtactggactatgnaagatatgtttntccttttgaattcctggngacccnctncatattatttnccagtnttntaatagataatatgtnnccaattgacacggtttaaggaccanggattttgtctacnaaacncatataaagtccnncatccccaataaattcgaattttnntnaaaaaaaaaaaa

SEQ ID NO: 20427 - DNA, 608 bp, Triticum aestivum
  Clone ID: PAT_TA_20427
atctggccttggatggaaaggacttacatggacgcaatctacgggttagtgctgccactgagaggactgctggcttccgtaatggtgctggttatggaggtggtggtggcagctttggaggaggaggatatggcggtggtggctatggaggaggtggttatggtggcaacggtggcggcggcggcggtggttatgccccccctgtgggaaatgatgccttctctggaggcagctttgctcctgctggcagcggcaactttgctgccggcaactttggtggaaaccatggtgctcctgcaggttccaccagtggtgatgagttctccctcggcacccctggttccagctttgaaagcgccaagaatgacgatgtcatggacgacctcttcaaggatgatgaacctgacaagtacgccagcaagaatgtctagggctccagtctgcatctccttctgcaagtccctaaatatgtaccttggataagtgtgaggtggatgatcctccagcccagagactactttcttgatgactgtctagataccaaaataacttatgcaagtacctgcgttgaggtgacaatgagaatgactttctgtttgcctgattta

SEQ ID NO: 20428 - DNA, 891 bp, Triticum aestivum
  unsure (1)..(891): unsure at all n locations
  Clone ID: PAT_TA_20428
cgtccgcggacgcgtgctctctccccccggtccgcgtccgcgcctatcgaactcgtcgagtgccgcgaccgacgcacgcgcgcgcggcggcgagatgaaggtctccgtgaagacgctcaagggctccaaattcgagatcgaagtgaaccccgcggacaaggtttctgatgtaaagaagctcattgagagttcacaagggcagaatgtgtacccagctgatcaacaaatgctcatttaccaagggtcagttcttaaggatgagactacgttggaggaaaacaaagttgttgaaaacaactttcttgtgataatgcttagacagaataaaggctcatcaagtgcagctccagctaaatccaaggaaccctcaaatcaggcaccccctactcagacagtgcctgctactcctgcctctcaagcaccagccacaccagcacctcaagcagtggctgcgccagcacctattgtacctgtcagtgctcctggtccagctgccaccgcctccccagctcctgctgttgctgtctccactgaagcagaaacttatggtcaggctgcttcaaaccttgtcgcgggaggcaccctagaggcaacaattcagtcaattcttgaaatgggtgggggaacatgggacagagacactgtgttgcgtgccctacgtgctgcattcaacaacccggagcgggctgttgagtatttatattctggtattcctgagccgatggagattcctgcaccaccaccaagtgcccagccagctgatcctgccctggcttcgcaagcagctcaacctgcagttgcctcttccggtcctaatgctagccccttggacctcttccctcaagccctgccaaatgcttcagcanatgctgctggtgaggaaatctgatg

SEQ ID NO: 20429 - DNA, 994 bp, Triticum aestivum
  Clone ID: PAT_TA_20429
gcgagggacgacgaggcgcacctgccaggtctacacgcgccgccgcctccaggaccctccgcccctcgccgccgcctccaggatcctccgcccctcgccgcctccgtcctccactgcagcaggaagcagattgaagctatggccttggttaataagcttggtaatctgctcaagaaggccactagctcgaatccgactctctatcaggcaataagatgcatgtcatcatcgaagctcttcgttggagggctttcctttaacacagacgagggcagtctgagagatgccttttcccattatggagaaattattgatgctaagattatcgtagatcgcgacactggaaggtctagaggttttggctttataacttatgcagcagaagaacaggcttcatctgccatcatggccttggacggaaaggatctacatggacgcaacctacgggttagtgctgccactgagaggaccgctggcttccgtaatggtgctggttatggaggtggtggtggcggctttggaggaggaggatatggcggtggtggctatggaggaggtggttatggtggcaacagtggtggtggcggcggctttgctcctgctggcggcgacaactttgctgccggcaactttggtggtgaccgtggtttcggtggaaacccagctggaaaccatggtgctcctgcaggttccaccagtggtgatgagttctcccttggcacccctggttccagctttgaaagcgccaagaatgacgatgtcatggacgacctcttcaaggatgatgaacctgacaagtacgccagcaagaatttctagggctccagtctgcatctccttctgcaagtccctagttatgtaccttggataagtgtgaggtgaatgatcctccagaccagagactactttccggatgactgtctagtagagaccaaataacttactcgagtacctgcgttgaggtgacaatgagaatgcactttcagtttgcctg

SEQ ID NO: 20430 - DNA, 1587 bp, Triticum aestivum
  Clone ID: PAT_TA_20430
ggccagcgccccgacccccccccccccccgcgcctccggctccgcgtcaccaacgcgtccgcccccgcgaccgacgcacgcgcgcgcggcgacgagattgaaggtctccgttaagacactgaagggcaccacgcgcgcaatagtagtgaagcccggcgacccagtcactgatgtgaagaggcgaattgagactctccgtgaagacgaatgtggactcaacattcgaaaacatggtgaaatccgacgactagggttcttaaggaaagaggctaaatgagagttaaccagggtagtatgtaaacacaattgatgcacaaatgctgcaacaccaacagaaagttttaaaggctgaaacttcgttcgaggacaatcagaacgttcaaaataatcttccctccaaaccaccaaaatggcctaacgactcatcactggcaagcacatctacatactatacaccttaatgcacggctccccctgctcataccgtgcctgcctgctaccctgcctctcttgccaccatcgcatcgccaggctcagcaagccagtcccctgggctcaggacgctgattcaggtcacccaggcagtggtcctgcgatctacgcaaagagagcaccagacggtgatgtcttgaaatgtgtcgtggaagatggttccgagacactgggccgcgtgccctacgtgttacattcgacaacgaatgacgctattatttgtatcttgattctggaagagctgagacgaaggcgattcctccagcacgaccaagtgcccagtccgctgatcctgccctggcttcccaagcagctcaccctgcagatgcctcttccgatcctaacgctagccccttggacctcttccctcaagccctgccaaatgcttcagcaaatgctgctggtgaaggaaatctggatgttttgcgtaacaatgcacaattccgaagcttactttctttagtgcaggccaaccctcaaatcttacagccattgcttcaagagctgggaaagcaaaaccctcagattttgcagctgattcaggacaaccaagcagagttccttcgtttaatcaatgagccagctgagggcgatgaagacgagaatctactagagcagtttgctgagggtgtgcctcagaccatagctgtcactcctgaggagaatgaagctatacttcgtcttgaaggaatgggctttgaccgggcgcttgttctggaggtgtacttcgcctgcaacaaggacgagaccctggccgcaaactacctgttagaccacatgaacgagtttgacgacggagcgccgcagtaagacaaagcaggttgtttctgaatacatgcacaagcccatgggaacaagggtgtggggagactgatactcctgcactcgcagggcaggccttagagatctttttgagattttgtctcgtcctttagtttgtaattcttttctgccttgctattagtacatactctagatcgtctttaaatgttaattcacagacttaacgacagcgtataaaagttctctgtcagtttttactggatctgctgatctagtgataaacgaagtcgatgtaaaataaaaaaaaaaaaa

SEQ ID NO: 20431 - DNA, 359 bp, Triticum aestivum
  unsure (1)..(359): unsure at all n locations
  Clone ID: PAT_TA_20431
gcgagtgcgagctgctggcatgtgtaaatatatacaagttcagaatccgcccgggcgggtcccaggtagctactacatgctcatcaatcagtaacacagtacagagatcgagccgcagacagatgtgcacttattaggttcagaatgagcactgaaggaaccaaaccaacatatgtttatcagtctgtacagtgcattccagagagcgagcctgcagacagatgctgatataggttcaagaataaggcgtgaatgtaaagtgttaccacggcgattcttggttaatctctcctatcaattgcatgcgtgcgcttttaaaaaaaaaaaanaaaaaaaaaaaaaaaaaaaananaacaaaa

SEQ ID NO: 20432 - DNA, 642 bp, Triticum aestivum
  unsure (1)..(642): unsure at all n locations
  Clone ID: PAT_TA_20432
ctgcaagaaacaaaccaaacaaaactcaccggaagcttcccaaacacccaagtctttggatctgcattgcctttttttatcaaatctgcatcaaccagatcggaaagcttggcaggatccatgtaacatatgcgggggactcgcatgtcaggctccacggtcttgccacggataaggcagtcaaggtacattaagtacaggccctatggcacagcctgtgattgccctccccagggtatcaccactttgggacttggcaacagcccttctaagctcatcaaaccatcagctgggcattaatccatatttgccatgtcctccaaagacgagaccctccaaacattgctgcctctcctggaaacacccggggcagttacaaggcaacacaaccttcattaacacaaccatgaagacacttccaagagcaaggcaccttgccaggtcctttgacgacacttgacttatcctcaancctgtcccgggacaccgtccccccactgtgtctcctccgtactactgcccctcgtcgcctcccgaccgcctccgccgctcgacccaacggcactcgtagggcccaatcggcgccacaccctatgcgctaccctccacccacccgtgancctcgacccatcacccccttaa

SEQ ID NO: 20433 - DNA, 619 bp, Triticum aestivum
  unsure (1)..(619): unsure at all n locations
  Clone ID: PAT_TA_20433
ggccatccccgcctccatggccatccttgccgccgtgtcgtgcatccggcgaacccctagagatgtataagaacacgcccacgcccccgacgaaccctagcttccccctttctccccacacgcgccgctgctctcttccccatccacacccgacgccaccgtcgccgtgccgtcgtcgttcgcgcgcaccggaagctccctacgccacctggggacgtccaggaggaccgccactctctccttcgtccgtcccgggggccagctcaagctaggacaccgcgtagcctcgccatcgcctcttcttcccgccacggtcgtcgcgcgtccccgccatcgatttccaccaaccgggcctcccccggcatctcgactccgtctacgactcccgatgccgggagcccaagaccaagacccacgtcgatgacgatcctaatacaccggaggggctactacggctgcatccgtttgatacaaccggattatttagaggttcaagaagaggttcnctcttcattngttcccattgtgcgacctctaaggatctgttaactagtcggccaaaatgtctccccggctcangtnacatgttancctcaggctggnttatagagctttactt

SEQ ID NO: 20434 - DNA, 1085 bp, Triticum aestivum
  unsure (1)..(1085): unsure at all n locations
  Clone ID: PAT_TA_20434
aggctatcccgtcgtccccgcttcgccagctacccccacggccacggagtgagcatgagttgaatcgtcgcaatatccatccatggctccgccccgccgttgagtcagtttcgcgagccgatttagtccactcccgtcaaccacgaagcagatcgctgctgccttctcgactccactgcagatctcacgctttgcgctcgcgcgagcttccgccagacttgatcacactggtcgtttgctcagcacgtacgctgctgtccctctctattggccacctactacaagtcttcagaagatcaaatggccgaggcggtactcattgctgtgacgaagattggtgacattttactagaagaagccaccaaaggcatcatagctaagctttctgaaaaagttactaatctgaaggaactgccggtaaaggttgaggaaataaagaagcaactgaccatgatgggcaatgttataaggcagataggcacggtatacctcacggacgacgttgtcaagagttggattggggatgtccgcagggtggcctatcatgttgacgatgtaatggataaatactcataccaccttcgtcaacttcagaaagaagggttcctgaggaaattcttcatcaaaggaacacattatgccatagttttcactgaaattacagatgaggtagttgaggtagagaaggagattcaactaggttataaagatgaaagagcagtggatgcagccttccagcttgtcgctaacccacttactgagatggaaaggcagcggcccaagacagttccccgaaattgtcaaaagatggaattctagtagggattgaaaacaacagattgggtaactagatggtgtacccngaagaccaagagacagagaacaacgtgataacanttcnaaatcanccttggttcnaatgttacgaacgtgaaantcacttccctgacatcangtcttgtnccagttacacggtnaccccgttnaggactacatggagtcgttacgacacatgcacaggatganaatggctgtagactganaggatcacagnatgtanaaaatntgtgcgtanttgacagntt

SEQ ID NO: 20435 - DNA, 591 bp, Triticum aestivum
  Clone ID: PAT_TA_20435
ccacgcgtccggccgcgtgactctcgcgtcgtcgcatcgcgcgcgctgcacaccaccgtcagcgcgaccactgccgccaatggcgaccgcctcgccgccgctcgccacccccttccgcccgctcgccgtcgccggaggtagcggcggactcgtcgtgggcgccagggccgtggtaccgccgaggcgggggcggcgggggttcgtggtgcggagcgtggcgagcgatcgggaggtgcgggggcccgccccgaccgaggaagagctttcagccgtgctaacttccattgattcatccgccatcgcatcaaacatccagcaccatgcagacttcacaccgttattctcgccagagcactcttcacccctaaaggcttaccatgcaactgccaaaagtgtttttgattctctgatattgaattggaatgcaacatatgactattacaacaaagtgaatgcaaagcaagcttattacctatccatggaatttttgcagggaagagctcttacaaatgctattggcaacctagagctaacaggacaatatgcagaagcgttaaaacaacttggacagaacctagaggatgttgctag

SEQ ID NO: 20436 - DNA, 456 bp, Triticum aestivum
  Clone ID: PAT_TA_20436
ctttaaagtattacgtgtactagttatagaggatggtgtttttcctgaaggccgtagtctcaaggatcttggcaagttggtccagctgaggtacctaggactagtggggacgtcggtcaagctcccagaaggaataggacatgatctaaaatttcttgagatattggacgtcaggggaggtgccataagtgagttgccatcatctattggtgagctaaagaatttgaggtgcttgtgggctgataagggtacagagatgaagggtgagatagagaaactgacatgccttgaagagttgcagctttattcggtggacaaatgtccaaacttttgctctatggtggggaagctaacagagttgagggagctcaacatccatttcaaccaaatggcagagacggcgggcaagactctggtggagtctctgtgcaacctgcgcaagatccgcagcctggc

SEQ ID NO: 20437 - DNA, 1107 bp, Triticum aestivum
  unsure (1)..(1107): unsure at all n locations
  Clone ID: PAT_TA_20437
ccacgcgtccgcacacacacattaacacaacgactccccatctcatccttccccatctcatccgttcccttgagagctgcagcggcggcgcagccggggatgccgatgggtgggcggatcaggaccaggggaacggcgggagccgcggcgggggtgaggcgaagcggtcggagatctatacctacgaggccggttggcacatctacggtatgaactggagcgtgcggcgggacaagaagtaccgactcgccatcgcaagtcttctcgagcagctcgtcaatcgcgtggaggtggtccagctcgacgagtccacaggtgacatcgcccccgtgctctccttcgaccaccctttccctcccaccaagtccatgttcgtcccggacccccaaggcctccgccccgatctgcttgccacctctgcagacctccttcgcatatggcgcatcacggacgacgacgccgctgccccgggcgctgccgactccaacaatggctccgtccgctgcaacggcgtggggggccccgctggtcagcagccgggcgtcaagctgtgctgcgagctcaacggcaaccgcaacagcgactttactgcggccctgctcaccttcctttggactgggaacgacgccgacccacgccgcatcggaacatcatccatcgataccacttgcaccatctgggacgttgaacgtgaggtagtcgacacccagctcatagcccacgacaaagaggtctatgacatagcctggggtggcgctggtgtctttgcatctgtttctgcggatggctcggtccgcgtgtttgatcttccgggataaggagcattccacaatcatctatgagagtattctgggcggcggtccaattctggctgctaccgatggtgggctgtgttnccgacacatttggttaagctggggtnngnacaagcaagacccaangtatatngnaacatcatcaatggtanccaaggtggcctgctttaatncgctanccaacgctcctgtcnttganccaacggcatcaagccccgggaatgnatccaatgggctaancttcttgcaaattttanaattgggaatncccaanaatnnttggaactcccca

SEQ ID NO: 20438 - DNA, 307 bp, Triticum aestivum
  Clone ID: PAT_TA_20438
atcctgggcgggcacaagaaggaccgggcagcgcggagcaaggacgataggtagatagattgttgctctagtagctagtaagataggatgatgattgcctgcttgcttgcttgcttgctgtagaatatatatatatatatatatatatgtatgcatggtatggtttgtagttgtagtagtagtagagcgaggaggtatgcatggtatatgcttaattgacctgatattggcgattaggaattattactgtggttcctgattggtgtggtgtcttgcatgtaaaaagtttttggctagtgtctaaaaa

SEQ ID NO: 20439 - DNA, 1469 bp, Triticum aestivum
  Clone ID: PAT_TA_20439
gccgtccccgcgccgcccgccctccccctgcccacccccggccccgtaaccatgtcccgccgcccccccccccccccgccccaccgccttccccgtgtcctccctccctacccgcatcccttcccccccggcccccgccgccccgcggccgcgggccgccgccgtgcccggacgcccccgccgcgtccggcgggtcttggcgtcgccgccgccccgcctcgtcatcgccggcggcccgtgcgcgctttacaagtgggtgcgagaggacaggttggctgctcttaagtccaaggacaagaaagaaggggcatgcactgcaaagcctgaccctgccaccgaggttcttttcttatgcagctatgatggctgtgggaaaacttttgttgatgcaggtgctcttaggaaacatgcccatgtgcatggggagaggcagtatgtctgtcactatgagggatgtgggaagaaatttttagatagctctaagttgaagaggcattttcttattcatacaggcgagaagaacttcgtctgccctcatgaaggttgtggcaaggctttctcattggattttaatttgaaggcacacatgaaaacccattttgcggataactatcatatgtgtccatacccagaatgtggtcgaagatttacacaggaatctaaactaagggctcatttcagggcacagcatgagaagtctggtgcacagaatccaggtgggcctgtaatgaaccgcaatgcactaggagatcaccctcataacacagcgaaatctctggtaacaccaccagttccatcagctgatcgtccgtatgtctgcccttacgatgggtgtgccaaggcatacattcacgagtacaaacttaacctccatttgaagaaagagcaccccaaccactattcagatgctggtgctcaagctggtccgtcgaggggcacagtatcgaagaattcccgtagaagcaagccaaacctcacaaccagcatgccactcgccaagatctctaagcgcagcggttatacggtgccatctccagctgtcagtatccctgaggagcatcagtggccaaggaaggtgttgtacgaagatgatagtgaggagaccgaggaagagggagataaccttgaggaggggggattgagatacagagctgctagcgacggcgatgacgatgaggagacggaggaagaagaatgagagctatgggttgctgtgcacatagtttatgagcaccggactggattatagttctgcatacatgtaacaatacatattaagggtggctagttaggcagaaacttgtgggctgcatgtaggtgtctcaatttaaggctattaaggctgtgttcggtagccctccactcctccattcaggagcggagcgggtggagtaccatattagcagctcctcaaattaacactgcatgttgctccgctccggagcgcagttggagagcgggagggagtc

SEQ ID NO: 20440 - DNA, 630 bp, Triticum aestivum
  unsure (1)..(630): unsure at all n locations
  Clone ID: PAT_TA_20440
ttttttttttttgtatgcaggactaccttgcctcgcgtgctgctcttgtctgttcttgtgtagcaaaatcttattctttgtactagcttctttctctgtacactgtgtagtgacaaatcagcaaaatatacatgatctagctaattaagttatttttcttctatgtatacatgaaatgactagatggtgggcgtcatgatgttgagcagtgaaactctggtctgcacaatgctcctgaacaccaagccgcaggcgccgtcgcactccgtggaggcaccgttccagcgcgcacagctctccatggcacctccggcgtctcctgtgccggtgaccttccctgggtgggcgaacgcccggaataaacgtggcgtcttccttgcaatccgacgccgccagacgacattgacgccagcggcccgagaacaagnccnccgagncgcacgcggtttttttttaatggnggaagcaatattgngaaangatttcaagagctccacaacatanccagggnacaatatanacctacgganaacttngccattagccganaacatcacatatcaacncaaacctaagancaaccaaaaacgggacatnacaacgntcacaaaaaccatggcccatgtannc

SEQ ID NO: 20441 - DNA, 617 bp, Triticum aestivum
  Clone ID: PAT_TA_20441
ctcgtgccgaattcggcacgagctcgtgccgaattcggcacgagcgccgccttcgctagcggacgagcccgccctccccaaactgcccctcgcaccgtcgcctccaaaaccacctccggcttcctcctcactcaggcccctccgctcagccccgcaccgcgccgatggccgattcgccaaaccctagctccggggacctcccctcagccgccgggagctcgcccgacaagccgtaccccgcggatcgacgcgtcgcggcgctcgccggcgcgggcgcgaggtacaaggccatgtcccccgcgcggctgccgatctcgcgcgagccctgcctcaccatccccgccggcttcagcccctccgccctcctcgactcccccgtgctcctcaccaacttcaaggttgaaccttcaccaacaactggtagtctgagcatggctgcaattatgcacaagagtgctcatccagacatactgccttcgccacgggataagtctattcgagcccatgaaagatgggggttctagggattttgaattcaagcctcatctgaattcgtcttctcaatcactggctcctgctatgagtgatctaaaaaaacacgagcattctatgcaaaa

SEQ ID NO: 20442 - DNA, 414 bp, Triticum aestivum
  Clone ID: PAT_TA_20442
gacacaaacaggtatggggatatagtatgaatcgctcaaacataattatacagcccactgggtaactaagcatatagtccgaactgcagagatacaccccagaactaattctgtaatatggacagcactttagtcacctttaagacatgacatggttgacactatcagcacatttgggatacaaaaatttacaccacattagcgaggactcaggcgtgaagtcggaaccgatggcattctcaagtgggatacatttatacttcctcgctaccgctgctgctgccgcccttccggatactgaacttgcacagggggcatgttgcgttgatgagcagttctatgtcgctgcaggcacagtggaaatggggccgagacgcacgctcatcgctgcaatgcagccaagggagttcccgt

SEQ ID NO: 20443 - DNA, 748 bp, Triticum aestivum
  Clone ID: PAT_TA_20443
cacgaatgggcatttacaagattacatcgctatggtattgtgtaacaaacagttttagctgatatacaccacaatgtgtaacttcaatacacaatgactaccatgaccatatataaatacacaaattaacatgaatcacacttcctttgttatattagctagggcgctcaaattcacaatcaggagtttatcatggataagtaccgttgtcgtgacatgagtcgcccgtcgaatatttggattcacacttggagatttatacttcttcactaccactgctgctgctgtttttccgcacattgaacttacacaaagggcaagttgcattgatgtgcagccacttgtcaatgcaggcacagtggaaatggtggccacaagggagttcacgcagctctgcaccatcatcgtatgctgaaatgcaaatgcagcactctgcatcttcagctgcaagtgctttctctataggttggttggtgccacactctatcattattccaccagaagactcagtggcatcagcggaatccttttcaggttcatccatcctacggaatttgtatttcggaatttggcgaatgtcatcttcagatgctccttcctgatcagagacagcatacagaattgctataatgcaagggaggcagcaacaaacggcaataccaataatgcaagccagagcgacacagaaaacaacaaagaacacatcaaacgccaggaagactatgcaaagccagtatagttgaggtgc

SEQ ID NO: 20444 - DNA, 1095 bp, Triticum aestivum
  Clone ID: PAT_TA_20444
ggggcagcagattcaacttatttatttattgagagcaagatagataaacacttgaaaacaacatataattgctacaacaccaacccaacaataaactggcatatgcacatcgcatatgcatctccaagacgattatcttccttggagcttacatatttattctttagttagacacaccgcatgacatgcgaccacatacaatacacataaaagatgtagacatgggtggaactcaaagaaaatgatgcttcaagttcaagccatacgtacgtcttaatgttcatctgttaccgtgtggccccctcctgaagattttagttgaattctgggaggcttttgggatttcgcttgcttgaaggcaacaaaacctgttacgaggactgtttaggcaattctaatcgaaccggtaggtttcgcgtctgcgcctcgttcccgaccgtttgggcagaagtaaagaagcccagcgagaagataaaaagcctcaaggcccatttccccatctctatcatcggcggcggcggctcgagcagaggaaaggaagctttctaccctagcagagaaaaaaaaagcagaggagaggaagcggaggcgacgatgtcggcgatgactgcggcggtgcccttctggcgcgcggcggggatgacctacatcggctactccaacgtctgcgcggcgctggtgcggagctgcctcaaggagcccttcaagaccgaggtctcctcccgcgagaaggtccacttctccctctccaagtgggccgacgagaagcagcagaagcccactgtgcgcacagatgatgaatgaagatcgggtgccatggtgatgttttgagaagttgttgatttatggtcagggcttaagaacttgagaataaattcttgcggtgacaatggatctattccgatactatgttgttatatttactaattgctcctgttctacttgatgaaccatgtgaaactcttgtcttgtgctgctcgagtgagcgtgtttttatgcattatatcttctgatgatttaatttggtatatattccaaagcttatgaataaactgttttagccaatgtcaaaaaaaaaaaaaaaaaaggccccta

SEQ ID NO: 20445 - DNA, 2557 bp, Triticum aestivum
  Clone ID: PAT_TA_20445
gctgctacttattcaaaatcgtccacgagttaaaaatattccacaccagtgattctcaaacctccgtatggagtggaaataacagcaataccgtaataccacatattaaattctcacaagtattaactacaggaaaaaaaggacgatagctcagctaggttcaagagcacgaatgctgtcaaaacagttgcttccatcacaagttcttgaacgcggactcgttagggagcttaggcgtgagcctctccagcaaggccttgttggagaagtgatcggcgtcgacgaagtagaagttcccgttagccctgaaggtgacgaaaggtcggttggtctccgcgggcctgatgtcagcaaacttgatcgtcttcttcaggggtgtagccagccatgacattatctctgcctcgaagctgtctgaaccctgccgccatctcagcttatggatgtacgggctcacgaaccagtgcagggctgcagttgtggtggcactgaggaagatcacggtggatgcgactcctcccttgaggatcacattcatgtcgggcgaagtcatgaatgttatgacagggcctagcgagacggagaggcagcaggtggacagggacagaagcttcactttcttgatgccggccgttctaccctgattcgctccggctatttcttcttattataaactggcggctactcattaaacttctccaagtgtcactaagaatcaagtccagttttgagtagttattttttttttttttttgggcagcggattcaacttcttttatttatttgagagcaagatagacatacacttagaaaaccaacatacaatggttacaacatcaaacccgaagcgagtgaaactaggtcatgatagcacatcgcatatgcatccccgacacgggacttagcgtaagcactccgaagtacaacttatatgtcttcgaagctcatcatatttgttctttaatcagacgacacactgcacgtacattcacgcatacaatacaacacaaaagaccgtaggcatggcagtcagaactcaaaagaaaatgatgtattccaagttcagggccgtgacggtcacggtcttaagtgatcctattcttctttaccatctgccccccgtcaatgaaaggattttgaagttacgaatcttacgggagggttttcgcgaactccacgtttgcttcagggacaacaaaaacccatagtttagcacgggctgcagaggccaatccttcgagaagggtttttgcgactccgcttgctggagggcaacaccaccatgtagcagggctgcagaggcaatcctcggagggttttgcgactccgcttgctggagggcaacaccaccatgtagcagggctgcagagacaattttcagaggttgagcgctcctgctttgcgaactgcaaaagccgagccgacgcatcagtaactgccatcatctggcccatggtcaggaccagcacacagagggcagctaacttgagaccattagcgaaagccatgacggccatagctaaaaagctcgataagattgtgtatattgtaccgttctcgaagattggcgagatggcagagaaaaaaaaagcagaggagaggaagcggaggcgacgatgtcggcgatgactgcggcggtgcccttctggcgcgcggcggggatgacctacatcggctactccaacgtctgcgcggcgttggtgcggagctgcctcaaggagcccttcaagaccgaggtctcctcccgcgagaaggtccacttctccctctccaagtggaccgacgagaagcagcagaagcccactgtgcgcacagatgatgaatgaagatcaggtgccatggtgatgttttgagaagttgttggtttatggtcaggggctcagggcttaagaacttgaaaataaattcttgtggtgacaatggatctattccgatactatgttgttatatttactaattgctccttttctacttgatgaaccatgtgaaactcttgtcttgcggtggtgcttgagtgagcgtgtttttatgcattatatcttctgatgctttaatttggtatatattccaaagctcatgaataaactgttttagccatgtccgagtcatgcctaaaaaaaaaaataaaaagatccatcatatgaattagaacaggttgatgatatcggtccctgactatgccaccatcatctttgtcctcctgcttgatcgacgatggtgctcgctggcatgcttatcttgccgccactggggtcagtttctttcacagcagtggcttgagaagcccatcttgtctggctgtacatagaagccattgagccaaagctgttcccttttgcaagagggttaggcctgcatgttgagaaatgcctccatgttgcagatccaggaacctgaaaatctgagacggcgcgcgggggcgcggagcagtgtcgtaggaggatcccgcggagggaggacgccgacgcggatcgcagcctcgccgtcgccatgggagatttagctagctagggtttgcgcggcgagaagagtcgtccgtggggagtggtggcgcacg

SEQ ID NO: 20446 - DNA, 452 bp, Triticum aestivum
  unsure (1)..(452): unsure at all n locations
  Clone ID: PAT_TA_20446
tttttttttttttttttttcagaaactcgcgcggccgcccgggccggtacgaataagcttatttccatacacgtgtttagtagcatctagctacaacggttaacaaaatttacataagacgataagattttgtgtccttagactgagctacaccaatggtttaactttagcgcatagctgtagccatgtccacgaatacaagttgccgtgattactcttttggtcctctgccgccgccacctgtttcctttggatggaattaacatattccatcctgaataccaaactccacaccatcccaaatgaaactgcattatccgaagatgggcacatgttctcccagccagaaganttacnattttgntatgcttttaagatgttaatacnnaagagaagaacatcaggttgaacatctcccaanggatgatgccaacccacttttaatttttcca

SEQ ID NO: 20447 - DNA, 577 bp, Triticum aestivum
  unsure (1)..(577): unsure at all n locations
  Clone ID: PAT_TA_20447
gcaaggcatggccggagccggaaaagttcatgccggagaggtttctcgagcacgaggtggacttcaagggccgagacttcgagttcctgcctttcgggtccgggaggaggatgtgtcccggtacgccgctggccgttcgcatggttcatctcatgctcgcgtccttgctgcatcgcttccagtggaggcttcccgtagacgtggagaagaaggggctagacatggctgaaaggcttggggtcaacctgtccatggttacgccccttgaggctatagccacgccagtttgacatgatcatcatcgtcttcctctgcacctgacctggtggcatgggaacatcatcaacatgcatgcgtaaataaggagtaaccaaaagatttgctttatactgctactagtgaaaaagttgtatggcctctccgggcccttgcttcggacacaccctcccccttcgtcccatgagtggtctcgtttttcgtagtggcgttgcccatccttaaataatatagtaatgttgatattaaagtaatgattaacacctanaatcttacaggaagtcatattatataanaaaaa

SEQ ID NO: 20448 - DNA, 893 bp, Triticum aestivum
  Clone ID: PAT_TA_20448
cggacgcgtgggcggacgcgtgggcaccagcccagtgcagcagcatggccgccatggtcagagcatgcatgccactccgcacccctcctgccgccgcgtcctccaccgccaccgcgcccgctgccccgagcaagccgcgctcgagcgcccgcgtgctcgtgctcggcggcaccggccgcgtcggcggctccacggccaccgcgctctccaagctacgccccgaccttaacatcctcatcggcggcaggaaccgggagaaaggtgagtctttggcatctgagcttggtgagcaatccgagtttgtgaagattgatactggcaacgcagccatgttggagaaagcgctagaggatgtggacttggttgttcatactgctgggcctttccaaagggaggctgaatgcaccgtcctgcgggcggcgatatcgaccaagacagcatatatcgatgtttgtgatgatatggactattcatggagagccaaagcttttcatgaagaagcaaaagctcaaggtgttccagctattacaacagccggcatatatcctggagtgagcaatgtgatggctgctgagcttgtgaatgctgcaagaagtgaagatggagaacctgaaagactaagattcttctattatactgcaggctctggtggtgctggcccaacaatattggcgacaagttttctgcttcttggggaggatgtaattgcatataacaaaggagaagaaatcaaattgaagccctacagtggagttctcaacattgatttcggaaaaggggtcagaaagagagatgtttacttactgaatttacctgaagtgaagagtgctcataaatttttaggtgtcccaactgtcagtgctcgatttggtacctcggccgcgaccacgcta

SEQ ID NO: 20449 - DNA, 668 bp, Triticum aestivum
  unsure (1)..(668): unsure at all n locations
  Clone ID: PAT_TA_20449
ccccgggctgcaggttttttttttgcatcaaatcaaatanacaatgccaccgtgtgcacaaactgaacccttgacaaaccaaagcataagccagggcactgagggattcaggcatctcaaatagcattgagagattgtgtccaacctctaacatcactggaccaatgctaatagtgcaccgattacaaaatctggattcatgtctccctgcaagtatggcacaagccacacagcaggcagtgngcaccatttcatcacaacatgcattctcaagtaggaagctaggatcatcatctcttctcaaaagaagtgctctaggtggagactgcccacctttgcctccaagccttctgctgtgcctttgggccacaatgctggggtcccggctatccggggaaccgggcatgacctctcaaggactttcacctttccccccgcgcccgtcctgccccacaagatatcagatgcccttgtttgtgtttgcacctaaatacctcgtgccgaattcgggaacaacttcctccggcgacaacgcccggcctccatacgtgccaacanaggcacatcctggggtgcccatgacttcccgcccgcccgcgccgccttaaggcggggctcttcgcggcagacttctcgcgtgggctgcctgggattccanncgtncccaa

SEQ ID NO: 20450 - DNA, 466 bp, Triticum aestivum
  Clone ID: PAT_TA_20450
ggcaggtgggggcttcttgtgaagaaggtgaaggctgtcagcgtcatgtcttccctcggcaagagaagcccgccctctcaatctcagtgctgctgagcctgagcgtatggaatgtgtgttactgaggatcccctctcaagagctgatcgaatgttgtgcaatcgcagcgtgcatcagcctggggacaggtagctaggtgttagtgtgccgagtgttgagaaagcggcctatttttggcccgtctttccagtgtataatctctctattgagcaatgtagtcgtagtgttattgttttgtggggcgagagaggaaacgggcggaaatttgttgtaagatactgcctgcactgctaatcgctctgtcttactagcactgtgtgcgatttgcccacgtagcaacaaactttgcaatcctagaacagggaacaaagttgcaaggtatctatttttgtttaaaaaaaaaaaa

SEQ ID NO: 20451 - DNA, 647 bp, Triticum aestivum
  unsure (1)..(647): unsure at all n locations
  Clone ID: PAT_TA_20451
agaagaagaagaagaagaagaagaagaagaagatcagtcatgttgccaggaaggtttctcggtcagaagaaggcgaggccaccggcgggtccgcccacaaccccaagaacaccaaccccggcggctacctcaagacccatcaacaatggtggctccgcgcgtgccctcaacaaagtcaccaagggtggctacacctgtggcctcaagatcgtcagcaagagtggcttcctccaccgcatcaagaacgtcagcaatggcagttccgcccacgcgctcaagagtatcaacaacgtcggctcaacccgctacctcgagaacttcaacaacggctaatccacacgcgacctcaagaacgtcaacaacggcaattcattccgcgacctcaagaccttcaacgactgcacacctgcgtcccacctcctccacgtcggcaacgactatcccgtccgcaacctctaggccggcaacaacgacaaattcgtccatgacctcaagaatgtcagcggcatcagtgacggtggtcctctgcgactcaagatgtcagcaagaccgctcgttctgctgcgactcaagagcgtcaacaggacaacggtggctcaaacgtcgacacatgcagcaagtggcgactcaagacgntagacnaagcc

SEQ ID NO: 20452 - DNA, 463 bp, Triticum aestivum
  unsure (1)..(463): unsure at all n locations
  Clone ID: PAT_TA_20452
ccggcgcgccgcccaagacgccgcagcggtgggcctcgctgccccgcgccaaggaggagaagcgtgcgaggttcgtggcgttgccggacgagctgatcgcatgaccgacatttcgctcgacggagacgagttaacacatccatcctgctgtcccagccatgcttgctgattgtcaggccaggagatagggagttataaacctatcttcaggctgttagagataccgtttccgaaagaaaaaaaggctattaagagatacatgcttgggttcatcattctccttgcccaacaaaaactatggtttngaagacgagaagccgcccgaatggcttccaattcaccttgatttccccatatcatacgtgtttcctgncccgtgttctccctgtgtgttttccttggtattcctcctccgggtggtttaataattatccacnagccangttcntngaaaaaaaaaaaa

SEQ ID NO: 20453 - DNA, 573 bp, Triticum aestivum
  unsure (1)..(573): unsure at all n locations
  Clone ID: PAT_TA_20453
atcctctctccgcgcccacgaagcaagctctccactcccgatggcccgcacgaagcagacggcgaggaagtccaccggcggcaaggcgccgcgcaagcagctggcaaccaaggcggcgcgcaagtccgccccggccaccgggcggcgtgaagaagccccaccgcttccgccccggcaccgtcgcgctccgggagatccgcaagtaccagaagagcaccgagctgctcatccgcaagtccccttccaacgcctggtgcgggagatttgcgcaaggactttaaagaccgacctccgcttccaaggctccgccgtctccgcgcttgcaggaggcccccgagcctaactcctttgggtcttcnnaggacacaactctgggcctctcgcagcccttgcgtctaccctagtcccacgcgccgccgatccccggccaagcctttgggatccgccacctgtccccggcccccgtttcgtcttgcgccccaggcctttcggggtaaagtcccatatcctgtcgggggtacgtgtccccacactgttcacanataaatnnatntccagggggccgtacatccc

SEQ ID NO: 20454 - DNA, 1339 bp, Triticum aestivum
  Clone ID: PAT_TA_20454
ccacggccggacgcgtggggtgaaggcgggaggaccttccgttccccatcccttcgccaccccggccggccctcctcccccaaaaagaacctcaacaacgatgaatcccctgctaaacaacccgctcagcggcggctgcgcgttcccgtcggtggcagccgcgctgcggttgccggcggcctccctctgtacaagcgcgggccggagcaggagcaggaggcggcagcccagtttagcgcgcgcaggctcggatggctctgacggcgccgtggccggcgcagtaacggaaggggaggcagcgcggcgccggcggccagcgcggtacctcggccgagccggcggcggagaggcagcagcccgtcgtcaatcctaagatcgagaaagagctcaagaaggcagttcagaagaccgcggcgacgtttgcgccgagggcgtccaccaaaagcaagaaccccgccgtgcccggatccaccctgtacaccatctttgaggtccaggcgtacgcctccatgcttgccggcggcgccctttccttcaacctcgtctttccctccagcgaaccggacatttggaggctcatggggatgtggtccatctggatgttcactataccttctttacgggcccgtgactgctcaaacaaggagaaagaggctctcaattatttgttcatcctggtccctttgatcaacgtgatcatcccgttcttcgtgaaatcgtttgcggttgtctggtcagcagatacagtcgcctttttcgtgatgtatgcgtggaagcttggatggctgcaaaagaccgagtgaagattatcctgattgaggagcattctacttgtgaattttgctggtttctttctagggcacaggttgaccaaatttcaagatatagcgtctgtatagccctttaaagttttgtttatacccacgaagtacggagaaattggattttgacatcagattgttaaatagatgtaactgagggccaacattcattattaactaggaaccatgcagcaatgttagatattgttaatatgtatgtgtttattataaaaattgtagctattgtatcaaaagttccaggtccagctacttcaaggcacatttatagttcaagtgacttgggttttttgggggcaactatggtagccaaaagcggcctgaaccatttgagttataattgcaagaaatcaggcaaaagccacccatgcaaaaagaagtaaacaggttacctttttgtgcacaggttgtaataggtcatattccttgaccaaaatttacacggcaacgcaacctacatgtatgattggctactgtgttcaaaaaaaaaaaaaaaaaaa

SEQ ID NO: 20455 - DNA, 896 bp, Triticum aestivum
  Clone ID: PAT_TA_20455
gtcacccctcagccctcactcaccactcaccagcagaccgacaggtgaaaccaaagataaggtccgggacagatggcatggccagtgctccagcagctcctgctcatcgccgccgccaccactgcggcggcgtcgggctcagcgacgacgcctgatgggccggcgccctggccggagcagttccacgcggtgctgttcacgaacctgaccaacgtctcgattgcttcaacgggcccgccgctccgcctgcacgacctgtactacgactggccgcggcggcgcaacctgaacctgatccggcaccagctccccgggacccgctgtagagtggaagtgcggcaaccacccaccttctacttctactccacctcccggcacgcagcaggtccccgtcggcgtgctcccccccgggtggctcgccgacggaggcgccgtctacctcggacgcgagaccaccggcgggatcgactgccacgtctggggcaaggctgatttcatcgtctactacgaggacgcgctcacgggccgccccgtccactggaacttccttgacgtgacggggttacagcagttcgtgatgagcttcgaggtgggcgtggtgctggaaaatgacgaccagtggcaggcgcccgcgcactgcttcttggatgaaactgctaaccggaccaacgaggatgacgcccatctggatgaatggcaggcggccaggctattcaggaagtttgctggagctgctgccgcgtactgaacatgtgtgaatctgaataaatatatggtgcgtgtttggctggcgagccactcctacattacacgggtgaactatgtaatctcgggttagcccgctcgtgcttgtgttatcttgtctcttgtctgttagtcatgtgtgtatattttgt

SEQ ID NO: 20456 - DNA, 1115 bp, Triticum aestivum
  Clone ID: PAT_TA_20456
gcaccgctcaccagcagacagacaggtgaaacggaggataaggtctgcgacaacagacatggcccggcccagccgccatccccagttcccccgcagctccgccgcctcccccacggcgccggtgccgccctgagcgccgccgcccggggggccggcggcctggcgggcggacttccgcggggccctgctcacgagcctgcccaacgtcccgatctcatcgacgcgcccaccgctccgcctccacgacctctcccactactcgccgcggcggcgcaacctgaacctgatccggtaccagctgtccggcgacccggctctacgacgtggagtggaacaacggcaccagcttctaccttcgactcggccacctgccggcaggtccccgtcggccccctggcggtgctccgccccgggtggctcgcccgagggcggcgccgtctacctcggccgcgagaccaccggcgggatcgactgccacgtctggggcaaggccgacttcatcgtctactacgaggacgcgctcacgcgccgccccgtccgctggaacttcattgatgtgacggggatagagcagtttgtgatgagcttcgaggtgggcgtggtgctggaagacgattcccagtggcaggcgcccgcgcactgcttcctggatgaagcagccaacaagaccaacgaggatgacgatcatgtcgctgtttcgaatggcgtcatggacgcggccaggctattcaggaagtttgctggagctgccgccgcctactgataatgtctgaatatgaataaatacttggtgtgtgttttcacaccttgctactggggacatggttcatccaaccattgctactggggatggcactctgaaaaaactcacgctgttcaatttaatttcctttgtagcaaagcttacctgttttctctcccatgcacaagtactgatcacaaggctggcgaccactcgtacattacacgggtgaactatgtaatcaactatattgtgcttaatcattcttgtaaacccaagttttgttgtgctttcaaccttagtttcaaaactcagactgggtaagagaaccgccgagtgtcctgtttgccccttcacccaatcatttgcaagc

SEQ ID NO: 20457 - DNA, 813 bp, Triticum aestivum
  Clone ID: PAT_TA_20457
tcgagcggccgcccgggcaggtcgatgagcttcggggacctgctgggctgggacaaccctgagaagaaggccatcaggacagctctgagcaacatgtcaagtaccagcaattccaagttggagttgaccccaaactggagccaggagaacggcttgtcacaaatgtggacacccctctgatcctgatatgagattattgtgctactagttgaagtgtggtggtgactagtaagtaattagatgacatattctttctaatgatattggagtagtattgggctattggttgatgcagtgtctgttcccagggatttgatggaagtgtgtgttgatttacaaaccagtagattagtggaatggcttgatatagcatctgtacctcggccgcgaccacgctatccctattttagtcctactcttactttccacccgccaaatgtaatgttaccgccatctgggactaggtctgcccggtgacggaggccatcaggacatctctgagcaacatgtcaagtaacagcaattccaagttggagttgaccccaaactggagccaggagaacggcttgtcacagatgtggacacccctctgaatcttgatatgagactattgtgctgctagttgaagtgtggtggtggctagtaagtaattagatgacatattctttctaatgatattggagtagcattggactattggttgatgcagtgtctgttcctagggatttgatggaagtgtgtgttgatttacaaaccagtagattagtggaatggcttgatatagcatctgtacctgcccgggcggccgctcga

SEQ ID NO: 20458 - DNA, 585 bp, Triticum aestivum
  Clone ID: PAT_TA_20458
ccgttgtcctccaccgatgtgtcagctctgggcgtcccccttgccgcgcgccgggggccgtgtcgtccaggatcggaaatttgtccgtcggcaacggtcccggaggggttcgtcccccttgcctcgctccgggtccgtgcctagctggtgcgccgcccggtcttggcctcgcgcccccttcttcgcgctccccctcccccctgtcgcccatgggatgtggtcctacgcgtccgcccctgttcccccctcccatgggccacggcgcctcccagatgacttgtgtgatgcaagttaaaggagggtcctgggagacgccagtattctgatgaattttgttccttttctttgtcaggtgatttgttgtccaggaaaggaaaaaagagcgtgggcaacggtccaggagggtttggtgatagttgccttgttttgtttcggttattagttagaaccgggtcagattttagccacacgaccccttttttggaaatacaagcatacaattgtccatggtatttggacataggtgtcagcacttgatttatcaggaaattgactataatatagtgctttttacctttgtaaaaa

SEQ ID NO: 20459 - DNA, 447 bp, Triticum aestivum
  unsure (1)..(447): unsure at all n locations
  Clone ID: PAT_TA_20459
gcggctgctcggtgccgaagggcgcccgtgttctgatcaacgtgtgggccatcgggagggaccccgaggtgtgggccgagccggaggtgttcatgccggagaggttcttggacagggaggtggactcccgggggagggcgttggagttcataccgttcggatcnggggcggagggcgtgccccgggatgccgctggccgtgacggtcgtgccgatggtgttggcatcgctgctccacgagttcgaatggaggctgccggatgggatggcgcccggtgatgtggatctcagcgaccggtttgggcgccgcgctagagctcgccgttcccctgagggccgtgccggtttgggacgaaaggcgccgaggatttgagttctccttcgtgacgaactcattacccgttgactaccttttcttgatttattttcatcatcaatgtactaaaca

SEQ ID NO: 20460 - DNA, 861 bp, Triticum aestivum
  unsure (1)..(861): unsure at all n locations
  Clone ID: PAT_TA_20460
aacttgacatctcccgttgtcctggatgattttcgttgcccaatatcactggatttaatgaaagacccagttattgtctccactggccagacttacgagcgaggttgcatagagagatggttggaggcagggcacaacacctgtcctaagacgcagcagaagcttctaaataaatctctaactccaaactatgtgctccgtagcctcatagctcaatggtgtgaagcaaatggtgtagagccgccaaagcgccctgctcagcctaataatacaccagcaacatgtaccgcctctgagcatagtaaagttattgagctcctgcagaaactatcatcccagaaccttgcagatcaacgtggagctgcaggtatgcttcgtcagcttgccaagcgtagcgctgaaaatcgtgcttgtataggagaagctggtgctattcctatccttgtgagccttctaccaaccaccgatgttagcacccaggaacatgtggttactgctctcctgaatctttctatttatgaagagaacaaagcaagaataattacctctggagctgttcctggaattgtacatgtgctaaagagaggcagcatgggggctccggagaattcagctgccaacactgtttagcctatcacttgtggatganaacaagtgacgataagggctccnggggnatccanctttggtgctgcnatgggtaatggaatcaacggggtaaaaaggttcacaacacactattaactggnttccancanggcaacaaggtaaancgttaaactggatggcccaaacacttgactcaanaanacgaaatgnatgtnataagcctgcaaanggaattccaacancnaggaaagg

SEQ ID NO: 20461 - DNA, 1010 bp, Triticum aestivum
  Clone ID: PAT_TA_20461
gctccggcagccggatctccacgccgcccggctgcccccggcggctgccgccttcgtatctcttccccgtcaccctccgcctcccctccactggagccgctcggctgcccccatcggctgccgcgttcgtctctcgcagccttcatcgccctcctcccctccactggaccggctcgggggttcggatgatttcttcttgcttcgtggtcaaaagaagaaggcgtaggaatggtatctccgcctctttgtttggcgttggagctcctgaagccctggtcattggagtggtcgccgactagcagagagctacaggatgtatcaagggatttcaagaacactcttgaacgagaaatcggacttgatgaggatcctcccatccatgagttataggcctcctccacctatgaataatagcccacagcctgctgttgacccagatgtcaagcctgaaacaaccgtgccatacaccagcgaggaactcatgaaagtaaccgaagaacagctggctgcatccgcaattgctgcttggaatgcaaagcaacctcccacatctgagcagcaagaagaagcagcagcagcaacaccttctgaaagtactgactcagcattatcaggagggagtgatggtcctgatgccgtgacggcggagtccacctcaggtaatactgagaatgcaaagccgagagatgaggcataatactgaaaacagaaagtatgttgtatgcggagtagagcaaggcgaaagctttggcgtcaattggttgtagaaagaatgaaatagttttggtttccacttggtgagctgggttggccaagtgatgggtgatttgaggcttcgattagtagcggcttggtctgttgtggtgtgtagcatggagagataggtaggtgatgcgaaaccgagctgtgcatatcttggccctcctccagtgtcttgtttttgccacggctgttgttacatgtctgtaccatatttttgtgattatgcaaggtaagcagatagatttttt

SEQ ID NO: 20462 - DNA, 1224 bp, Triticum aestivum
  unsure (1)..(1224): unsure at all n locations
  Clone ID: PAT_TA_20462
ggtcccttccnttcagtggaantttggaggcatcgtgcggccttttgtataccccgntgcgaaggggtttttgcaggggtnaattggtaancccaggtttcccgtcaggagtttaaacgacgccattgagcgcggtaatagggntcntataggcgnattggtacgggccccccctnggagaatgtcnnacgttgaaattgtagggtatcaccaanttatatgcaggatgtcatatatgtgggatgaaggatcggaagaagtcatggaggtgtaccctaatcnagtatactcctgtgtctgctcggcnattggccgggcttaggtcgcgcatnnaactcccagtgaccactcaaacatgttantcatctctggcctccacatccacccttcttggaccttctcttggttgtgcccagtttctcccaaagacgctttctagggcttcatctcaaagcaaatagagagagcctggcaccaccagcaaccgttcaacaggtaaagatggttggtggtgtgatacgagtaacacatatactgtaacggaggttgcggcgccattgtgcctgtgggatgttgtggcctctgggctgtggtgaatacacgcaggatctgtgatgtgtgtatgatccgtgttgtaacttgtgagatttttccttcacatcaccatgcttgcgaaactacgcattgccgggttgcatttgtctcctcaagttgaggacttgatgccgaggccaaattcaaggtgcattgcgtggccgcctgagacgttttacatgttattggtacatatgcaagccttcatttgttaataatgaagttatgtaatgttcatcaagcaagcaatggaatctccgagtgcctaaaaccctgttggcacatgacgctcgaccaggtgaagtagaatcaagacgaactctgaatgtaatgcaccatcgaaatcaacaagtatcaagcangtacaactgttcagaaggacgactagaatcatacagtatgatggatcagattcaacattacattagtgcaagaacattgttggatcaaccggtgcacaacatttcaactcgttgagtatgcccgttctttggttccaaaatagtctccaacataatatgtctggttaggggttantagtatttgattnactgtattaattgtgccacnccggcctgngattaggaagntttccttgataaaactgaaacnctcacancacncatgntn

SEQ ID NO: 20463 - DNA, 707 bp, Triticum aestivum
  Clone ID: PAT_TA_20463
tagcgtggtcgcggccgaggtgtcgatatgcacagcggttgcacgttcaaccatagatatgtcaagtccaatccacgagaggttgaaaatgccacctggatgctaacagtgttccattgttttggacaatacttctgcctgcactttgaggccttccagctcggcatggcaccagtatacatggctttccttcgtttcatgggggacgagaacgaagcaaggaactacacctacagcctcgaggttggtggtaacggcaggaagatggtatgggagggcacccctagaagcattcgtgacagtcaccggaaggtccgggacagtcacgatggcctcatcatccagaggaacatggcgctgttcttctccggtggtgacaggaaggagctgaagctgagagtgactggacggatctggaaagagcagcccaatccggagggaacctgtatacccaacctttgtagctgaggcgagcaacgtccagtgatgaaaatggttgcgctgtctagctggcttgttatttatccactgacatgtcctctttgtttcgatagtccagtgagagtcccagtgctgtactaccttgagcttgaggcaatttttagaggtgtaaaatgtcttgtaaagtaagtaactgtgtgtaacgaaaccatgaaacactacaagttggccaataaatgtttttagaggaaaaaaaataaaaaaaa

SEQ ID NO: 20464 - DNA, 657 bp, Triticum aestivum
  unsure (1)..(657): unsure at all n locations
  Clone ID: PAT_TA_20464
ctcacatagagagagctgcaagggtgcaaccgcagcaacctcgaagctagtccaaactagtggaaggttgtgtgcaatccatcatcttcttcgtctctccatctaccccttatcaatcatccacccatccatccatccatcatcatcatccatggcgagaggcaaggtccagctccggcgcatcgagaaccccgtccaccggcaggtcaccttctgcaagcgccgcgcagggctcctcaagaaggccagggagctctctgtcctctgcgacgccgacatcggcatcatcatcttctccgcacacggcaagctctacgacctcgccaccaccggaaccatggatgggctgatcgagaggtacaagagtgccagtggagaaggcatgaccggcgacggctgcggcgaccagagagtggacccaaagcaggaggaatggtgctgaaacaagaaatagacttctgcagaagggactgaggtacatttatggaacaggcaaatgacaataatttgacaactgaatgcctggagaggacttgagatatgatgtcaacatcgcccgcaagatcagtatgatcagagtcagcacnaagacaggggggatntnaaactcaacaantccaagaaagtatnnaacatgctntnacttgatantgantt

SEQ ID NO: 20465 - DNA, 633 bp, Triticum aestivum
  unsure (1)..(633): unsure at all n locations
  Clone ID: PAT_TA_20465
ttttttttgntgtgttttttttttttgaaaccctagaacattttgctttgcttcgaacacatgaactgtagcatcttcactgcaacatggtgtaacacgggcgcggcctgaatctacaccgcatcgtatggtacatcgatactttcgctggggttacggtaatggctatgggggtttacacaaacatggccgaaacataggcaagaaacacactgatgagcacggtggcagcggcggagctcggcgcccctgctgcgtgcagcagttctgggagctttgatatcccctgtgaatcggtgcttgatccagcgccttggggggcaacctgtcccgtcttcgtggcagcagccggagaatcgtcacctgctgccggtgggagcttcgtcgcaaccggcactctccggtgcggttgcttgccgccgcgagctctgcccccgcgggaccggcgcctggcggcgccccttctcgggacccccctctgcgccggccttcccggtcctccgggcgatggctcgctctacgtgcccccgccgcccgggcgcaagtncaacntggggataancctggactgccaagacangccnaaggctgggccaattggnagggcaaaccagnntttaaancttgaaangg

SEQ ID NO: 20466 - DNA, 633 bp, Triticum aestivum
  Clone ID: PAT_TA_20466
gcagatgatattaaattggacatttcaatggataatatatggtattgacttggacattggtgttgtggaacactctagcaggttttggatcttatagaagtatcagttggcagggtctgaaaatcacggtgtaagtgtttcagcctattaatctgtagatataaaagtccgtacatctctaccaataaggcaataatcccgaagaaagttctactattgcaaacgctccaactgaacaaggaatatgaatgtttaaatgaagaaagaagccagtttctccagaaggaatacagaataatattttggattatttacttgaggttatggggaagtgtgtgttcaaatgaatctagcatgccaataacatttgttggttcctgagaactcacatgaagtagtactatatcacactcttccgtgccaaggaaggctggatcgctagcaagtcgtccatcatgctggctgctgtacaccaagaatgccagcgagaacatgtatattccataaactttttcattgtattatactccctccgtccttgaaagagtgtacttccaactttgttggaatgtttgactgtatttatacaataatacgtcaacatttatgccttcaaaaaaaaaaaaaaaaaaa

SEQ ID NO: 20467 - DNA, 952 bp, Triticum aestivum
  unsure (1)..(952): unsure at all n locations
  Clone ID: PAT_TA_20467
ggcagtctgcatggggttggcacttgcagtagttttgtgtgttattttggttaacatttccaaaacggaggccagtgctatcgatgaagaagacgacgctgggggcgcttgtcatgattcatattattcctactcaaagccagtgctgttctttcagaattctgccaaggagctaactgtcagtgacctcattaggtcgactgacaactttgatcaagccaacattatagggtgtggtggatttggtctcgtgtacaaggcctacctcccagacggaacaaaggcggcagtgaagcgactttctggtgattgtgggcagatggagagggagttccgtgccgaggtggaagcgctgtcccaggctcagcacaagaatcttgttacgctgagaggctactgccgccatggaagtgataggttgctcatctacacatacatggagaacagtagcctggactactggctgcacgagagagcggatggcggttacatgctgaaatgggagtcaaggctcaaaattgcccagggttcagccaggggattagcttacttgcacaaggactgcgagccgaacatcatccaccgagacgtgaagtcaagcaacattcttctgaacgagaactttgaggcgcacctggctgatttcgggctagcaaggctaatacagccctatgacactcatgtgactactgacctagttggcaccttgggttacataccacctgagtacagccagtcactgatcgccaccccgaaaggggacgtctacagcttcggtgtcgtcttgctggggcttctcactgggtagacggcccgttggaagtgtccgaaagccaagggattccagggacttggccccctggggcactccnagatgaaatctgagaacaaggaagagcagatttccgacaggctgatttggggccaaagagcatgagaacaactggtgtcc

SEQ ID NO: 20468 - DNA, 1418 bp, Triticum aestivum
  Clone ID: PAT_TA_20468
cagcaaacgattgtgttgcaccggaacaggccggcagccaagaagcggtgcaggcgtggactcatcgatcgaggccatgtcgaaccccgacgtggaggccgccggcccggccagggcggcgacgacggggatcaagccgccgcctgggaggtactacgcgggcggcgacgggcagcacgcgccggcggcgcccttctactacggccaggaggcggagcgcgagcggcagcaccacacgtggctggtgccggtggtggtgctcgccaacgtggccatgttcatcgtggtcatgtactacaacgactgcccgcgcaacggcaggggcgccgactgcctcggcggcggtttcctccgccgcttctccttccagccgctcaaggagaaccccctcttcgggccctcctccgccacgctggggaagtacggcgggctcgaccggtacaaggtggtgcacggtgaccaggcgtggcggctggagacggccacctggctgcacgccggcctcatccacctcggcgccaacatgatcagcctcatcttcgtcggcgtccgcctggagcagcagttcggattctggaaggtcggcctggtctacctctgtctcggggttgggcggcagcgtgctctcggtgctcttcatcaggaacggcgatctccgtcggcgcctccggcgcactcttcggcctcctcggggccatgctgtcgcagctcatcaccaactggaccatctacaccaacaggctcgcggccatggcgaacctgatcatcatcgccgccatcaacctcgcgctggggatactgccccacgtcgacaacttcgcgcacatcggcgggttcctcaccggcttcctcctcggcttcgtgctgctgatccagccccggttcggatggctggagcagcccttcggcggcaagacaaagtccaagtacacggcttgccagatcgtcctcctgatcgtcgccctcctcctagcgattgcagggttcgccgttggattgctgatggtgttccgcggggtgaacggcaacgaccattgcagctggtgccactaccttacctgcgtcccgacgtcgcactggaagtgtgacaactaataaaaataagaggacaacagctgtggagacaaacgtgctgcccatccagataattgcttcagtttggctttttttatacttttgcgctgtatagaaacttcaaggctgcaccttttgcttttctttgttgtccaagaggcgttgattagcaattctgcttgaatatgttattaaagctctgcaaatcactctggtttgtttgtggttaaagcgtttgtttattctttggttctacatagtccgtcacatttgcaatgttagagactaaaacaggcgaagaacgaacgtcctttttccgtcgctgtaaaaaaaaaaaaaaaaaa

SEQ ID NO: 20469 - DNA, 1027 bp, Triticum aestivum
  Clone ID: PAT_TA_20469
catgggccaggctagggcttacctcctagcctccctagcggcgttctacctcatcgccctggccaccccccaggtcacggccgccgacattaccgaggaggtcaatctcctgtggggcaagtgcaacgttctccgcgacggcgccggcagacagactgtcgcgatgagtctcgaccgcagcacgacctccggattcagctcaaaaatcaagtacctcttcgggaggattgacatggacatcaagctcgtgcccgggaactcagccggcacagtgacaacattttatatgatgtcagagggaccatggcaataccatgatgagatcgaccttgaattcttgggggaacagcaccggcaacccctacaccctgcacaccaacgtgtatgccagaggcgtaggcagcagagagaaggggtaccggctttggtttgatccctcccaggacttccacacctacagcatcatttggacccaacaatacatccgaatccttgtcgataacaagctgctccggcagatcaagaaccagatgatgtatggtgccccctatccaaactatcaaccaatgagggtgtacagcaccatctggaatgcggatgactgggcgacacagggtgggcgggtcaagaccgactggtcactagcgccgttcacagcatacttccggaactacaaggcctccacctgctctccaagctccaaggcctgcggccagagctcccctggttcgtccggcccggaactggaccagacgcagcaacagcaactgaaggaggtggctgccaactccaaggtctatgattactgcgatgactcaaagaggaggattgggtcccccaaggattgtgagtcacagtagaagtgattcaactagcagatacaaaaggaaagtgcattggattatttagtccattttttcagaacatgaacattgtattcagtttacttgcgtaagtaccatgattgcttggtgtacctccatagataactggcaagctcaacaatggtaaaaacaacttcagccca

SEQ ID NO: 20470 - DNA, 614 bp, Triticum aestivum
  Clone ID: PAT_TA_20470
gagatgcgaagctcggcgcccggttgagatcttcttccccatcactggttccctacttgcgtgtctggatgccttccgcgtctccgctgctgccatgctcgagtggccagcaaacgtcgaagaagcagcaagatgagtccgtctgctccacccaaggggccaatgaatttttccagcgggagcgccaagcaaacaaacgaaaggaaggcagggcaagtgaaacgaggaggaggtgaagcgaagctcggcggcccgtttagagcttcttgcccgacaataattccctggtaaaatgtctcgagtagcttttttcttcccttccttcctcaaagttccttcgaagatcgtccgatcgattcatgtttccgttcttcatgagacgagacgagacgaagaaaacctcgtcgctagcgtggcaaataaactaggcagggcagggcagagcatagcaaacatgttgcttgctggttcgctccagagttcttttttgtatagagaaagggaaaagaagaaatgaaacgagatgggggaaatgaaagacaatgcatggtgaaaaaaaaaaaaaaacgcgtcggggggcccggtacccaattcgccctcgagtggctcgtatt

SEQ ID NO: 20471 - DNA, 1190 bp, Triticum aestivum
  Clone ID: PAT_TA_20471
gcctcggttttcttcagaaagtgatcaagcgagcgatctagactggcaacaccagcattcatatgtgtcattacaatagtctatgcattacacgatcccctgtgatggaggaggtgatcgccggcggcgacacggccgacgtggccgcggagaaggcgccctactgggacccgccgccggccccgctgctggacacgagcgagctgacccggtggtcgctgtaccgcgcggtcatcgccgagttcgtggccacgctcatcttcctctacgtcagcctcgccaccgtcatcggctacaagagccagtccgccgcccagccgggcaccggcgtcggctacctcggcgtcgcctgggccttcggcgccaccatcttcgtcctcgtctactgcaccggcggcgtctcaggtggccacatcaacccggcggtgacgttcgggctgttcgtggggaggaagctgtcgctggtgcgcacggtgctgtacatcgtggcgcagtgcctcggcgccatctgcggcgcgggcatggtgaaggggatcgcgggggccagctacgttgccctcggcggcggcgcgaactcggtggccgacggcgtctcggtgggggcagggctcggcgcggagattcgccggcacgttcgtgctggtgtacaccgtgctctccgccaccgaccccaagcgcaccgcgcgcgactccttcatccccgtgctggtgccgctgcccatcggcttcgccgtgttcatcgtgcacctggccaccatacccatcaccggcaccggcatcaacccggccaggagcctcggcgccgccgtcatgtacaaccagcacaaggcatggaaggaccactggatattctgggtggggccgctcctcggcgcgacggtggctgcgttgtaccaccggttcgtgctgcgcggcgaggccgccaaggcgctgggctcgttcaggagcaccggcgccgccaccgcacgaacctaatcatcaaatatactgcgtgtgatcggtcgaagctcgttcatgcatatcctggctctaatttaatttggttggctatatgtaactatatgttcgtgatgtatgcctcgatcgtgaaattgtattgtgttgaaccccgtagctttgcatgggcatgcatgcatgtggcgtctgtatttgtttcttccacttttgcgcgtctgtattttttcttcccc

SEQ ID NO: 20472 - DNA, 1271 bp, Triticum aestivum
  unsure (1)..(1271): unsure at all n locations
  Clone ID: PAT_TA_20472
cccacgcgtccgggcgcttgcttggcaccaacaaaaacctgctcctcctcctgtaggtaaggtattccgaaagagacttggccatggcagagaagcagcaacaaggatcgaacgtggaggaggggagctccagggctgcggggaaggtcgtctgcgtcaccggcgcctccgggtatatcgcgtcctggatcgtcaagctccttctcgatcgcggctacaccgtccacggcaccgtccgggacaccgctgacccagataaaacatggcacctgcgtgctcttgatggagcaaacgataggctgcagctgttcaatgcaaacttgttagaagaaggctctttcgatgctgccattgacggttgcgagtgtgtcttccatgcggcttctccagttttcttcactatcaaagatcccaaggccgagttacttgaagcagcagtcagtggaacacttgacgttctgcgttcctgcaagaaagcttctgtcaaaagagtggtcataacatcgtccatggctgctgttacctttaacgggaaaccaaggacccctgatgtaattgttgacgagacatggttttcagttccagagctatgtgaaaagcaccagcaatggtatgtcttgtccaagacccttgcagaggaggctgcgtggaagttctccaaagataatgaacttgaaatagttgtaatgcacccaacaatggtcatcggtcccctgctgcagcctacactgaatgctagtgttgaagtaatcttaaatctaatcaatgggtcatcttctacataccctaatattgcccatggatgggtaaatgtaaaagatgtggcactggcacatatccttgcatatgaagttccttcagcagatggaagatattgcattgttgaaagagttgctcactacttggagcttgtcaagatcataagcaagatgtatccgaacattccactcccatacaagcgtggagatgacgagccactttttccaacctaccaagtatcgacggacaagataagaagcttgggtgtcgaactgattcctctcgagacaactattaaagagactatcgagagcttaaaagaaaggggtttctttgaattctgagtcgagatatcagtggaaatatacaaataaaatgcttatgtttatttgatgaggtttaaatccctgctatacctactctctactaatttaaatgttacacttgttgtctatgatgtcccaagttatatttacaattctataacctccnnannaaaaanannnntnnnt

SEQ ID NO: 20473 - DNA, 557 bp, Triticum aestivum
  unsure (1)..(557): unsure at all n locations
  Clone ID: PAT_TA_20473
gctcgctccctcctcccctcagatccactagcgtgttggttggaatcagtggatattcacatgatgtatacacggaactgcagcttcacatctttgtcctgaatcataatgagtatcttttctcgccatcgatttctgcacgtatggttcagctggcatgtctagatctacatgttcacctgggcttatggtgcctctccctcgtcgatgcttgcggtctcgatgtacgtgctgatcggcgctttccctatctgcgtggatgcaatttctgtggctgggcctccttccttttgtgatggcgttacttccttcccggctgccttccgtgcggttcccgaggcctaatgctgcccgggtcgtttcatttctgcctcctccttggggtgcgctcttcacgtcctttactaagtatttttttaatcccttaagtggtgttacccggatgcaaacatttccngatggtaaccggagttaaccagtttggancncatgtgccaagttgggnccgttggatggatcaggattngaccagtttcangaattaattagcccggttg

SEQ ID NO: 20474 - DNA, 811 bp, Triticum aestivum
  Clone ID: PAT_TA_20474
ctgggtgacccgccgcgtcgggttcacggcgcgggtgttcgagaaggcggtgcagcccgtggacaagttccgcggcctcaacgggccggcgtacctcatggtggccgccgggttcgtgtggatctccgtgtggtgcgtggccgtcatcggcgccgtcaacttccggttccccggcctgaccatcctggcgctggtggtgagcctggcgtggaccgccgaggtgatgcgcaacgtggcgaacctgacggccagccgggtgatcgcgctctactacctccgcggcatgcagtccagcgtgcagttcagcttccagcgcgcgctgtcgtacaacctcggcagcgcctgcctcggctcgctcttcgtgcccaccatcgaggcgctccgcatcctcgcccgcgggctcaacctgctggagggcgaggacgagttcatgttctcctgcgcgcactgctgcctcaacgtcatgaacgccgtcttcgagttcggcaacagctgggcattcgtccatattgcggcgtacggcagggggttcgtgcaggcgtcgcggagcacgtggaaccagttcgaggggcagccggggatgccggcgctggcggacgcggacatcacgagctcggtgtgcttcctgaccggggtgaccagcggcgcgctgtgcgtggcgcttgcgggctcgtggacgttcgtgacgcacaagcactacacggccacagtgtcgctcatggcgttctacgtggggtacctgatgacccggatcggcatggcgcttccgcatgcgtgcgtgggctgctactacgtgtgctacgccgagaac

SEQ ID NO: 20475 - DNA, 602 bp, Triticum aestivum
  Clone ID: PAT_TA_20475
cccacgcgtccgcggacgcgtgggcttccccgagttatgaaacagggccatgcgcttccacctgtgaggtgcagaacaaacaaatcccgagtggcgatgatgttgagccggcgaagatcaccggtagtggcttcgctacagctgccgccggtgacaactcttctgtttctatgggtcttaagctgtgggcatgcaacagcaaacactgatatagctaacatgacggcactccagaaacatgtctcttttttcgaccgtaacaaggatggcatcattactcctatagaaacatttgaaggtagtatgctagtggccatggtgtgttttggattgaggcatatagacttacctttcaaggatttgttgcaattggttgtgatgttgcatattctagagactctgcctcctccgtgcatgctgccctgagcagaataacacacccggtatgactacctcaataatgtaggtggcaaatttagaagctctacttgtgccgcatagccctaagaaaaaatctaaggcatgttaagttaattcctttgccgtgtttgtatcttcttgattttgactaactatacttggaacaagggctaacatatctt

SEQ ID NO: 20476 - DNA, 516 bp, Triticum aestivum
  unsure (1)..(516): unsure at all n locations
  Clone ID: PAT_TA_20476
cgagtttttttttttttttttttttgaggccaagcataaccttgaagattgatagtgatagctttgtcattacaatataatgtcattagatattcagcaacatcacatgcagaatggcatatcattcctcggaggcatgaaacatccggaagatatcaggtaagcggcaagcgtgtccctctccctcgccatcctgcagaattcccgtcttccggtagtattcgatgctatccaggagcgtctcctccaattcccttggcttccagcccaagattcctcaagctttgccgacgagattgggggtgataggagagttgtgatccatctcagccttgcagtttacataattggtagtccagggtacgtctccttcaagcaactccagcatggcttttgtgctaatgtaatttggggcgctgatatacctcccagaggtcccgggcccctccccataccaggatccccagcatccggcctcgtctcgggaanacagtccttaaaccgattagacccttt

SEQ ID NO: 20477 - DNA, 593 bp, Triticum aestivum
  unsure (1)..(593): unsure at all n locations
  Clone ID: PAT_TA_20477
cgctgggcctgaccctccgcctcgtgctcccccccctgtggcgtcgcctcgcgcgcgttgccctcggtcgcggctgctcacgcagattcatggtgctcttcagcgaattctgtgccccgttcccgttgtgcgaagggtgggcacccttccccttgttccttggctgcttggccgtcttcgccttgggtcctgcccctggtgggggtacgtgcgaggacggtccaccagtgcatccgcgccgcttacctttgtttttcatcctaccctcattgactgggggcgttgacttccttctttcttccctgccctgcgtgggcgccatgtactcgcgtgatcggaggatggccttgaaactggacaatccccctgtcgaggcggccttcccccgggatttcgttccctggccctccgtctgggtggactccttcgtctgtgtgctcttccccggtgggctcccaccctcccgggtttgtgtgctgccctatccacccaggggtccggtgccctaacgccagaaaangtatagggactcccaaacagttcgggatttagcttanatggacatactggatgggtaanantacccctaancc

SEQ ID NO: 20478 - DNA, 635 bp, Triticum aestivum
  unsure (1)..(635): unsure at all n locations
  Clone ID: PAT_TA_20478
gtcatantcatacaccatctcccaatcatcgtcaatggcgtctgccggaaaggaggagcaggtcagtgctaccccaaccgtggacgctggccaagcgcgagcgctcctgagctccggcggcggaggtcacgcgtatctggacgtcaggctgccggtggacttcgacaaggaccatgccgccggcgccgtcaacgtaccctactacctcgccgttactccccaagggaaagggagaaaagaaccccaaaattccgtggaggaagtaactgcgcgctatgggaaaggaacatcacttggtccgtggcttgcccgcactggcgttggattccaagcttngcgaccgccgacctccctnaatgccgggttatgaagaacgccgaagagccttgcaaggtggtatgttncttcctcccaanangcaaccgcggtttaanaaccanacctcaacanttgtnacttnacccatcatgatgcatgatcaaanggataattccgacttctttanatgtgccacagtttccttttttgancttcacaatttcangatgatgttaaatcgggattnttntacaaagggactncacattaacggccgggtngggaanagtctnaatttcctgggttttcaaaaaaaa

SEQ ID NO: 20479 - DNA, 400 bp, Triticum aestivum
  unsure (1)..(400): unsure at all n locations
  Clone ID: PAT_TA_20479
cgtgaccccgagtgacgtcggcaaactcaaccgcctcgtggtgccgaagcagcacgccgagaagcacttccccctgaagcgcacgccggagacgacaacgacaaccggtaagggggtgctgctcaacttcgaaggacggcgaggggaaagtgttggaggttccggtactccgtactggaacagcagccaagagctacgtcctcaccaagggtttggagcccgcttcgtcccgttaagaagggnctccggtggccgggcgactcccatcggtgttctccgtgctccggcctaacggggcaaggaagaaagcaattcttcatccgactgcaaagaagaacaaggcccggcggcngaagctggccccctgaccnggnggncccncaanatgggggttcccccg

SEQ ID NO: 20480 - DNA, 522 bp, Triticum aestivum
  unsure (1)..(522): unsure at all n locations
  Clone ID: PAT_TA_20480
ctggaagagtacacggcggtcttcttcagggtgttcaagcacgatggcaagtacaaggtcctcatgtgcaccgatctgacaagatcatcgaaggaaggaggggataaacaagccatcctacggggcatttctggacgtgggcgtggaagaaaggagaggagcatctcgctcagaacactgatcgatcacacggtggtggagagcttcgccgacggcgggaggacgtgcatgacggcccgggtgtacccggagcatgccggaggcggagggcagccggctgtacgccgttcaactacggcgccggggccgtgaaggtgtccaagctggaggcgtgggagctggccacggccgccgtgaacggcggaggccatatgtactccgctccngccggacgtcgcgacgcatgaagccttgtagatcagggtgtctggtgcatgctcatccattgactgatgtatttggaccctgagtgagattgtgggattatcatatatatattatccaatatgaacacattcacaa

SEQ ID NO: 20481 - DNA, 440 bp, Triticum aestivum
  Clone ID: PAT_TA_20481
gtcgaatgagagcatgtttccgccatccggcttcagctacgaagagaagtccgagggctgctttgccagctatgaggttcgcccgaggatgaactggatcactactgaatatggtggccataaaattgacaaagttctcaagaggtttgggagcaacatcatcttctccaacgggatgcgagacccgtggagtcgagggggggttctcaagaacatatcatccaacatcattgctcttgtcacagagaaaggggcccatcatttggacttcagatctgcaaccaaggatgatccagactgggttgtagaacaaaggagacaggaagttgagatcatacatggatggatagatcagtataacaaggacattgcacagatgtagcagtaagaaggcgtcattgattttcacagttgaggaaaataaatatgtggctacatgc

SEQ ID NO: 20482 - DNA, 1855 bp, Triticum aestivum
  unsure (1)..(1855): unsure at all n locations
  Clone ID: PAT_TA_20482
gcgccgttccgccgtctcggcgggccggcgggcacagtgggccgccccatcctcgcgcctcgccggagccccggccctcctcccccccccactcaccgcgccagcgccgacagcagccgcgcgagctacgaggctcgccccacgccggcctccacctctccctgaacgtggtgcccccatgattcaccgggctcccaagaggtgcgggagcaacatcatcttctccccacgggatgcgagacccggtgcagtcgaggcggggtcctcaagaacatatcatccagcatcattgctcttgtcacagagaaaggggccccatcatttggacttcagatctgcaaccaaggatgaaccagtcttgggttgtagaacaaaggagacaggaagttgagatcatacatggatggatagatcagtataacaaggacattgcacagatgcagcactaagaaggtgccattgattttcacagtcgaggacaataaatttgtggctacatgcaaaatattataaggatttgcctttcttttattaggcgatacgtaccaatatccacatacactttcttaccggctgccgcccacgggaggtcgctgtcggcggctccaacggcggagtcttagcatcatccttcacgcccaagtagccccctttctccacgggggcggtggcatcctcggcaccgatgctgcagttcgacgacttcaccccgtggtcgtccttctgcgacgccatctcgcaggacttcaagtctgagagcctgaggtgcttcagccgcgtcagggctttctgggatgcgcttgacaagccgggatgccaccacacaggcctcgcggcactcacctaaacaggccgcgcggggctcaccatgacctccgctgcctcgatgaccgtctggttatggtatgcactcacctactggcccgcgacagccttcccctccccagccaatttcatgatgaatctgcctgcttaccctgtgaaggagatgtgtaagatcattgattcttttcccgcgggagcagacatcatcgacaaagctttcgccgcggcgagcctgtactacaattactcggccggcctgtactgctttgacacgggcggcggcgatggcccccaggtcctgggtggcgatgaccctcatggcttcaaaggatggggctggcaggcctgcacagagatggtcatgccaatgacggtgtcgaacgagagcatgttccgaccatccagcttcagttacgagaaagatgtccgagagctgccttgcgggctacagagttcgtccaaggatgcactggatcacttctgaatatggtggccataaaattgacaaggttctcaagaggtttgggagcaacatcatcttctccaacgggatgcgagacccgtggagtggaggcggggtactcaagaacatatcatccagcatcattgctcttgtcacggagaaaggggcccatcatttggacttgagatctgcaaccaaggatgatccagactggattgtagaacaaaggagacaggaaactgagatcatacatggatggatagatcagtataacaaggacattgcacagacgtagcagcaagaaggcgccantgattttcagtcatggaaaataaatatggcttggtggctttgttaatctattaatctgaagtcaggcaatcgccttttatctaaataaataaataaataaatatggttacatgcaaaatgtaaggattttcctttcttctacagggtgataagcagtaaaagaagaagataatgcattagtgcaacttcaaattcaacaagacaccagaaattcttgaacttaagcggtcatacgtaatcataaatgcagagggt

SEQ ID NO: 20483 - DNA, 677 bp, Triticum aestivum
  Clone ID: PAT_TA_20483
cgccgcttgcgcgtccccaaccctaatccttccacacatgagcagcggcggcagggtgtcctggcccagcggcggcagggtaccccaatcgcgcttcaacgcctgaatccacttagcgcacggatccagcggcgacagggtgtcctggccgcgagcgccggggcaaggcggtccggcggcggcgttgtggcagcttcgctggtaatcccctcccccctttttttttgccatcaaaggcaaagaaagagattgggccggattcctcttctcctatgaaccggatctgatgataatttttttctttctctaactcggattatccgtccacagtattccagtccgtcaaggattacggtcctactccgatcccaagttcccaacagcccaacaccgtcgctcatatatacatcctggcgaatccaacccctgtatagacgaaagccggtgctaaaaaattcttcctggtagaaattcaaacccaagaacatgagctgcaggggaatctcgccgtccgtcctcttgcctccgttcctctacaagcccacagccttccgcctcctgcagcgacagcaagagcagtcctctgtggtcttggacagcttgggcgaacaaccatttcggcacagctgtcgacaaaatgtgttgcctcaagcgatgctgcttcctcggcactacta

SEQ ID NO: 20484 - DNA, 402 bp, Triticum aestivum
  Clone ID: PAT_TA_20484
ggtcgccatgtacttcggcgtcgaacgcctcaagggcagcggctgggttgagttcctgacgcccgtgccgtccgacagcttccacggatcgtcgtccgacgatgacgtcgaggatgtccgcgccgtcctcctccccgccgacgtgccccccgcccaggaggaagtggccagcaaggccgagtagcgcgcgcgcggggagaggcggtcgcaatttgtacctgcacacatacgtacctagtacaattgttgtacagtaggttcagtaaatgggtatatttgtcatacaccaattcattcataatcataccacagttagttgagttgtataaacccccgacttttcagggtgataattgtagttgcttcatgtttgggattcaaaaaaaaaaaaaaaaaaaaaaa

SEQ ID NO: 20485 - DNA, 1081 bp, Triticum aestivum
  Clone ID: PAT_TA_20485
cggacgcgtgggtggagggacaaggacgccatgggggagctcgccatcgccggccacgctcgagcgctgctggaatggcacaacacggcgaaattctgcggggcatgcggggcaaaggcagttcctaccgaagctgggacgcggaagcagtgcagcaacgagtcctgcaagaagaggatatacccgcgagttgaccccgttgtgattatgttggtcattgataaacaaaatgaccgcgctctcttaagccggcagtcaagatttgtgccccggatgtggagttgtcttgctggttttatagagccaggggaaagcttggaagaggcagtgagaagggaaacatgggaagaaactgggatcgaagttgggcaagtcatttaccacagttctcaaccatggcctgttgggccaaataccatgccatgccagctgatggtgggtttctttgcttatgctaaatcattggacatacatgttgataaaaaagagcttgaagatgcccagtggcacagccgtgaggacgtcaagaaggcgctaacgtttgccgagtacgagaaagcccagagatcaagcgcgctcaaggtcaagcagatctgcaagggcgccgagagagggcagagcacctcctccgacctcagggtggagagcgaggaacccgctccgatgttcgtccccgggccctacgccattgctcaccacctcatctcgtcgtgggccttcgaaggggcgccgaaggtgcccagctccttctccaacctatgatgagcctggaccatactacttcgtcttccgatttacggcaggggatgtttgtatagcacactgaaacattgtaggcgcacgccatgtactttttcttacactgtcgatagctacggtagatatgttgttgctcattgctggtggttgtaacagaagggcagaagaggaccggggagggttttgcaagatcggcgtcgtggatatattgacggttattggtgatttgatttcgagtgtatgatgtataagaacttgcacggatgtgcttgcatagagacatatacagactgaagatgaagttgctatgtttttttccttg

SEQ ID NO: 20486 - DNA, 585 bp, Triticum aestivum
  unsure (1)..(585): unsure at all n locations
  Clone ID: PAT_TA_20486
ggagatcgaagatgttcgtattggagctgggcgtctggctgctgcccttcacgctgctgctggcgccggcgcggcggctcgtgcacctcgtgcgggagctgcagcggatcctcctcgtcgtcgcctgcggccgccgcacgcccgccgccttcggggaggtctggagccgcctcgaccgcctcgactccgccaccgtcatcgcctgatcggtcctccaccgatccttgcgtcgctatggctctgctccaccgtgtaattaacctcctgcgtttcttcctcttgtaaattccgcgcgtcctagttttttttctggcgcgtcctagttgtgcgtagctgttcttcaagaaaggatcgatgctacctcttttcttttgattgagcttttgaacagaccagctctctgttttcctttttgattttgacttcctcctctgtcctttccctcctgaatatgcatcaagacatgccattgtaattgcgttgaggagatgatcgatgaacaaggggtctcaatctgangcgatgatcttgttttaagatgttttataccagagaaaaaaacagaaaaaacaangaaaacattat

SEQ ID NO: 20487 - DNA, 2116 bp, Triticum aestivum
  Clone ID: PAT_TA_20487
ggcccgccgaacgcgtccgccagctccgcctttgctgctttcgctctgctcttccgtccccttcccccctttctcccccctccaccgggctcgctgccggtggccgccgcttccgccgcccgctttatcccctgctgatttacacatcagctgctcggctcgagctgcgtagcaagactgtggaggtcccagcgcctcacatcacccgtgccgccggacaaagaactactcctactcccggaggagatgaagtcccggagctccgcgaggggcgagccgaggaggttcgggaatgtggctctcctggcgctcatgctctgtctccctcgtcgcgctctcgctcatcagggccaggttctccccaatccggtaatgacggcccgttgcggcagaccattaaaaggtggtaggaatccgaacgccgggtggtggttgagcaagccccggctgtcaacggcgggaaggccggcgaattggcggccgacgagggccgccgcagtagctgtggaggaagacaaggaggaggaagctcagcccaaggatgaggaaattcagcccaagaccgagcaggccttggacgccgcagtgcggcccgccaaagccgcagtggccgttgacgccagcaagccggtgtgctacgagacgagccggcgctccgacacctgcgaggcggccggcgacgtgcgcctggtggggagaagccagaccatctacgtcgacacgctggagcgggagtggaagaccagaccctactgccggaagcacgacacctacgcgctgtcccacgtcaaggagtggtccctcaagccgttcccctccggcgacggcgcggcgcccaagtgcacgtccaacagctcggccaccgccttcgtgatctcgacgggcgggttcaccggcaaccccttccacgactacacggacgtgctcatcccggccttcatcacggcccaccgcttcgccggcgaggtccagttcctggtgagcagctacaagtcgtggtggatgagcaggtacatccagatcttccagcagatgagccggtacgaggtggtggacatcgacgcggacgacgaggtccggtgctacccgagcgccgtggtcgggccgacgttccacaaggagctgggcgtggatccctccaaggcgccgtcgggcgtctcggtggcggacttccgcaagatgctgcgtagcgcgttcgggctggagcgcgccacggcgacgccgagcggcgaccggtgggacatccgccgccggccccggctgctgatcatctcccggcgcacctcacgcgggcgggccttcatgaacgagcgcgccatggcggacatggcggggagcctcgggttcgacgtccgcatcggggacccggacacgacctccgacacgtccaagttcgcgcggctggtgaactcgtgcgacgtgatggtgggcgtgcacggcgccgggctgaccaacatggtgttcctcccggccggcgccgtgctggtgcaggtggtgccgtacgggcggctggagtggctggcccgcaacacgttcgcggagccgtcggcggggatggaggtgcactacctggagtacgtggtgcagctggacgagacgacgctgagcgagcagtaccccagcgaccacctggtgctcaaggaccccatggccatccacaagcaggggtgggacgcgctcaagaccacctacctcgacaagcagaacgtccggccgcacctcggccgcctcaagaagaccttcctccaggcgctcaagatgctgccgcacggccgggacgattagaccagcagctttagctcaccgtcgtcgccatcatcatgggagcttgagagctctgctggtagcctagtatcatcatcactaatagtgtacaaaatggatgcagaggacaagtgtctataacctttactctgttttcgcctaatccgtgggccgcgcggtgcactgtactactctactcttttttttttcaggatgaggtaaaacttgcagccgtgttaacaggatgcacacaccacactcagcacaaactagacccgctgtatcctcttctgttacgagaagcaatgcacatgtatttttataaaaaaaaaaacaattttgtagtacacgt

SEQ ID NO: 20488 - DNA, 660 bp, Triticum aestivum
  unsure (1)..(660): unsure at all n locations
  Clone ID: PAT_TA_20488
agtcgngngagcggcaccttngtacccgtcgtgtcccacgtgangancctgcgtctaggggnacgatccttgtcgtcgcgtccncggacgtcgcgcgccacngccgcccctgcgccggcgccgaccgcgagccccggcgcccggtcctgggccgcgtcgtcgtcggccgcgtccgcccgctcctccggctgtcgcgcggccgccgccgctcgcggggctttctccccccgccgctccccccaccgtcgcctccacggccgcggccacccctcgcccgcggcaggcaggcgggcgcgcttgcctcgagagcagtttggttgcagagtcgctgtgcttgtgtctctctcgaccgacactcagatgatggaacgcaagcgaaaatatctgagagcgacacggcggtgttgagcgtacgtgcaggtctgcgtccatggagaaacctcaagaacccatcggcgtgccgtccagtgtacataattccgccacacccaagaacctccactgtactgaaaaaagaatctgtaataagccttcgatgaagcttgtgctccggtgtgctccggtcaggagctagctagcgccggcctgaaaattggttcgaacgtttctctgtctattgtactccaaatgaatccgtcgtcgtgctgaagcccccacgag

SEQ ID NO: 20489 - DNA, 612 bp, Triticum aestivum
  Clone ID: PAT_TA_20489
tttgtttgccaggaaccttttgcctgaaagcatgatgattaccatatgatgcttagatttttgaaagctagaaagttcgacgttgaaaaggcagcacaaatgtgggatgagatgctccagtggaggaatgaatttgggacagacacaattttggaagattttgaatttcatgagctagaggaggtactgcaatattatccccagggttatcatggggttgacaaggatggaaggcctgtctatatcgagttgcttggaaaagtagaacccaataaacttgtgcaaaccacaacagtggaacgatatatcaagtaccatgtgcaagagtttgagagagcattccgtgagaagtttcctgcctgctcaattgctgctcaaaagcatatagatacaacaaccacaatattggatgtccatggcgtgggctggaagaactttggtaagattgcaagggatttagtgcgctgtatgcagaaaatagatgggtgactattatccctgagacactacatcaaatggtcaattgtaaatgccgggagctggtttcaaactgatctggggcactataaagggacttcttggccccaaaacatcatcaaaaattcatgttct

SEQ ID NO: 20490 - DNA, 742 bp, Triticum aestivum
  unsure (1)..(742): unsure at all n locations
  Clone ID: PAT_TA_20490
gagcctcctcgcggacgccgagagcctggtgcccgcgcggggctcgagcatggtcgcgcagaacgcggtggaggacatcatgctggacgacggggagaagatggtcaacgcgctccgcgccgagctgctgcagctgctcaccttcatggagtcccaggcgctctacaacgagcgcgggcacccctacgcgctcgccaccattgcgtcgcacgggcgccagcgcactgctggtaggggcgatgagggggaggtcatctccctctacgtcacgccgcgcatgatcgcctacctggagcaggccaagaggttcgaggagaacccggaggagccggtgcccaccgccgacgacgacgtcgaggaggagataagaaacgaccccttcggcaccatcgccgccccgctcgccttgtacctcgacaccgccatacaggcgctgcagtccatcaagaaggtgctcgccggcgccagccagcgcaagcgctgaaccgcgcgctcgatatatcgtgtgcaacacttcatatatgttgtatccttgcattgcattgcatgtgtttgtacgttggcttgcatgtaatttcccctttatctcttccctgtaaaattgtaatccgtgtaccccgtttgtttcaattaaataaaaagagcgtgtaattgctggagtttgataaaaaaaaaaaacccaaaggggggccggtaccaatnccccnaaaggagtcgnttaccncccaanggcttgtttaaa

SEQ ID NO: 20491 - DNA, 628 bp, Triticum aestivum
  Clone ID: PAT_TA_20491
atacgactacgatttcgagttccctcaagatttgacctcgatatcagcaatctccgcgaaaaggaacaggtatcagcgggcaaagtccgtgatgctggcagagatggacgcccacaacacggacggtttctacacgaacgggaacgggaacactcgataagcgacgcatgcacgctggaaatggactggttgtcgcatgcacccagaagaaacactcataacaggctgcatggtcagagcagggatagtgcgttgtgaattgatttttgccagcatcatcggcatcatgccctggtagcttcttcggtcagcagcaacagcttcgtcgccactcccttgcagatactcccatacacgacggagctatccgaggcgtaccttaggtcatgtttaccctactatagtatgagctggtggtggtagttagtactagggggccttgctcctttcccgggcggcgtcggtcccgggtccgggtgttcgttggggcttagggctcggttgtccactgtgtgcaccgggggtacgcatccgggggtatctatatttttgttcttgtataaaaacctgacatggtgcaactgacaaaggaggcaaggacaatgaaaacattggttcgtgtgtgatc

SEQ ID NO: 20492 - DNA, 766 bp, Triticum aestivum
  unsure (1)..(766): unsure at all n locations
  Clone ID: PAT_TA_20492
gggnggnttccttgaccttgttggggnanaaccagcagccttttnggaaacagctntnccnttaccatacaagtcgcttattccggcaaccaggaagttccggaattctggcnattctttggggaaaacaacttaaaccnttgcataaactgtatctcaaaacacaattttccatcccggggaaccagcacaacactcccatggcaaactggccgtgctcatctcccatggccgcgcgcccgcgcccgccctcgccggtcgcctgcaccggcgccagcggcaccgccggcccatgcgcaccggcagccgcgccccctcccgccgcccgcacctggcgcgcatcgccgaggacccctgatcgagcgctggctcccggtcgtgccggtattgtcctttctgcatggatggtctcgttttcctgtctgatcgcgtggtaaatattcttgttgcatgtctcacatttattattgtcttgttaatctacccccaagtgtacattggattcaagtgtcgcgtgtgtgaacagaacaatgctgtgaccgtggcatatgtttctttttgttttgaacttcctgatttgtgccttgtnacactcggttggnaaatacaaaggagctncaattttggccncccntaaaaaaannnaaaaaaanccaaggggggcccgtaccaattctcccaaangatcctattancngcnaggggcgtcctttaaactcgtgacgggaaaccngggtnccaactaacgctngagaatcccttccca

SEQ ID NO: 20493 - DNA, 423 bp, Triticum aestivum
  Clone ID: PAT_TA_20493
agatgcatcaaatgcagcggagaaggccgagcggaagatgcagctgaaagacaagaagcgcagggaggagatggagagggtggtgaaggagcggcaggccgagatacggagctacaagggcctcatggtcgccgagaagatgacctccaaccgccagatcgcctccgccggcaagtccatacaggaaatggaggacgagttcgtctagcagctagcctcatgcgtgtgtagtgtatcatccatgtccatgtgtatatgtgccgatgcgcgcaccttgcgtgcgtgtgcgagcgtggtctcgacgaggcggccgatgatcgatcgatcctcgatgttactgacggtgcaggtgtacatatataaggtccttgatttggacagaaatgagaaagcagctagcgcagaaaaaaaaaatttttttca

SEQ ID NO: 20494 - DNA, 1073 bp, Triticum aestivum
  Clone ID: PAT_TA_20494
cgtccggttcctccctctcccacatcggcgccgcccccgcccccgcccccgccggcgaactcgccctctctcccaccgccgccgcgctccaccctctccctccctccctcacttcaccttctctccctacaccaggccgggccgcagatcgagcttctctccccaccctaggtcggggcgccgcagatcgagcgggtcaggcccgatcctccacggtcgcggcggcgcttccccgatccgtgccgttgacaagggattcgagcagggcagcgcagggaggggagcctctgtgtgccgccgcccccctgcttccctcctctcctctctgtgccgccgggagaggagctcgtcaagccaaggtgcgcaagagaccgccgtgtggtgctgcgcgcgtggttcttcttccactccggcgcctcctgccctgcccctccggtggccgcttcgtcttcttatactccggcacaggtgatattgaggagtacagcagtaacacgggcaaattcagcctttctttcgatggaggacggggttgatttcaagtatgacggtgtcaacaacgagagcaaagagcgtaagggagggcatggcatcccaaaggtttccatggtcccacttgtcttcctcatattctatgaagtctcaggaggtccctttgggattgaggatagtgtcaaggctgctggaccactcctggcaattgtggggtttcttctgtttgcgctcatatggagtattccagaagccctaatcactgctgagatgggtactatgtttcctgagaatggtggctatgtcgtctgggtctcttcagctcttgggcccttttggggttttcagcaaggctgggcaaagtggctcagtggtgtcatagataatgctctctatccagtcctttttcttgactatgtcaagtccagtgttccagctctcgggggtgggcttccaaggacttttgcggtgcttatcctcacagctgcccttacttactggacctacagaggaataacgataggtggctgggtggcagtccttcttggggtgttcactctgctccctttctttgttatggg

SEQ ID NO: 20495 - DNA, 500 bp, Triticum aestivum
  unsure (1)..(500): unsure at all n locations
  Clone ID: PAT_TA_20495
gtgaccagctgcatccaagccacacattgcagtttggccaacacatgccatccgcagagcaatctaggggagtcgagtgggtgtatccgactatatatcaggatgatcaagtgccttatgacaggcggacatcttgatccgtagaacaaggagaatgattccaggtccctgatgagatgtacagagggggcccgggaagctgccagctggcgtcggccccccaccccaggtggtgttaaacatcggaggcgaggcggcgtgatgagagcgtcggcgcgtgtcggcacaagtctgggcatgtggtttgattctttggcctgcatagagaccggcaggaaggaatgtggcaatgtgccttgggctggccttgatggtgctagcaactgctaagatgtatgtactgcgcctgatcctgacaagaaccaaatatactctctcaaatcctgctctcttttgacgcggctctgaccnagtgaatacatggtcggntttttcttcng

SEQ ID NO: 20496 - DNA, 617 bp, Triticum aestivum
  unsure (1)..(617): unsure at all n locations
  Clone ID: PAT_TA_20496
aagtcttacctgatggtgaccatgatctccaacgctgtcagtatgtcacagaaaaggttctggctgctgtctacaaggccttgaatgaccatcatgtctacctggaaggaacactgctgaaacccaacatggtgacagctgggcattcctgccccaagaagtacacccctcaggatgtggctgtagcaactgtcactactctcctccgcactgttcctgctgctgttcctggaatctgcttcctgtctggaggtcacagggaagaggagggcttctctccatttgaatgccatgaatcagtcccctctgcctaaaccttggaaactggccttctcatatgggagagctctgcaagcctctgccctgggcaacatggcttggcaaatcagagaacaagaaggctgcacaggaagcttccngnaagcgggcccatttaaaaatttggcttcanggaacatntntcactctgggaaanatgaaaaagctgccaagccatcantttaacgcaagctctcttatngaaacaaaganctgatttgnccgtccttccaaangggganntccaanagtnagaaanaattactnttccttccaaaaaagggaaggttttcccccct

SEQ ID NO: 20497 - DNA, 664 bp, Triticum aestivum
  unsure (1)..(664): unsure at all n locations
  Clone ID: PAT_TA_20497
tcccaactaggctttcaagacgcctcatcccccatcatagaagagctcgttgaattccacgaccacgccctgatagtcgcactagcaatttgcagcttagtactctaccttctaactcttacacttatagaaaaactatcatcaaacaccgtagatgcccaagaagttgaactaatctgaaccatcctacccgctattgtcctagtcctgcttgccctcccctccctccaaatcctctacataatagacgaaatcgacgaacctgacctcaccctaaaagccatcggacaccaatgatactgaacctatgaatacacagacttcaaggacctctcatttgactcctacataaccccaacaacagacctccccctaggccacttccgcctactagaagtcgaccatcgcattgtaatccccatagaatcccccattcgagtaatcatcaccgctgatgacgtcctccactcatgagccgtacccgccctcggggtaaaaacagacgcattccctggacgactaaatcctacctcctccaccacactctaccaggagtgttttacggccagtgctcagaaatctgcggtgctaaccacagctacatacgcattgtcgtagagtctagccccctaaacactcgtgcctgtcctcatacgtactaann

SEQ ID NO: 20498 - DNA, 409 bp, Triticum aestivum
  unsure (1)..(409): unsure at all n locations
  Clone ID: PAT_TA_20498
cttcaccccaactacccagctatcaataaacatggccttagccctgccactatgactagccaccttactaacaggcctacgaaaccaaccctccgcctccttaggacacctactccctgaaggcacccccaccccactgattccagccctaatcataatcgaaacaaccagcctacttattcggccattagccctaggagtacgcctaacagcaaacctcacagctggtcacctacttatccaacttatctctacagccacaatcgccctactaccaataatgccatcaatctccgccctaacggcactcatcctattcctactaaccatcctagaagtggcagtagcattaatccaagcctacgtcttcgtcntcctcctaaggctctacttacaaggaaatatttag

SEQ ID NO: 20499 - DNA, 1410 bp, Triticum aestivum
  Clone ID: PAT_TA_20499
gagagaaaaagccaagggagtaagtgtgaagcagcagtatttttgtggaatcttgaagcagttcggagatagagttttccaagcacgacaacttatttacctaagccaaaaataccccaaggctccattctcagaggtttctaaatttgtacatgattctatcggcgtccacaaagagtgctgtgaaggggacatggtggagtgcatggatgacatggcacgtatgatgagcaatctgtgctctcaacaagatgttttctcaggtaaaatcaaagactgctgtgagaagcctattgtggaacgaagccagtgcattatggaggcagaatttgatgagaaacctgcagatcttccttcattagttgaaaagtacatagaagataaggaagtgtgtaaaagttttgaagcaggccacgatgcattcatggcagagttcgtttatgaatactcacgaagacaccctgagttctccatacagctgattatgagaattgccaaaggatatgaatcacttctggaaaagtgctgcaaaactgataaccctgctgagtgctacgcaaatgctcaagagcaactgaaccaacatatcaaagaaactcaggatgttgtgaagacaaactgtgatcttctccatgaccatggcgaggcagacttcctcaagtccatcctgatccgctacactaagaaaatgcctcaagtaccaactgatgtcctgcttgaaactggaaagaaaatgacaactattggtactaagtgctgccagcttcctgaagacagacgcatggcttgttctgagggttatctgagcattgtgattcatgatacgtgcaggaaacaggagaccacacctataaatgacaacgtttcacaatgctgcaccagctcctatgctcactgcagaccatgtttcactgctatgggagtagataccaaatatgttcctccacaatttaaccctgatatgttcagctttgatgaaaaattgtgcagtgctcctgctgaagaacgagaagtaggccagatgaaattgctaatcaacctcattaaacgcaagccccagatgacagaagaacaaataaagacaattgctgatggtttcactgccatggttgacaagtgctgcaagcagtcggacatcaatacatgctttggagaagagggtgccaacctaatagtccaaagcagagccacattaggaattggtgcttaagacacggttgccagtgagaaaaatacaaagataaaatgcttctcctgcccattaccttttttcccttgttattgaatcgtggtttcataaatcttcagtgttttgtcaaacaatatgcttttccagaaacttttcaattctattacttgcaaaaaataaaaaataaaaatagaataataagccttagccctgaaaatctg

SEQ ID NO: 20500 - DNA, 633 bp, Triticum aestivum
  unsure (1)..(633): unsure at all n locations
  Clone ID: PAT_TA_20500
atttagcccacatcataatctgcagccatgaagtgggtaacattaatttcattcattttcctcttcagttcagcaacatccaggaatctgcaaagatttgctcgtgatgcagagcacaagagtgaaattgcccatcgatacaatgatttgaaagaagaaacatttaaggcagttgccatgatcacatttgcccagtatctccagaggtgctcttatgaaggactgtctaagcttgtgaaggatgttgttgatctgggcacaaaaatgtgtagccaatgaagatgctcctgaatgctcaaaaccactgccttccattatcctggatgaaatctgccaagtggaaaactccgtgactcttaaggtgcaatggccgactgctgtagcaaagctgatcctgaaagaaatgagtgttcctgtcatttaaagtttcccaaccagacttcgttcagccatacaaagacagcttctgagtgaatgcaaggaatacaggacacaatgcattccgggcattcacatcgtgcagaaaacctctgagcccgaacctagttgcgtgattgaaacccttaactgtgaagaatgtgcgggtgccgaacaggagctaaaaaaacaggtcgtgctgctgacacanggaat

SEQ ID NO: 20501 - DNA, 636 bp, Triticum aestivum
  Clone ID: PAT_TA_20501
agaaagcacttgcagagatcttctggagacttggagctctctggaagctgcacattacacaatgaaaatctttctggccttccttcttgcaatgggcatcatagtgacacagggtgatgctttctgctttagtaaattgttcaagccaggagaggctgaaaaaggctgtatgctggatggagtattatatccctttggagagattccaaggacagaaaattgcttcagatgcagctgcagcaaaaacgaaatgcattgctgctccctccatcacactcctggtgaattaatgataaaggaacgtgttaaagtcattttcaacaaggaaaaactgtgactatgaggtggtgcagaagcacccttcaaagccatgctctggggtatgctcgtgtaggctaacagtgtgccctgctccaagctactccgtgccgtgggattcgcctgttcctgggagatgctcaaagacatgagagatcttataagaaagagtccctcggtgcgtcccaccccaatctcccatcttattctatgcatgtttacaagacctattccgagtgctgcgccttactcctctcgttacctgcatgggtgtcaccgagctttgttgaaccaataaatgcagatgaacatcaaaag

SEQ ID NO: 20502 - DNA, 603 bp, Triticum aestivum
  unsure (1)..(603): unsure at all n locations
  Clone ID: PAT_TA_20502
ggagcatccagcggccagccggcgagcaaaacgagtgcttgctagttgctactactagcagtaacaggtgtgctgcagagtccgtagctaagcttgtttgtggttgagagatggaggcgagggtggccgcggcggtgctcgtgctgctggcgctggtgctcgtcgtcccggaggcgtgccgggcggagcggttcatccgtcggcgacgcggcgcggtggacgtgggggtacaactacaccgactgggtcatcaaggaagggccccttcttccaaggacgacagcctcgtgttcacgtacgacccgcccgaacgccgacgacgcacgcgcacagcgtgtacatgatgcggaacctggctgactaccatcctgcaacctcaaaggcggccaactggtggccggctgacggagggccccggcgcgggcttcttcgtcgccctccaccgaagcgcactcctccgctgcctccgctagcgccaacnccccaggctccaactgcaccgccgcccaaancctctccgcccgtcacgccctcctctcccccnngccgcgaacgattaacggcccctcctcgnaggccccgccggttntcnatgggntcaan

SEQ ID NO: 20503 - DNA, 593 bp, Triticum aestivum
  unsure (1)..(593): unsure at all n locations
  Clone ID: PAT_TA_20503
tgaatggctaaacgaggtcttaactgtctcctgtaggtaatctatgaaattagtattcccgtgcaaaaacgagaatgtgaacataagacgagaagaccctgtggaactttaaaatcacgaccaccttacaaccttacacagccccactgggtccacccacacataaacccctgggtcgacatttttcggttggggcgaccttgggagaaaaaaaaatcctccaaacccacagaccacaactcttcactaagaccaactcctcaaagtaccaacagtaaccagacccaatataattgagcaatgggaccaagctaccccaagggataacagcgcaatctcctccaagagcccatatcgacaaggagtttacgacctcgatgttggttcaggacaacctaatgggcaaccgctattaagggtcgtttgttcaacgattaacatcctacgtgatctgagtcagacggggcatccaagtcggttcaaccatgaccaccccccctaatacaaaggacggagaagtgggcaatacacggacaaaccaacttcaagcatgatnaatcaacacctatgcccttccccnatatacatcntan

SEQ ID NO: 20504 - DNA, 674 bp, Triticum aestivum
  unsure (1)..(674): unsure at all n locations
  Clone ID: PAT_TA_20504
attaaacccaaacccatgattctccatcatactcctaacttgattcaccttctctctgcttatccaacccaaacttctttcattcactctaacaaacaaccctgcaaacaaaattacaacaactaaacccaccccctgaacctgaccatgaacctaagcttcttcgaccaattctcaaacccctgcctactaggaatccctctaatcctcccatcactccttcttccagccctcctacttccatcaccaggaaaccgatggatcaacaaccgcctctccaccatccaactctgattcacccacctaatcacaaaacaactaataacccccctaaacaaggcaggtcacaaatgagccctcctactcacctcacttatcctaatactcctctccattaacctcctaggcctcctccctacaccttaaccccaactaccaactatcaataaacatgggcttaggcctgncactatgactagcaacttactaanaggctgcgaaacaacctcggctccttaggcactatccctgaaggacccnacccaatgatcagcctacatatgaacaccactattatcgcatacctagggtagctaaggactctgaggtcgctctattacaantatctaagaaanngcctanacanatganaactcgnctacgganaccttnng

SEQ ID NO: 20505 - DNA, 430 bp, Triticum aestivum
  unsure (1)..(430): unsure at all n locations
  Clone ID: PAT_TA_20505
ggcaaagcacagcgcggccagccatgaaggtctccatcctgctcctgctcatctgcacggccatcctggcggtgggagcgcgggccgaagctcccgataagacagaagtggtggtgaagaaggtgcaggagtacgtcaagcaagccactgaggcggtcaagacggccttcaccacagtgcatgagtcagaggcagctcagcaagccaggaaatggctgtcagacaacgccgacctggtgaagcagcagctgggcaaagctgaaggagcagctggccgagctctgggaagctgacgccgaccgcgtagcccggctgtgggctggtgggggccgactgggtgcggtcctgccccccatcccacgcacagcaccgtttcccttttgtcgtggttcttgcaataaagtggactggagtgaaaaaanaaaagtca

SEQ ID NO: 20506 - DNA, 825 bp, Triticum aestivum
  Clone ID: PAT_TA_20506
attcaggaaaaggaaagaagatcatcagagagtctcctaatgtcacagtttcccgtaacactgaagaagcaacttgttgatgattgggagtttgtcacgcagctgggtaagcttgtaaaactacctcgatcgcccactgttgatgatattctaacgaagtatttggagtatcgggtaaagaaggacaacaagataagtgactcttgtgctgaggtaacaaaaggattacgctgttacttcgataaagcattgcctgccatgcttttatacaagaaagagcaaaagcagtataaggaagaaattaaaggtgacgtttcaccctcgactgtatatggagctgagcatctactacgtctgtttgtgaaactaccagagctactttcttctgtgaacatggaagaagatgcactcaacaaactgcagcagaaattactggacattctcaagtttctgcagaagaaccaagtccatttcttcctttctgcgtacgacggcgattccaaaggcgccgacggggcaaaaggcaaatagaagcaaacgttggtatctgtatgtcggatgcgccatccactgctggatttgtgttgcgtagctcacacctcatagtctggttgttgcttggatgtggatgttttgtgggatgtgtgacccctgaccgctgatcgccgctgctctgcttgctaacgacaagttcatgtagctgacctgtccaacatcactgttggccggcgtacaaaatccttgcgtctgtgtggtgcccctgggactgacctgcatcagttaactagtgtacatttgcagaatcctctgttttcttgcgaaaaa

SEQ ID NO: 20507 - DNA, 756 bp, Triticum aestivum
  unsure (1)..(756): unsure at all n locations
  Clone ID: PAT_TA_20507
atcgcccactgttgatggtattctaacgaagtatttggagtatcgcggtttcccggatcactagagaagcgactcgtgggcggtggggactttggcacgccgctgggtctgcgtgtaaaactacctcgatcgcccactgtggatgatattctaacgaagtatttggagtatcgggtaaggaggcgttacaccctcgactgtatatggagctgagcatctactacggctgtttgtgaaactaccagagctactttcttctgtgaacatggaagaagatgcactcaacaaactgcagcagaaattactggacattctcaagtttctgcagaagaaccaagcccatttcttcctttctgcgtacgacggcgattccaaaggcgccgatggggcaaaaggcaagtagaagcaaacgttggtatctgtatgtcggatgtgccatccactgctagatttgtactgcgtagctcacacctcatagtctggttgttgcttggatatggatgttttgtgggatgtgacccgtgaccgtcgatcgccgctctgcttattaacaacaagttcatgtagctgacctgtccaacatcactgttggcctaggtacaaaatccttgcatttgtgtggtgcccctgagactgtcctacatcagttcactagtgtacatttgcagaatctctctgttttcttgcgaactctgaataatttccttctttgaacaaaananaannnnnnaannaaaaaaaaaaagcggccgctct

SEQ ID NO: 20508 - DNA, 772 bp, Triticum aestivum
  Clone ID: PAT_TA_20508
ccgggctgcaggattcggcacgatggtggtgctgcagcgccggtatcaaagtgtgacgacgacgcgagctccgggtccgggtccgggtccggtggcaagctgagcttcaagtgggaggcgggcagctgctcgtcggcttcgtcggtgctgtactcgccgctgtcgttcgcgtcggcgccggccgggaggacggagcagcagacgccgtcacgggggaacgggaactacaactacaggtacaatgggtacgcgtcgcggctgtcgtcggtgagccagaagagcacgtcgtcggaggcgtgccggatggcgcagtggatcaccaccgattcagactttgtggtgctggagctgtaagtgaaagtggtgccgcagcgctgagggtggtgggggccgcattgctgaaggtggtgatgccgcagcagcctcgccagccggcctgggttgttaattactctagttagttagggagggagctaaataggagcagatgcatgtgctgctatctattctagactgatgaggagcctcatgcatgatcaaggagaagagaagcaattaatcaacagcggatggatgcatgatggagcagcaaagctaagcaagcaatgatggagttgtcaaattaagtctagtggtttctccagcagctagcctattttgccgcccgtttttgtctgttattgatgaaggtgttctcgcgttgcgcgattttttgttttgttcctttttgagataaagagatgattacatggtttaaaaaaaaaaaaaaaaa

SEQ ID NO: 20509 - DNA, 568 bp, Triticum aestivum
  unsure (1)..(568): unsure at all n locations
  Clone ID: PAT_TA_20509
tgtgtgggtcttgaactatgggccgcggcccgcgcgccttatgtctccctccgcggtcgtcccgggcgatgccttcattcgcgtgggggttgtcgactctgctgtcgacgggcatgctcttggccctggttcgccggtgtcgctggtggcgtgggcgtgtggcgttatcggtcggtgtcccttgcctgatctctgccgatggcgtcatccggccgtttctgcggcccctctacgggtgtgcttgcgtggtgcccctcgtgggcgcggcgcttggcaggcaaacattgcttccccttgnaactatattcgctcactcttggtttagttggaatgaacatagcatgtgtgtttgctgcccttgtctttttcacacagtagaatcctgtagtgttggttttgaactatgttctgctgccggtgaacccaaaagaaacacaccgctatcttcccatgcgatgccatatttcgtgtgggggaagattacactgcagaaaacttgatgttgccttttctgctgtttctgaaagaaaatgcttcttgtcaaaaaaaaaaaaaaaaaactcgagac

SEQ ID NO: 20510 - DNA, 710 bp, Triticum aestivum
  unsure (1)..(710): unsure at all n locations
  Clone ID: PAT_TA_20510
cgaaatactcctcctcccctagggttttgctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattgggtgttgaagttcacccattgggatttcaccactaactgcggaaagatccgtttctactgctggggacactgctggggcaagagaatttgggtggccttaagagatggatactatatccatggtcaagtgtgcgattatcatgtttggatgtcacttcaaggctgacctacaagaatgttcctaacgtggcacaaggactgtgcaggtttggtgagaacatcccattgtcctgtgccggaacaagttgatgtgaagaacagcaagttaaggcaacaagtgacatcacaggaagaagaactgcatacattagatntcgcaagacaaatacactttnaaccctccttacttcaggaaccggtgggnttcanatcactttnaacatggnctaaccccgatgacntnactgcatcaaaaaacaggttantttngtganggaaacatgccannataattttttataaaggnaaacccttgttaanaatttacaaa

SEQ ID NO: 20511 - DNA, 337 bp, Triticum aestivum
  Clone ID: PAT_TA_20511
tgagacgcatgcgaccacgcgtccggtagcacctagagcttgaggacaaaggcaggccatcaagtatgataggatgatgaagaaatacggacatggcatgtgctactaatgtgaagtcctgcttcatgcccaagaaggccgaatggggattgtcgcgccaggtcgcccctacgaggatgagcatggtcagacgcgcaagaccatacgacgatcagctcgcgaagacctggaaatcgatcaggtcaacggcgcgcggcataatggccatggactaatccaactgcacatgacagaagcgaatcgactggatctgcctgaactacacatatgcgaacct

SEQ ID NO: 20512 - DNA, 564 bp, Triticum aestivum
  unsure (1)..(564): unsure at all n locations
  Clone ID: PAT_TA_20512
ctctggagttgttggacacttccctcatctgcctcgccgcgctcgccggcggagccacctccgctcctctgcacttgcagtgcctggacaacccgccggacctgaccgccgccggagcccaggcgggaaaggtcgtcgatgacctgtccggcttcagggcctacgtcaccggccctgtccactccgaccgggccatcgtcctggcctccgacatcttcggattcgaagcgccattgctgaggcaggcagccgacaaagttgctgaagctggatactacgttgtggtgcctgatttcttcaatgggaaaccttacacgggtgacccaagtgtaaacatcacacagtggatagatgatcactctccggtaaaagccgctccagatgccaaaccaatttttgcgaccttgaaaaaagagcgaaaatctattattggggtttgggggatactgttggggtgggaaggtgcggggagatagcaaaatggagaggtgaaggnattgtatctccatccttcatcancggtgttgataaataganagncaagtcccatnnnatcttggagnn

SEQ ID NO: 20513 - DNA, 806 bp, Triticum aestivum
  unsure (1)..(806): unsure at all n locations
  Clone ID: PAT_TA_20513
aatcntgtaanattgccaaccnctttggttaactnttcgggattttcccagtattgaggatcctgggaattncccaggaaattgaggnaatattcgtacctttaagcatgtcatgacccataattttgccagtcctcttaatntgtgcggtaaagtagagagcaggttggatgcaatctaaaagtttccttgatgaccatccgcatgtagtggagttcttgcaaaggtcgctactggcaatgatagctcgatctggaccgtgttcctctcggtcctccctttgtgccgtggcctcttctgcccgatgcttgcacaggcaggtcagggcccgcactgttgtcgtgggagggcaatcgatagcagaacctatcctctcaaacaagacggtggttatcatctctgtggttagaggggattccagcgtgtcctcctcctgccgtgtgagcaacacgtctagcagcccctcatcgtaggtgctgccgttactagcagctctcgcagccttgcgctcgtcgataacgtcggtgatgatgcgttgcatgacatcgcggctgctcttaacgcggcgctcctcgctgctcaaccaccgcacgagcctcgaggatgggaagangtcgatgaggaagaagcctcccagcangtccatgatcctgttggatgcatggatgaaatcctcctgctggctgaacttgccgctgaagatngcccgtgccacgacgtcattgctcaacaccgcaccttctggctgacttaaggtggcgcagctgaccttcatgagcanagagntgccatctctcggccggann

SEQ ID NO: 20514 - DNA, 645 bp, Triticum aestivum
  unsure (1)..(645): unsure at all n locations
  Clone ID: PAT_TA_20514
cgaaagactcagcttaggccccactcaagtcaacttacccttcttcctcctcgatccacatatgtacgcctgcagctagctagcaagtactcaagatctctgggagtacttgctaggtccgcttcaagtagtagcaaggagccaaggagaccgagatctcgtttctctcttcccagcaaggatcccgcaagctattgttcctctcaagatcatcagagatggccaccgcaagtagtaacctgcaactaccggcagaactaccctacgattttgtgaaagaaaattacaaatgacttctctaaggagcgagaaattagtgacaatccatttggaaaactttacaagggaattaatccagatgatggcacagtgattgctgtgaagaaacttcaggaaaacgcaccaatgccagctggcaagatatttataaatgaggttcagaatattatggtgctcaaacacgcaaacattgtaaaaatggttggatactgcagtgaaacaacaaagaaattggtgcagttcgatcatcgatatattcaggcagatgttactgaaagtgtactctgctatgaatanttacctaaaggggacctgccagagcctctgggtggcacacccattggcgtatgcgttcacgttcaaaaa

SEQ ID NO: 20515 - DNA, 361 bp, Triticum aestivum
  Clone ID: PAT_TA_20515
gcgcattcattgatgattgatcagcagcacaagcgggcatgcaccggtggttgcatggtccagcaagcagcacacacatggttgttgccttatcatccaccgtcggagcacccgcttgtacgccgaccaacttgctgggaacgaagctgaagagacatgcgacctcaaccgggaactaccattggaagagctacacagccaacaggttaacagcaatggcaagggaaaagatctaccagacgaggtacaccgacacgtggaaggcatttgcatacgatatgtcctacgaccatcacgacatcacccgacggaagggcatggtggactccatgttgcacgcacctaatggcaacggctccca

SEQ ID NO: 20516 - DNA, 230 bp, Triticum aestivum
  Clone ID: PAT_TA_20516
tatatataccggaacataagtaattcagaatcctacttagtacaattctcgttactacacactgctaagtaaacccagccaagtcactaagtcagatgttgcttttgttttatatgaagtcaatttctcaacttgatcactactagatcaatagtttatatattgtcacattggctaggttcataaataaaaacatttgcaggttacataatttttttaaaaaaaaaaaa

SEQ ID NO: 20517 - DNA, 597 bp, Triticum aestivum
  unsure (1)..(597): unsure at all n locations
  Clone ID: PAT_TA_20517
caacgttgatgcatggcaatgtgatggttgatcccaatgcaacagcagcttgtaaaaatcaaggatgaactggacgtcatagagcttctgcaagggcgactgcctcatcactgtattggcacggtacaacctgtagtgaagtcatccctgcctaaatagctatcaaataaacttagatcggttgcttatgtatgcaccccaaagctgatgcgcactgcaatttcattacaaggtgttatccatagttgctgcatatgcttgggtattgtgatatttatccgtcaagcaatgctaagcattaggttgccttttattagatcccaacgttagggagcaccaaccatgagttccatattgggagagcggcatgtaaatacctgggatgaaaactatgatacaacttgtgtaatttgtattggatattaccttttggttgccagggggggccgggccctgtcccccatagggtccggttccgcgctcacggccgtcgtttacaccctcgccggttcacctgggcaccctcggtcgccgtgacattccctcccaccggcgtgccctaaagcccacgctgcctccatggggccacccttatnn

SEQ ID NO: 20518 - DNA, 844 bp, Triticum aestivum
  unsure (1)..(844): unsure at all n locations
  Clone ID: PAT_TA_20518
attcatgtaaaatctctactttatgccaatagctgcctgtaccattgttctactatctgtgtgatgctgaacaatatgttgttaatctgttgctaaattctcaccaaatgcacattttatttccttagacctattgttaaacaaaggcttaacttgtagcattttttcttaaaaataagcaaagaattcctgcagtttttctgttggaaatgagttattagttgtcacctaccaatgttggaatgtagagtaaggtcaggttgttgtgcatgtaactttatttcttatcaatatcgtcagtcatcagatgagccatggtcttgtgcaagcatttctcttttgaatgcagccatggtcttgcaagcaattgcggctggtagaacatgctgctattatgttgtactgcttgcagcagttcttgcttgatagtggcagtagtaactcaagtaaggtccaataataagttattaaacatgtgttcttgttcattaatatcataaaattaggagtaaggatttagctttcattttgcattcactcaacgattgtggcagtgaaatcaaatgtctcctctattgtttgaatccactcctgggttagatgacatcttgttagcgtggcatgatgaaagatcaagtttttcccattgatttgttcatcatcattatgcatgtgtacttggggaatcaagaacccttggtgccccaatgccctccttatacttctttatttccatcccattggtgttgtggtaagggaaccgacaagggaaacattanccncgtcttggtttaaanaacttaatttgcggatattaggcagtaaaatcctgttggtaaggaaa

SEQ ID NO: 20519 - DNA, 379 bp, Triticum aestivum
  Clone ID: PAT_TA_20519
ctatgtcccaaccttgcgcactcatgctagcaagctatatacctacatagtacagccatggccctcactcgtgatgggctcatgggccacctccgtctctcctttagaggggcttaagtccaccgtcggcctgccagtgagacgacggtccaacggatctagcctatgcagcgtcagcaactgtggaaggatcaggtgcatgcaagcgtggcccatctaggacatctaaaaactggagaccttgtcttacctgtcacctatcagaacggatgcaattctgaagcatgtctactacctaatccggtccaagtgattgccttggctcacattcaatacggttgggtctatcttgcgcgagcacaacgcatgtgctaggtac

SEQ ID NO: 20520 - DNA, 819 bp, Triticum aestivum
  unsure (1)..(819): unsure at all n locations
  Clone ID: PAT_TA_20520
atttggagtaacaaagtgcacctctggggactctggtgtggaaccatacatagcagctcataatacccttttggcgcatgcatcggttgtcagtctgtacagaaagaaatatcaagccatgcaaaaaggagttgttggcataagtatttactctttctggagttatccattgacaaattccactgtggatttagaagcaactaggagatgtatagatttcttcttcggctgggatactagatccgttgggtgtttggggactacccgcaagtaatgaagaagaatgttggctctcgccttccacccttcacggaagttcagtctgaacttatcaagggttctttagattttattgggaataaatcactactactctctctacgtgaatgatcgccctccgggaaacaggcgttcggagactacagcgcagacatgtcagttagtttaaggggttctaggatagacccaccatctagtcagggcttcccaagcaaatgttccaagtgatcccaaagggttccgccctcctcggggcggaccggactgcggcccccccgtcctgccgggcgatgttcgagcgcacggcgtcgggtctgccgattatagcctagattacacgggcaggtccgttccctgagcaactacatggaaagcacactaaacgcgattaggaacggggccacgttagangtatttcgcctgggcattcaaggatttgtttgactccgtccnggtacaattaagnacggctgtacgggtcgactccctacaaagntgcacggcaactagnctcggtcctgnatccgntcccaagnaaaa

SEQ ID NO: 20521 - DNA, 459 bp, Triticum aestivum
  Clone ID: PAT_TA_20521
gccattcaaagcctctccatgttcgaagccgcaacccaacctgcgtacggtctggctgcgcaggaaactgtggctgcggtaccgacctgcacgtgcgggaacaggtgcggcgggtgaaacatgtaccctgaggttgaggccgccagagcgaccgttctggtgtcctgcactggcacccacaaagcgagctccggcggtatggacatggcaggcgcgaaccgaggttgcggttgtacccatggcaagtgcggaaccatctgcgggtgttcctgctgcacatgatatatcaatcatcgatcatgcatgcaccccgccatatctatatgctatataccatcgattaccatgtaacataccatgataccgcaacctgtgcggtatgttttaacttgcaccatgagcaaatcagatgccagcgatcatgtaacccctaaataaaatctcccgggtttgctaaaa

SEQ ID NO: 20522 - DNA, 528 bp, Triticum aestivum
  Clone ID: PAT_TA_20522
ccgacgcgcgctcacctccgtcgtcctcagacgacgactgcgccccggccgtcagcggcgagctgaacagctgcgccctcttcctcccggagtacgccatgctcagacgtcgcgcccgcggagcgcgggcgcgtccaacaagggggaaggaggaagaggaggaggcggcagcgcaagtactgggcgtggttctggagctgatcgatgagagagcatcaggaaaattagcaatactccttgtggacgtgcgccatgtttaatccaatctagaagtgttacatatttgctcggtgtgttaattatttgccctactagcagtgagtagtgaattaagtgatggtaatgatatgaatatatatactcggtatagttcagcggatgtttaggctgaaactgcatggccttgctttgccaagggacatcagcaacgtcatccaagatacgagtgttcgatctttcgatgaaaattataacagtaagtactagttttggtggaaaaaaaaaaaaaaaaaaaaaaaaaaaaaaaaa

SEQ ID NO: 20523 - DNA, 400 bp, Triticum aestivum
  Clone ID: PAT_TA_20523
gaggtgatcgacggggcgttcaaggagggggcggacaagcaggccaaggccgcgttgacccgcgtcgtcgtgtcccgctccgacgccgacatggaggagatcaaggaggcctacctgaaacagcacggtgccaagctcgtggacgccgtcgccaagaacacccacggacattacagggacgcgctgctcgccatgatcgggaagtgatccactgaagctcagtcagctggagccggtcaatttgctctcctttttgctatttaccttaattgattaatcgctttttcgcagcgacagtccgtgttaattatctactgcttatcttacgtccaaatgtatgggatatctccactatcccgcatgattgaataaaaataattttctttccaaaaaaaaaaaa

SEQ ID NO: 20524 - DNA, 480 bp, Triticum aestivum
  Clone ID: PAT_TA_20524
agagaagctttgctcttcgaaaattatgtcgtgttactgaccgtgatgagacacaacttgagccaatgatgttatcggagccaacggattgctttcctgaccgagaaaggtgctgcgtgcattatgaaaggccgatgatgcaaattttctcattaaaattggctagtgtctctatcaacactagctcagtagaactatatggatatattgcagtgcgggattatgtggactcattgcttaattatattgtcaaccgtagcagggatgaccccattattgcgcaacagggttctttcattgagatgactggccctaagcgaggcattgcaatgaattcccctgttctagttgaatttggcatgaggatcaagacaggagagaaagaagaagatgatctaacattgatcgacggcgcaacagattattgtgacctaaccataccttctgtgtcattcacacatcgcattcatggcaattgtg

SEQ ID NO: 20525 - DNA, 535 bp, Triticum aestivum
  Clone ID: PAT_TA_20525
caccttcgtcgtgcccgccgagatcttccccgccaggctgcgctccacgtgccacggcatctccgccgccgcgggcaaggccggcgccatgatcggcgcgttcgggttcctctacgcggcgcaggacccgcacaagcccgacgccgggtacaggccgggcatcggcgtgcgcaactccctcttcgtgctggccggggtcaacctgctgggcttcatgttcaccttcctcgtgccggaggccaacgggaagtcgctcgaggagatgtccggcgaggcccaggacaacgaaggaccaggcacgcgccgccgccgtgcagccgtccacggcgtagctaggccggccgccatatattcacaactccgtgcgtgctaatgaagctgcatgatgttgatggggtcaaagatgcttaatcctgttgggaattttttggcgatactgcacgctttaaatacgaccgtatgtttgccggtcaatctatattcccacatatattaccaaaatctcatcaacttgcattcaaattgctaaaaaaaa

SEQ ID NO: 20526 - DNA, 537 bp, Triticum aestivum
  unsure (1)..(537): unsure at all n locations
  Clone ID: PAT_TA_20526
cacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccaagtgccccaagggctgctcggcctgccgcgtggtgacgccgagccctcacaagacgttccggtgcgccgacatgaagagcaccgtcgatggcacctgcggcgggcatgcaagaacactgatccgttcaanggctcaagctcaagacnaagtgtgccgcctaaaataaactcaagatgagatgacatcatggtgcctatgcttgtgtgtgggcctgctatacggcaacaatatgttactgctacctcctgtctgggcaatgtgtttccccccgaaaaaggtggtggngcttgtactgttcaactatcncctcaataaancattgatgtggctgtaaaaaaaaaa

SEQ ID NO: 20527 - DNA, 1886 bp, Triticum aestivum
  unsure (1)..(1886): unsure at all n locations
  Clone ID: PAT_TA_20527
ttttnttttgacttcccncggtnncgnnnagctnnanancnantnnntcctccgccctgcagtcccctccgcgcccctcaccgccactagctgtgtgcttagtggctaacctgcagtgtgtccctcccgttccgctcaccaccaccacacaccgcacgtacgtctgcttcttcttcttcctcctccccgatggcggggacgggggtgttcgcggacgtgctggacggggaggtctacaagtactacgccgacggggagtggcgcgcgtccgcctccggcaagacggtcgccatcgtcaaccccaccacccgccagacgcagtacagggtgcaagcatgtacacaggaggaggtgaacaaggtgatggacgccgccaaggtggcgcagaaggcgtgggcgcggactcccgctgtggaagcgcgcggagctcctccacaaggcggcggccatcctcaaggagcacaagaccccgatcgccgagtgtctggtcaaggagatcgccaagccggccaaggatgccgtttctgaggtggtgcgatccggcgatttggtgtcatacacggccgaggagggtgtccggatactgggggagggcaagctgctggtatccaatagcttccccggtaatgagcgcaacaagtactgtctgagctccaagatacctcttggagtagttttggcaatcccgccgttcaactatcctgctaacttagcaggttctaagattggcccagcactaattgcaggcaattctcttgtgctaaagcctccaactcagggcgctgtggctgcacttcatatggtacactgcttccacctggctggtttcccgaaaggtttgatcagttgtgtgactgggaagggttctgaaataggagattttcttacaatgcatcctggagtcaactgcataagttttactggtggcgatactggtatagccatttcaaagaaggccggaatggtcccgcttcagatggagctcggaggaaaagatgcttgcattgtgctggaggatgcagacctcgatctagttgcggcaaacatagtaaaaggaggcttctcatacagtggccagaggtgcactgccgtaaaagtggtgctgatcatggaagcggttgccgacactgtggtggagaaggtcaatgccaagctggcaaagctgaaagttggcccaccagaggatgactgtgatatcaccccagttgtaacagaatcctcggcaaatttcattgaaggcttggtaatggatgccaaggagaaaggggcaaccttttgccaagagtacaggagagaaggcaaccttatctggccgttgctgctggatcatgtccggcctgacatgaggatcgcctgggaggagccttttggccctgtcttgcccgtgatcaggatcaactcggttgaggaaggcatccaccattgcaacgccagcaactttgggctccagggatgtgtgttcacaagagacatcaacaaggcaatcatgatcagtgatgcaatggagagtggaactgtgcagatcaactccgccccggctcgaggtccggaccatttccccttccagggcctgaaggacagtggaataggatcccaggggataacgaacagcataaacatgatgaccaaggtgaagagcactgtcataaacctcccatctccgtcctacaccatgggctgagacgttcatgtacaggaatcggacgttgtataagcacacgagtacggtgtagagaattcaaatgttttgtaaccacgtgagatctggagatctgtatctgtatgcttctgcatgtaccttggctgttttacagtaaaaatttaaaaaataaaacaaaacgagagcnagcnaaaaaaaaaaaaaaaaaaaaaaaaaaaaaaaaaaa

SEQ ID NO: 20528 - DNA, 626 bp, Triticum aestivum
  unsure (1)..(626): unsure at all n locations
  Clone ID: PAT_TA_20528
gactgaaaatatgcttctcgacaaaacaagaaccgtgaaaattgctgattttggggttgctcgagtcgaggcttcaaaccctagtgacatgacgggtgaaacgggcacacttggttacatggcacctgaggtcctgaatggtcatccttacaacaggaaatgcgatgtttatagttttggaatctgcttatgggagatatactgctgcgacatgccatatcctgacctcagcttctcaagaagtaacttctgccgttgtccgccagaacctgaggccggagataccgcggtgctgtcccgagcgccttggccaacgtgatgaaccggtgctgggacgccaaccccgacaagcggcccgagatggccgaggtggtggccatgatagaggccaccgacacgtccaagggcggcggcttgtccccgagacacccctcgctcgcccccgtcccctgctcccgtccggaccctggcccccgacccccgggtctgacgccgtcgccccctgacctcattcctttgtgtagttctcctcccctgcccatgtcgggtaccgccaacctagccgatgcccgcttccccgcttcaccgtagggatgcctgggccgaacccgcttgccaaattnaat

SEQ ID NO: 20529 - DNA, 454 bp, Triticum aestivum
  Clone ID: PAT_TA_20529
ccgggcaggtacagcagcagcttgtcgtctggccatggccatggcagggggaagaccaaggaggaagagaacgtcggcctcgagcccgcgtccaagagggagtccatgtcatactccacatcatcctatggcagcttcacgacctatgagaagatcgctgccaagaacaggaacaaggatgatgaggcgatgaccccggtccggcgctccagcaggctgcggagtgtcaaatcacccgaggccgagtctagttagtgctccgacagatatgatgattgataaccgacagctttctgctgttatgttctgcgcaattgattattaagaggatttatgtttgtagtttgagattgcttttggaactgcacgagtgattgtggacaattcccttgtattgttctctgattgagatgatgaacctcctgcataagtgattgtggacaaaaaaaaaaaa

SEQ ID NO: 20530 - DNA, 415 bp, Triticum aestivum
  Clone ID: PAT_TA_20530
attcccgagaaagattcacaccagcccctctgacgagaacctgcaggccttcgctggcatcttctctagcggcgtcggcattgccaggcggagcccgggccctcggcactgagcctatgcaaaacaggttcattctttcagtcgtttacttgatctgttgtggagataatctgtttcttgttcttgtgggtaattagtttgttgacgctgaggatacagtatcacttgtatcataagttcataacatctcttgctattattgcaagtatagtacaccattttttgtgtatgaattcagtggaattgttgagtgttagctctgcaaaaactgacccagaccttcaaggaagtgtggagtgttattctgtcttctgggcttgatattggaagatacctgcttcttgtttaaaaaaaa

SEQ ID NO: 20531 - DNA, 366 bp, Triticum aestivum
  unsure (1)..(366): unsure at all n locations
  Clone ID: PAT_TA_20531
cccatcctccgaggactttgagcgaaaatcatcaagtgaggaaaatcccaaacccaaacacctacaaacccaaagtgattgagcatcactgaagagattgatcctgcgtggatccgacgcttgttacctttgaagactgtgcttcttccagacggttaggcgtcatggtctaagagcatccaagaggaattgtggatcgccgagtgaccgagtctgtgaaggttgggaagtcgcctgaagacttaccacgagtgattgggcgaggtctgtgtgaccttagttcaaggagaatacggtgaggactgggtgtcctgagctgcgtgctccgaggactgggtgtccgggactgcgctcnaaggggggggn

SEQ ID NO: 20532 - DNA, 437 bp, Triticum aestivum
  Clone ID: PAT_TA_20532
ccccccctttttttttggcattgtcaaatttgtcacccaacgtgtgtatacaccacgtcacacgtcatggcgagtttattatttatattggactatacagcaacagtgtttggtatttccccatctctattgttccatacttccatttacatcaaagcagtgccacgagggcatcaagatacaaaaggattggcatatatttacaaaaggtccagcaaagccaagtacagatgtttgcatactataagttcagcggctcgtgcccaccaaactgacctgaagacgaaatacctcatggacagcaccacggttgagaatgactagaacttttgccccgtcgtcgcttgtgagccaactcagtgagtttttgtacgactcatagtcatcgggcaacctaaaaccatagaaccatcgaccaagcttgagcaagctcacct

SEQ ID NO: 20533 - DNA, 655 bp, Triticum aestivum
  unsure (1)..(655): unsure at all n locations
  Clone ID: PAT_TA_20533
cgggtgctggccgtccggcagcacgccacggcgcggcacggggccgtggaggcggagctcacccaggtggagaccatacggctgcacgtgccgccgcccaagatcccgttcccgatcttcgcgctgccgctgggcgtcatctggcggcgatcgtcgtcgtcgtcgtcgaggaagaggacgtgaacggacgcacgccgacatctccggacggacttgtgtctcaacctgcaagttcatccgtccaacccctccgatcctctgcttgctagccctgcacatacagacagacatcttttttctttccttttatttttgccacaaatctctcttcttcttcttgcatagctcatccgaatccgactggatagacacagcacatcaaatagaacatgcctcgccgggtctgtggttatgtccgccgtgagagaacatgccgtggcccccgaatgaaaaaaannccaattttatccnaggggggccggtaccaattcgcctaaaggatctataaccgcgctcatggcctcntttaaactcctgacngnaacctgggtaccaattaacgcttganaatccccttcnancggggtaaaanaaangcgacgttgcctcaacattggaccnatgnaangacccccgtcggcataccnggggtttg

SEQ ID NO: 20534 - DNA, 603 bp, Triticum aestivum
  unsure (1)..(603): unsure at all n locations
  Clone ID: PAT_TA_20534
agataatcaacagaacgaaagacactaccaagaccatactagtataagctaggagcaacaccgtgagtgctttcgcaatggcgaggcgcctgggagtcgtgctggttgtggcggcggtcgttcttctccttgtcaccgccacggccgcccggtccgacaagccggaggcgcacaaggaagacaagcccaaggggcctgctgagagaccgcccaaggcccaggggcccaagctgaaggagcccaaggaagacaagccgaaggggcctgctgagaggccgcccaaggcccaagggccaaagtccgaagacaaagccgatgcacgttaagtgcagcgagaactgcaagaaggacctcaaaatcgctagttaatgctaacccttggagaagtcatatcccaccaacgcactacatgtgcgtcacttgttgcaactttgatttgtcctttttccgtatatttgttttttcaataaggttcatcttttgaaccgtgtatcaaatttctgaattatttttgtctttcgctttcaaaataaaaataaaaataagtaacatttaaaagttcncaactttcaaaagaaaaaaaaactcaggggggccgtacaa

SEQ ID NO: 20535 - DNA, 731 bp, Triticum aestivum
  unsure (1)..(731): unsure at all n locations
  Clone ID: PAT_TA_20535
ccccgccggcccctccgccgcggacgtccccgcgctcgcccgggccctcgccaccccccggtccctcggctcccccttcgtccccgaccgcctcgccccccgggccctcttcacgtccgacgccgcgctgctgtcctcgcaggacacggggaggatggtgcgcgccaacgccaggttcccggcgtcgtgggagaagaagttcgccaaagcgatggtgaagatggccaacatcgaaatcaagggcagcggcgtcggcgagatcaggaagaactgccgcctccgtcaactagctggcgggcaatgcacatacgcaaaagctacggctactgcgatcccattttatcccgttcgccgatgcgatggtgaagatggccttcatcgaaatcaagggcagcggcgtcggcgaggtcaggaagtactgccgcttcgtcaactagctggcaatgcacatacgcaaaaactactactatttgatcccgttttcaattggttgtaaagaacatctgtggtgttttctttgctcgtgttgcttttttgaagggaagatgctgctttatttgttgattatttttctcctgcctgctgtatatctgttgtctggcatgcactgcctttcccagaaaatgtcgcagtatatctttgttgtttgatttgtatgtggtatttgccacaacattgcagtgctagatgtttcacatatccnaaaaaacaaaaaaaaaaaaaaaaaaaaa

SEQ ID NO: 20536 - DNA, 375 bp, Triticum aestivum
  Clone ID: PAT_TA_20536
ctgcgaccacgtgaaattataagggatgacaggaccggccaactgttgttatccttcaatcccgattttcggctcgacgggatctaccgggatgttcatgtcggcgctataacaacagggcacggccaattcatgtctgacacggaaacaacgatatgaatcgccgattactaaacgaccccagccgatggctatgtcacctgaatcagaaactatagcctccggcagtagcaatttgatcccagatgagataatcttctttcacatactcaaacttgttgctgtgaagggcgttgcgcacttacaaaccgtatgcaagtgatggcgcaccacattaaccagcatcagtcacgggcgctggtacgtggagcttta

SEQ ID NO: 20537 - DNA, 548 bp, Triticum aestivum
  Clone ID: PAT_TA_20537
tccgccgccgtcggcagcatctcctcccaccggcccgccgccggcgccgccgatggctccgtgcaactgccagcagatgccgcagcccacggcttgcaactgcccgaagatgccgccgcctgggatgtaccaccacagcccgccggccgggcaccactatgggttcctatccgggtcccacgtgcaagccggagggcggctccatccccggatgctctgcgctgttgccgctgcattacttcttctatggtggtgctagtcactgtctgttgtgtcactcagatccatatgtgcgtgcttactgctgtgctatgacattattactttattttttcaaaaggacattattactttattaggcatttttatttgggacagaggaatttcatcaagtttctatgagcattacattgttaattttagacacgttcttgcagtgcactcagaaattccgttaatctagccatatgtatggatttggttgttgcaatctagtacatttgatgaagttgattaaaaaaaaaaaaaaaaaactcgactcgtgccga

SEQ ID NO: 20538 - DNA, 489 bp, Triticum aestivum
  unsure (1)..(489): unsure at all n locations
  Clone ID: PAT_TA_20538
tgancatgncgcccccgcangacggggcccttgacgccccggccgccgaggccgatcagatgacctgccgctacgacacgctgctccgcctctagctccacggcgacgagaatagcaaggattcgtggganggggaactggggaaaggaacgagaaaagcgcttgcccccgctccgctctgctctggtccgtcttccgatgatctcgtggtgttctctccttgctagaaatggataattcctgccacttttttctcttactttctttccctcctcctttttttctctccttaccactttgattccatatgtgaaataattcagtcatcgtaacctgcgagcaaggaaatctgagctttcccttccttcccggtggaattccggganntaattgctgcagttgtggttcaataaattggaaaagggtaatccaaaggattaacanaaattnttncaaacatgcttccngtggtttcaangctttccattt

SEQ ID NO: 20539 - DNA, 483 bp, Triticum aestivum
  Clone ID: PAT_TA_20539
ctcgccccccgcccccccccccgcgaggtggtgcacatgctctcgcagcccgccctggccgccgccgccgccacagccgactgcgcggcccggcctgacgacgacgaccttatcctctccttctgaccagcacgccagcgttcaagatcgccgtggctcaggaattaagcagggagatcattatggtaattgtacgcgctatttttgggtctaacccttggtgcttaggtattttgtggcgtgtggatgtgtagtagcaactacaactactactacccctagtaccgtcagtgtgtaccccctgaagcttaaaggccaaggctgcgagatgtaccttgacgtggacatataatgggcgatgctgaatggacccactgtatatgtacatagtagttaacagacgaccaaaaatggacggggccgtttgcacgaaatgtatctgtacatagtagtaaaacatcccgagttcaaatatcgaactgg

SEQ ID NO: 20540 - DNA, 553 bp, Triticum aestivum
  unsure (1)..(553): unsure at all n locations
  Clone ID: PAT_TA_20540
gaaagcccggttcttcttgcaagttggcgaaggggagnccttgcagaggttgttgaggctgaccgcgcggcgaagcaggccgtggagaaggcggtccagctgcgcagcagggcccaggccctcatggagcgggccaacctggcggcgtacaagtcggtgatggccgtcaggatcgcagaggccgcgagcgtgtctaacaagtgccgggatttcgtgtggaggagcctcgactagccctgtggatctttttgctcccgcatttgtcgctgtgtgatataattgggctaggctgtcttttttgtgtaccccctcctctccactcctccggttggttgtaactatgcgaagaagaagaagaagaagaagaagaagaagaagaagcgaagtcggaagaaggaagtgtaattcgttgtgtaaatgatagttgggttaggtagatgatgatgatggactcaccgttcctgacaattctgtatgttacatgtaccgcccatgttttgacagaggaaaaaagaaggaaaaaaaaagatgaggtatgctagagcaaaaaaaa

SEQ ID NO: 20541 - DNA, 676 bp, Triticum aestivum
  unsure (1)..(676): unsure at all n locations
  Clone ID: PAT_TA_20541
cgcagcgaggaggaggaccaggcccgcctggccgccatcaccgacaacctcaaggcccgtgactcgatccggctatatacctggctctcgcaccggtgcttctccgactgcgtcaccaccttctaccgcaagacgctgggcaagcgcgagggggactgcgtccgcgcctgcgtccgcaagtaccagctcgccaccgccgcgtccgccgcccgcttcaacaagctcgccgacccctccgccgccgccgccgacgccgacgaggacgactgatccgtgcggccctgtgctccactccactgtcggctgggggaacttttttgcctgctctggttagtcttctgcagtttgagttctgatgatgtagtgcttgtgttaccctgaagaaacaccaatagtgacagactagaagaaccacggaatctgaatttctgaaccgattattgcggctgtatcgaacacacatggattcggnacttgggtggatcaaacatgaatggttcaagctttacaaacttagtaccgtgaatttcactgaatgttaaaaanaaaaaaaatcnagggggccggtaccaatngcctaaatgatcgataancgnctaatggcgtcgttaaantccnacggaaactggtaccaattatcctgagaatccctnncangggtanaganngcgacgnt

SEQ ID NO: 20542 - DNA, 478 bp, Triticum aestivum
  Clone ID: PAT_TA_20542
tttttttttttttttgtaacccgctcatgtagttatatcgaacatcaagggcgttcgttttacaccacggagagcacaggacgagctcactctatgtacagattacacaagagaggaggtagccaaatggatcagatcgggatcaaattgggtcaaaacttcagaaacatctaactgtatcttgcatcttgctatggcatgtcgacgttgatttgtttacttggtacttgttgatgggacgctcgccggccgtggagacggcggagagtctgctgggcctggggcggaacccgcccgcgcgcctccggtgctgctgcgactgctgcgcagaggggggaggcgcgagggccctgcgggcacactgagcgctgtccatgcgcttcgagcccagattgcaggcgctgcggacggacggcggggaggcgggcttgctgctcccggcgggggccgcctggttgcgctccttgtggaggctgca

SEQ ID NO: 20543 - DNA, 594 bp, Triticum aestivum
  unsure (1)..(594): unsure at all n locations
  Clone ID: PAT_TA_20543
gcaggaggtagctaccacatccttagccaagcaagcatggtcaccttgaagtcgacccatgcagcggcggcactggtggtgctggtagtggcgctggcgctaacgctaacgctggcggaagtatcggcctgcccccaaggagatccctgtgtcgaagttatgagcggtggtaagctccctgagccttatataatgaagcactgctgcgaaagcttatctgaagattcgatgagttgcctgtgtgagctccgtgacaagttcgcgaagcggctcccggtcatgttcttcgatggtgtctgccctacatcatgcggcaccagcaccactcacgaatctggttaatcatatgtgtatcgacatctccatttcatttcccttcagtgcttagagcctggctggttggctggctgcgatcatgatcatccatgggttttggtcggtcaacgcacacttttttgtgtttttaaaatccaacagctgctacactagtatatccactagtactgatcgtctggttgccccactacacacgtgagtgcagttgtagtgtcgacagttgtataatgactncgctgttctntaantggtgtccct

SEQ ID NO: 20544 - DNA, 666 bp, Triticum aestivum
  unsure (1)..(666): unsure at all n locations
  Clone ID: PAT_TA_20544
ccgccttccattccgcttgcccagtgtccccgccgcagccctctccctctctctcaagtaagggggttcgtgctcaactgtaagaagctgcggattcttgaaatctaaacagctagattagtatcccggactcagggtaattcctctatctcaaggtcagtagttgactcctcgcagttacttgttttcaaattttagttcgtagaacggttgttcatgtttttctatgactaagaattactgtcttattttgggcaaacccgaagtactgtggccgctgaaataagcgtggcttgttaaatcatcagaaatggccacccccgaactaccgaaagaactaccagacgactttttgaaggacatcacgggtaacttctccgaagagcgaaaaattgcgccgccgattcaagccggacactggggtaagtttgcccctcgatcttctgcacctgctcctgagaaagtcaaactgctatatatcctaataacggagaattcaacacatcttggggatagacgcggtaccctcggcgcacacctcttgacggctgcacctctaagactaagggcatcgccggggctaactccaattactgcttgccatacataggtncaagcaggataaggtgtgaaattgcccaaatggattccatcgaggtntgggag

SEQ ID NO: 20545 - DNA, 771 bp, Triticum aestivum
  unsure (1)..(771): unsure at all n locations
  Clone ID: PAT_TA_20545
gcgcactgacgaagaaataggaatgatacagatgacaagtgcagtctcacagaatggcgagggtcattcccatcatggtaattgcgatgaccatgcttgtgctgattcacatgccaactcaaactctcacagtcaaggtggttcctctcagtgttgcgaccacagcaagaagaatgagaggacaccattcggcctagggctcggccttggacgaaacagtgcttcccggcagtatatccggaatcttcttccactatgattcgtcgcttggagactgtgagttgtcgcagtagatcgtacacgctcgctgctgaggctccattgtccatttagcctactgtggacatgttcggacatgctcatatctttggggcgctaggtgttcatattatacaggagatgggttgtaacaatgggctcacggatatccgctaggccgcatttcgaaaatgttactatgtagaacaggatagcaaatcctttgcatatgcaggcgtgcaggggcgtcaccctcttcatccgtcccgtacccgtcaggatcggcgggagtacaatcgagctattcggatcatatacacacttgggaaaatgtactgtaattgtaaattcanggaaattgtaaattgattagtagctcactgtggcttagctnatctctcattccatcattgcgnngatacgtatcagncaagggttgcggtgttcctanatgcaccattggattcgatnacgggttgaaaacgttcngatgggtaagactacgntgagaat

SEQ ID NO: 20546 - DNA, 598 bp, Triticum aestivum
  Clone ID: PAT_TA_20546
gcacagtctactcgatctagtgagagctgcgaggcagcgttccgttccacgacggatctagctagctagctacagcgttacctcataggctcatacctcccatggcgtccagctcgagcacgtcgaggagcatgccggcggtgtgcgccgtgctcatcctgctgctgctgctgtccgcggcctcacgttgcgaggccgaccacctgcaggtgacggtggccggccggagaatgctggccggtgggagcaatgccgccaccgtctactcgagggaggcggcgacggccgtggcgaatagcgcgcggcggtcagcagatgggagggcggcgatgccttactccgagtccaagaggtccagccccggcggcccggaccctcagcaccactaattaggtaagctcgcacgaacgtccaagcgcttgtcaagtagcctgtgtccgttaaggacgatgtacgcatggggtggtaagttggcatctactgtgccaaaaataatgcccttatatgttgctctacacattgagttttgtactccgtgtctctgaagcacgcaacgggaaataataaatggtatgtttacttgttaaaaaaggggggg

SEQ ID NO: 20547 - DNA, 486 bp, Triticum aestivum
  unsure (1)..(486): unsure at all n locations
  Clone ID: PAT_TA_20547
tcgagtttttttttttttgtgttttcgttggcttgtttcaactgaaaaagtaccgcctggtttaaataaatcaacagtcaacaaactcattttatatacaacagttacctttcacatcattgaacaggatgtgagttagcacatttcattttctgcagaacatttccatttttttggtagctcttacacatcgaaatgaagaaatacagaattgagcatttcattctcagtatactctcaagtaaccacatcttctgggggcatctggtaaagaaagggtgttgaagagcttgtcggtgccttaaagacgctcatcaggatcatacccaagaaagcccctggaagaacatctatcagatccccagcagaatgatcgacatgttgcatgaccaagttcctgcagcacggagggtctttccgccctggcgccacccctgccccggcccctccnggcaagcaagcttagccaagcctgnaanattccag

SEQ ID NO: 20548 - DNA, 836 bp, Triticum aestivum
  Clone ID: PAT_TA_20548
ggaatttgaagttgcgaaaattcttgaggagcttgaattcactatggaccaattcattgacttgtgcatcctctgtggatgtgactactgtgatagcattaaaggcattggtggtcttacagctctgaagctcattcgtcagcacgggtccattgagggcattctggaaaatattaataaagacaaatatcaaattcctgaggactggccttatcaagaggctcggcgcatgttcaaggaacccgatgtaacactggatattcccgagctcaaatggactgcacctgatgaggagggcctcgtgaactttctggtgaaagaaaatggtttcaatcaagatcgtgtgacaaaggccatagagaagattaaatcagcgaagaataaatcatcccaaggaaggctcgagtcatttttcaagccaactgttagcacatcagtgccattgaagcggaaggaaactgcagagaaaccagccagtgcagccgctagcaagaagacgaagtcaacccgcggaaggaagaaataagttgaatgcgcgaactaaaagctgcagtcgcgtgctcagctagatcagtctcctcctgttgtgtaactcaaatctttgttcggtgctctctcgtcgtctcatgttcaaagattaggtaaattagcgacttgagaagggaaaaacaaaactctgtctcatgtttgttcatctgctgatagttgtaggatcgtactttcctgttatggagaattcattgttgcaattttagggttggtttgctttggtcgattgcatgcaattttagttaagacggagaaagtttggactaaaaaaaaaaaaaaaaaaaaaa

SEQ ID NO: 20549 - DNA, 760 bp, Triticum aestivum
  unsure (1)..(760): unsure at all n locations
  Clone ID: PAT_TA_20549
gctcctcctcggcctcccgctcgcatgcctctacgcgtggctctcccgctggctgctccgcgccggcctcctcgacgcgcccgccggggtagcattaagcagaagacagtgcttcttgctaatcgcagccggctcgctctcccacttcttcttggatcacttgtttgaggaaaatggccattctacaatgtatacttggatactgagcactggttggtggaaaggacgcgctcctatcaatccacgatgcagtgtttgttgtcggccttctttgcgtttgcctcattggggggatttgtgtacattaacagagtggagcatggaaagtcagtgactgaaaagtcaaatcaatctttctttctcatcctgggtgatagccacctgtactgtatgtggtgtgccagccagatatacctgcgaaaccccctcaacccgccataggtgaagagctgatcttgggagtgataatattccgtgcaatttatccttttctcccgcatggcttgtgtgtctcaacgatgaaccaaagaagattacaatgaacaatgggatggacggccttgctaacttccgctgatatggggggtcttccgctactcgtttctgccgagggcagtttggnagatctctcgctcaagtgtgnatatttaattccaagggcaatgcaagcattattnaacctgtnacttaggtagantaaggttataggttangaataaagagncaggaantatacatgcngtgtgngtacaatatgttg

SEQ ID NO: 20550 - DNA, 1386 bp, Triticum aestivum
  Clone ID: PAT_TA_20550
caacaaccaccattttcgcagcaacaacaaccaccattttcacaacaacaaccaccattttcgcagcaacaacaaccagttctaccgcaacaaccatcattttcacagcaacaactaccaccattttcacagcaacaatctccaggtaatgtgcacacttctgaacgcacggagcgagtctacccaggtggggttaatccgtggtttgctgttcatattaatatcagccccgttcgaaaccgcgaaggcattggctgtagtaggcgatcttgggctgaccattttgacaacatcaacattaaaacacataaagcactgtgaatatgatatgctctcactgcccgttgatctatcttatgctgattctattcaagatgtttgtgattccatcggtgattgggtagagccagttgctagtacccggccctgggctggtgacccaaaccaaccatgaaaaggagagcgtacagcttgtgaagtctggagttcaatcaaaaaattcgcgatcgaggacgccttatgaacagggcagctgcacatcaaagttgagactgctaatttggggttcctggggtgaacgtcatagtcctagtttcctatacagataataaagagagtgccgtgcagtatgcttggctatagtctgatcttgccaacatagttcgagcgaagacataatgtcttgtggttctggctcacgttgcattagtataacagcaactgggctcatcagggtgaaggtgacagtatgatgagtgcgatggagcctttgctacatgccgctcatgtggatattataatctcaggtcacgtgcacgcttatgaacgcacggagcgagtctacaaaggtggggttaatccatgtggtgctgttcatataactattggtgatggtggaaaccgggaaggcttggcccgcaggtatcataacccgaaacccctctggtcggtgttccgggaagcaagctttgggcatggtgagctgaagatcatcaactccacgcacgcgcactggacttggcacaggaacgacgacgaagagccggtgagaacagatgacgtgtggataacctcgctggctggttcgcagtgcgtccaggacagcagcagccctgagttcaggaagatactcatgtccccttgagacgatcattcgggtcgatatataccttagtctgaaaaaagggcttgccatgtagcagtactgtatatgtatatatgtgtgtctaagactacttgctaaaccataaactgataagctttttgctgtatatgggttaatcaacgagaacatgtactccatgtcatagttggcatgttttaaccgctcagtatgatatgaaatggcgattcagaaaaaaaaaaaaaaaaaaaaaaaaaaaaaaa

SEQ ID NO: 20551 - DNA, 862 bp, Triticum aestivum
  Clone ID: PAT_TA_20551
cgtcaacaaaacaagcagtagtgtaagttcagcttgagattagggtacaagttccacccatctcaccgaagaaccggttgagaaattagccagctctttcttggaatttttggtgattcctagaggaaatggcgctgaggaggatcgtcaaggagctcaaggacctgcagagggacccgccgacctcctgtagcgcaggtccggtgtcgtcgaacgacatgttccactggcaggcgacgatcatggggccccgagcgacaatcccctctcgagtcggcgtcttcttccgcagccatctcacccaagaacaggttaagaaattagcctctttcctggaatttttggtggttcctagaggaaatggcgctgaggaggatcgtcaaggagctcaaggacctgcagagggacccgccgacctcctgtagcgcagggccggtgtccgtcagaacgacatgttccactggacaggcgacgatcatggggcccgagcgacagcccctactcgggcggcgtgttcctgggtgaccatccacttcccgccgggactacccgttcaagccccccaaggtggcctttcaagaccaaggtgttccaaccccaacatcaacagcaacggcaacatctgcctcgacatcctcaaggaccagtggagcccccgccctcaacatttccaaggtctgctgtcgatatgctcgctgctgacggacccaaccgggacgaccgctggtgccggaatccccaattgcaaggcgaccggacaagtacagtcacggcagggctggaccacagtcccatggatagataatactaacaaactgactcatcatgactcaagatgggaacattacgtatttcccccact

SEQ ID NO: 20552 - DNA, 596 bp, Triticum aestivum
  unsure (1)..(596): unsure at all n locations
  Clone ID: PAT_TA_20552
gccgactaaagggcacaagtcagatcaagagtaacagaaaggttcttcacagaggcatgccgatgacacgaacaacaaaggaggtcagcgtcgttcgcccggagagagtggtgccccgatccgcgtggaagctgtcggaggcgggaattcagttcctgcccagcaacacgagctgcctcgacgacatagagctacacaacgggaggctctacatgcccaaggtccagatggacgactccaccgcctacaggatccacaacatgatggcgttcgaggcgatgcacgtccgcactggcaacgacgtgacggcgtacgtgttgtccgtcaagggccccaccacctcggccgacgacgtgcgcgntnaggaagaaaaggggaatcctggagcatgaccttgccgatgacgacgacgctgtggtgagactcttcaacagcctcaccagagatgtttcccaagaattnggganagtcatctgtgcagcgtnccgttacccctttggagcaacaactacaccaacaacatctacgtgtcatcctcnatatccnngggcanactcaaagncaantctttaagaccnttngccctcctcnccttt

SEQ ID NO: 20553 - DNA, 1280 bp, Triticum aestivum
  Clone ID: PAT_TA_20553
tcggctcctgcgccgggtgcatcccacttacgttttgctgctctcgctccgcgttcccgaccgcccagcgcttgccgcagtttgtcaccgccgctgggatgaaggccacgcctgatgatgctctggcgggatggctctcttgccggtcggtgccgtttcgagaaaggcccagaaaggcggagagggagatagatacagtgcgagggccatagatccaggtcaagctgtcagtatttggcagggagttaaatgttattctcagttcgagaagatctcggcattttgctgggacacggtatttgaaaagaggcgtgaatgaccatggaaaagttgcaaacgatgtggaaacagagcagatagtatttgaagaggaagctggttcctggaagggaagaatgagcgcaatagtacagatgcgaggatcgatccctctcttttggtcacaagaggctggccgacttagtcctaagcctgatatttttgtgcagaggtatgatcctacttatgaagcaaccaagttacattttgaagatctcgctcagcgatatggacagcctatcataatacttaatttaataaagactgttgaaaaaaggccacgggagatgatgctcaggcgtgaattctttaatgcagttggatatcttaatcagaatgtcccagaagaaaggaaactgagattcatccactgggattttcataaatttgcgaaaagcaagtccgcaaatgtgctgggtgttttaggaggtgtggcgagtgaagcactggaccttactggattttactacagtgggaagccaaaagttcagaaaagaaggtctatccagcttagtcgaactagcactgcaagggatgttgaaataagagctagttctggagaccttccgagactctctagcaatgctgatgcacttggttctatagcttctcaggatatgagaaaagaggatagcaaacatgagcctcttggtgatgctccttgttatcaaactggagttcttcgtacgaattgcatagactgcctggatcgcacaaatgtcgcacaggatgcttatggccttgctgctttggggaggcaacttcatgcgatgggactgacagatgtttgagaaatccacccagatagcagcatcgcttgagctttaatggaaatgtaccagagcatgggtgatgcacttgctcattcagacggaggctgtgcatcgcataatacggttgtacccgagagacaacggaagcggaaggctactactcaatctagggagcttctgaaacgactg

SEQ ID NO: 20554 - DNA, 488 bp, Triticum aestivum
  Clone ID: PAT_TA_20554
cggccgccgccgccgccgctgtccctgttcgtgcccgtcgccatcctggccgggctgctcctgctcgtgctcctgccctccgacgccaggggcctccgcgtcgcgccatcctacttgtagccagctagcatagcatttctaaatcaaatccgtgcgctcgctctctccgctccgccgtcgtcctcctcgccgctgccttgtacatgtaattaagctatccgcggggtccgtttctttccttggagactactagttgatggagaggattttgctccggactaattaattgcttgccgcgcaaggagtgtctccgctcccgcagtagtatcgctgtacgttaaccaccggactgtggccaaacgccggccggggatcccccctccacccgatgttccccttcgggaagttcaaacaggtgacaccgaggggacaaatttctgtgtctccgcggccgctcgagcatgcatctagagggccgcatcatgtaa

SEQ ID NO: 20555 - DNA, 599 bp, Triticum aestivum
  unsure (1)..(599): unsure at all n locations
  Clone ID: PAT_TA_20555
ctcgtgccgatctgatcttaagcaagtgtggggaagataattttatccgtgtggcatatgactataaaaacatggcacaacgggatggctgcaactacagggtccgccgactatctctgaaattaagtgctggtagcgcaacatcggggaccattgctactagcttaacacaaattcgatcatttgcatggtttggcgagtccaagtacacacctcctctttcggagttcaagtatctacgtgtgcttctctttgattttcccagattaccgggagatgggtagccgaccgcactgccgctggccagttgtttcaacttaaggtatttgaaggttccagctgcatcaggcagcattagagcttccctactggaatcccatgggcctgttcatttgggagacaattgatatagattgcccgaacggnacaaaacaccccgtcagatatagtcatgttgcaccgcttgcccctttgctccttccgccgtgatanaggactgccaatggggattgggaaatnaacccnactanccacntgttattcatgggcaaaccattggngaatttagcctcngnaccacnacctgnggaacgaaccac

SEQ ID NO: 20556 - DNA, 601 bp, Triticum aestivum
  unsure (1)..(601): unsure at all n locations
  Clone ID: PAT_TA_20556
atcacagtttgtcctcctccctctagtattgtcccaactccaaagcgaaacttttatcaactgatgatgcatcactagcaccggatatcagctacagtttactttgcagaaagtatcagatttactaaagcaaggcaaagtgcaaaacgagcattcatgtaccttctcatcaaaagcccctagctcaaacagcaaaggaatgcccggttaattatcatttgggcagcggggcaaggagatatgtatctatgatcagagaactaagatatgcatgcctccggtgcgaagaaaagaaaaatccaagatatgccatttatttctccgtttgctgctcctgttgtgccataaccatatggatgcaaagactggaaggaagatctttccattatctaaatatgtgtatacctgggctagaaatatccatattgttttgtcctcaaacaaatgtctcccgtgtttcccacatgcccaattaagatccaatgcgtcccncgtcaacaagagcccngaagacgcncagacttngcaaggactnacaatggggcccgtcgctnccaagatcggcagtacctanacgaggaaaatgtcgggaaattccaac

SEQ ID NO: 20557 - DNA, 1051 bp, Triticum aestivum
  unsure (1)..(1051): unsure at all n locations
  Clone ID: PAT_TA_20557
cagccttgcttgccatggatgttggtttcactgagccccaactactcactttcgactgcgtgtgcaacctccaactactgcttttatgctgccgcaaaccatattcgtcgtggtgaggctgatatcatcgtcgctggtggaactgaagctgccatcattccaatcggccttggaggttttgtagcatgtagagcactatcacaaaggaacgatgacccaataactgcatctaggccatgggataaagagcgagatggctttgttatgggtgaaggtgccggtgtactggttatggagagcctggagcacgcaatgaagcgtgatgcaccaataattgctgaatacttgggaggtgcagtcaactgtgatgcttaccatatgactgatcctcgatcagatggactgggtgtatcatcctgtattacaatgagcctcagagatgcaggtgttgcaccagaacaggtgaactacatcaatgcacacgcaacttcgacacttgctggtgacttggctgaagtaagagccattaagcaagtcttcacgaatccatctgagatcaagatcaattctacaaagtccatgataggccattgcctgngtgcagcaggtgggttagaagctatcgccactatcaagtccataactactggatgggtgcatcctaccggccgaggttttaacccagagcctgaagttgattttgatacagtagctaacgaaaagaagcagcatgaagtgaatgttgctatttctaactcatttggatttggagggcacaattcggtggtggtattcgcgccattcaagccgtgattcgccatcacttcagagatatagaatccgcggcatcctcttgattagatgttagcctgcttgaatttaccggctttgtgtagcaagttttgatgattggtagagtggtgctgccttgaccctgacactgttgtttatatgatcattctttcgggcgctcctcgtgtgtacctgcccggggggcccctcgaatagtgtaaaggatcattcatcggtattgtaatttggtacatagttc

SEQ ID NO: 20558 - DNA, 703 bp, Triticum aestivum
  unsure (1)..(703): unsure at all n locations
  Clone ID: PAT_TA_20558
ccgggtcccatctggggagggtacgaggcagggaaggacgccgccatcgcagaggagatggtcaacagggaaaagatacacatggtgatgaagcttatgtactctctccctgacgaatagagggggacgaatcaggatggatccaagctgccgacgcctcttctttgctgccatggacgagccctcgcccagcgaccacctccattcagctgggcggcagacggcgatggccaactcccaggtgcagccagtggggaggcgacaatgggcaagggcggcaggagacgcaggtaccttaagtgaacattgtggattgtgcctcccactgtgactatgtgcttaatttgttggtgatctgaaagaggaatgtgagggaatattttatagcaactgatcaacactgtccactgctgccatacaagagcgttatcaaccgtgatnctgaagnaatgtggcgtggtggttactgatatctcctatggaagaaatggttgataacattttcttctccatgttcaacctggaaactctgctngatgctaacagatccaagngatttggctaatgcccatccagcactaggttatacttcagaaattaccccggtcatgcgcaggtcanttttgactcctgttcctcaccccgtggcccgttttctcacatnggcaaggcccggggcgcaacaagngcntagagaancctt

SEQ ID NO: 20559 - DNA, 467 bp, Triticum aestivum
  Clone ID: PAT_TA_20559
cggacgcgcgggcggacacgtgcacctccatgatacctgataccaaagacaatcttgttgtacttgaaatatctgtgggttcacagattaggaggatgtcttacagctgtggatccagatgcacctgcgagctcacactagcaagtgcgggacgatgtaccctgatctgacagagcagggcatcgccggcgtccaggtaaccggcgtggtcatgctcagggtggctcctgacaacaaggcgaggcatgtagaggtggccaccactcaatgcgcaaagggctgaacttgcaaccacaactgactgtgccacacctgcaactgataagctgcgtgcactcttacatacctacctgtgaaggtgagagagtatactagaataacgagcgcctgatctgatggagttcagctatggtgcatgcgcgtgcgatgtgcttgctcggtctatgcctatgctcttgccatggtgt

SEQ ID NO: 20560 - DNA, 701 bp, Triticum aestivum
  unsure (1)..(701): unsure at all n locations
  Clone ID: PAT_TA_20560
cagctgcgttgtgcttcngggcgtctgctctctccgtggcctgttttctcctggccttgccattgctgatggcacaggacccttcaaatctgagcctggagcactactccaagacatgcccgaatgcggagcatgtggtccgggccgagatggagtgcgcggtgcgcgacgaaccacgcaatgccgctttgatgcttcgcctccatttccacgactgtttcgtgcagggctgtgatggatcggtgctgcttgacgacaccgcgaccatgatcggagagaagcaggcagaccagaatgtgaacccgctgaagggatttgaggtggtttgacaaaaccaaggcaaagctgggaggctgagtgtcctgggaccanttcctgtgctgactttacttgccatccgcaagccnaaggacgcagttgtcttgggtgggtgggctttactgggatttcccggtaggaaattggccccaaaggagcaanccttgacctaacaaacaagaatccccacggcccagcagnctcctcacctcattccaantcctgggaaaagcctttatccacnacatggtgcctngtggttccanacattggttcccncggtgcgcgattcccgganaagnatacgggatnccagatgnncaaattaacctgcgtcnnaactactcanaantaagnatntnccttgatgggggacaaaataa

SEQ ID NO: 20561 - DNA, 680 bp, Triticum aestivum
  unsure (1)..(680): unsure at all n locations
  Clone ID: PAT_TA_20561
agatggtaaaatggatgacatgtcatgtttcctgaataggtttgattactcagtgaaccccaccagatgttctggattttactctgtgataaggaagtattttccaaatctcaaggatggctctttggagncctggnttagttctgggatccggccaaagcttttcttggcccgggnacagcgcccttcagatttttgttgtttcagggggggggaggtcccacggtattcctagggctgggttaancttgtttggtaatagaatcccctgggtttgacatcaagcnttggcaattgcagaacacgtcgtttcaaggtataacagcaccttgattctcaaacaatcgccgatcgatgaattgcagctggatgaacccnggacggctggagtctatcatgtgaatcacattgctcacaatgatttccttgtttatttccttttattttggggaagaacaagatgctgcttgtaaaggtgcgactctccagcttaagttgaataaacaaaatatatcgattgtgggttggtgtataccgacgtcgtgccgcgctggcctctgctgccgcgagcatccctcgcggtcaaatacactcgaaacacccggcaataaggctcctcacgtcaccgcgggcccggtacccctcgcgcccttgggtgcggctagcctcccgtgtaaaaa

SEQ ID NO: 20562 - DNA, 417 bp, Triticum aestivum
  Clone ID: PAT_TA_20562
ggccgccgaggcgcccctcgggcgcctcctgccgccgcctcgccccccgccccccgcggcggcccccctcctcgcggcgcgccaacgggtccggcaggtcgctcgtcgccgaccacctcgtcccccccgccggccggcccgccgccgccgtctgctccgccgtcctcctcgtcgatggttcccgcccggtgacccgtgccaggcatgcgcgtccacgcccgcgcgggcttgttgggcctagctgtgcagccgtgtcgtcccgtgtcacccccggtggctacgtatttatcatttttcgtgtcctactatccttgtaataatctaacgtgcccgctatcgtttatcgggtcggacggtccctggtatatatacgatacgacacgtataggctagctattctgccgtaatgtatcatgc

SEQ ID NO: 20563 - DNA, 426 bp, Triticum aestivum
  Clone ID: PAT_TA_20563
cgggacggggacgggctggtgagcgcggcggagctgtggggcgtgctgcggaggctcggcatgaccgagggcgccaggtacgaggactgcgccaggatggtcgccgccgcagccgcccgccacggcggcgtggacggggggctcgggttccccgagttcaaagccatgatggagcacgcggtttaagcacgtacgaagtacagtacgtataattggctaaaaagtggtgcactgcgaggttagactgttcaagtcgcgtggctcatgcccatatttttcattgtttccgttggtgtgtagcttcgggttgttcctcagtccgttccaaatcgagcgtatgttttatcaagtgttgttgaataataagttcgatgtgtacaagcttcaaagttaattaattaattacttgaccggaaaaaaaaaaaa

SEQ ID NO: 20564 - DNA, 754 bp, Triticum aestivum
  Clone ID: PAT_TA_20564
gtatgcgcaaggtgtggtcgtcgccaaagtaatccaaaacatacaaccaacccccgggcgtacttgggagcttcgtatcagtgctttctgtctatgcatccctaaagtgaccccagtgaccaagatgggaccttggggtggggacggaggggcagcctttgacatcacggagcttcctcgctctcttcaaaccgtgacaattcgatgtggcgacgtgattaactcggttgcgttttccttccctgatcaacctggtcacaagaaaactgccggaccatggggtggtgatggtgcacttactgcaagtataacacttgctccttccgagtttataaagcaagttcttggaacaaccggtacagttggaggagagaccgttgttacatcacttaccttggtcagcaacgttacaacatatgggccttttggaaaagcaaatggcaccccttttagcagccaggttccagatggtaacaacattgggggattctatgcacgtgttggggggtctgtcaatgcacttggcgtttacgcgtgcccaatttagcacaatgcatgtcttaacctgcttaagaatcttcttgccccggtcgatgcctcgctcattgcaacagtttataagcagtcggacaagggtcgtccttgtcgtgctctcgtgtacttgcttgaaaatgagacgatgtaataacagcttgatgacttgcctctttgttcttcaatatatataaccgagcttgttttgtgtaaaaaaaaa

SEQ ID NO: 20565 - DNA, 1118 bp, Triticum aestivum
  Clone ID: PAT_TA_20565
attcggcacgaggcgtctcctcctccgccccgcccccgtctcctcctcctccttcccctcgccgccgggagcccagatctctttctccgcggcgcggccaagacgagttccgccccctcgtgaatggtgggaacccacacgattgccgcctcccccccctggcggccgcagccggagagggactcctccgcctccttcgcctgcttggccgcttccatccaggcctggtaccaccgctgcatcggcctcgacccctgagcggccctccctccgtcagcgacccaccttattctgctctcccccggaaccatccctggcttattttggtcttgagtttctccttgcggtagaagagaataaatcaaaaaagaaaagagggaaacaagcgattttgattgatatggtttcgtttgatttgattgaattgactgtcgctatggctgttgctttgccgtcgacgctgccgatgaagcatggtaaggttggtctccgcggcaaggcggcggcgacgggggttgccggccgcgcgcgcgtgctggtgacggttaccgtcctcggaagcgctggccctctaccgttcttggtcgaccggggcgagtcagtctacggactgatccgtcctgcgctccgctgctatgcccgcccgggccgcatgccgctgctcggctccgacgctgccaacttcctcctctacacagccaacggcagatccgacgctctcaaggccgacgagaggatcagcttcaatggatgcaggagcttcatgctgtggcagaagactgtcgccgacaacaatgggtctgagcctaattctagcccaggcagaaaggggatcagcggctggaaatttggcctaaacaagatccttctcaacttcagcttcaaggtgtgagccatcgatgagttcgaaacgaataagtgcgctcgattcagcgaatcattgctgtaatcggccgtcaattttactgcattgggaagtctgttgcttcgtttttttttttgtttggttcagttgctgtttcatcgtcctctacatgtaatgagattatagttcgaagcatacattcagaattgtccagtgtgaaacttatatgcattaaggttcctttaaaaaaaaa

SEQ ID NO: 20566 - DNA, 495 bp, Triticum aestivum
  Clone ID: PAT_TA_20566
atggattggtgcctacgacgcgctggtcgacgcggcggccaccgcagtccgcgagctcgggtgtacggtggcgctcacggacctccaccgctgcctcgatgccttcagcgagtcctgcgaccgagccaagggcctcgtccaggcggccgccgctggcctcggccccgccgccacccgccacgacgagctgtgccgcgccgtgcgcgcggtcgacaaggatctccgagccgccgaggagaacgagatggaagaggagaagcatcgccctccgaccacgccgctggtggcctaggacaaatagcccaatcgatctacctcttctcctgttgaagtgatgttcatcgttcttgttttttcaatgtgatgttcatcgttccttttaatttcttgcttatgtgctaatcgtgttagtcatctagaagatgaatgaaactgtactgaaaggacaaatggcctggatatttgccttccatacagcaacatgggggccgagat

SEQ ID NO: 20567 - DNA, 647 bp, Triticum aestivum
  unsure (1)..(647): unsure at all n locations
  Clone ID: PAT_TA_20567
ccttcaacaataagtaccccaggtgttacagaaaaagtctatgaagaggataaaaagttgtggaaaaagcatgttgatacatacaagagggtaaacaagttgatagggaagtcaaggtataggaatatcatggacatgaatgcaggccttggaagttttgctgcagtgctggattctcccggctcctgggtcatgaacgttgtgcctacgatatcaagagaggaacactcctgggcatcatccatgagcggggtcctaattgggcatataccatgattggggcggtccctgccccccgggcctcccccgcgtcctcgctaggtatccaattgggccaaataatatgtttngttccctttgaatttttttnggcaaataatatgttttgggggcctttttgaaccattnccccgaattaccattatttttgtgcccgtttatccaagngcgaaanctttttccctaaantntcccccctaganattatacccttatacatgncacagtgtcttcccananttttgttntaaacaataagggatttccctctcccccccccggggatacaccatatttacccatacacatagaagncatacncccccctaaagcttttggaccttttaaggggtaccccgaaanacttn

SEQ ID NO: 20568 - DNA, 589 bp, Triticum aestivum
  unsure (1)..(589): unsure at all n locations
  Clone ID: PAT_TA_20568
ctgagttagggtttcaacctcccagcgcgctgcgatgctagatccacaagccgccgtcacgctggtcgccggcggcggccctagctaccaccactcgagctaggcgccctctggatcctcctctcctcttccacgggacctcaaccaccaacgcggcagcaccatctccaactctctgcatccgccatcgcgcctcctctgcatctcccaatcatccgacgaccgggacctgctcccccgtccgcctttaccttggctacaagcaagcacccggagctgtgcccctcttccctggttaccaagcaaccgggagtttgcgccactccttccctccaagagaagcacccgggggccacaacaataatttcctcccaatgggcccgaacgggctgggggatgctcccggcgccgcggccttccccttccctttgcttgccgggcggccgcccgcctcccttccctctcgctcgctcgaacgacagcagttatacacacatcccctttnntanaagcaagcagcaatccctgatgtgcttccnatgttcccnnaggttgcnagttnccaaactggaaaaatcccggtgaatga

SEQ ID NO: 20569 - DNA, 716 bp, Triticum aestivum
  unsure (1)..(716): unsure at all n locations
  Clone ID: PAT_TA_20569
gcccggcccctgctgcccgcgagggcgcccaggggcacgccggggataacgcccccgccgcccagcaccatgttcccccaaccgacgccgcatccgggggcctggttgcattcggggaagtgggcggtacggaaagcagaggtgtttctgccaatcctttggcttcattgccttcagtaacttaccaagcagaaggataatcaagacagcaacatggaacaatgtgttatttgccctgtggaatttgaggatggtgaatcattggttgcacttccttgcaagcattcatatcattctgactgcataaaccagtggctgcagttaaacaaggtatgccctatgtgcagtgcagaagtttctaccccgggtaacaacgaggcatgacattctgttgtggtccgtaatgatgggcgaataatgggaagaaatagggacagcatatatttcctgatgctggtgagatttaagcaccaggagctgttgtattgtccaaagaaactagcaaacaagcctcgagttcgtctctctgcttttcagcccagcagactcggacacatgtacttccggactccaccgtgatgctgctttgggtaccctgttaggggctcatggcccatgtatgatccatggatgttaaatagcttaattttaccgcccttcgttgtccgacgccgtggcccccgggtgtaaatatataattaaacatctttacactn

SEQ ID NO: 20570 - DNA, 408 bp, Triticum aestivum
  unsure (1)..(408): unsure at all n locations
  Clone ID: PAT_TA_20570
gttcggggaaagctccggggggaagccgttcttcggcggcgacggcatcgggttcgtcgacgttgtgctcggcagctacctgggctggttcgtggtgatcgagaagatgatcggcgtcaagctcctggacgcggcgaggacgccggccctggccgcgtgggctcatcggttcangatggcggatgccgtgaagggtgtcttgcctgaagatgtcgtacaaggtgctccagtttttgcagacgttccttgattaggtgcgttggtagcgctgtcancggtttgggctttccattattatcttccgaggtttgtngctctccatttggccntttnaaattngggttttaatggcacccntattnaangctanaaaaaaggtttaataaaaaggcncaantttaactttta

SEQ ID NO: 20571 - DNA, 451 bp, Triticum aestivum
  Clone ID: PAT_TA_20571
acagggtctgcttcggggagccgctgccggccaacctcgcccaccggttcgggctggaggacgtcgtgagcgacccgtacgtgatgggctcattcggcggccaggaccggcacttcgccaaggagatcggcggccacctgctccatgatttcgtcgggtaatcggcgctgccggtgctcagctcgccccctgctgatgcacattgttgtaatgtacgcacgcacgcactactagtatgctaggatggtatatagtaagtcaatcatcacaatcatttggcggcttggctcgatgatcggtcgacatgaacacggtcgattcctttggagggcggatgaaacattgacatgccctctcccatgtactagatccaaattcaaacagctgtccaacattcaaacacctgtgggctacacagagcttgaaaataccttgttccaaaaaaaaaaaa

SEQ ID NO: 20572 - DNA, 734 bp, Triticum aestivum
  unsure (1)..(734): unsure at all n locations
  Clone ID: PAT_TA_20572
gttcgcgccccccgcccccgccccccccccccccctccgccccgctccggccggccaccttgccgccgccgccgcccgtcccctccttgtgatgcttcggctgtcgcaaggaggcggagtgccgcgccggtgattactagtaggcatcacatctccggcctcatttgccctcttcatcaccagcttcttggaagtctacattttggtcagaccctttgaagaagaaatcctctcacaactactaccatgggtgcctgcgtgtcttcaagcaggaggcggagaccgcagagattgcgctgcacatatcgccgtggaaaggttttgagaaacacgcctaccatacgcgccagtgatgtggggacctgtgctgcttctggagaagttgtccatgtggagacttccgcggccactcgcaggaaatctgatggctcgaatgtgacattccacctcacacagctgcagtggcatcatagcgagctagactcggaaaatggaagcgttgtatgtcaggaagaagcatggttcgattctgtcagcattttggggtctgattccgatgaggacttcagcagtgtcaacggagactttcctgccatgtcgggcgctggaaggacacacttggtgcagtgcgaagatgcttcatgtattgctgattgcatccagaagttcgagaagtttttcgacnnnncatgtgttgctcaagctgttggacagtacctaacaagnnntgcann

SEQ ID NO: 20573 - DNA, 675 bp, Triticum aestivum
  Clone ID: PAT_TA_20573
accagactgcaagaaaccagcgcagccgccgccgtcgaggagctcgagctgctcgccccgagggccttcgcgggcgccggaatggaccgccacgacctgggcgcgtccggggagatcgagaagacgccgcgcgaggccgccgcgccagacatggagtcggagccggcggcggcgcgcgcggcggagcgcgtgccgccgtggcgcgagcaggtgacggtccgcgggatggtggcggcgctgctcatcggcgtggtgtacaccgtgatcgtcatgaagctgagcctcaccacggggctcgtccccacgctcaacgtctccgccgcgctgctcgccttcctcgcgctccgcggctggacgcacgcgctccaccgcctcggcattgcctgccgccccttcacccgccaggagaacaccgtcgtccagacctgcgccgtcgcctgctacaccatcggcttcggcggtgggttcgggtccttcttgctggggctggacaagaagacgtacgagctgtccggggtgaacacgccgggcaacgtgccggggagctacaaggaccccggcatcggctggatgatgggcttcctcctcgccatcagcttcgtcggcctcctcaccctgcttcctctcagaaaggtactctgaatcgacggcatgcctcgctacccaagtgggact

SEQ ID NO: 20574 - DNA, 506 bp, Triticum aestivum
  unsure (1)..(506): unsure at all n locations
  Clone ID: PAT_TA_20574
cctacccttctcgtgccgcttgaccagatcaatgagcccaagaggccctcagacaagcccctgcgtcttccccttcaggatgtttacaagattggtggcattggaactgtgcctgttggccgtgttgagactggtgtcatcaagcctgggtatggttgttacctttggtcccactgggtctgacaactgaggttaagtctgttgagatgcaccatgatctctcctgggaggcgctcctgggtgacaacgttgngttcaacgtcaaagaacgttcctgtgaaggatccggaagcgtggttttgttgcatccaactccaaaggatgaccctgccaaaggaggcgccacttcactcccaagtcatcatcatgaacaacctggccagtttgggaatggtacccccaatgctggactgcaaaactcccanattgcttcaatttgctaacttggggacaagttnacagcgntttggtaaggactgaaggctgccaattcctgaaaaacggga

SEQ ID NO: 20575 - DNA, 1304 bp, Triticum aestivum
  unsure (1)..(1304): unsure at all n locations
  Clone ID: PAT_TA_20575
tgcaaggccgcgatgccgctcttccaccccgccccatgcgctcgccccgccgccgcgcgcgccgcgtcccgcttttccggggcggtggtcgcagccagcggcgccggaggagcgcgtcccccgaaggcgcccccgcggcgcccgcgcggtaagccacggttctcgcggcagtcggccatcaagaagagcttccagcaggagcaggtggtcttctccaccccggtgcccgccgaccccaccgtcgccatcatcggaggcggagcctctggcctcgcctgcgcttccgccctcgccgcccgcggcgtccgcgccgtcgtcttcgacacgggtatgcacggcttaggtggcaggatggcgaccaggatggtagacgacgggcggcggctggtgttcgaccacgcggcgcagttcttcaccgcgagcgaccagaggttccagaagctggtcgatgagtgggtcgataaagggttggcccgcgaatggagaggttcgatcggtgagctcgaggctggtggccatttcacagctataccttcctcgacgccgaggtacatcggcgtgagaggaatgcgtccgcttgccgatgcaatgctgcccgagaatgacctgattaaagttgtaaggccttcctggataagcaagcttgagccgttcaacggcctgtggcgcttgtttgagagtgagaagccccagggtcaatatgatgccgttgtgatagcacacaatggcaaatgtgcgaaccgtctgctttctacgtcaggtctaccccaactgacaaggcaaatgaagagactagagttgagttctgtctgggcactacttgcggcatttgatgatcctcttccaatcccacaagataactcttatggcacatttgaaggagcatttgtgagagatattgattctctctcttggatggccaacaatactcagaaacttttccctttggagacaaacagacccgagtgctggacatttttcagcactgcttcttatggaaagaaaaacaaagttccacaggaaaatatcccgaatgccactgcagaaaaagtgaaacgagacatgcttgggggagttgaacttgctttggggctctcgacaggatctcttcagcgaccattttacacgagagtacagttgtggggtgcagctttaccgatnaacactccaggagtaccatgcatatttgatccccagggccgagcaggcatttgtggtgactggctcacgggttcaagtatagaagcagcggtnttgagcggaatgtctcttggagatcatgtcgctaactactttgcgagcgg

SEQ ID NO: 20576 - DNA, 1549 bp, Triticum aestivum
  Clone ID: PAT_TA_20576
gacttggacggttcatgattgagaggacggcagcttgagctgagctatcattcatggcgatgcgtagtacagtacagagataagtaagaggaaaagaatgcttaagctagcgaacgaacgggcggcggagggggtcgtggaagggatcgacgaggcgagcctgtaccagctcgagtcctatgtacattcagtgagggcggccacggccacgcatggcgcggtttgtcgggatcagtacaccttcttggagaagaaggtgcggaggccgaacagcccctgcggcggcacgcactcctcgccggcgacttccgcgcaggccgcgttgttccggcacgcggcggctggcgcgctcacggtcgccggcgctgcatctgcagcagcggacgccgtcgccttgtctgctgcttcgccgccgtccgcttggccttggctcgtcgcggcgtcgtcttgttcggggacggccttgctcttgccgctggcggtggcggtggcgttgctgctctgcttctgctccgcggcggcttgctgctgctgtagcttgttgcgcctcagctgccagacggggctggccctgcccaggcggatgccgttcgcgctcaggcctgctctgccctggccgccgggaacccaccgcctcagcatggacgtggcgggcgcttgggcagcggccttttcagctgccgccgcgatggcgacggccggcacccccgacccggaggcctcgccgcgggagttgctccgggagcacggcgcgctgctcaccttgcgccccgccgccgtcgcggtagccgccaccggtgcgctggcagcagcggcactggcgttgccggtgctgggagtgctcgccttggccttgctgctagcgcgggcgccggcgccggaggtagagtggccagcggagcggctccgggagaagggccatatgttgatgttgatgagctcggcgttgccgctgacgctgggcgctccgccttcttggcgcgccccttggactcgccggtggccttgaagatgtccttccacttgagagtgaccgcggggaggtccagcgtcgggacggcgcaggcctccgcaagcggctgcgcggcaggctccccttcctcctccggcggccccgcgcgggcgttgacgtcgacgttggggtcggcatcttcctcagcgtcttcctcgccgtcgtcttggccggcgtcggggcaaggaggaggggcctggagggtgtggagagggagcacaatgccgtcggagaagagctcgtcggcggtgagcagggcgggggaggggaatgtccccgggttcttgcccaccatccagaactcgaactcgggcgacgcggtcggagacggcgaggagcgcccggactcgggcggagacgacggcagcccgacgacgacgtccatcgcccgctcgccgagcaatccagccccccacgaacgcggcctgggctcggacggggagcacgagcgaggtcagctagtaggtgcaggacagcatgggtgggagggactcggcgcagcttgcgaagcgaggagatgggaatggggcctcgtgc

SEQ ID NO: 20577 - DNA, 1181 bp, Triticum aestivum
  Clone ID: PAT_TA_20577
cgacggactgccttggtcatgtggcgctagtgactcagctcatgcggcggcttggtgaggtgaaaccaccattgaagcattctgtcattgtggtgtttattgccaatgaagagaattcatcggtcactggcattggtgttgatggtcttgtcaaggatggtttgctggataagctcaagactggacccttgttttggatagatactgcggataagcagccatgcattggtactggtgggatgatcccttggcatctaaaggcaacagggaagctgtttcacagtggccttgcacataaggccataaattcgatggagttaaatatggatgcacttaaagaaatccaaactcggttttacaatgacttccctgcacacgagaaagagaagctctacaagtttgctactccatctacgatgaagccaacaaagtggagttatcctggtgggggtctgaaccaaattcctggagaatgtacaatttcaggggatataaggttgactcctttctatagcacgagttttgttgtccagaagttaaaagagtatgtagatgattaagatgcactcctttctatagcacgagttttgttgttcagaagttaaaagagtatgtagatgatataaatgctggacttgaaacaaagcttcctactcgtggtccagtttcgaaatatgttcttccggatgaaaatctgcgaggaaggcttgaaatctcttttgatggagatgtgatgaatggggtggcctgtaatctcgagtctcggggctttcaagcattatgcaaagcaactgaggaaatagtcggatacgtagagccgtattccatcaccgggagtttgcctctgattcgtgaattacaggatgaaggatttgatgttcaaactgctggatatggcttactgaagacgtaccacgcgaagaacgagtattgtctgttttcagatatggcccaaggctttcaagtgtttgtaagcatcatttcgcagctggaagcagatgcttaagccttctttaagggatgaaagataaccttattggacacctattcctgctactcgggaatctaataatagtgttttgagcttggtctcaatcatagaatcagaacttgtcgagatcgcgttgcagcgatttcggttgcattcgaatgttttgagtgtacgagcttggtgtttttgg

SEQ ID NO: 20578 - DNA, 1719 bp, Triticum aestivum
  Clone ID: PAT_TA_20578
atccatcttgctcaaacacagagagttcctcgacctcgactggactcccttcgctgttgacccaatccgccgccgcgtccaagatggcatctccggcgccgccgctcaaggacgccgtcggaggcctggaccgcgaccccttcgtcgccctcctcgccaagctcatcggcgagtcccagcgcctgcagaacgacccgccggccctcgtcccgcaggaggacctcgtcggcgcagcacgtggtcgacgcgctccgcccggtgtcgacggacaccggcggcggcccgctcgtcgtgcggaaggtgagctacacggacggccggagcaacgtcatcgtcgagtaccccggcaccgtccccggccgcgtcgtctccttcgtcggcatgcacatggacgtcgttccggccaaccctagcgaatgggacttcgatcccttctcactaaccttcgaaggtgatgacaaggaaaagcttaggggccggggcacgaccgactggcttgctcatgtggtgctagtgactcagctcgtgccgcggctaggtcgggtgcaaccagcattgaagcaatctttcattgtgttgtgtattggctatgtggagtgataatcggtcacaagcattggtgtttatcgttgtggaaagcatagttggcgagttaagctttgcccggaactgctgttgtggtgagatcctgggtttgagatgcgatgcagcggaaaagctgccatgctttgttgccagttagaggatacatggagcctctcatggcgtcctggatgctattacaccattggcctcccaacgtaaagccaggaatccgatggagttaaatatggatgcacttaaagagattcaaactcggttttacaatgacttccctgcacatgaaaaagagaagctctacaaatttgctactccatctacaatcaagccaaccaagtggagttatcctggtgggggtcttgaaccaaaattcctggagagtgtacaatttcaggggcatataaggttgactcctttctatagcacgagttttgtagtccagaagttaaaagagtatgtagatgatataaatgctggacttgaaacaaagcttcctactcgtggtccagtttcgaaatatgttcttcccgaattaaaatcagcgggggaaggcttgaaatcgcttctgagggagatgtaatgaatgtggtaggcagttgtgttgagtgtcggggctttcaagcattatgcaaagcaactgaagaaatattcggatacgtagtgccgtaatccatcaccgggagtttgcctctgattcgtgaattacaggatgaaggatttgatgttcaaactgctggatatggcttactgaagacgtaccacgcgaagaacgagtattgtctgttttcagatatggcccaaggctttcaagtgtttgtaagcatcatttcgcagctggaagcagatgcttaagctttctttaagggatgaaagactaccttatttgacacctgttcctgctacctggggatataataatagtgttttgagcttggtctcaatatctctcgtaccatgatattcaagctcaatttaccgcatagaagaaatatatttagaaaaaattccattgccttcgaatgcattgagacgatgagcgtgctggccttgcgtgtttttggtgaacaaagcatcgacaaaaatacagaaggcaaagatcatcttaccaaaaaaaaaaaa

SEQ ID NO: 20579 - DNA, 677 bp, Triticum aestivum
  unsure (1)..(677): unsure at all n locations
  Clone ID: PAT_TA_20579
gtagagcacacgagccagacaaccgagagatggcccaaaaccagcagcaggaagccgttattagccacttctcccatccagggcatgacctcgtgaagcggcactacaccgggccgttccgctgcgacatgtgctgggaggacctgtccggcgccggctatggctgccgcagtggctgcgactttgcaatccacgactcttgcgcaggccacacgcagacgttctcctccctcggagcaccatgcgcacccgctcgtgctcgtccaagaccangccacgacgcgaccctatttgtgcgacgtttgcctggggagctgcgccccggggtctttcccctaccgctgcccaccatgcgggttncgatatgcacccgagctgcacgcagctgccccaggtcgtgcgcagtgcgcggcacgcgtacccggcgcatgacctcacactggtcgtcggcgacggccgctctgccgcatgcaacggcagcgcgggccgcgcgtcctccttcccgggcccggcgtgcgacgccggcctccccctcccgtgtgcgccgccctcctccgacctcaggggctctcgtcaggctccaagtgccccccaggccgcatccgtgatatntagggtccaaggcgnanggctaacggcncgtngtgggcctggcgccccccttnaaacccgttaaa

SEQ ID NO: 20580 - DNA, 784 bp, Triticum aestivum
  unsure (1)..(784): unsure at all n locations
  Clone ID: PAT_TA_20580
ggcgngctgagcnncttcaaaggctgntggggtcaggtattattgcatcacttgatgatattgctggcaaagagtcttcaactagtctacntgacaggctggtcagtggatgagcgatacagcatggctgtatatacttctaagaagtgcaagattggatgcttttccagtgtgggttgcttggggccatgctctaattcgaatggaacactacgctcaagcccgtgtgaaatttaagcaagctcttcaacagttcaaaggtgatgcgcctcctgttgtccttgatatcattaacacaattgaagggggtcctcctgttgatgtttcttctgtccgctctatgtatgaacatgtagcaaaaagtgcacaaccaatcttcgatgattccctttctgctgattcttatcttaaatgttctatatatgccatccacattcccacgatctgagaggcccaggcaatccagagattctctangataccaattttcgtctgctaacccataccttgaaaatggtcctcccaacaaccttggatagcctcccgatatccaaagtgtatccattacttgcaggaatatgcctccccacaaagcttgctttcatttcaaggctgggcattttgccaaaacagcccctatcttctcctccaggaccccacccaggggggactcgcctttttccccggcctcgcgggacccgtatcggcaantttggnanaannnnnnccnggnancnntnntnnaangggncnnnnnnnntngnnnaacaaantgncaaaaccn

SEQ ID NO: 20581 - DNA, 664 bp, Triticum aestivum
  unsure (1)..(664): unsure at all n locations
  Clone ID: PAT_TA_20581
tatttaggaatgaagggagtatatttatataaacatatcactcacagtgatcgtcgaccacgactgaacaatcagaccgttgacgcaacacaacactagggtacatgtacgagcgaagcagaacgaggcgacagtattgagaagccaattctcatggcttggcccccggctttgggaagtggaacacgggaacagtgggcatctccgggctttgggtggaagctccaccttgggcatctccgggcttcnggcggcagctccaccttgggcatctcccggttgggtggcaggtgaactcccgggaacgttggcaatccaccttgggcagctccggcttgggtggcaagtgcacctcagggaccggcggcagctccaccttgggaagctcaggcttaggtgccaggtgcacctccgggaccggcggcagctccaccttgggaagctcaggcttaggtggcaggtgtacctccgggaacagtggaagctctaccttgggaatatgtggcacctcattctggtgctcttccttggacggaacggtctcctcaaggattctcgccacaccactcatggctacgcatgagagaagaagcccaagcacgcagcccccggacttgttgggcgcctgtctgctagtctgctagaggtgtgcaggaccggctag

SEQ ID NO: 20582 - DNA, 500 bp, Triticum aestivum
  unsure (1)..(500): unsure at all n locations
  Clone ID: PAT_TA_20582
tttttttttttttttttttttttgtgttcctcacctgatttctggctcctgttttctctttttcacttgatcaacctgatccagccatgtggtacaccattcattgccaactgacgtgttagaacatgtggtacatcatcatatatgtttgattttagatgtctactgtgtataaccgtgaccaacccctactctatttccttctctacaaggccatgctccatggtcatgccacagcaacgcacatacgctgtcattttccttcaacgcgcccagcatgcttgaaccaagcaatctactagtagctcatccttgacattgtcaagcggccgctactgtttcgacctcaggagtttggagcttctccttgatctcgacgtccgaaaatctgcaagcttctccttgacgtctcccgccgtgtcctgccggcttctcctcgttgaatctcgncatgtcttcaggctaaattccttgaaggttgntcgggtnggctgncctca

SEQ ID NO: 20583 - DNA, 538 bp, Triticum aestivum
  unsure (1)..(538): unsure at all n locations
  Clone ID: PAT_TA_20583
tattcccctttgtnacctcnggnntaacaatggngattggccnccgttttgccatgccttgtgtcacagtttttcctttgtccaggagtatccttgagagttgagcggctgtgcggatggaccccgcatcttcttgccgtcgcggcgacgccgacagcgtcgccaccgtcgagcgcttggtcaagacggccatgtggtgcctccaggaccgcgccgacatgcgcccctccatgggcaaggtcgccaagatgctcgagggcaccgtcgagatcaccgaccccgtcaagcccaccatctttctgcgtccaggacgactaacaagtcttccctctttgctttactttagtcgtcgtatatataaaaacaaagccaaattgttagttacgtgtataatactattatattatactatctcagatccagttcagttgactgattgattgtcgactacgtatacatgcatgctcttggaaaagtcaagtccaaccacatgttataaatggttaacaaattattaaaaaaaaaaaaaaaaaaactc

SEQ ID NO: 20584 - DNA, 433 bp, Triticum aestivum
  Clone ID: PAT_TA_20584
ggcgacggaggatggcctctccgaggcatctggccagtacgacgccgtcctcggtggcgatggcgacggagcgacaggcggcacagatgagaaggagaggatcgagtcgggcctgcgcaggtttgcggggatacggcggtggaggagcatcgagctaatcggaacggcctacgctgtcggcttcgtgcagcagagtggtaataggatcatcagctttctgcgggagaaagtgctggccggagtgctcgcgggaaggctcctcaaaatgtcagactacaactgcgggaccctgtcaagctagggagtagtacatttgaggcaaccaaaagagcataggaaactagttttccttaaacccgatttctggtgtaacaacctaaaacattggttggatcctctaactaactcgtggatatactaaactgggtcttcc

SEQ ID NO: 20585 - DNA, 705 bp, Triticum aestivum
  Clone ID: PAT_TA_20585
gcaggctggtgtgggacgtgcagatgatgatggtgccgaggagagcggtaccaagatgaagcagtacgtgctgacgaagctgaggagctccaaggtgcccgcggaggcgctggaattggtggagaggagcgacgacgcgcccgccacgccgctgaggttccggccgccgctctcgctcgtgttcgcgggcatcagcaaggggaacgtgtgcgtggccggcgacgcgctgcacccgatgacgccggacctgggccagggcggctgcgcggcgctggaggacggcgtcgtactggccagatgcctcggagaggccatcctcggtggcgatggcgacggagcgacaggcggcacagatgagaaggagaggatcgagtcgggcctgcgcaggtttgcggggatacggcggtggaggagcatcgagctaatcggaacggcctacgctgtcggcttcgtgcagcagagtggtaataggatcatcagctttctgcgggagaaagtgctggccggagtgctcgcgggaaggctcctcaaaatgtcagactacaactgcgggaccctgtccagctagggagtagtacatttgaggcaaccaaaagagcataggaaactagttttccttaaacccgatttctggtgtaacaacctaaaacattggttggatcctctaaaaaaaaagaaaaaaaaaaaaaaaaaaggcccctaaaa

SEQ ID NO: 20586 - DNA, 647 bp, Triticum aestivum
  unsure (1)..(647): unsure at all n locations
  Clone ID: PAT_TA_20586
gtcaagtcaacttaattacccatcttcctctgggtagcttcatttatatgtacacccgcgactagctagcaaggagaacttcatctgcttcctctcttcgctgcaaggatccctcaagtgctcctctcaattggtcctcacgaatcatcaggaatggccagcggaagtacccaagagagcaagcagccaagccccgaactaccgtcggaactaccatatgactttttgaagaacattacggatgacttctcggataagcacatacttggtgtaagtccatttggaacgctttataagggaacagtgccagaaggtggaaaagtgattgccgtgaagaaacttcaggaaaacgcaccaatactggctggcaagacattcaatacagtggttcagaacgttatggcgctaaagcatattaacatagtagagctgatcggattctgcagtgaagcacagaaaaagatggtgcagtcatggaagatatatcatgcagacatactgaaagttacctgctacgagtattactaatgggagctaaccagatctttgggcaggggagctcgtccccactgaccggaccccggcccgcctctggctgnggaaaagatcgctanaanacngatgaccggcggtccatanaaaaaaaa

SEQ ID NO: 20587 - DNA, 267 bp, Triticum aestivum
  Clone ID: PAT_TA_20587
ctcctatggggtgtgcctgggtcaccagatgaagaatggaaagtatattggctcaaatttgtaggatactaagcacatggtggaaacaagattatccagctatcgaccatgcatggcatttctagggagaagatatatagacattttgtggtcaacgtgcgcctgcatggattagttgatctttgtagctttgaggggcttgatatccaactatatgttctgatttcagtgataaatttatgttttgttctcattaaaaaaaaaaaa

SEQ ID NO: 20588 - DNA, 678 bp, Triticum aestivum
  Clone ID: PAT_TA_20588
gccaaaagctggctatgaatagcaactccggcatatcctgaccctctcacccatccattctataccttcctgtccgctctcattataccacaccagtcctcgaccaaatggccactgctcacaagttcgccgtcatggccgccgccctctgcgccctgctggtccttgcctcggcagggcagtagggaggactgctatagcacatgcaggccggggggcggcggctgcgacgccgagtgcgcggcgaggccgtggcgtcactgccccgagcagtgcacagcccaaaggcagagctgcgagggctggtgcgccgagcagcgtttccccgacgcgcaggccgctcgctaggccgacgctggctcagctgccatgtctaataatggagccaggtgctctgctttgcttgttgtatatggactgtcttgtactatttcatccggtccataataagtgtcgcgactttgaactaaaatggaattaaccttagttcaaagctgcaatacttattttgaatcgaagggagtgatttgttggtgactttaatatatgtgatgatgtggtgttgatccgttgtgcttatgtcctatggggccagtgacaatgttgtgtcttgtgtgagcaataataatggtactactgtttacatgaaaaaaaaaaaaaaaaaaaaaaaaactcgag

SEQ ID NO: 20589 - DNA, 1037 bp, Triticum aestivum
  Clone ID: PAT_TA_20589
cttggctccctccctccctcctcgctctgatcgtgcggacgcgtgggcgcggatcgggatcggatgggcgcgcggtctccccggccggcggcgtgccgccgatgagctccccctcctcctcgtcctcctcctcccgcctgcttccggcgagctgaggccatctagagcgatatttctgtggcttctcagctattcctgtggaccttgagatggccggcgcggaggcaagcaccgggagcgcccagaggggggatacccttccaaatggagacgtctatgtgggcaacttcgatgggctagtgcctcatggaatggggaagtatatgtggacggatgggtccctttatgacggcgaatgggatagaagcaaaatgaccgggagaggaatgatccagtggccttcaggcgcatcctatgaaggcgacttccggggaggtttcatcgacggaacgggcactttcaagggggtcgacggctcggtttacaaaggttcttggaggatgaacaaaaagcagggaatggggacaatggtttactccaactctgacagttatgaaggcttgtggaacgagggtttgccggatgggtacggtaaatatacatgggctgctggcaacatctacatcggaagctggaagtcaggtagcatgaacggccgaggcgtaatgcagtggatacatggtgatactcttgactgtaattggctcagtgggctggctcatgggaaaggctactgcaaatacgcatcaggcgcatgttacatgggtacgtgggataggggagtcaaggatggccatggcatattttatcaaccgggaagtaaaataccttgtaaccctgaagtttctgagtgtgcaacaaataatgatggtacaagtgcttcaagttctagtaatgaaaaggtcaaagttggactgttgtttctattgcaaaatctgtgcaacaaatgggggctgcgtaggttttttcatcgccccaggcgcatttcaaatggcacaacgcccatttttgttgatgattccggaaatcacctatca

SEQ ID NO: 20590 - DNA, 796 bp, Triticum aestivum
  unsure (1)..(796): unsure at all n locations
  Clone ID: PAT_TA_20590
ctcgtgccgaattcggcacgaggtcaacagctgagtcaggatcagatgttgatgatctaggttctcctatgatgagaagcacattggggtgcagtcgactagctccagttcgtgaagaaatgcagatgagagcacgagagtctgcggcttattacagttgcgatgatcactttgtggtggtggacaaaacagtcgattatggcagaggaggatcaatgccagataaaagcagtgccccacaagtaatagtacaagcccagcctttaggcacacaaaacactccaggttcttcaagaaacagtcgtgctatactagtacccaaagagattccggaggaagggaaattctatcgttttctcagattactgctggttctggttgttagaagtttttaccttcttacgcacaagtatgcaagtcagccangagacaacgattgtcaacaacccactacctccagtcctggantttgaaccactcctggtggataatccagcatttgaagcgtcantgtggccttgtcancctgtcattgagcgccttcaanaagtggaggnccggtttgatgactccggnacaancccccagagattccactgggagaaaaacncccccttgggttcaanggataggttnaatgtttccancctacctccnaaagggcaaagaattctgccagntactgtgatgaanaactaaaatttcaacncaatntaggagtttcttgtcaaantgcacagcnaattttgtggatataacacatacccttaacattacacangggttaattaactga

SEQ ID NO: 20591 - DNA, 850 bp, Triticum aestivum
  Clone ID: PAT_TA_20591
acctccgcgtaaggccgcaaaacagcttgcattggcttttgccaagcgaacacttgcccggtgccagaaattcgaggaacgagagaaaagctgcttcagggagcctttcctttggagtgtgctgtccgcgcctttgccaaagagtgacccagttgatggtgtccctccaggatctgcagataggccaaaggccctaaagcttgacagaagcccattgagccaaggtagcacaaaattgaaaaagggcgagagagaaagggaccagagcagagatgggtctgccaagaactccagctcgaaatcaggcagcggccggaactcgtctggcagcggccggaacgagcgcaagaccaagatgaagccaaagcagaagctagcgcagctatcaacatctggaaacgtccttggcagagtcacagagccatccaactccagcttcccatcaccgtcgccgcgagaatccaacgagtggaacaaccctctgagcacaagacctacccagcaaccaaggaacagcgcggccaacgtcgctccggagtccctggacgcccccatgaacctgccaccgatggaccccatggtggacatcctggacgtgccggagggcaacgacattagtgcctggttcacggacggcctggacgactcgctgcaagactttgatttctccggaggcctggagatcccggacgacgatctcacccagctagggttcatgtgagatgagagctatagtaaatatcattatatatatgtgcatataattggatgattcttgatgctgtgttagcaagcgctgccttgctggtttgccgcactaaccaccttagctgatgtaactaaccccaat

SEQ ID NO: 20592 - DNA, 965 bp, Triticum aestivum
  Clone ID: PAT_TA_20592
gcctttgtattggatggatccatggagcttgtgttgctcctccctagcttagctagctagttagtgaactagttgttttatattttcggtctaggcatgaaggcacgaacgcactcgcatatgctggctggctgtcttttgttgattattagagatgctgtctctgttgctttatttcccaacttctccgcaacagtcaggacaaggacaacagtcgggacaagggcaacaaggtcagcaaccaggacaaggacaacaagcgtactacccaacttcttcgcaacagtcaagacaaaggcaacaggcaggacaatggcaacgaccgggacaagggcaaccagggtactacccaacctctccacagcagccaggacaagagcaacaatcaggacaagcgcaacaatcaggacaatggcaactagtgtactacccaacttctccgcaacagccaggccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccaacaaagagcagtcaatcatcgcatgtctcttcatcgatcatcagtgggggtgcatggcactgaaggcacactgatgttctcctccatcgcgctgctgcagcaaaggtcaccaagagcgcagcctaaaggtggcaaaggcgcagaagatagcggcacagctgccggcaatgtgccggctggagggcggctatgtcattaacggtaataagatgtggtgcacagatggtccgtctgctcatatactggtgtcaggactgctccaaaagttggacaaacttggcatgcgagtgaagtgatacatgtgagcttgactttgagaattgctttgtgcctcagagaatgttcttgatgaagaaggaaa

SEQ ID NO: 20593 - DNA, 908 bp, Triticum aestivum
  Clone ID: PAT_TA_20593
ggccgttccaattgcaacaaccagcacaagggcaacaaccagcacaagggcaacaatcagcacaagagcaacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaacttctccgcaacagtcaggacaagggcaacaagggtactacccaacttctccgcaacagtcaggacaagggcagcagccaggacaaggacaacagccaagacaagggcaacaagggtactacccaatttctccgcagcagtcaggacaagggcaacaaccaggacaagggcaacaaggatactacccaacttctccgcagcagtcaggacaagggcaacaaccaggacatgagcaacagccaggacaatggctgcaaccaggacaagggcaacaagggtactatccaacttcttcacagcagtcaggacaagggcatcaatcaggacaagggcaacaagggtactacccaacttctctgtggcaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatagaactctctgcagcttgcatggtgcttgggcatgcatgcaccttagctatacaataaacgtgacgtgtgttcacagcttttcgtgtaactagagtaaagcccaataataatgcaagatgaaaagcttctccgactaaaaaaaaaaaaaggaaaa

SEQ ID NO: 20594 - DNA, 790 bp, Triticum aestivum
  unsure (1)..(790): unsure at all n locations
  Clone ID: PAT_TA_20594
cccacgcgtccggccgggacaagggcaacatgggtactacccaacttctccgcagctgtcaggacaagggcaacggccaggacaatggctgcaaccaggacaagggcaacaagggtactacccaacttctctgcaacaaccaggacaagggcagcaaccaggacaatggcaacaatcgggacaagggcaacatgggtactacccaacttctccgcagctgtcaggacaagggcaacggccaggacaatggctgcaaccaggacaagggcaacaaggatactacccaacttctccgcagcagtcaggacaagggcaacaaccaggacatgagcaacagccaggacaatggctgcaaccaggacaagggcaacaagggtactatccaacttcttcacagcagtcaggacaagggcatcaatcaggacaagggcaacaagggtactacccaacttctctgtggcaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatagaactctctgcagcttgcatggtgcttgggcatgcatgcaccttagctatacaataaacgtgacgtgtgttcacagcttttcgtgtaactagagtaaagcccaataataatgcaagatgaaaagcttctccgactaaaaaaaaaaaaaaattagtgcaagagaaacctn

SEQ ID NO: 20595 - DNA, 1779 bp, Triticum aestivum
  Clone ID: PAT_TA_20595
tcagggaccgggaacaaggccaacacccccaccaggaacagcaaggccaacaagggcaccagggcgaccacgggcaccaaggtcagcagccaggacaagggcagcacccagcacaagggcaacaaagagtcagcagccaggacaagggcaacaaggtcagcagccaggacaagggcagcaaccgggacaagggcagccatggtactacccaacttctccgcaggagtcaggacaagggcaacagccaggacaatggcaacaaccaggacaatggcaacaaccaggacaaggggcaaccagggtactacctaacttctccgttgcagctaggacaagggcaacaagggtactacccaacttctctgcaacaaccaggacaagggcagcaaccaggacaatggcaacaatcgggacaagggcaacatgggtactacccaacttctccgcagctgtcaggacaagggcaacggccaggacaatggctgcaaccaggacaagggcaacaagggtactacccaacttctccgcaacagtcaggacaagggcaacaactaggacaatggctgcaaccaggacaagggcaacaagggtactacccaacttctctgcaacagacaggacaagggcagcaatcaggacaagggcaacaaggctactacagctcataccatgttagcgtggagcaccaggcggccagcctaaaggtggcaaaggcgcagcagctcgcggcacagctgccggcaatgtgccggctggagggcggcgacgcattgtcggccagccagtgatagaactctctgcagctcgcatggtgcttaggcatgcatgcactttagctatacaataaatgtgacgtgtgttcacagtttttcgatgtaactaacagtaaagcccagtaataatgcaaaatcaaaaaggacaagggcaacaagggtactacccaacttctctgtggcaaccaggacaagggcaacaaccaggacaagggcaacaaggctacgccagcccataccatgttagcgcggagtaccaggcggcccgcctaaaggtggcaaaggcgcagcagctcgcggcacagctgccggcaatgtgccggctggagggcagcgacgcattgtcgaccaggcagtgatagaactctctgcagcttgcatggtgcttgggcatgcatgcaccttagctatacaataaacgtgacgtgtgttcacagcttttcgtgtaactagagtaaagcccaataataatgcaagatgaaaagcttttccgactaaaaaaagaacaaaactggtgctatatagtatgcgttgcatgtctcgatttcatcctaagaaacatactcataaaggatttcaccgactatttcttccaccagtacggaaaagggcaccatcccaggccttccgccacacccagggcggtcctcgcccccaggacccggcctgctccggtactctcccacctcgtcccagccggccgggcaagcgcggccatcaggtctaggcctacgtgcgttctcccccactgcgctgtccctccccggcccagcccctccagcctacgccagcccgtcccttgcttgcgcggtgcccccggcggcccccctgcgcgccgcaaaggcgcggccgctcgcggcccggcggcccgcacgcggccggctggagggcagcgacgcattgtcgaccaggcagtgatagaactctctgcagcttgcatggtgcttgggcatgcatgcaccttagcttttcatcttgcattattattgggctttactctagttac

SEQ ID NO: 20596 - DNA, 431 bp, Triticum aestivum
  Clone ID: PAT_TA_20596
gggcgaatcgaaagaacaaaagagcttgcgcaagaacacgttaaccttgcggtcaaagccatcgaatctctcccagacagtgacgatgaagatgttctgatttcaaggcgcgctcttattgatatcacacagagagtcatcacaaggacaaaatagcatgattatacacagggtggagaagataaggcggagtttcaccacaggtgtagtgttccgcttggaaatttttggtcgccttggtcattgcattctttccattgcccgggttttgtgtaacatttgatgagacttcagggtaaccattcctgggaatcatcctaagtcgcagctgtagtggttttagttactggtggcagcagaatctgtgtattaatatcacgattggcgattgcacgatgacctgatcataagactgtaacctttataatcca

SEQ ID NO: 20597 - DNA, 1132 bp, Triticum aestivum
  unsure (1)..(1132): unsure at all n locations
  Clone ID: PAT_TA_20597
tcctcgcggggggctctggcgccgcgcgtcgccacgcgcgtcgccggcggcaccggcgcccccggcgccgcccacgcctatcgccgctcccgcgcggcaggcacacacccggccaggctccaccctgcgccgcggcacatcgccacgatggtggggggtggcacaggagcaggtcccgtcgacgcgcaggggctgcgtcacgtctcccagtcgcaggcccgccaggacgggctcccgccggcgtcgcaacagcttcgtcccttggtattggtttgcgatgaacctgcgtttctgggcacgcgatggcggcacgttgccgccgctgacgtgactcgcctagacgcagctgcgggggctgtagtacaacaggatccattggaattggttgctgatcaaccatcgtttcttggaaacagaccaccgtccatggtggttgctgaggtcccgaaactagaatcagctgctggttatttttttaatgtacgagctgagggaaaaagattccgacctacggttttattgcttatggcatcagctctgaaattcccaataccagaatcgacagatgttggagttttcagcatattggcaagtaagctgcgcacacggcagcaaaacattgccgagataactgaaatgatccatgtcgcaagtcttctgcatgatgatgttctggatgatgctgacactaggcgaggtgtcacttcattgaattgcattatgggcaacaagctttctgttttggctggtgactttctcctgtccagagcatgtgtggcacttgcagcacttgggaatacagaggtggtatctcttatggcaactgcagttggacatctagttaccggtgaaactatgcaaatgtcaacaagcagagagcaacggcgaagtatggagtactacttgcagaagacgtactacaaaacagcatcattgatatcaaacagttgcaaggctgttgctattcttgcagggcacactgctgaggtttcagtgcttgcatacgaatatggtcgaaacctgggtctagccttccagttgatcgacgatttcttgattcccaaggaactctgcacactgggaagggtcattatcgatatcntcatggnacatacgctcaatgcttatcatg

SEQ ID NO: 20598 - DNA, 801 bp, Triticum aestivum
  Clone ID: PAT_TA_20598
caatttccgggcgccgggaagagaagaaacccaacccgacctctgattccccaatcgccatccctcctccgccgccacccatggccgccgcggccgccacctccgccccgctccgcctcctctcctcctcgcccctctccaggccgctcctgtccaggccccacctgctcaccctctcccgccccgtctccttccagcgcctcgccgccaggtccgccgcctccccgaccccctccacctcctcctccgcccccgaccccgcccccgtcgacccggcgcagctgcccccggcgctcagggacatcatcgcgctcttccagtccgtgcccgacgagcgcacccgctacaagcagctcctcgcctacgccgcccgcctgccgcccatggacccggcgctcaagtccgacgccaaccgcgtccggggctgcgtctcccaggtctgggtccacgccgcgccggaggcggaggcccccggctgcgtcagcttccaggccgactccgacgcgcagctcaccaagggcctcgccgcgctgctcgtgctcggcctctccggcgcgcccgccagggacgtcgccatggtgcccgtcgagttcatcgagatgctcgggatcaggcagagcctctcgccctcccggaacagcggcctgctcaacatgatcaacctcatgaagctcaaggcgctggaaatcgctgcgggccaggaggtgactggcggccaagaaatccgccaggagcatactgaaacgcctgccgtggagaaggaagagcctcagtttgaggctttcggtgggcaagtgcatg

SEQ ID NO: 20599 - DNA, 1041 bp, Triticum aestivum
  Clone ID: PAT_TA_20599
ctgcgctgaggacatgcataatgtatatgcaaggtttctcactggccttgctgctaacaatcatctttggctcgcggctgcccagactctcgacatatgggaacgtagagtggtcctgtcgctcaaaacttgctaattttggtgatgctgcgactggtgtaataaactgcatatccaaagtagtaattcaggagctaattctggcataaccatatttatgccagctatgatgcttaatctgaaagaccgtaccttggcgagggacaactgcagaagtaagctgttcgtctttgataggacaatattagtttctcaaccagagggaaactttagaatcgataaaataaaagaaacagaaaagccattatggccgcttctgaaaaatatgggaatcatcttaagtgcagaaaaagcagtgctttatcgctccaaaacattcccatatattgcgatcagcttagccagaaagacaaatggttacccttcaaaagcaagcagtaatgggctatcgaccccaacacctcgccgagcattcctagccagtgccacccctgagctttcgacacccagatcatatactagtcgctataatagatactttggtgattcaaggcggctatccgtatcacaactgaacttcggcgatgattcactatcgacatttacatcaattagtggttctgaaccagaatccccttctatcggataatttcctggtcaatctattgggtcaattgccaagtacttagcattgtaaatggaccagtgtgctatgaagtttttgcatttgtgtgtacattactgatgccatgtatttagctatagctagtattgttgactagtaagcactgggttggttgacttggtttcgggtttgaaattgatgtttcgagctgatggctcttttagatgattaggtgaaagatgtagtgagtggtttaggggtaatcacttgtaccatatcaagggtcatattttatgtgactggcttgtgtgttgcaaccttgcagaaatagttcgaaagagatgtacgggggtgat

SEQ ID NO: 20600 - DNA, 750 bp, Triticum aestivum
  unsure (1)..(750): unsure at all n locations
  Clone ID: PAT_TA_20600
ctggagctggatcgccgtggtgaggagtccgcgcgcctccaccgggcctgccangaatggggcttcttccagctgattaaccacagtgtcccacacgatgtggtggaggcaatgaaggccaacattcagcaattctttcagctacccgcagagacaaagaaacgattcgcgcaggagcgagggcagctggaaggctacggtcagctgttcgtcgtctcggaggatcagaagcttgactgggctgatatgctttacctctacacacagccacctgagagcaggaacaccaagttctggcctgaccagcctgttaacttcagatcgacgctggatagatactctgggtgctgtgaaggagatagcggttcccttttggcgatgttggcggagaacttgggactgaaacaagaggtgattgctgacagatgcgtgggcggagtgcatctgtcaggatgaactactacccgccgtgcgctcaagcagacaaagtcctcggcttctccccggcactctgatgctgatccctgaccctccgtcctccacgtgcacggccgatggctgcgaatgcagtggtccccacgcctcccctcaccccgccnatggcgtccttcgcttctgggggggcntgagatctnaaaatggaggaaggacatcagcacgtcgtctcanccaggagaacgtgtcgcgcgggtcatcccaaatcancacaaggccctaggactaggggcaacagctnaanggcccaanttn

SEQ ID NO: 20601 - DNA, 827 bp, Triticum aestivum
  Clone ID: PAT_TA_20601
gctcatgcgatttgggatcctcattttggtcaacccgctgtggaagcctttactcgaggaggtgctgctggtccagtgaatattgcttattctggagtttatcagtggtggtatacaataggattacgcaccaatgaggatctttatactggagctctttttctattatttctttctacgctgtccttaatagcgggttggttacatctacaacccaaatggaaaccaagcctttcgtggttcaaaaacgcggaatctcgtctcaatcatcatttgtcaggacttttcggggtaagttctttggcttggacaggacatttagttcatgttgctattcccgcatccaggggggagtacgttcgatggaataatttcttagatgtattaccctatccccaggggttgggaccccttttgacgggtcaatggaatctttatgcccaaaaccctgattcgagtaatcatttatttggtaccgctcaaggagccggaactgccattctaactcttcttgggggattccatccacaaacacaaagtttgtggctgaccgatatggctcaccatcatttagctattgcatttatttttctcattgccggtcacatgtatcgaactaacttcggaattgggcacagtattaaagatcttttagaagcgcatactcctccggggggtcgattagggcgtgggcataagggcctttatgacacaatcaacaattcgattcattttcagttaggtcttgctctagcttctttaggggttattacttccttagtagctcaacatatgtactctttacctccttatgcattcatagcaca

SEQ ID NO: 20602 - DNA, 695 bp, Triticum aestivum
  unsure (1)..(695): unsure at all n locations
  Clone ID: PAT_TA_20602
tccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcaagctgattgacataactggatgatggatatgtcagcttctaactggagagtggcaacactaaggatgacctgaacttccaactggatgatttctgcttggccaaattaagacgggtttgctgatggcaaggactgatcctgtccgtgatgtccgcatgggtgaagacaatntgcctgtgaaggaatccgtgggggcaataacactgtccgtggtgccacctgcaaattggaacaatgctcgggtgttgagaaccatcataggataagatatcgttgggtgaacagttgtcaaattggtgttttaccggcccgccgcgcactgaactctacaccaccaccca

SEQ ID NO: 20603 - DNA, 667 bp, Triticum aestivum
  unsure (1)..(667): unsure at all n locations
  Clone ID: PAT_TA_20603
agcctctctccctcgctcgctctctctctcgcgctctctctcccgctcccccgccctcctctgagccacaattgatcgaagatgtggaaatgacantcagtaatgggatgaaaaaaagcaacattagtattgaagaaaagccccaatctgaagcgacatctgtagtgaaagatgtggagatgaccatcgatgctggaatagaagcagatcacacacaactagcagatggatcaactgaaaatggagtaggagaacctcgccatgaagaggcatgcatagataagtctgacttcagcgaaatgtcagatcatcataccaaccatcagttaattccaaatggggtgctacctgccacagatgaagctttatgcagtcaggagactaaggagggtgaccttgtgggttgcagtgcggccctaagagaagacaacaactagattcagatattaggttgcatccaatttacttttgcagatggggggcatgaaggatgcaccagtagatcagctagcatcagtgattagccatgctctcttcattctcctggatcacctatttagatttattagtgatggacaaccattttcgtcgagatgcccggagcctcttggtgcctcgtgaggttcttgtactttacgggcgccattatgcgtttctagttagctga

SEQ ID NO: 20604 - DNA, 659 bp, Triticum aestivum
  unsure (1)..(659): unsure at all n locations
  Clone ID: PAT_TA_20604
atccgccccccctccgatctcgccgagaaatctcctccgatcgaagcgaagccaaggctctctcgtccccctccccaagatgcagatcttcgtgaagaccctcaccggcaagaccatcacccttgaggtcgagtcctccgacaccatcgacaacgtcaaggctaagatccaaggacaaggagggcatccccccgggaccaagcagcgcctcatcttcgctgggcaagcagtccgaggatggccggcaccctgggccggctacaacatccaagaaggatccaccctccactgggtgctcaaggtccgtgngtggcatgcaagttatccgtcaaagacctcaaccggcaagacatcacactggaggttgatcctccggacacatcgacaacgtcaaggctaagttccaagacaagganggatcctcccgggacaacaactctgactttgctggcaacactccaaggatggcctacctggcggactacaacatccanaagggatcaacctcaactggtgtaaggtcctgggggatcaatttggggaactccgcacggcatacctcacctgccggacctgtaacttcgtaagtaggaaggggatcccggagggattcccgncaaaagnttatttntgaaaatcagtgcgaccttcgnnaataa

SEQ ID NO: 20605 - DNA, 821 bp, Triticum aestivum
  Clone ID: PAT_TA_20605
ggagttgtttgtccttagcagagttgaagataaagagaggaaggctaaactccgctgactcagttcatgtgtgcaatgagccaactgcaatagaggttttcagtagattaacaccaattgggtcaaagaaaatagagaggtttagggggaggtatgagatactactcgcgtcaagtccagcgtttggctggagacacagaaggaggagcactgttgtttgtagacgccctcaactccaagtaacaaagcgaccagttgtcaacacttccttttatttttgtattttccctggaattggagatggagataaattcttcgggtgaggaaacggtcataaaggtgcgaaagccgtacacaataacaaagcatcgggagcggcccacgggtccggagcacaaacggttccttgaagccctcaaactgtatggcagagcttggcagcgcatagaagagcatgtcgggacaaagacggccgtgcaaatcagaagccatgctcagaagttcttcaccaagttggaaaaggaagctatcaataatggtacttctccgggacaagctcatgatatagacatacctccaccacggcctaaaagaaaacctaactgtccatatcctcgaaaaggttgtctcagttctgaaacacccaccagagaagttccaaaatcaagtgtaagcttgagcaatagcaatgcagaaatggcgagcaatggaactcttcagctcacctgcattcggaaacttcaaaggaaggagttgtctgaaaacggcagttgctcaaaagttattaatatctttcgagaagcaccatctgcctcattttc

SEQ ID NO: 20606 - DNA, 619 bp, Triticum aestivum
  unsure (1)..(619): unsure at all n locations
  Clone ID: PAT_TA_20606
ccgcacctgagtacccgacatctcgacccttcccttcccttcccttccttcgtcattcgcgcgcgcacgcacgcacgcacgcacgcttgttcctcccgctgctgggctagctagatccccaaagcggacgagttggcccggaagcttcgtccggaagcatcggcctgtggcggcagagagaggagccgctgcgcccggtgcggcggtcgcttgaggccgccgcgcggagggcgggctgggcgggcgacgtggcgaccggggttagcttgctgctcgcccgaggtgtaggaagtgttaaggggatacataatcagttttgagctgtgaggccctgcatttgtgctgcctgctgtttgattcacagctcactcttttcctcctactcattcaagcaaagtactggaatttgtaagctcagtttattcaggtcatgggagttgtttgtccttagcagagttgaagataaagagaggaaggctaaactccgctgactcagttcatgtgtgcaatgagccaactgcaattgagggtttcactagtggacccccaattgggtcttagggaagagagacgtccctnaatcaanttgnggaaannaagngacacnttttnaaccnaa

SEQ ID NO: 20607 - DNA, 651 bp, Triticum aestivum
  Clone ID: PAT_TA_20607
attcggcacgaccgccagatggactgcgttcttctgagctcacacttgtcgtcccatgccactgttaacgcaaggcttcagcaatgctctgttagtctcaacagtataggatttgcagttatcagaaagggatgcttaagattaaggtgctatgcaattggtgatgcagggcgtcgaaatgatcctttgaacgagaacaagaatgggccaatttcacaagaactaaacgggtccagtgcttccttcacaactgttggtgctgaaatcactcaagaaacaggagatttctttagtagtgatgctgagggtgacccggataaaccgacggagggtttctcctcgatcgaggatgctataaattcgctgcgggagggaaagtttgttattgccgtagatgacgagaagggtgacaacgaaggggatcttatcatggcagccgatcaagccagcccagaatcaattgcattcatgatcagaaatggttccggcatcatctcagtgggcatgaaggaagaggacctagaaaggttgatgcttcctatgatgtctccggtcacggaaattggtgacatttcagctgttgcttccacagtgacagtggatgcgagagtgggcatatccactggtgtatcagctgcagacagggcaaag

SEQ ID NO: 20608 - DNA, 596 bp, Triticum aestivum
  unsure (1)..(596): unsure at all n locations
  Clone ID: PAT_TA_20608
gggggaactgcttaccaggaagagaccactcgcctatcattctgtggatggcgatggtcttgttctgcattttgcctcactggttacgggaggcgtgctggctgacttgctggatcctcaggtcatggaagaggaagacggggaggtccaggaggtagctgcgctccgcggcaaagtgcgtgaggttgaatggagaaggaccggccggcgatgagagaggtggagatgacgctccgaaaacctgcggattaaagatgaagcaactgcgccttgatgccaatcctaagggctatgatgatgatggccaatctctaccgacgacacggcaatngaaggggacacccgagcaaccaagtggggaatacaccgtnggaagacaancctgttttccggagaagtacctccagatgatctgttttggcctgaagaacaatctactgcatggtcccttgtaatacattcaaatcaaangactctccggtgatttgctaaggaggaactantccatcaattgtaatcttcnggaacaattggaacatattcntatcaatanttgncatttttcagtacttagatgntcgggcaaaaaaaaaaaa

SEQ ID NO: 20609 - DNA, 633 bp, Triticum aestivum
  unsure (1)..(633): unsure at all n locations
  Clone ID: PAT_TA_20609
atcatcttgtgtctggtttgatcttcctgcaactactacaaatagctactgggaacaagtagtgtgtgtgtactgatccaagctcaattttgttggaacataagctatttcacatgcacgttttacttttacttctgaaaccaaaatgcagttacagttaaactactactgtaaccaggtatcccccctgaaagtttggctatcttgtagtactgaaccttcagctttgaataaatctgggcaaatgccttttatctaaaaaaaggattcaaacaaactactactattaatatcatagcgaagaagtttcagtagccaaagacatngaagcggagagtttttttttaagagtagatggagctccttccttttattcaaacaaactactactattgattgttgtggtcctcaacaaaaaacaaaacanaaaaaccccagggggggcccggtaccaatcccctaaatgatcgtattacgcgcgccacggccgtcgtttaaactctgacgggaaaacctgcgtaccaactaaccccttgcagaaaccccttccaccgggtatacaaaagcccacgatgcctcaaattccaccnaagcaanggaccccgtcggcataccggggttggtaccactacc

SEQ ID NO: 20610 - DNA, 241 bp, Triticum aestivum
  Clone ID: PAT_TA_20610
gtactgccattcacatactgctccctgttttacttcattgagatccatagaaataagttatattcagttcgccacttttacaattgatggtcttatgttgaccgaaacaatagttcaagctcctaaaaaagcaattatgtgtatgctacatcactttgaggaactacagcaaacaaaataaggagagcttgggtactacatgatttttttatagtactacttgaagcccaaaaaaaaaaaa

SEQ ID NO: 20611 - DNA, 644 bp, Triticum aestivum
  unsure (1)..(644): unsure at all n locations
  Clone ID: PAT_TA_20611
gccgtccctcagattccactacatccgctcgcagcttgagatcgtcagccatgtccgggcgcggcaagggcgggaagggactcggcaaggggggcgccaagcgccaccggaaggtgctgcgggacaacatccagggcatcaccaagccggcgatccggcggctggcgcggaggggtggcgtgaagcgcatctcggggctcatctacgaggagacccgcggcgtgctcaagatcttcctccgagaacgtcatccgcgacgccgtcacctacaccgagcacgcccgccgcaagaccgtcaccgccatgggacgtcgtctacgcgctcaaagcgccaaggccgcaccctctacggcttccggcggctaagtccggccgactgtccctgtcttcctcgcaacctgcagattccaaaacttgatggacctgactgttaattcgcattctcgtcgtantctttggaatgaatttcccgtaatcgtctaaaaggggggcccgtacaatccccctatatgatctataccccgctcatggcgtccttanaactctgacgggaaacctgcgttaccacttatccctgagaaacccctttccactgggtatacaaaggcccacgtttcctcaaattccaccttgnaangacccct

SEQ ID NO: 20612 - DNA, 906 bp, Triticum aestivum
  Clone ID: PAT_TA_20612
agcaggaggagaaggggcctgcccaggcctccggcggcaaccaggcgtcgtcatcggtgaacggcaggggctccgggctcttcggcatgtcccaggacggaggcgatgacgacgacgacaggatgtcgtttctctccagaagcctggactggaagactctgcttggcctatccccggatcccgcccctgtttctccaaccagggtggcctttgcgactcacttccagcgcgccttcatgaacctcctacgcaacgcacagttcgaagaactctccgcgcaggacctgctcctgacatattcactgaacagcgattacctcctgacgctgccggtttacgtcgactggaagaaggcagctgagtctaatgccatcatattccagcgtgggtattcgaccgagagccaaaaaggcctgctattggtggagaaacttgattacctgcagtccaaactgttgcagaatattttcttcagcctttccaaacccttggggaaactggggaagtggaccaatgaggcattgaaaaaatcaacagggagcccgggatttcagatctggattgacaaattgaagctctggctgaaagagcaaacttatgcagagaattcactcttgttgatagaaaactattctaggggcaaacttacgccagatcaattaccagatgcagatcttcctatttggattgctgcacaaagggcagtctctcgttatgaaggatttctgtcacctgtcggccctcgcggcagactcctaaggagagtgcttacatggacaggattaattccatctttgccagaagcaacgctgaactctgatactgaaacaaacaatcagaaggttatgtgaggccaaattttctgcctagaattacgcttgcaaatatatgggagccagcaagcag

SEQ ID NO: 20613 - DNA, 869 bp, Triticum aestivum
  Clone ID: PAT_TA_20613
ctcaagctgtgcggagcgccgtcgtcgtcgagtggaggtggagcgcgccatgagaggggacggggaggcggaggaggcgtcggcgccgctgctggtgccggccgccaagggtaccgggcaggggcgggtggcgcgggagtggtgggaggagtcgaagcggctgtggcggatcgtggggccggccatcttccagcgggtggcgctgtacgggatcaacgtcgtctcgcaggccttcatcggccacatcggcgacctcgagctcgccgccttctccatcgcctccaccgtcatcgccggattcaacttcgggttcctgctgggcatggcgagcgcgctggagacgctgtgcgggcaggcgttcggggcgaagaagcaccacatgttgggcatctacctgcagcgctcgtggatcgtgctcttcctcttcgcattagcgctcacgcccacctacgtcttcaccgaggacctgctgctccttctcgggcagacaccggagctgtcccgcctggcgggcaagatgagcgtgtggctcatccctcagcacttcgccatggccatgctgctcccgctcacccgcttcctgcagagccagctcaagaactgggtcaccgccgccaccgccggggccaccctcgcgctgcacgtccttgtcacctacctcctcgtcacccgcttccatctcggctacgccggggtggtcgtcgccgccgacgtcgcctggtgggtcgtcgtcctggggcagttcttctacgtcgtctgcggcggctgcccgctctcgtggaggggcttctccgtggaggccttcgccgacttctgggacttcatcaagctctccaccgcctccggcgtcatgctatgcatggagaact

SEQ ID NO: 20614 - DNA, 532 bp, Triticum aestivum
  Clone ID: PAT_TA_20614
cggacgcgtgggcgcggtctgtgctccactccaccccccaccccacccccgcccgcgccgccgccatggtcgcgctcgcctccctctcttctctgtgcctctgcggcgccgctcgccgccgttctgcctccgcgcccacctccatatcatgctgcatgctcgcaactccctccggcagagggtctcatgaatctagaataccccgtagaaggttccggagaaccgagggtgctactaagagcatggaagattcagtcaagcgaaagatggagcagttctacgaaggggtggatggtccgcccctccgggtcctcccaatcggcggccttggggaaatcggcatgaattgcatgctcgtcgggaactgtgaccgttatatcctgattgatgcaggggttatgttcccagactacgacgagtttggtgtgcaaaagattattcctgacacaactttcatcaagaaatggagccacaaaattgaagcagttattattacacatggccatgaagatcacatccttgggtatcccga

SEQ ID NO: 20615 - DNA, 397 bp, Triticum aestivum
  unsure (1)..(397): unsure at all n locations
  Clone ID: PAT_TA_20615
gcgaggggcacatggggatcctcgccgcgctcaacgcgtaccgtgggcagcatgcagcggcgtcggaggtcacggtggcggggcacaatggagcggctgaagggactactcgccatcaacatcagaaccagcatcagcatctgcagcacgggggtggcgagccgaacgagagcatgagcggcagcgactccgtagggcttccgtgaccgctggtccgttcgacagctttgggcttaccaatttccgtctttgggtttgttcttctttgggttgtttctgttcttgacccgatcgcttgttatggctttgtaaaaaacggcgccgaatcttgcacggtcatacggttgcaacttncatttcattgcatncaagggcaaatngctataaaaaaaaaaaa

SEQ ID NO: 20616 - DNA, 680 bp, Triticum aestivum
  unsure (1)..(680): unsure at all n locations
  Clone ID: PAT_TA_20616
cagagatcatgttattcctgttcatcacccatggtcttttaagtcagtccgaagatttgtgaagaaagcaatgtggcttctacctgatatggattctactgggaactggtataaacctgggcaagtttatctggaaaaggatgttatccttccatatgtcccaaatgttgacctttgtgattataagtgtgtgtcagaaactcaatctaaaagaagtacgttgctgttttcccgaggaagtcttaaaagaagcgctggtggccggctacgctgtaagcttgtgacagaattacaaagtatagaagacataattatagaagaagggtctgctggcgccaaggggaaagtagcantcaagactggcatcgcaatctctcntttgcttgatcctgctggggaacccatcttcgctccctgtttgatgcaattgttaagtggtgttcccagttatanccaggaagaanctaactccttttgaaggatacttgactacagcaagatacattgttgttccacaacgatgcngtcaccngctggcngggaanactaanagnatgatnccaagattaggaatgaaccaactccaataccaggattcaatcaatccgncaaccctgncaaaaactaatgnaagatcngaacgggaacattcaatcaggnccggntggcaaaacaaaatn

SEQ ID NO: 20617 - DNA, 532 bp, Triticum aestivum
  unsure (1)..(532): unsure at all n locations
  Clone ID: PAT_TA_20617
aatcttccctggatttttatccgaagatactggatcacatggcctcgcgtcccggttcccgctcgtgctgatcacgatgtacaatgtgttagatctgattggtaggtacctaccactgatcaaatgcctgaagctgacgaaccggaagggcctgatggtcgccatcttgggcgcgcttcctgttcatccctgcgttctacttcacggccaagttatggcgaccaagggtacatgatcttccctcaacgtcctttcctggggactggaccaatcgctacctcaaccgtgtgcgtcctccgcctgaacccccaaatgggtacaaggggccgagagcagaacgctcctggggaacgtgcccctggtgtgccccccccggcggcatattccccggcgtcccgcccccctcggggtggcgcataggcaagggctggtagtcnaacactctccgctgtttggtctggcgcgattcgttcgtgtcggggtgggaagcgcgctaaatgctggggatntttcttgctccaaanaggtagnn

SEQ ID NO: 20618 - DNA, 666 bp, Triticum aestivum
  Clone ID: PAT_TA_20618
cggacgcgtgggcggacgcgtgggcgaaggccgacagcagtctcctcggcggctgacggtgtgcaggtgtgcaccctggccctggggcctggagacgtgcatcgtagaaggccaacagctaggagctgagcagccgtacaaagccgaaggtgtcagaggggaagcgagcaacataacttttctcgcagaaggctaggaggtcgtcgttctgcacgtcggacaaggttcttcagctgtcggacgaggtggaggcactcttcctgaagcacttcgcgggcaacaacacgagatggtggcctctatgcatgtttcgtcgtgagctctaggttctggaagttggaagaagcaatgcatgccggatctaggcatgcatgcatgctctagtatccctgcttctgaagctttcctgggaggctggggactttgttgtaatgctgatttttctgagaattttgttgtacagggtataagagtatatataggcgaaagaactaggtcggtggagctacgaggggccgacgagggtggggggcgtgtcctcctgcctcgtggctgcctcgttgcttccttgacgtccactcaaagtctcctggattgcgtttgttccaaaaaagatcctcgggaaggtttcgttccatttggattccaaaaaaaaaaaaaaaaaaa

SEQ ID NO: 20619 - DNA, 419 bp, Triticum aestivum
  unsure (1)..(419): unsure at all n locations
  Clone ID: PAT_TA_20619
ggtggacgtgccccccgggaacaccgccgacgagacgcgcaccttcgtggacaccatcgtgcggtgcaacctccagtcgctggcgcgcaccgcccagcagctcgccgtccccgcctagggcatgccggtcctcaccggcgtccaccagctcctgcgcgcgcgtgccctttttctctctttttttccaggaatttgatcgtcgttgcttattgtttcctgactagttgcctccagcgaggaggcgattgatcatgatcagatcagcgtgtggttctagcttgtgtacgtttacccccttccatttttgactacacaaagtacaaaatcattgtgttaagtgctactacctgatactaaccttgttcataaacattcacgtttcttccccttgttctccttaataaaattcttggatgtan

SEQ ID NO: 20620 - DNA, 495 bp, Triticum aestivum
  unsure (1)..(495): unsure at all n locations
  Clone ID: PAT_TA_20620
cccgccccctgccgcctccgcagccccgtgctcccccggaccgccgtccgcggccgctgccgcccctcgcggcgggggcgcaccggcgcgcgcgggccgccccgccgccggtccccgccccccgcgctctctggcgccccgcccgctcccgcgcccgctccgccctgccccgccgctcccgcgccctccacccccccctccctcctcctcgtcttcagcgtgacaatgcccgctgtccggccggccggccggtgccttcctcggcctccgttcatgctcttcctccggcttgccccgttcgatcactggcgcgcntcctaatcgatgagctcctgccattccaagcanctgccatgcatcctcncctgcatccatctggtctggtctggtcntcaaactgaccaaacaaaaccctctgttcaagtccggaaactctggatactgcccgaattgaattcaanncattcaanttcaanganacattgcctcttctaa

SEQ ID NO: 20621 - DNA, 710 bp, Triticum aestivum
  unsure (1)..(710): unsure at all n locations
  Clone ID: PAT_TA_20621
aagtaattaagactgtcttacaggcttacctgccgcagctcgcgcttattgtttttctagctttgctgctctccttatgtttctctcaaagtcagaagggatcccttcacagagccatgtagtcagggcagcgtcaggaaaatatttctacttcattatcttcaatgtcttccttggctttacaattagctcctcattgttcagtgccttgaaaaccatcgttgataaccctcctgggattattgtgatgctagtcaacagccttcctggaagtgcaactttcttcctctcattccgttgcactgaaattctttggttggttatgggcttgagctctctcgcttggtccctctcatcatttcccacttgaaaaagaagtacctatgcaagactgaggatgaagtgcgggcagcgtggagtccaagggacttggggtataacaccaaggttccaagtgacatgctgatggttacaattgtgctgtgcactccgtcattgcacttgggtttcatccggtcccgacgtggctggntggtatacaaaaacagtttgagatcaagtccaatacaaacaatgggattgcganacaacaggtnttcggtcaagatncagcacatatgggtacaacnaattctcangnaccttcgcacatattaactcctaattcaaantnacgatncaaccctaggacagncannaccaagggcnat

SEQ ID NO: 20622 - DNA, 808 bp, Triticum aestivum
  unsure (1)..(808): unsure at all n locations
  Clone ID: PAT_TA_20622
tgcttcataatctatagtaacatagggaagagtgccagttcatccttttcagagagggccagatggtgcagccctacgagcaagctaacgaagaggaggattaagcttaaaccaagaaaattgaatactaactaggcacagacccacatgggaaccagtactagatcaaacggcaccgtccttgggttgggtggacaatggtcctgaacctctcctctcagattgagaaggcttagcagatttatttaaaagcatattgcgaaaatccaacagctctttcatgcgttcagttgatcaacagtctgacgatgatacgattgaatgaatagcaaagtagagtgatccacagcaatcgctctcattgtcttgaacaccaatttgagctcaacaagacgaatcttccgagaagttgacagccaggtcccagtagtgtgcaactttagcatctacaaacagtttcttgggcagcagcctcactcaggcacttacgcacaccgaaccacctggggaaaggcgggttcaacacactacctccgccatactaatgcgcagctattcacctgcctgtccggttcatcagcggcgttatcttgccacaaactgcagcagcagccatcaatcccggttcatcatgagctgatgtactcttgatnatgctccgtccttcacaacacaacactncacatctgtgattacggnacgcantanccgtatcccggntgactcacttaaaggacgtgtgcagnccgatcgtnacacaacattcatcnagntcgtagntacaaaagttccccttctctggggccaa

SEQ ID NO: 20623 - DNA, 931 bp, Triticum aestivum
  unsure (1)..(931): unsure at all n locations
  Clone ID: PAT_TA_20623
tagggatttgtacnngcccccgcnngacttgtganttcnttgttgtgnncaagaggaggaggtngacgagctttccttgnctantaactggtcctaacggcaatntgcantccacctgtgcaagatgatcangtagtaccatggccaaanggtaccaaatngtgaaagacattggatcggctctttgtttacntccaccatgagtgtgaccnttacattttgcatagagatatcaaacccaggcaacatactccntggacaacaacttcaatgccaagcttgctgacttcggtctgtcgaggatcggcanccaggataaggcgacgttgatgacaaccgctctagggacggaagggtatatagatccagaatgtaggaaagatgggaaagtaaagttctaccctagatcagatgtctatagctttggaattgtcctacttgacattgtatgcacatggaagtcaagggagcatgtatgggagctatacaaaggaggcaaggtcatcgaggctacagatgcaaggttgcatggggatgactttgataggtggcagacacagatgcagcgtgtagctgtcctaggactctggtgttctcttcttgacggtgcgaaaaggcctaccattcagaaagcaatggagttcctggaacgtcatgagccattgcctaaccttaactacacggtgaacacttggcttccctcgccacatcatgatgcctacactagtcattgctctgacgagcaaacacttatgtcaaatctcaagatgacagctagatctccctgggagctgcatacaaagatttagggtggttatgtccactacattatatatcctgctctcaacatttctggacaacgtacactcctctatgcatctccgtaataagttcttccacgcgcgtgcttcgcccagttcnnaaaaaaaaa

SEQ ID NO: 20624 - DNA, 804 bp, Triticum aestivum
  unsure (1)..(804): unsure at all n locations
  Clone ID: PAT_TA_20624
attcggcacgagggcgaccgtccagcgccgccctctcaaccggnatgcccgaaggtcgccgcgaccaccagacgcctccctctacagcagacggccctctctctccccgaccacgcaggctctgttcacaagaattcccaagcgatattaccatccaagttggggagagcagcttccgcacaagctcccactggcatctaaatgcggctacataaggaagctggtgtcgggggccaacgggtccagggtgacccacctcgagatcacaggcatgcccggcgacgccaaggcgtttgacctcgtcatcaagttctgctacggcatcaacttcgagatcaccaccgacaccatcgccaggctgcgctgcgccaccgagcacctggagatgaccaagggagtgcaagcccgggaacctcatcggtgggaccgaggcctacctggaggaggtggcactggtgaacctcgaggaccacgctctgcagggccaggaccgaggagctcctcccgacgtccgacaaggtgcagatcattagcaggtgcatcgatgccatagcgaccatgacctgcagcgatggcagtcatgagggactggacagtgctacggcagcgtgggcacggcgcccaagcccgtggatgactggtgggccaacgagctggacggtgggagtttaaaccgcactctttggtatgaaccccatgcgtaaactttgatagttcttgtaacatgatttcagttcttgggtaaaattcagttcttgaaatgtaagtcattctgtacatatttttagttnaggnaagagagag

SEQ ID NO: 20625 - DNA, 657 bp, Triticum aestivum
  unsure (1)..(657): unsure at all n locations
  Clone ID: PAT_TA_20625
gttctcctccggcgccgatgacgactccaccgagcgcctcaccgtgtccgccgtcctgggcagcgcgaggggcaacctgtggggccccgtcgcgaccgtcgccttcgggtacgtccttgaggtggcctgcgcgggcgccatcgtcgcgctggcgctggccacggtctacctcctagagcgctccctgctgctcctcttcctcgacgtgctgctcgtgctcctcgcgtcgctcttcctggtctacctcaccgtcgtctgcgcggtggcggtcgtcgtgtcggtggcggagccggggcggcacggcgcggcggcggtgtcccgcgcgtggcggctgatggaggggaggaggagcgcgggcggcgctctacgtggtcgcgacgtgcgcgctcggcgccgcggtgtcaccggtgtacacgctcgcgctgaggtggtggccgcggagcccgtgcgccggggtggccgccggcgccgcctacgtggccctgctcggcgccngtggaggtgttctccgtcgcggccgtcacggcgtactacttcgagtgcagggacagcaaggaggaggaggaggtggtggcagnccacagatacagacacgccaagctgcccaatggagatgcatgaatagcttatgttcgatcaattcattcccttattttt

SEQ ID NO: 20626 - DNA, 458 bp, Triticum aestivum
  Clone ID: PAT_TA_20626
gtgcagctctgcagcttcaaggaactcaagagctctgaggtgaacaagaatggcaggagcagcgccatgatgggcgtcaagaacgacgtgtactttaggaagggagccgtcggcgactggaaaaactacatgacgccggagatggcggcgcagctgggacaagattcgtcgaggaggcgcttcaaggttcaggcctgacctttgggcatctccatgttagaagggaaaggacacccgtgcagagggatggggagcgaattgttgctaatgaagcatgaattttccctatttgacaaaccaaaagaaaataaggccttatgaatattgaacctcacaagtgatatttatttatttacgaatcacaagtgatatgctttaaggtcattagtttccgaccctatgaaatgacatgtattaaaataataatttacttgcttaacccaatgaccaaaaaaaaa

SEQ ID NO: 20627 - DNA, 832 bp, Triticum aestivum
  Clone ID: PAT_TA_20627
caggctaacgtactcgggccgcggtcctacattccacttgccgccaccttattcaattgtcattcaggaatccgaagccgggagctggcacgtgccaacaacgaccggagacgacatcgagagcccgcggcagtggctctgcgccaccaggaaaacttcggagggaccgccttctccaccgccccaagctcgcgccaccagcaaaacttcggagagaccgccttctccactgccccaagctcgcgccactagcaaaactttggagagaccgccttctccgccgccccaaactcgtgccaccagcaaaacttcggagagaccgccttctccgccaccccaagctcgcgccaccaggaaaacttccgagagaccgtcttctccaccacgccaagctcgcgccaccaggagaacttcagagagaccgtcttctccaccaccccaagtttcggcaaccaggaaagcttcggagagaccgtcttctccgccgccccaagcttccaccaccagcaaaacttccgatggatcgtcttcaccaccgccccaatcgaggttaagtgagctgggttggtagcctttgctagaactcatgttatgggggtgcatgagcatatagcagaagtagaaaaatagcacccagatttgggcctatttgttttagatttaagagaaaaatagcagctcttgattgaggctgagattatgagccaccaacatctgtgactgaagttagtccttagttgcccatgaaaatgaaaatttttgcttgctgtaacaaggtgattggtgaatgtggatgattttttaccttaaaaaaaaaaaaaaaaaaaaaaaa

SEQ ID NO: 20628 - DNA, 417 bp, Triticum aestivum
  unsure (1)..(417): unsure at all n locations
  Clone ID: PAT_TA_20628
gagaggtccgtctgggtctcggcggcggaggcggtttgatctcaccgccggcgatctcctccttcctcaccacccgccctctccatatctcgctccagttacagtacaggagtggtcgatcggtcggtggccatgtcgtccgccaacgcaacctgttgtgtttctgggagaatttgggatttgacggctctgccagactgcagataagggatggtcccgttcctaanaccatcatcgattaccctcaagggtttggtgatctgtgggtagctgacgccaaacgtcatttaattctccaggcccaatccccgtcccctggatnagaaaacccaaacaagaccnttagcccaaggctttggcaataacgctccaacacttttgcccaagcgaaacaaattcaccccnctaattgatttt

SEQ ID NO: 20629 - DNA, 668 bp, Triticum aestivum
  unsure (1)..(668): unsure at all n locations
  Clone ID: PAT_TA_20629
gtccaatttgagaatacttttttcttttttagtccctttaattgacatagatacaagtactctactaggatgatgcacaataaatagtcaggatagctcagttggtagagcagaggattgaaaatcctcgtgtcaccagttcaaatctggttcctggcacagaacaaacaatgaatgacttttcggggaagaaaagggccacatattttttttagggaaaagctttttttaaggggaagaatcatcaacaaaaaatccaggaaagaacagcgaaggaaaaacgtgaaaaaacaagtgttttcccggaacggaatagcggaaattccatacgttgatcaccaatgttgcatgtctttccttaagctgggagtactttgagttagaaggcctactttattccgtccttttagagcctacttattccgtctagctatttccattctaataaataacccgattatatcatatcttggnaaancctaaagactaccaaggtgtacctanagggtaccatagncaaacttgngtaacgttcctctgggngnaactgaacaantgncaggacaatcaattancatgtccanttcccaaataaaaattggaagggcacacanaggtccggcgggaaacntgccgaaanagncacgggatcttggccagggtncgcc

SEQ ID NO: 20630 - DNA, 637 bp, Triticum aestivum
  unsure (1)..(637): unsure at all n locations
  Clone ID: PAT_TA_20630
actacaacatccagaaagagtccaccctccacttggtgctcaggctccgtggtggtatgcagatttttgtcaagaccctgaccggcaagaccatcaccctggaggtcgagtcgtctgacaccattgacaatgtgaaggccaagatccaggacaaggagggcattcccccggaccagcagcgtctcatcttccgctgggcaagcagcttgaggatggccgcacccttggcggattacaacatccaagaagganccaccctccaccttgtcctccgccttccgtgggaggcatgcaatctttggtcaaagacctcaactgggcaagactatcaccttgggaggtggatccatctgacaccatccgacaacgtgaaggcaagttccaagacaaggaggcatccccccggacaacacgctcatctttgctggtaacactttangatggcccaccttgggaaactacaacattcaagaaggancaacctcacttgggtgtccgtctcccaagtggcaataactcntgacaatgactgctcgtaactgggtcaatgctcgtgtctcgtgtcccaaaggatccggncgtgcgtcttctaacgtcttgttcaaactacgtatcatttacttnagttaactccgtg

SEQ ID NO: 20631 - DNA, 811 bp, Triticum aestivum
  unsure (1)..(811): unsure at all n locations
  Clone ID: PAT_TA_20631
cggccgcgtcgaccgccattatcaggagctcgtggaagaactggaaatttacctacttgcatttgatagagcagggtactaaatatctgttggaggcagatattaacgagaagaacctaaaggagttctccttaagccttttggatggtacactccctccatacttccgctcagaaccagtaccacaagaaaaaggacttgttgaaaaggttgttggacggacttgtggttctgctggccggccaggccctcccaatgtcctcctcgaggctcatgcaccttggtgtgttgactgtgaagccatcagtaaaaacattgagaagttggccaagcatttcagtggtttgggacaatcttaaatttgcacgtattgatgcttcggtgaatgaacatccaaaattgcaggtaaacaattaccccacacccttgctttatcctgctgaagacaagaccaacccgattcaaactttccaaagaaattaagcctggaaagacatggcgagattcgccaagggggcgccgcggccgccagacgtccnagattaaggagaactccaaacttctgacgtccaaacagtaacngccgcttacaatgtcaaggatgactataattgattgcncgttnaacatgctggcgccttttaaggaaatgacatggacatggcttatanngaaggaataatanggttggccccgtaaacgggnnacatctaaatcaacattatgatgatgtncaaagtcnaaactcattggaatnatgngtcanaaacttgtcaagtttataaagaaatataancagaaaaaaaaaaaa

SEQ ID NO: 20632 - DNA, 741 bp, Triticum aestivum
  Clone ID: PAT_TA_20632
gtcccgcgccgcgcccccctgcccgggccgcgggtcccccccccgcctccccccgcgcgtcctcagcatcctccccgccgccggccccgccgccgtctccgtcgtccccgccgccgtcccccccgccgtccccgccgtccccccctccggccccctcttctccctcgcgctcaggccctacggcgacatcttctccgtcaacctcatagacacagaggacatggccaagaacaaggacatccaggaagttccaccgcgtcacgcacagccgctacgagtactccacgcctacatggtccggccgtgccgacaacggcgacgagctcgaccccaacaccaagtggaagatgctggaaagctggcacgacgacttccagccccggtgcccgtacgtcggcggcgaagctgggcaaaaaggagagctggcacatgaccgggacacctctccatcgataagaggtgctgctaactcaacatctacgtacggcagcaggacaagggtctccatccgcgcgcccctttccgttttcatcagccttcaaaccaaaccatgcatgctatcctagctctacctgcacttatttatgttggtcttgtccctcctcttatggttcgtctccgtatgcatgcatccgaactacctggaggagaaggtttctttcccgatttcatgtccttgttgttccctggtgcatgttaataaataaagtaagtccttggttgttttttttaaaaaaaaaa

SEQ ID NO: 20633 - DNA, 960 bp, Triticum aestivum
  unsure (1)..(960): unsure at all n locations
  Clone ID: PAT_TA_20633
gaatactgaaataattcggacccaaattcatttgttttgacttgttgaatagtattgatcccacatttttgttctgcctagaccatcatcttctacagtgctgcctaacagtttatttaacgaatcatactgtgctccacaaattgtcagtctttgacacaacataaatacttgtgtgcacacatgcatggatatagatatttacgaaaacatttcccattgtttagtccatgccaatagttgaggttcaaattcacattcatcttcaaaatgattactttcttgatactgcggtggatggaccaaggatatgtggcatactacattattcctcttctctgggtggcgttagctttttcgccggggacaggtatgagaaattcaagaagggtcagataaatgaggatggagtcgattcaccttcatttaagtggggatgccaaatacattattctagatgacctgggaagatgaggatgggtttctggatgaagatacataatttgggaatgtggcaacattttaactgccacttgggattgttgatgcctttaagaccattggatgggctgcctgtttgaaataatactcatggagttttcctacaagagacattacaaacacacaacatcctgttgttacttaaccactcacattgagtttaagcttgatttgactgaatggcacctggattgccattatatcatactatgcgctaactttcactggacactttttnaaagattcgnaagttggacaatccgcgcttgttcaataaggatttactttnaacccacgatattactngtttcccttcnctccntgtnnacgcgaaatcacattcattataaacncacatttggggccaagnataatcacccgtgtaataacgtagatgncanaataccanattncngcccctnaactaggaancccgatattgaccgaaacgtatgaaaa

SEQ ID NO: 20634 - DNA, 711 bp, Triticum aestivum
  Clone ID: PAT_TA_20634
ctccccgtgttcttctcttcgaatcgagatcacgaccgcgagtggacagagaggcgacgcgaatcccccgaacctcatatttgccacccgccctcttccaaagatggctgcttcggcggccttcgcggcggtggcggtcatgatgctggtggcagcgcacttggccgttgcggcggcagctccggtgacggccccggcgttcctctgggcgcctgagaactatggttcccacgagactaaaggagtagtccactatcagacaatgccaccggcaagtctagcaaaatctgttcttgatgaaggtggctggtcaaacttggtgtgttcaagggagggctcttataagaatgttgacattgcagttgtttttcttggctcgaagctacaatcgtcagacatctctagagtttagcaagctgatccatctttggctgacacactaaagctctccttcataggctcagggctttccatggcattccctaatcttgctttttgctttgatgaataatgagagatctcattgctatctggtcttgctactagctgtgaaaattaatttcgcggataacacatcacatacaaccttctctgacccctggtccgtttggggtgtagatccgaccttgcccctttgctggcatccgcttcgcggccgtgtgatgtcccgggagagaagcaatccaaggggaaaggctgatctaattgttt

SEQ ID NO: 20635 - DNA, 429 bp, Triticum aestivum
  Clone ID: PAT_TA_20635
gcgctccgcgccgagctgctgcagctgctggccttcatggagtcacaggagctctacaaccagcggggacgcccctacgccctcgccaccgtcacgtcccacgggcgccagcgcaccgccccgagggacgacgagggggaggtcaggtgcctctatgcggcgccgcgcatgaccacctacctggagcaggccaagaggtccgaggagaaccccaaggagcccgtgccctccgcggacgacgatctctagtctaggagataagaaaaacgccaccccttcgccgccatcgccgacgccagcaacaaattatactgtactttatcattgcatgtatttgtacgtccttactttcccaggctttctgttaatataaactgcatgtaattgcttgagtttgattaataaagttgcttatctaccagttcaaaa

SEQ ID NO: 20636 - DNA, 1730 bp, Triticum aestivum
  unsure (1)..(1730): unsure at all n locations
  Clone ID: PAT_TA_20636
gttagccctggccttccgctccccaacgccccacgagtgggctggagctccccatccgctccccggcagctgctatccaccgtcgcactctttgccttcggcgcggggctcctcacctacggcgctcacctctcctacgtccacatcgagccccagcgcgcgcgcacgctcgcccgcgatcaattcgtccgcgactacctacgcaggaagcacgacaagtaagcccgcaccccccacggcatccccctcccagtccgctcgatctctcgccgttcctgctcgtcggcgatggctttgtcccccgcgagcgtcgggccggtgatttcggaggtggagatgaacgccggcgccgatcagggtgccactaccgtgcgggccactgtcgtgcaggcctgcagcgtgttctacgacacccctgcaacgctcgataaagcagagaaattgatagcggaggctgctggatatggttcacagttggttctttttccagaagtctttgttggtggctaccctcatgggtctacctttggactgactattggcagtcgatctgccaaaggaaaagaaagactttcggaagtatcatgcggctgccatagatgtgcctggcccagaggttagccgcttagctgcattggccggaaaatacaatgtcttcttggtgattggggttgttgaaagggcaggctacacactctacaatacagtgctctcctttgattctctgggaaagtacctaggaaagcaccgcaagctcatgcctaccgcactggaacgagtattctgggggtgtggagatggatctaccatacctgtttatgatactccacttggaaaggtaggtgccgtcatctgctgggagaacagaatgccacttatcaggacagcgatgtatgccaaaggtgttgaaatatattgtgctcccactgcggatgcgctgccaagttggcaatcttccatgacacatattgcgcttgaagggggatgctttgttctgacagcaaaccagttctgccgcagaaaagactttcctcccccgcctgagtatacctttggtggccatgaggaggagccatccccagaaaccgctgtttgtcctggagggagcgccatcatttcgccatccgggacagtgttggcaggtcccaactatgaaggcgaggccctcctcacagctgacctggaccttggagaaattgttcgagccaagtttgatttcgacgtcgtgggacactacgcgcgccctgaggtgctgagcttgactgtgaagaccgaaccgaagcacgccgtgtctttcacctctactgtgggataagattcgaggcgcaaagagggacgatagtttgaagacctgatgtccagtagtcttccgtagtcgtgtataacaaagttctcgtccaacgtctttgtcggcattacaacaataattgtggcttcatatatttcttgtaaagattctctactgggtttgctgttacactctcactcggtagtcaccggccgccatatatacaatttcaacaaatttaaaaaaaaaaaaaacacacacgcaagtgaaccaaaaccgaacaacaccaacaccttaaacacacaacaaaaaagatgcttcccgaacaccccccgcccctgtttgttgggttttcctcctttggattcaacccaactggtatgttacttcnnccaaangaanaanaaaacantcaactnggtctnaanacggagtcctgcta

SEQ ID NO: 20637 - DNA, 488 bp, Triticum aestivum
  Clone ID: PAT_TA_20637
agattaatccagctatccaggaagccatggacgccgctacggtgatcgggtgtttccgggacaggagcatcctcatcaccggctcgacgggcttcctcgggaaattgctggtggagaagatactaagggtccagccggacgtgaggaagctctaccttcttgtgcgctcaccagacgccgcatccgcccagcatcgtgtgctcacggaggttgttggaacagaactctttgatgttctacgaaggaggcacggagctgatttcaactctttgataaaagacaaaattttccctttagctggagatatcgtttacgaaaattgtgcactcccaagctctacgattgagcagatatccaaggaaattgatgtcattgtcagtgtagctgcaactactagcttctacgagagatatgatgttgctttggcatcaaatgccttgggggtcgcccatgtgtgccatttagcaaacaagtgtgggtatctcaaa

SEQ ID NO: 20638 - DNA, 572 bp, Triticum aestivum
  unsure (1)..(572): unsure at all n locations
  Clone ID: PAT_TA_20638
cgagcntngtcgaggccgtgggaagcagtgctgtncgtagttggatagatgtagcagcgttgtcaagagtcaagtgacagcggcgcacttgtncccaggtcccaagtgaggagcaagtcgcaggccagctgtgtcatatgttttagaaatttcccatgttgcatgctctgctgcntgaatgtcccctccatctgttctttggaacaggatcccaatataaaagagaaggattatttggtggagcggacaataacaacccacatgaatgacccagtgaagctgtaggcccaagacaagcaactaggagaaggaccttataaagtcattgaagaacttgcctccatcttttgttctcagggaaggacacttttgctgaatgcatgttactgtgatgtatttaccactacccctaagacacagtagacctactgctggaagaggtatgaatctatgttatttgccacaatgggttagattagatccaggcaaagagacacaaattaggcccatgtcagttggtacgctgataaatgtataataaaccagtgtattctcattttaaaaaaaaaaaa

SEQ ID NO: 20639 - DNA, 724 bp, Triticum aestivum
  unsure (1)..(724): unsure at all n locations
  Clone ID: PAT_TA_20639
ccgaaaggtaatcccaatccccacagaaatcccggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccaacggcggcgacttcaccaaagggcaacggcaccggcggcgagtccatctacggcgagaattcgcccgacgagaattcgtccacaagcacacgaacgcccgggatcctctccatggtcaacgcgggccccaacacaatcggtccacttctcatctgcacgtccctgcaattggcgcgacggaatcactggtcttccgcaagtcgtccaggcatggactctcaagaaatcgagaagtgggtccgcaacggaactgtcaacaatcgcatcgcgatgcggcactcaaatcgtcgccgccgtcgctgctctccccggtccggtctcattaaaaaaaaccgttcgtcgttccctggccccaaatcgcgtgtgtaggccttgcggttntcggaagtttctccggcccngttagaaacc

SEQ ID NO: 20640 - DNA, 883 bp, Triticum aestivum
  unsure (1)..(883): unsure at all n locations
  Clone ID: PAT_TA_20640
tttggtgattctttctaaaacttctatctcaagcaaggattcagtagatgaagcaaaccggaaagataattcaaacgcagaagaacaaggtgctgcaggttctgttgatgaggatggtgctcctgttgcatccaccgaagtgtccataaatacacagaaaacagaagacacacgtcaactgtttgcaagtgccgagactgctgtggaggcgggggctatgcttgccacttcaatggggcgttccagttttataaaatcagactttgagaagatatgttttctggataatgtttcaactgacacacaggttgccatttggcgtgattcttcacgaagaagactggttgttgcctttcgagggactgagcaaacaaggtggaaggatttggtaacggacttgatgcttgtccctgctggactaaaccctgagaggctgggtggtgacttcaaacaagaagttcaagttcacagtggattcttaagcgcatatgactctgttaggaataggatcatggctcttgtcaagacacgccattggatatatggatgaagaagatgcagaaaccatacctacgtggcacgtctacataactggacatagtttaagtggagcactggcaacccttctcgctcttgaactttcatcaagtcaaatggctaaagaatggtgttatattcntgacagtgtacaattttggctcncccaaagttggnaatagaaggttgctgatgtctacaatgcgaaagtaaaagatactggagagtntcaatcatcgagatacatccaacaatgccactctaagggctatgccatgtggaacacantttactaaagtggaatcaacanatcacggcaaggaattggataagacaggnatanaag

SEQ ID NO: 20641 - DNA, 1407 bp, Triticum aestivum
  Clone ID: PAT_TA_20641
tatccacgcgtccgctcattcatctgcaaccatcgagttgtactactactgttcgtcgtcactagcattgcgtcgcactaatggctcctgctcaatgcgcgcgcgtgcagagggtgttccacttcggcaagggcaagagcgagggcaacaaggccatgaaggacctgctgggcgggaagggcgccaacttggcggagatggcgagcatcgggctgtcggtgccgccggggttcacggtgtcgacggaggcgtgcgagcagtaccaggcggcggggagggcgctgccgccggggctgtgggaggagaccctggagggcctgcgctgggtggaggagtacatgggcgcgcgcctcggcgaccccgcgcggccgctgctcctctccgtccgctccggcgccgcggtgtccatgcccggcatgatggacacggtgctcaacctggggctcaacgacgaggtggccgccgggctggcggccaagagcggcgaccgcttcgcctacgactcgtaccgccgcttcctcgacatgttcggcaacgtcgtcatggacattccccatgcgcttttcgaagagaagctcgaagccatgaaagcagccaagggggtggacaacgacaccgacctcactgccaatgacctcagggagctagtgggtcagtacaagaacgtctacgttgaagccaaaggggaacaatttccctctgtaccccaagaggcaactgcagttagcggtgttggccgtgttcgactcgtgggacagtccgagagcgaacaagtatagaagcattaatcagatcaccggacttaggggcaccgccgtgaacgtgcagtgcatggtgtttggcaacatggggaacacctccggcactggtgtcctcttcactaggaaccctagcaccggggagaagaagctttatggcgagttcctagtcaatgctcagggtgaggatgtggttgctggaatcagaaccccggaggatcttgatgccatgagggatcacatgccggaggcctatgcagagcttgttgaaaactgtgacatactggagagccactataaggaaatgatggatattgaatttacagttcaagaaaataggctctggatgctacaatgcagatccggaaagcgtactggcacaggagctgtgaagattgctgtagacatggttaatgaggctcttgttgatcgcaatacagcgattaagatggtagaaccaggccacttggaccagcttcttcatccacagtttgcgaaccccgaggctgcttcatacaaaggcaaagttattactacaggcttaccagcatcacctggggctgctgtgggtcaaattgtatttactgccgaggatgctgaagcatggcatgcccaagggaaatctgctattctggtgaggacagagacc

SEQ ID NO: 20642 - DNA, 636 bp, Triticum aestivum
  unsure (1)..(636): unsure at all n locations
  Clone ID: PAT_TA_20642
ttttttttgactcaaattgatatccattcagctaaccatccggttatacatcggtacaagagtttacaattttgcaacactggtaatttacacactgaagcttgggaccaaagcaaatgtgtatcatgtccctgatttacagagtccagtttcttttcccaactaccatgctggaaagaaaattatttcccaacctggagtatcaagtgaaccatgtcatctccatatcctggactgggtagaccaaagtggttatttgcttaccccccccaccccgattatccccatccccaagtgggttggatcccaccaagaagggagctaccattccccgtatatgatccacgccccttccacatgagagtacgttggtttgggaggtggtgggcgcattttgactcgggttcgcaaacggtgctaatggcgcaaactgggaaacaaggcatcatatgtcaactgtccatacataaaagcaaanacctggttaataccggccncaacctgtcctccngggaacttgttttgccaaacgtccggtattccatggggatttcaacaattagcactataggagaaaanccacaacctatnaacaagacatggantgcaatgcccanaaggaaaaatnacaatcng

SEQ ID NO: 20643 - DNA, 670 bp, Triticum aestivum
  unsure (1)..(670): unsure at all n locations
  Clone ID: PAT_TA_20643
caccctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagattccgcaagtaccaagaagagcacggagctgctgattccgcaagctgcctttccaagcgcctgggtccgcgaagattcgcgcaaggactttcaaagacggcctccgcttcccaatccccacgcccgtgctgggcctcccaaggaaggcggccgaggcgtactccgtccggctgttccgaggacaccaacctgtggcgcatccaacgccaaacgcgtcacatcatgcccaaagacatccaactcgcccggcgcatccgtggcgaaaaggctaactgcctcctcccgtttaacacgtatgggttcggataattgtatcccggtggaatttgtcccnaatggctgtccaaggcttaaactttggtgtanaaaaatatggtgttgggtagtggacaacaacccanagtagtccnttgttcataacaactttcattnanncccaaaaagggcgt

SEQ ID NO: 20644 - DNA, 1330 bp, Triticum aestivum
  Clone ID: PAT_TA_20644
ctttgtccctttccccccgccccagccggcgacgagccttatcccgcgccggacataaagcccctcccctcgcgactccctcctccctcttcccatccgcctcgccgctcggtccatctcctccgccctcctccgatttctcctgcgcctgttggttgaataaggttgacaagaatctgccggactacttgcttcagtatggataccagctgcctatcatctatgaacatagctggagcgaagcaagtaagatcttttgctggacaacttcatacgcagaggtgtttcacaagtagcagcgtccaggcactaaaaactagtcatcgtacgacctcccttggcttaaggaataaagtaaaaggatcacgtcatggacttcgtgctctgcaggttgtttgccaagattttccaaggcctccactagagaacacgattaactatttggaagctggccagctttcttcgtcgtttagaagcagtgaacgccccagtaaaccattacaggtcgtgattgctggtgcaggactggctggtctatcaactgcaaaatacctggcagacgctggccacaaacccatagtgcttgaggcaagagatgtgttgggcggaaagttagctgcatggaaggatgaagatggtgattggtacgagactggccttcatattttttttggagcttatcccaatgtacagaatttgtttgctgagcttggtattagtgatcgcttgcaatggaaggaacactccatgatatttgccatgccaaacaaaccaggagaatacagccgttttgatttcccagagactttgccggcgcccttaaatggagtgtgggccatactgaaaaacaatgaaatgcttacttggccggagaaggtgaagtttgctattgggcttctaccagcaatgcttggtggccaagcttacgttgaagctcaagatggcttaactgtttccgaatggatggaaaagcagggtgttcctgatcgagtcaacgacgaggtttttattgcaatgtccaaggcactgaatttcataaaccctgacgagttatccatgcagtgcattctgattgctctaaacagatttctccaggagaagcatggctcgaaaatggcattcttggatggtaatcctcctgaaaggctatgcatgcctattgttaaccacattcagtctttgggtggtgaggtccggctgaattctcgtattcagaaaattgaactgaaccctgacggaacagtgaagcactttgcacttactgatgggactcaaataactggagatgcatatgtttttgcagcaccagttgatatcttcaagcttcttg

SEQ ID NO: 20645 - DNA, 695 bp, Triticum aestivum
  Clone ID: PAT_TA_20645
cagcattagaactagcacatggtcacgctccattttcgaagtaccctccaatgaaggtgttgcttatgacgttgcaaaatgcaccaccaggtctagactacgagagggataaaagattttcgaagtcttttagggacttggttgctgtatgtttagtcaaggatccacagaagcgtccctcttcagaaaagctgttgaaacattcgttttttaagcaagcgcgatcagctgattttttggcaaagagtattcttgagggacttactccactgggcgaccgctttagggcgttgaaggcaaaagaggctgacttacttctcaataacaagcttggtccagagagcaaggagcagttatcacagaaagaatacataaggggcatcagtggctggaattttaatctggaggacttgaaaactgcagctgcccttttagacagttcaaatggcacataccattttgatggtgccaacaacaaagataggaatgggctacaagacgtttataatgaatcagaaaatatttatcaggaaagggttaaccatggtgcttctgcaaggcatgatgagcatgagatacaagaagtagaagatttggatggagatcttgcctcttcctttccaacccgtccccttgaggcactaaagtcttgctttgatgtcggcggtgatgatgatccggaccctactgctacg

SEQ ID NO: 20646 - DNA, 982 bp, Triticum aestivum
  Clone ID: PAT_TA_20646
agccgatccgcctcccggtgtcccggatcgcccggtgcgcggagcctgcgggggccgccaggcagggcggcgacggcgacggcgggggcggcagctcggagtcggtcaactcggtgctgcagaacggggagttcgacgacgaggacgacgactcccggtcgcggtcgcacggctcggcgcagagctcgccggggccggggagccgggacgggaggagggctcctgtggtgaccttcgggttcacgccggacagcaagtacggcgagagcggcgacgacatgtcggagcaaggccagcaacggcaacacccaggtttatataaatggaagggaaattacaaagagtgagctcaaaattctcaaggttgcacatgttcagtgtccacgtgatacacatttctgggtttatgacgatggtcgttatgaggaagaaggacagaacaacatcaaaggaaaaatatgggagtcagccttgacacgttttgcatgtgcgttgttctcacttccggtgcctcctggggactctaatggaaccaaggacgaaattccctttgtaccaagagcagtccctgattatttggatcagaaacgaatccagaaactgttgcttcttggaccacctagtgctggtacaagcactatatttaagcaggctaagtacctctatggaacaaggttcacccaagatgaacttgatgctatcaaattaatgatccaaagcaatatgttcaagtatcttggaattttgctagaaggtcgtgagcgtttcgaggaagaggctttgtctagattggatcaaacaatcccagaggatgaagcagcacaaaaagatgaaaataaagctaatggtcgagattcgtgtatatactcaataaatgcaaggctgaagaaattctccgattggcttttggatatcatcgcaatgggcgatctagatgcattcttccctgccgcaactcgtgaatatgctccatttgtcgatg

SEQ ID NO: 20647 - DNA, 829 bp, Triticum aestivum
  Clone ID: PAT_TA_20647
tatatccagatgaaccaagcacttggcccctcggcgagcacggtcttcccattggagagtgctggcacagtgtacccattgtgtgaccaagcagacctttaccagtccttcagttcgggtgctatggagaaccaatgctccatgggtctgttagacatggctctaccgcccgccccgcagtacccttttcaaaaacagcaacaggatttctgggaggcgagtgcccaaaatggcctgcatatggaccacgagcaaagccaggagaatgcgggttcggcgccgaatttcgatggttcgtatagtgaacaatgatggatcgttgcttgctgcacgccttggtaattcagcttggactaacaggtttgtgtggttcggcttacgcaggtcagttacaagcagcagatcatccagagattgagttctagacgatcacaggatcactgataatcaccaaggcccatatttttgtacataagaaaagtatggcgagtgaagctcctaagctaacggtcttttgacttccggactgagaactgatttgatcatccacatccgatgccgaatggtaccaagacggcggggatcggggacactagaatgaatcccagctgaactaccatcctctccttgattcttctcgtgttgatgagattatgtggtctcaaaaatagtaaatcatgtacttagatatggtgaaaatatttagaatcaccatcatctcccctaatgtgtaagaactcggcagatattgggacgatactactaccatgtacttctattttgcatttgtcgtggaaatggcaattatgaacatatatagtttgttcgc

SEQ ID NO: 20648 - DNA, 1369 bp, Triticum aestivum
  unsure (1)..(1369): unsure at all n locations
  Clone ID: PAT_TA_20648
cggcgtgggagtacgcgcgggcccaggtggcaggaggcggccacggggccacggcaggcgatgggtcggccggcggggagagagggcgcaagcaggccaagggcaagggctccaagtccaagcagccggcggcggacgagccgccccgggactacgtccacgtccgggccaggagaggccaggcaaccgacagccacagccttgctgagagggttagaagagagaagatcaccctcaagatgaagatgctccaggacctggtgccaggatgtaacaaggtgattggcaaagcgctcatgctcgatgagatcataaactatgttcaatcgctgcagcagcaagtcgagttcttgtccatgaagctctccaccgtgaacccgcaacttgacttcgacaccttgtcgaacctcctacacaaagatatgaaccaagcactcggcccctcggcgagcacggtcttccagctagtagagtgctggcacagtgtacccattgtgtgaccaagcagacctttaccagtccttcagttcgggtgctatggagaaccaatgctccatgggtctgttagacatggctctaccgcccgccccgcagtacccttttcaaaaacagcagcaagatttctgggaggcgggtgcccaaaatgggctgcatatggaccacgagcaaagccaggagaatgcgggttcggcaccgaatttcaacggtcagctacaagcagcggatcatccagagattgaattctagacgatcacaggatcactgataatcaccaaggcccatatttttgtacataagaaaagtatggcgagtgaagctcctaagctatcggtcttttgacttctggactgagaactgatttgatcatccgcatccgatgccgaatggtaccaagacggccgggatcggggtcagtagaaagaattctggctgaactaccatcctgcttgattcttctcgtgtcgatgagattatgtggtctcaaaaaatagtaaaccatgtacttagatatggtgaaaatatttagaatcaccatcatctctcctaatgtgtaagaactgggcagatattgggacgatactaccatgtacttctattttgcattttgtcgtggaaatggcaattatggacatatttatcctcagcatatatactaccaatgcatatatatgttttgtccctaatgtgcaagaactcggcagatattgggacgatactactaccatgtacttctattttgcatttgtcgtggaaatggcaattatggacatatatactaccattgcatatatatgttctgtccaaaaaaaaaaaaaaaaaaaactcgagggggggcccggtacccanttcgccctanagtggctcgtat

SEQ ID NO: 20649 - DNA, 1061 bp, Triticum aestivum
  unsure (1)..(1061): unsure at all n locations
  Clone ID: PAT_TA_20649
ngaagatagaagatagaggccattgccagagagacccagcaaccagcaaccagagaggccatagccaagttcttgcaagagaggaaagaaatcgaagaggcagagaaacagagggaggcagagatgggaagaacagcggccacggcacgctcgtcccgccgcgccacggcgacggcggcgcggaggaggaggccatcgtgcccaccgacttcaacctcatcacggacgtggacttccggcagctggtggaccgggtgccgccgggcgcgagcttcaccattgtgtccgactcgtgccacagcggcggcctcatcgaccaggagaaggagcagatcgggccctccgtcggctccggccccggcgcgccgtccgcgcgcaccgcccggttccttccctacggcgcgctcctggaccacctctccgccgtctcgggcatgccttcctcccaccacgtcgccgaccacctcgtggcgctcttcggcgccgacgccagcgccaagttccacgttcacggcggcggcggcaacggcagcgccctgtccaccacgcccgcaccggcgccaacgccgccgcgcccggacgagggcatcctgctgagcgggtgccagacgaacgagacctctgcggacgtgccggcgtacgaggccagcggaggcaaggcatgcggggcgttcagcagcgcggtgcagagtgtgctggcggcgcaccaggcgccgctgagcaaccgggagctcgtggcgaaggccagggcggtgctggaagagcaggggttcgagcagcacccgtgcctctactgcaccgacgccaacgccgaggcgccgttcctttcgcaggacaagaaggaggagacagcggtgggcgcggcaagcccggccatgtcgccggcgctgctgtagagcacgttcagctcacgagctatggagcgggcatgcgttcctcatgtgtcatgttttactgttcccgcgcacgtcggattggatgaggggccaaactcacgtgctatattgtttgtgtgtgggtcaagtgtataagtgtgtgtattatatatacacggatttgtt

SEQ ID NO: 20650 - DNA, 859 bp, Triticum aestivum
  Clone ID: PAT_TA_20650
cgacccacgcgtccgggccatagccagagagacccagcaaccggagcaagctccacaccggtcaagttcttgcaagagaggaaaaagaaatcgaagaggcagagatgggaagaaggagaagcccggctctgccgctgctgctgatctttggcgtcctcgccgtcgtcctcgcggctcttcctcccctcgccgaatccagcagcagccaccaccaccaccacggccatggccaccactcccgcgtccaaagcagagggcacggaggagagggagagcagtcgtcctcggctgcggcggcggcgaaggcgagggggagcgcgtggccgtgctgcgacagctgcggcgggtgcaccaagtcggacacgccgcagtgccggtgcatggacgcggcgcccggcgggtgccacccggcgtgccgggactgcgtcaagtcctccctcgccgtgcacccgcccgtgtaccagtgcatggaccgcgtccccaacttctgccagcggcgctgcagcgccatcgccgcccactgaccgtgaccggccggggcaaccgaccagctgaccaaccgcccaccccacctaccgccaccggcgacggacgaatcttgatggcatcacggccagagatgccagccagccggcccccttttgttgttgttaattaggcgcggcttgtcctgttgacttgactctgtaacacgtatggcttcttgtgtaaagtggagtataaacacgtatggcttcttgtgtaaagtggagtataaacaagctgggcttgggtttgtttgagcgactccgagtctcgtcctccgcaccttgtttatctctcgagacagagttgttggtaattataagttcattattgg

SEQ ID NO: 20651 - DNA, 1980 bp, Triticum aestivum
  Clone ID: PAT_TA_20651
ggtagcctgctggtctcttcatccatcgctgaggtgacgaagctacctacattggattggaacacgcaagaagatggagggggagacgagcaagaggctggccacgctggtgggctgcaactacgtgggcacgcgctacgagctccgcggctgcatcaacgacgtcgacgccgtgcgggccgccctcgtcgcccgcttcggcttcgcgccgggcgacgtcgccgtgctcaccgacggggacgggcgcggcgccgaggtgctcccgacgggggccaacatccgccgcgcgctcgcggacatggtcgcccgcgccgcccccggggacgtgctcttcttccactacagcggccacggcacgctcgtcccgccgcgccacggcgacggcggcgcggaggaggaggccatcgtgcccaccgacttcaacctcatcacggacgtggacttccggcagctggtggaccgggtgccgccgggcgcgagcttcaccattgtgtccgactggtgccacagcggcggcctcatcgaccaggagaaggagcagatcgggccctccgcgggctccgggcccggcgcgccgtccgcgcgcaccgcccggttccttccctacggggcgctcctgggaccaccgctccgccggccgggcagcacacagatagaagcacgcggccattgccagagagacccagcaaccagcaaccagagaggccatagccaagttcttgcaagagaggaaagaaatcgaagaggcagagaaacagagggaggcagagatgggaagaagaagaagcccggctctgccgctgctggtgatcttcggcatcctcgccgtcgtcctcgcggctcttcctcccctcgccgaatccagcagcagccaccaccaccaccaccaccaaggccacggccaccactcccgtgtccaaagcagagggcacggaggagagggagagcagtcgtcctcggcgcggcggcggcgaaggcgagggggagcgcgtggccgtgctgcgacagctgcggcgggtgcaccaagtcggacacgccgcagtgccggtgcatggacgcggcgcccggcgggtgccacccggcgtgccgggactgcgtcaagtcccccctcgccgtgcacccggccgtgtaccagtgcatggaccgcgtccccaacttctgccagcggcgctgcaacggcgccatcgccgcccactgaccgtgaccggccggggcaaccgaccagctgaccaaccgccccaccccacctaccgccaccggcgacggacgaatcttgatggcatcacggcccgagatgccagccagccactattttttgtttttgttaattaggcgcggcttgtcctgttgacttgactctgtaacacgtatggcttcttgtgtaaagtggagtataaaaacaagctggacttgggtttgtttgagcgactccgagtctcgtcctctgcatcatgtttatctctcgagacagagttgttggtaattatcaagttcggcaaggcatgcggggcgttcagcagcgcggtgcaaagcgtgctggcggcgcacccggcgccgctgagcaaccgggagctcgtggcgaaggccagggcggtgctggaagagcaggggttcgagcagcacccgtgcctttactgtaccgacgccaacgccgaggcaccgttcctttcgcaggacaagaaggaggagacagcggtgggcgcggcaagcccggccatgtcgccggcgctgctgtagagcacgttcagctcacgtgctatggagcgggcatgcgttcctcatgtgtcgtgttttactgttcctgcgcacgtcggattggatgaggggccaaactcacgtgctatgttgtttgtgtgtgggtcaagtgtataagtgtgtgtattatatatacacggatttgttatgactcacacgcaaaaaaaaaaaaaaattaggccgcccgtttaaaagattccttcaagggccccaggtttaggggtc

SEQ ID NO: 20652 - DNA, 563 bp, Triticum aestivum
  Clone ID: PAT_TA_20652
gggaacggcatcgtgctgaccaacgcactagccacggcgggggatctgctgtcgtcgccggtgtcgcgcgcggctgggaaggtgcaggaggccgtgcggatggtgacggacgagtatatgcggtcggcggtggactattttgaggcgacgcgcgcacggccgtcgctggcgtcgacgctgctcatcaccacgtggtcgcggctcgcgttcaacggcgccgacttcggctggggcgagccgaccatgtccgggccagtcacgctgccggagaaggaggtcatactcttcctcgcgcacggcaaggagaggaaaagcatcaacgtgctgctcggcctgccggcttccgccatggacgctttccaagagctcatggacgagatatgatcggcccagattgattggatgcgtcagcgacagcgcttatacactgttatcctgagtattttgtgtgtgttagtatggttacgttaatccctgtggtgcgctggtgagtctgcgcctgctgtttatcttacaacatggtctgtataatacttgaaaatataatttccaaaaaaaaaaaa

SEQ ID NO: 20653 - DNA, 736 bp, Triticum aestivum
  Clone ID: PAT_TA_20653
ctcctccgtctcgtctcgtctcgtcgcagtccatggccgacccgcaggccgaagcgcgaggcccaccggagccccgggcggaggccctggtggagctcgtgcgggtcaacggctctgcggcggaggccacgctctccagcgccgagctggcgtggcgcaccaccggcgccggccgcgacagcgggggaaggcggaagctggagctggagtccgacgtgctcgggttccaggtggagggcaggtccctcaaactcgcgacctttacgcggggggacgtgacgggcgcggggaggccgccgtctccggtgggctgcggcggaggagcagaggacaggaagagaggggaggtggcggtggagatggagagcgaggaggccgcggagaggtgggggcacgccatcagagatcgcttcgcctcgcttggtcgaccgaagagactgttcttcatagtgaacccttacggtgggaagagaggtgggcggaagattttccaaaccgaagttctgcctcttattgaagctgctcacatccattacaccatgcaagaaacaaattaccgtcttcatgctcaagaaattgctggttcactggatcttaagaaatatgatgggatcgtttgtgttagtggagatggtatccttgtagaggttggtaatggtctgctgcaaagagatgattgggacaaagcaataaaagtgccactagggatcattccagcaggtactggaaaccgaat

SEQ ID NO: 20654 - DNA, 1701 bp, Triticum aestivum
  Clone ID: PAT_TA_20654
tgggcagggccctcaaactcgtgacctttacctgggccgacccgccggccgcggcgcggcccccgccgccgccccgctccggcgcccgggcggagcccgggcggggcggcggcgcggcggcggaggccgcgcgcgccggcgccgcgctggcgtggcgccccgccgccgccggtcgccgcgccgctcggcggcgttacttgtccccgccaacgggccggctcggccccaccagcaaaggtggcactcggcaacttgccagcagctacaggcaaggcgtgcccgccgcgggtagcccgccgtctccggcggcccgtggcggaggcgaacgccatcggagcacccggcagggggcactgcagggcgagcgctctcaggcccgggccgcggcggcggcccggcatcagcagcctcgtcggctcgctcgacccccccgggcggctcctcgcaaccccacgcgtccgcccacgcgtccgggaagattttccaaactgaagttctgcctcttattgaagctgctggcatccattacaccatgcaagaaaccaattaccgtcttcatgctcaagaaattgctggttcactggatcttaggaaatatgatgggatcatttgtgttagtggagatggtatccttgtagaggttattaatggtctgctccaaagagctgattgggacaaagcaataaaagtgccactagggatcattccagcaggtactggaaatggaatggtgcaaggtctattgcattctgctggtgaacccttctcaatgtcaaatgctgtgtttgcaatcatcagaggtcacagacgtgccctcgatgtcacttctgttgtgcagggaaagacaaggtttttcagtgtcatgatgcttacatggggtttggtagctgatattgatattgagtcagaaaagtttaggtggatgggaagcgctcgcatcgacttctattcccttctacgtgcggtgaacttgcgacggtacaatgggcgtattctttttgttcctgccccaggatatgaaggatttggtgatcctgtggagcaaactatcagctgtaaatcaaatggggctgccaatgccgccgaaggagacataacagatgtttgcaataatgaaacatgtacctattcaggtccttcaactgacgatgctgatcttgaatggagatcactgaagggtccgtttgttaacgtttggatcagcaacattgcttttgctagtgaaggtgtcatgatagcaccacaagcacagtttgcagatggctacttggacgcagctataatcaaggattgcccatggtctgttgctctcggactcttgcttcggatgaaggatggtagctacatcgaatcgtcctacgtggagtacttcaaggtgaaggctctccggatcgagccgggcctgcgcgtcggcagcagcaccataggcggcatcatcgactccgatggagaggtcctcgcgagaggcgacaggtcccaaaccaaggaagagccggagcatctaatggcgtatggcccccctatccaactaacggtggatcaggggctggccaccatcttctccccaagatgatgaagtctttctcccttgtccccctgttctttacctctcacatggcatggttgggcctcagcacatgttgtatgtaaatactcacacagaaatgcaagaggcggtcgatgtttgtttgaatcctggat

SEQ ID NO: 20655 - DNA, 557 bp, Triticum aestivum
  Clone ID: PAT_TA_20655
ttacgacatgaacatggtgtgatgacccgtgtgcaacctcaacaagtgtgaaggtgctgctaagttagaggattgattagaaagttgagtcgttgcttttctacttcaaactgatggatttatcttcagccaaaaaaaagcaggcttggttagcttcaagaagaaaatatttcaaaaccgtgtacctattgaaatggcatggaagacagagatggtagcagcctgcatcctcaaattggagttgcctcttggggagtatcaggttgctgaaatgatgaccagggtggatgcccatagttacagaaatatctacctgggaggaggcgccgaaattgtaagtgcatgcttacagagttctatcatgcacaatcatgtatgcacaccgatctatccaaaagattagctcgcgaccctctccgcccgcaccgccggctccccgggaggccgcatccggcctgccacaagtacacctatgtcgccgcctccccgggggccacaattggaagtgggatgaccaaggagaaggcacgcggcgggggccaggcgatcaagtggga

SEQ ID NO: 20656 - DNA, 693 bp, Triticum aestivum
  Clone ID: PAT_TA_20656
gcacgaggcaacgtgctcctcagcgacgacctggagccccggatctccgacttcgggcacctcagcggcggcgacggcgacgacaacgcgacgccggaagcggacgtgtacgggttcggcgcgctggtgctggagctgatgacggggcaggcgaggtgggacgaggcgtcggtgagctgggcgcgcgggctcgtccgcgacggcaaggggctggacatcgtggacccgcgggtgcacggcggcgaggcggcggagcgggagatggtggagtgcctgcgcgtggggtacctgtgcacggcgcactcgccggacaagcggccgacgatgcagcaggtggtgggcgtgctcaaggacatccggcctcgcccgctcgacggcggcggcgacgcgtgatcatgccatgcatgcactgccagtgcgccgcgtgtgaactgcgcgcgtgcgtgcgtggcttgaactgccagccaccagcacatgcccccgctcgagtgcaccagcaccatagtacacgtcacggcctttccttttttctactgtatgtatgatcggcaggcctcgtacgatgtgcagtagcggtggcgatgccgtccctgggatctcttgatttcagaccatttctctcgtgttgctgcgcccgtacaccataaatgtgttcccgccatttaattgcaaaagcttacaccaagaaaaaaa

SEQ ID NO: 20657 - DNA, 780 bp, Triticum aestivum
  Clone ID: PAT_TA_20657
aagatatcggattttggaattgcgaagctgttcagcagcagcggagacaacagtcaggactccaccatcacagaaaggattgttgggacatatggttacatgtcaccggagtatgccatggacggcatggtatcattcatgcaggatgtgtacagcttcggtgtgctgttgctggagatcgtcagtggcaggaggaaccaacgaagtttcaacctcatagctcatgcatggaatctgtatgaagaaaacaggagcctcgagctccttgacccagctgtgcgtggcggctgttccccaagcagagctagagcatgttaagacgtggatccaggtagggctactgtgcgttcaaggagagcccaagccaacggccgcaaatggctgcagtaatccccatgttgtcgcaccaacaggcgccagggcggccacttcggccggttgtctgcatgccggcgagaactcccgtggaccttctcaacatggaggagaacacatctagcaatgagttgaccatcacgaacctcgaaggccggtagcaactagcaagaatgcatggatggaaggatgccgggcaagctggaacctaagattgaagacctcgccgccgtcgtgttgtgggtgacggggttcgacgggtgcattcaagccatctcatgcttctgcaaaagtgtgacctcttaattaacacacctctgtaaaaaaacacctatgtaattcatggagactgagaacaaattcaagatttgaaaaaaattcaaatgaactgcaaaaaaaaaaaaa

SEQ ID NO: 20658 - DNA, 340 bp, Triticum aestivum
  Clone ID: PAT_TA_20658
cgccgacaacccagagcagaagtacatacacatggccaccgtggacgggttcgagttctggttcatgggcttcgtgagctaccagaggtgctgcaagtacatgcagcaggtcatctcgtcccagttgtgatggcaatagctaaaagtgaacgtcttgtgggcttcctgccgcaacgtcttgttggagcgcgcgcagccgagaacctctgctccaccatttttttgatgagagcatgttccgattgggaatttacagatgtgcctattgcaatttctgtttgtaggaccgaggaacttggtctgaatgaaaattatttattttccgggggtaaaaaaaaat

SEQ ID NO: 20659 - DNA, 626 bp, Triticum aestivum
  unsure (1)..(626): unsure at all n locations
  Clone ID: PAT_TA_20659
cccggcccctgctctaccgggggatgccaggacagccctgggggctacctccccccctgctgctctggtgggataggcgagggcaggccgggagcctgcgcccctccatgccccctgcctgcgcagcgcgctggggagacgggaacgtggccaccgttcttccccctgcctgctcggcctgctgtgggggcggcaggtgccattcttctcttctcaatcgggcagccctcgctcttcttccgcatagcgacttgatggggcgggtggtccccctgaagtttgctgggccctcccttggcgatgcagatgccgttatactgttcccttttggggggggctgatcctagtttggacaattccactggatccgccacgctgctcccgtgtcctcacaacggcgtccgccccttttgtgaccggcatttaacccccgtgccggggtaggttttccccaaggacacccgcgggtgccccacacccactcctccccgctcgactgggtgccccctgatgtgctctcaattacacccgtccccgtctgctccccaggtanctcagggatctcaagcaaattnacngtcnacttgtcntcaatatgngcaacacaatgccactaatcnnaacan

SEQ ID NO: 20660 - DNA, 566 bp, Triticum aestivum
  unsure (1)..(566): unsure at all n locations
  Clone ID: PAT_TA_20660
aatntataaccaagcaggcagttgagacttattattatacataccggagccacacgttttcttattattctacacgaggaatatgtctaccattccaacaantggacacaattgtgaatgttgacttcatcccgccacagcattagctctggacggaacaggagtccgcgctgcgctcaagggccaggaagagggcatatgtggaggaactggagaaggaggttcggcgcctggtggatgacaacctcaagctgaagaagcagtgcaggcagctgaagcgggaagtggccgccctcatcctgcctaccaagagctctctccggcgaacctcatccactcagttctgaaaggggatcagacggcccaagacgctgagcacaggcgtattttggcagtacaaatttaggagaaaattaatcaaacctgtgcacatttcgtctacagttcatatgtatacctatgtacaagatcgatctaaacctatatatgcgttggatcttttctgcatttgtctctaagaaagaaaagaaacggagtttcgttggtggagaattaaaaaaaaaaaa

SEQ ID NO: 20661 - DNA, 331 bp, Triticum aestivum
  Clone ID: PAT_TA_20661
gcaccttcgggtgtccggcctcgctgggatcttggttgagcagtttgccaagtgctgccgtctggcgtccttgtgtcgttgggtgctgtgtctgccctgcggcgctcccgcccctgctccgaccgtgggtcgtcgtgaactgtaccggtcctgccgccttcgccctcggccccccccaacgccgtttgcgtgcctctctgttgcttggtatcttggctgcctttaacttcttagctgctgatgtgttcctgtttgtagtcctgtatctgatcgttctgctcagttctcttattcgggagagtcctcgtcaaggtgctgccagtttttctaa

SEQ ID NO: 20662 - DNA, 1189 bp, Triticum aestivum
  Clone ID: PAT_TA_20662
aatatgtgggcaggagttgtacaggctgggggcacggaggctaggactgctggacgcgctgcccatcgatccctcgggtggctgcagaagttcctttggacatgatggcacgtgggaccccactgccaactctctggcccggcggttcaatgccctactcccggcttggaaatggcccagcgccacggcagctccgatgccaaggcatgggagtactccatcggccagcatctacggaatctcctcctgacatcatcaccaccccgggagctggcaccacggggcgtcgacctgccgcgcgcgatccccggcggacggaccgggaggttcaccaacggctacaacctggccgacatcatcgcacaacgcgtggggtttgacatgagcccgttagcttacctctccttgacgccgcaagcgagcctcgacctcctgagcggccgcgttggggccaattatgcttccggtggatcaggaatccttgacgacactgggaacggcacgatcacgctccgagaacagattaagagggttgcagacaccgaggcagccaggaacggggacagcgagctggggagaaagagggtgagaggcttgttgtcccagtccctattcctcatcagcactgcaggcaacgacttcttggcgtttggcgacggtagggcaaccagaagtgatgcatcagcctacatcgccaaaatggtcaccacctacctcaagcacatcaaggagttgtacaggctgggggcacggaggctaggactgctggacgcgctacccatcggatgcttgccgggctgcagaacttcctttggacacgatggcgcgtgtgacgccgttgccaactctctggcacggcggttcaacgccctactccggcttgaaatggccagcgccacggcagcttcgatgccatgcatggagtactccatcgccagcatctacggcatcttctccgacatgatcaccaacctggagctggacaacggactgcaggaggcgactagcgcgtgctgcggaggagggaggctcaacgcggagatcgactgctcggcgagctcgaacctttgcaccgaccgcgacggctacgtgttctgggacaaggtccacgggacgcaggccgcctaccagcgagccgttgccgccatgttcgaccgcgcgggggtgacaaagttcacggagcccgtca

SEQ ID NO: 20663 - DNA, 681 bp, Triticum aestivum
  unsure (1)..(681): unsure at all n locations
  Clone ID: PAT_TA_20663
gatgatatgaaggtgtgctccatagctttctgtccagttatatagcatcccatgtgtgttctgtaattattttacatttcttttcatgattggttgtcaacagtttgaataacactaccctaataatctggataaatgatagatggaataagtacatgtgtagttagatctaactacgtatgttatatctatattacctaaacatttccaccattttaaattaagagcttggaatttcaaagagaacacctcatgttcaaaccactttcatttcccttccttcttaaggtccttaactaatggtccgctccgatggtgctaattgggctaacgtggttaatgttattaatgaatattactggtattaaggaaggcccattcaccattatttttagggaaatttaaccatgtagttttggggcatgtattttaaatcctaactgcatgggaaggggacttttatcctttgggctgcttacaaaacaacacatgggctgtacatggacggcataaccaagatgatttaggatttctctgggaacttcgttaatgggaaatgtgctgaanggtcaaatatatacccaacnatcaagatgcaatgaanctcttgattcctgaagaaatctgccantcacgcttaagtctaggcnataaattcgngncaactaanatanctganag

SEQ ID NO: 20664 - DNA, 1272 bp, Triticum aestivum
  Clone ID: PAT_TA_20664
ctccttcctccgccccccgtcctatcctcggcgggcgtgctgctctaatggcggatccgccggcgtcgtccccggccgacgaggcgcgggatccaggtatctcagaagctgctcatggtactagtacgacgcaatgacacgaaagagcaggaggacatgaaaggagaagcggctgttgcgacctctgaaccggtgagggaggaactggtccaggagtgccgttagttttctgagtcaccccaaagtcgtggcatcttccgatgtccaggaggcgttccttcctggaaaataaagggctcaccatggacgaaatcgaagaagcgtttcggcgtttgcttcttagcccgccttcaaactctgcaagttcagatgcttgcaaacctccaaggggctcctgaaccctgaaactgtgacccctgtggccgccccggcacccaaaaatcatatatggaggtcatggaaatgatacagaggggcagagcggcctattcatatcccggatattaatgatgagccaccaaaccctgatcagccaatctcgaaacccagtatggcacccaagcccaagccatgggagaagcaaggccaacaaagttccggttgggacctgaaggttcactcaagcgacccaagcgaatcgtcgtcaggagttcgaaccgatagcaccagccaggccacgggatcaaacaacagctccggtcacggggacttgatgctgacggcagagccagctacaggatctgaagcccccgtggatgacgttgccgcctcgccgaagcagtaactctggaaatgcatagacgaacggcggtgggatcaggacatgatgtgaatcagcgtcggcctgatgctgcttcagattccagcaccacattgttgcatcttccgttattatcagaaactagcttagtttagggggtcagcagcattcttgggaagctgggattggattcttgctggaaatgagcacctacattatgtacttatcattggcattcttcacttgttgacacatccctactgctggggtgtgccttgcatgtaatgttaatccaagaaagcacacccggttagtgtggtcatgggatggtgggcaaaatggtcattcctgcctgaagatttttatagaaagcaaaggttagaaaacggaagaggcaaaatactaatcccttcgtttctaagtattcctagaagagaacgcctgtataattattttgaatataaaaaggctggacccggctttgcatcattgtgacccccaaaaaaaaaaaa

SEQ ID NO: 20665 - DNA, 612 bp, Triticum aestivum
  unsure (1)..(612): unsure at all n locations
  Clone ID: PAT_TA_20665
agcaaatgtactgctcgatgacttctgtgaagcaattgttggagattttgggcttgccaagctcctggatcaccgtgactcgcatgtcaccacagctgtgaggggaactgtaggccacattgccccagagtacctctccacgggccagtcatctgagaaaactgatgtcttcggcttcgggatcctgctgctagaactgatcaccgggcagactgcacttgagtttggaaagtcatcaaatcaagaagggagccatgcttgactgggtgaagaaagatgcaccaaggagaagaagctccaacgtgcttgtcgacaaagggactccggaagcagttacgaccacattgggctagaggagatggtgcaaggtggcgctgctgtgcacccagtatccccccggtcnacaggcctaagatgtcggaggtggtcaggatgccccaaggggacgggcccgcagcccgggggggcgccccgcggcggaccccctcgctcaagggcccggtgcccgtcggcaccggtggccctccctactccgccccctcagacgattcgtcattgctggtgcaagcagttgagctctccggaccaagagtcgacgcggccgcgaattcg

SEQ ID NO: 20666 - DNA, 637 bp, Triticum aestivum
  unsure (1)..(637): unsure at all n locations
  Clone ID: PAT_TA_20666
cttcaatcctccacccacccccccccccgccccacccccccggctgcccccggcgcgcccgcggccgcggcggcgccggccgcggccccgccggcggaggaggagcccgcggcggagaaggccgagaagaccccggccgcgaagaagcccaaggccgagaagcggccgccggcggccaaggcgtcggcggcggccaaggagggcggcaaggcgaagaagaaggccaagaagagcgtggagacgtacaagatctacatcttcaaggtgctgaagcaggtgcacccccgacatccgcatctcctccaaagccatgtccatcatgaatccttcatcaacgactcttcgagaactcgccggcgaggccgccaactggcaagtacaacaagaacccaccatcactcccgggagnttcaagactccgttcgcctcgtctccccggcgaactcgccaaacacgccgtctccgaaggcacaaggtatcacaaatcaactctcctgagcccctgtctcggtcgccctgttgtggcgttctcctggtgttccgtcctatgtgcccgtccaaatgttacgtccgcttcggcaaatataagggaaaatnttcaggtatgnggaanataagggtncttaaaaaaaaaaaa

SEQ ID NO: 20667 - DNA, 463 bp, Triticum aestivum
  unsure (1)..(463): unsure at all n locations
  Clone ID: PAT_TA_20667
actacgacgggttgagcgccgccggtggcgactggccgagcggctcgcacatggacggagccgacgacgactgcaacggcagcggtggctacggcgccggcgaggtcgcgctctggagctactgatcgagctgctcgattgagccattctccagcccggtcagctttctccgatggggctgccgtacaacatcactcagcgtaggataaagaagaagcagagagggaacgggagcttcagttctgaagtagtactaagtactagttctgtgttccgtaaagcagagagggcacgggaatgcaagttgcatcaacctgtttccctcccttaattttttttcattttttgataatttttggttggcaagattttttgtaacatgtgctggagtagttagagtaataagagacaactccgctttactaatatatatctgaagtaattttgccnagntttccaaaan

SEQ ID NO: 20668 - DNA, 451 bp, Triticum aestivum
  unsure (1)..(451): unsure at all n locations
  Clone ID: PAT_TA_20668
gcctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactgggcccgcgctcttccgccaagtcctgggagaaagaggagcgtcgatgacctcacctttccgtcggttctggtggaggttggtgctcccagctgctgctgctgctgccccggctgctgggggtgccctcccgcgcagaagaagaaggggaagaaaagaagaanaggcaaggaagaagnatnatacatggtttancttggttcacnaacnttcattcaagtctcccgnggtctccnatcgaaaatttctaagtcttttag

SEQ ID NO: 20669 - DNA, 923 bp, Triticum aestivum
  unsure (1)..(923): unsure at all n locations
  Clone ID: PAT_TA_20669
cgactgtccatgcaaattcggaatgaaaggcgacggcaaaacaggaacctgcacacctgtattcactccagcagcaaaggcgacagtgggtgcaatagcgggtgttcttcttctggtgattatatcgtttcttgttattcttcgcaaggagaaaaagaaggcgaaagaattttacaggaagaacggtggccctacattaagagaaggcaaatgtgattaaacttttcagaaaggatgagctcaagccaattttgaagaagagcaacttaattggaaaaggttgctttggtgaagtttacaagggcattcttgacaataaactagttgcagtaaagaagccgattaatggttctgtgctagagagtgaccaatttgcaaatgaagtcatcatccaatctcaggtcatccacaagaacattgttagacccattggttgttgccttgaagtcgatgcccccatgcttgtctatgagtttatctcgcaaggtagcctccatgacatccttcaacaatagcaataacaaggtggctttcaacttggtgcacgtctaagtattgctacacattcagcccgatggcccaacttatatgcactccaaaaacaaattatacaattctacacggtgatgtcaaacaactaatatacttttgggtgatacctcatacccaagattcaaacttcngnataccaagccaatgcaagtggacaagggaacacatgcacaaccaggggcgacagaatanatggtccgggtaccacaagaaggctatcacgaaaaatgattcnaaatttggataagatctggactaatacagganagnaaccatcgatatataacggnaagattctnaancaatgaataanaacacgatttcncaggaatgatacaagttggatcttaagtaaanagngtgagctncct

SEQ ID NO: 20670 - DNA, 2549 bp, Triticum aestivum
  unsure (1)..(2549): unsure at all n locations
  Clone ID: PAT_TA_20670
aaaaaaagggttgcccctatttttggacggggaaggaaccggttgggttcaaaatcctgaaaattttaaaaaaccccccccggtttttaaaaaaaaaaagtttccccaaaaagaaaattttggcggggaaacccccggaaaaccatttttgaacaaaaaattttttttttaaaagggattgtttttttttttgttccaaaaaaaaaaaaagggggaccccccccctctanaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcgccgcctccgcgccgccgtccaaggaggccggccggcgggccaagggcaagtggtcgtgcgtggacagctgctgctggctcgtgggctgcgtctgctcctcctggtggctgctgctcttcctctacaacgccatgccggcctccttcccgcagtacgtcacggaggccatcacgggcccgctcccggacccgcccggggtcaagctgcagaaggaggggctgcacgccaagcaccccgtcatcttcgtgccggggatcgtcaccggagggctcgagctctgggagggccaccactgcgccgaggggctcttccggaagcgcctctggggcggcacattcggcgacgtgtacaagaggcctttatgctggattgaacatagggcccgggacaacgaaactggattagataaaccaggaataagagttaggccggtcacaggccttgtcgcagctgactattttgtccctggctattttgtttgggcagtcctgattgccaatttagctcggattggatatgaagaaaagaacatgtacatggctgcttatgattggaggttatcattccagaacactgagacccgtgatcaaacattgagcagaataaagagtaacattgagctcttggtagcgactaatggtggaaatagggcggtggtgatcccacattccatgggagttctctattttcttcattttatgaagtgggtagaagcaccttctcccatgggtggtggtggtggtcctgattggtgtgcaaagcacatcaaagctgtagcaaacattggtgggcctttcttaggagttccaaaggctgttgctgggcttttctcatctgaagccaaagatgttgctgtggctagagctattgcaccagaaatgctggactctgattttcttggacttcagaccttgcgccacttgatgcgaatgacccgtacatgggattcaacaatgtcaatgctccctaaaggtggtgagactatttggggaggtttggattggtctccagaagatggttttgagtgtaaatccaagaagcggaagaccaatgattcagaggtttctaaggatgttcatggggaacctgtcgaagttaatccagagcctgtgaactttggaagaatggtatcttttggaaaagatgtagcggaagctccggcttcaaatattgagcagatagaattccgtgatgctgtcaaaggtaataatcttgcccattcgaatacatcatgccgggatgtctggacagagtatcaggaattagggtggggtggaataaaggcagtttcagactacaaagctttcaccgcaggctctatcatagatctttttaactttgttgctccaaggatgatgcagcgtggtagtgttcatttttcatatggaattgctgataacttggatgatccaaaatatggccactacaagtattggtcaaaccccttggagacaaaactaccaaatgcgcctaaaatggaaatattttcgatgtatggagtaggcattcctaccgaaagagcatatgtctataaattatccccacaggcagagtgctatataccctttcagatagacgcctcagctgagggtggggatgagaatagctgcttgaaaggtggtgtttacatgtcgaacggtgacgagactgttccagttcttagtgcagggtatatgtgtgccaaagcatggcgtggaaaaactcgcttcaacccttctggcagcaagacttacgtgagagagtacagtcactctccgccttcaaatctcctggaaggcaggggcacacagagtggtgcacacgttgatattatggggaactttgctttaatggaggatattatcaggattgctgctggggcaaccggtgaggaaattggtggtgatcaggtgtattctgatatattcaaatggtccgagaagataaagctgaaattgtagttagtaggaaatcacgtgattcgtggtgacgaagcagattttactctggtcgaatcctattaattttgatttgataatgtaatggtttttgctctgacactggcgttattgtgaaaccgcggtgtatattaaaatgtatagatgcaaggtgtgatacttttgtaggttcctttgttatgatgataaatattgtgcaattcatttgcatcttcatcacttgtaacattcatttgttatacttccgtagtttcctttatgatgatgagaaatattttgcaattcattt

SEQ ID NO: 20671 - DNA, 520 bp, Triticum aestivum
  unsure (1)..(520): unsure at all n locations
  Clone ID: PAT_TA_20671
ctcgatcgaccagcacttccacgggcttttgtcagctagccatggcttccacgcgcgcggttgcgatcgtcttctcgctcctgatcttggcggcggccgcgccctcgcctctcgtgcgagccagaatggtgccggcggatggcgaaggagtaccacccgccggacggatcgcggcgccggaggttaccggctccggtccggaacagcgtcctctctgcaaagaagcgctccttcaagaggcccccgcttgccgctgcccgctgctgacgtcgccgcccgacgatgaccgtctacgcgcagcgcagcattagatgctccggatctggtgcccgaccccggcgcttggacactagctgtgttctcaagtcctttcctgcgtatatacnactgnatttaagttcaagatcccgtgagagcttgatttccacatnctaactacgtgtgttgacttnttaacctcagggtcggtccttgtccggataanaggttaattaaccaatattaatttaaaaaaaaaaaa

SEQ ID NO: 20672 - DNA, 603 bp, Triticum aestivum
  unsure (1)..(603): unsure at all n locations
  Clone ID: PAT_TA_20672
tttttttttttggtaagatactgatgtggaaaattaatactcctgttgcttcggttcacagcgagtatacacatcagttgacaacatctgaatagtcaagcgtgtagtattggacatacatgcgtacaagttagctatattgctcggcataaccgacgaaatactacaagaaatactgatacgccataaaatgaaataaattggtgccacctcatactcaagtacaaattccgcattccgtatagataatactgggaagagcacatcatgcatgaccatttctctatgaggagcggtccgtagncaccttttacaacagcggctggtcatgttgataccagatgcttgtacgcctgatgcacgttcgccagtctcgccgcctctgtcaaacccttggggagcaccatcttcaggatntcaggaccccttttatgggcggcgtccgttccgctcctcttcctgtcctcggggagcttcagttcggacccatctgtcgggcggctccacccatccttaaccgcaacntcgtcttgcgaaatgggatacacatctcaaccatgggactcanaccccttagtgtaacaagaaccacatgnagtcggg

SEQ ID NO: 20673 - DNA, 1898 bp, Triticum aestivum
  Clone ID: PAT_TA_20673
ttcaaattcagaatataccacctcaaactacgcagaaattccccacgcgtccgccccgtccggcccgaacgcccaacacccaccactgccggcgatgagcaccaccgagggaaagccggacgccgctgcggtggaggagatggcgcgggaggcggcggcgtggtgcgcgatgcacgggctcgtcgtcggggaccgcgcggacccgagatcaggaacagttcctggggttgggttggtccacgctccaatctccctgctcccgtcgcgtctcccggagtccttctggagccaggcgtgcgagctggccccgcttttcaacgagctcgtggatcgtgttagcttggatggggatttcttgcaggattccttgtccaaaacaaggcaggttgatgatttcacttctaggctcttagatattcacaggaagatgatggatgcaaacaaggaggagaatattcgactggggctgcaccgatcagattatatgctggattcagaaaccaattctcttctccaaatagagctcaacactatttcagtatcttttcctgggctttgttctatagtgactgagcttcacaggaccttgatcaatcagtatggaaatttattatgtctagatgccaaaagggttcctggaaatgatgcaagccgtcaatttgctaaagcattggccaaagcatgggatgagtttaatgttgacagtgctgtagttatgatgattgtgcagcccgaagaaagaaatatgtatgaccaatactggcttgtcaaatatttgagggaatcacatggcgtaacaactattaggaaaaccttgtcagaggtggaggctgaaggccaggttctccctgatggaactcttgttgtaaatgacaggaaggtcgctgtggtgtattttagagctggctatacaccaaacgattatccttcagaagcagaatggagtgcaaggcttttgatggaacaatcatctgctgtgaagtgtccttcaatatcatatcatttagtggggaccaagaagattcaacaagaactagcaaaacctaatgtgcttgaaaggtttcttgaaaataaggaggaaattgccaagctccgccaatgctttgcagggctatggagcttggatgatgaagaggttgtcaaatctgcgattgaaaaccctgacttgtttgtcttgaagcctcaacgtgaaaggcggagggaacaacatatacggtcttgatgtgcgagaggctctgatcagactcaagaaggaaggaggagatgctctctcagcctacatactgatgcaaagaatctttcccaaagcatctctcgctagtctggtccgtggtggtgtttgccatgaggccctcacagtatctgagcttgggatatatggagcctacctgcggaacaaagataaggtgatcatcaatgataagtgtggttacttgatgcgaacaaaagtttcttcttcggatgaaggcggtgttgctgcaggatttgctgttttggacagcttatacctgaccgacaagtgacataacctcaggaataccagctacaaatccgaaccagcattgacctaccatggatttagcattctgttgcatcggtcgcaacaaatgagatgaacaaagttgctgcacaatttgcagacgtcagccattagcatacagcacactgtgtgaagaataaatgtcatgtatagatgacatgtttatgtatggaaaaataatccccgtgaaaaaacggattacaaattcttgtttcgtggatcactacacccttgactcggggccaggcagttgtgttatgcactgttaatgtgaattttcagcgttgccatttctgttggtcaatcatatacgaagaagttaaaaattctgtgaaaaaaaaaaaactaaaggccccta

SEQ ID NO: 20674 - DNA, 588 bp, Triticum aestivum
  unsure (1)..(588): unsure at all n locations
  Clone ID: PAT_TA_20674
ctcgtgccgctggccctttccgccccgctcgtccccctggtctgttcggtcaggttgcccggaacagaggcgagtgagagagatcgccatggcgatttggagctgcccctcgcctgattggttttgttaaaagcctaatctgtcgattttgttcgtctgatttggcacggcctatcccgtctgtgcctcatccgctcacctgcgtcggcccccggggccccccggtcgcctccgctggttgtgttaggcgctcgcgtccgccccagtagttgtgcgtggttgcggcgtttcagggattgaagcgcggctgccggccgaatttgggtaccctcctggcttggtgtttaggctctgtattttccctgcacatcccgcctttaactccgtcccgtctcatttgtcctcctggccgctccccactctcctgccacctccgcccttcccacatccagccgctgttcgtgaggtccccatcgatggccctacacgcggcagtcagacatgggtgcacanggtgaacctcgatagtgtggtgggctgacggngtgccacgtgacaaggtgtgtgtgctcgtatataactgggaaa

SEQ ID NO: 20675 - DNA, 472 bp, Triticum aestivum
  Clone ID: PAT_TA_20675
gtaccgggccccccccgaaacttttgatccagaatttcagtacttggcaagagaaaataaatgctgctgcccccaaggacctaaagtattcttgaacagcctgaaaaatcataacttgggacgtagctcttggtacaattattcaaaagaaaatggatgactatatggtgtgtggaaagtgtactgcaatgatgatgttcatgttcagattcatgatgatgatggatgctttcagttttagttaagttgtagggatggcgcctattggatgttgttcctcgttgatttttaagttaagttgtagagaagttgattgatgctttcaatgtaagttttgttgtcaagaaaatagtcaagattatgcatcacatttggatgatgttcctcctgtaatatccactattgtaatccaacagttctatccaatatatgatttcctcctctacgagtaaaaaaaaaaaaaaaaaaaaaa

SEQ ID NO: 20676 - DNA, 1465 bp, Triticum aestivum
  Clone ID: PAT_TA_20676
cgcctcctccgccgcggccgcgcgccggcggccccccccgcccggccccgccccggccaccccggccccccctgctgggagagtactggccaaaagtggactctccttgactgatcctctcccaagaaatgatgctgtaacaactaccgttggtgaagctctcatggcaccaactgtcatctatgtcaagcaggtacttgacattatcggcaagccgggcgcgtccgccccagcccctagctcgcccccgggcttggcggcttcggccccctctgcccccacggggaggagtaccttgtggctggtactgatggagttgggacgaagctcaagctcgcgtttgagaccggtattcatgataccatcgggattgacctggctgcgatcggtctccatggccgtgcggcttcggccgcgtagccagcgtgcttcctggacggccatgctccgtgcgagctcgtcatgtccggcttaccagcatcggcagaggtgatccagggcgagggggttcagtacgtctgagagcctacacaagcatctcaaacttctaatggttgagaattgtttagctgatgatgggcaaagctgcccaggtttttccgtaaccccgcaatctatcttacggggacaagtatcggagtaaaagtagtttactccagtgagatttgacaaaaaacgggaataatgttcctgggttcgtggccactcgctgcaaacagctgtctctgctatcctgaacgtcacttcacagttgatgtgattgcctctgctctgctgaattatcttgagaaatcacatatataagttacatcttctggccaaaaaaaaaaaaaaaaaatcaagcaggtacttgacattatcagcaagggtggtgtaaaagggctagcccatattactggtggtggctttactgataatatcccaagagtatttcctaaaggacttggggcgaaaattgtcaccgggtcatggcaagtgctgcctgtgttcgagtggcttcaacaggtcggcaaaattgaagacgcagagatgctgcgaacgttcaacatgggcgtcgggatggtccttgtagtaagcaaagacgcagcggacagaatcctcgaagagtcgagccctgcttaccgcatcggagaggtgatccagggcgagggggttcagtacgtctgagagcctacacaagcgtctcaaaacttctaatgggtgagaactgcttagctgatgggcaacgctgcccaggttttttcgtaaccccgtgatctatcttacggggccaagtacgtcgggagtaaaagtagtttactccagtgagatttgacaaaaaaaaggaataacgtttctgggttggcgacaactcgctgcaaacagcttgtgttgctatcctgaacatcacttcacgattgatgtgaatgcctctagtgtgctgaattttcttgagaaatcatatctataaattaaaaaaaaaaaa

SEQ ID NO: 20677 - DNA, 424 bp, Triticum aestivum
  Clone ID: PAT_TA_20677
ccgcccgcctcctccgcaggtcggccgtggcggggctggagacgctgctgcccctgcacaccgcggtcgcgtcggcgcgcctcaagtcctgcatcgccgtcgactccacctgctggtgctccctctcccaaggttttaaaaagcgcatctgatcatggttaggagctgcacagctgagaagtgaagccaccgagttaaaaacaaagtgcatttgtttgctgatagtgcttagaacttgtatcccagctattttggccattgctctcgatgaatgtactcttaacaaaataatggagcgttgcccccttgtctccgggaccttgattttttgttgagcctggaatgaccttggattgctattggatatcacattattgcttcattatgagcttgaaatcatcctgtattttctaaaaaaaaaaaa

SEQ ID NO: 20678 - DNA, 1497 bp, Triticum aestivum
  Clone ID: PAT_TA_20678
cccacgcgtcagcaagtcccagtcgtcgagctacatgtaccacagcactccacgtcgtccgcctcctctccacacaccacgtcgcgcccgcctccggctcccactcccctcatgcgcccctccgcggcggccccggccgccttcctagcccccgccgtcacggcctccagccgcctggttccgctccggcgggcgaggcgcttcgctgtacgctgcgtcgccgcccctcccgcccccaagcctgcgtactcgccctccaagactggaaattggcagtggacatttgaggataaaccagtaagcgtttactatgaggaacatgagcaggggactgctgagaatgtgaagaacatccttatgatccctacgatttctgatgttagcacagtggaggaatggagggtggtcgccaaagatattgtgacacggaaaggagaactcagctaccgtgctactattgttgattggcctggtctgggttattcagacaggccatctctgaactataatgctgatgtgatggagaattttctggttcaactactgaactcaccaaatagtcctgtggcggatgcagatggtgaactggtagttgttggaggtggtcatgcagcaaccatagctatccgtgcagctgggaagggccttatcagaccatctgcggttgctgctgttgcacctacttgggctggaccccttcccattgtatttggccgaggttctgatatggaaacaaggtacgggcttctacgaggaaccctcagggcccccgccatcggctggatgatgtacaatgttctggtgagcaacgaaaagtccatccagtcccaggccaagtcccgtgtgtatcccaaccctgggattgtcccaccggaaatcgtcgagagccgctacgaattgacaaaaagaaaaggcgcgcgatacgtccctgccgcgttcctgacgggccttctcgaccctgtccagtcgagggaagagttcctggagctgtttgccaagttggatggagatgtctccgtcttagtggtgtcgacgctgaattcccccaagaggtccaaggccgagatggaggctctcaagggcgccaagggcgtgaccaaattccgtggaggtcccgggcgcgcttctgccgcaggaagagtaccccttggcagtcgcagaggagctctacgacttcctgcagggatcactctcgtcaggaagatgagccgcatgtcagcatgtgtgaggaaactacactggggtgaccctgactgagttcatcgactcgtatcgccttttgccggtaaatccatcgacgcgccatgttgttgcacctgaactttttagaagcagtaaagcagcaccatcagctcctgggtgccaccacacataccggacggagcctgcttctgacggagctgacgtccatacatacagcttcaatttgtgtaaaaaagcacactgccctgatcaataattgcagttcgtcacagttaagcccaaaaaaaaaaaaaa

SEQ ID NO: 20679 - DNA, 600 bp, Triticum aestivum
  Clone ID: PAT_TA_20679
atcttcaaaaggctgagctcgaggtggatttacttggcgatgaggttgaggccttaacggatcttcttgcaaaaatttatattgcgctcgaccactattctccagttttgcaacactattctggggttatggagaccttgaacatgatcaggaaacacataagcacaacaaagtgaaatgcctatgcacattcacatcagctggtgtgatgctaacagcaaccttggttttattggcctgaaggtgcacttcaggtgggtctgcgacaacttctctaggtgggttggataaagcccttgcagttagaaacccagggctaggtagcgcaagagtagcttgttcccctcccgtcgtaggcagtagattttgctagccttggagcaccttgttacccgacccacccaaaccactggttactggttagtccttcccttgtgttttggctgtgatgctacctggcgggcctgcagaggggagactttgattcccccagcaacaacggttgtggtgtgctttgtgaccaagtttccatttttatgactggaaaggtatggcgtttatgtaagaccttgacacccgtgggctttccgcaaaaaaaaa

SEQ ID NO: 20680 - DNA, 843 bp, Triticum aestivum
  Clone ID: PAT_TA_20680
cggcccggccggggcgggacatctcatctgcaatcccctctcctccttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctcgtcctccccggcgagctcgccaagcacgccgtctccgagggcaccaaggctgtcaccaagttcacctcctcctgagtctcgtagttagctgtttgggtgtgtttgtggccgtgttatcgtgtaagaatcgcatcgctatgtttctggatctcgagaaatagtaacggtgcctgcctcaatgttcagtgcgagctcgaaaagcacgccgtctccgagggcaccaaggctgtcaccaagttcacctcctcctgagtctcgtagttagctgtttgggtgtgtttgtggccgtgttatcgtgtaagaatcgcatcgctatgtttctggatctcgagaaatagtaacggtgcctgcctcaatgttcag

SEQ ID NO: 20681 - DNA, 741 bp, Triticum aestivum
  Clone ID: PAT_TA_20681
aacacctcgaaccccagcccacgcgtgcgcaaatcctccagtcctcccacctcgtgcccccaacccgatccctcgtccactccacctccgccgaaaccgtcatggcgcccaaggccgagaagaagcccgccgcggagaagaagccggtggagacggagaagaagcccaaggccgagaagcgcgtgcccggcaaggacggcggcgccgacaagaagaagaagaaggccaagaagagcgtcgagacgtacaagatctacatcttcaaggtgctcaagcaggtgcaccccgacatcggcatctcctccaaggccatgtccatcatgaactccttcatcaacgacatcttcgagaagctcgccggcgagtcggccaagctggcgcgctacaacaagaagcccaccatcacctcccgggagatccagaccgccgtgcgcctcgtcctccccggcgagctcgccaagcacgccgtctccgagggcaccaaggccgtcaccaagttcacctcctcctagattgctgccgtccgtccgagtctgtttctgatggtctggtctgaatttgttcccgtgttaaaacatattacagggggttagattcccctatcgaacagtgtaaaatgagtccaatttgctgaatcaaagaatcatccagtggttgttacaaacgtgccttgcttcagcaatttaacttgcacctctttcttggatgaaaaaaaaaaaaaaaaaaaaaaggagcggccgc

SEQ ID NO: 20682 - DNA, 772 bp, Triticum aestivum
  Clone ID: PAT_TA_20682
cggccgctcaggcggcgggtgtgccgcgctcgaggcggccggaaaaaatctcatctgcaatccccacaactcccacacatcctccggcgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgaggccgccaagctggcgcggtacaacaagaagcccaccatcacgtcccgggagatccagacctccgtccgcctcgtcctccccggcgagctcgccaagcacgccgtctccgagggcaccaaggccgtcaccaagttcacctcctcgtagagtgctcctgctcctgtgtctcgtagttagctgtccgggtgtgtttgtggccgtgtaatcgtgtaagaatcgcaccgtgatgtttctggatctcgagaaatagtaacggtgcctgcctcaatgttcggtactacatgttcgtctaaaaaaggccccgacttgtgatcttgattcaaaaaaaaaaaaaaa

SEQ ID NO: 20683 - DNA, 686 bp, Triticum aestivum
  unsure (1)..(686): unsure at all n locations
  Clone ID: PAT_TA_20683
ctcgtgaagaaaacagtggaccgtattggacagcttcctgaccgtgaacctatagatgtacctgctgacagtactgatcagttctcaaataaacgcggtctacgaaagagacctccgaaccctttagacgtgtcgaaagatacaacaggcaaacccgagcaattcataaaagcagagacacctgggagtgataatctaaagcattatgccatcctcgccaaatataaagctgtcaccaacgccacttatcgtgataagtggcttgataaactagtagacactattccattaacatcaaaagaaggtgctgaggcttctcatgccgatgctggcagtgtggccaaaatttcaaatagctcttcatctgcaagggatactagttcaagtgataatgaaaattcatatccaccagatgtggttgtttcaataatggcctccttagaaaggtctacatatgacgctcttcatgctgacttccagaagtataatcagaaaatgagaaaattagaattcaacatcaagaatagccctgtactgcgcaggcgactgatgaacaaggagcttgaccctccagttcttttaaccatgtctncagatgaactaaaggctgggttgacaccagcagagaaaacgtctgaaccagaagaagcaaggcgattgcagatgactgacgcacgatgtgaaag

SEQ ID NO: 20684 - DNA, 1845 bp, Triticum aestivum
  Clone ID: PAT_TA_20684
ggggcacgaccgccccgccccgcgaaaacaccccagccccagccacgttctcgaagccggtagctgctccagaccgaggaggcgagaggagagccaggggaagacgctctgcgcgaaaggggagatggtccggggcgaggaggcaaggggctggttggggcagggaaggccggcggcgcaggggcgaccgccgacaaagacgggggacaaggacaaggggcacgcgacaaccgagaaggccgcggcggccggcgtggtcccggtgggacgtatacacaggcggcgtcacgtaagaggctgtcagctaaaggacgtgtggctcccactactgctgggtacggttcacgcactccttggtcaacttaggcggcaaaggtccgtagagccgcacctggccccgctaaccccggatcccagcctgaccgcgtcccagcccatctgccaccaggcggcgtgccagtcccatcgctagaccgccggagctgcgcagcccctcatcagtgggcacgatccgctggtcggtccgctgtccacccctcaccattccctggggcactcatggttcatcgaccaccaaggtcgtgaaagtcattccaatccaactagttcttctcctgttgtgttgtactggtaacttgataagtgggtacttgtggttggttgtttttctttgtacagaattgatcgggtgctgtactttgatgttgtgctattataacaataccggatatcaaggtctgagttggcaatgggaatggcaataagaaggcgcctgtgtcccgctcgtcccgtgccgggattcagttcccggtgggccgtatacacaggcagctcaagcagagggtctcggctaatggccgtgtgggtgccactgccgctgtgtactctgcagcaatccttgagtacctcactgctgaggtccttgagctggccggcaacgccagcaaggatctcaaggtgaagcgtatcacccctcgccacctgcagcttgcgatccgtggagatgaggagctggacaccctcatcaagggcaccatcgctggtggtggtgtcatccctcacatccacaagtccctcatcaacaagacctccaaggagtgaatgaaatgcaataacgggtagttgtgcgttgtatcttcgtgatcccttgttatgttgtgctatctgttatgtgttgctattatcacaacctgaataggttgtctgaatttgtgatggggctagctttcggtaacttgttattagggaaagacttggcaaatgtaatcgtgatatggaaccacttatatttggtttcctgaagaccagacaatccttactattcgtcttcatggatatcgatatcagcttgaatgtatttcctgtggttacacatggttttcgtcaagagatgccatctcatcgctgacggtcgatactccaagttctggtgggaatgtaggcaccgctccctgggcaacagcaaagtttgatgtccttcagaagcagctggtgagccctcgggatcagccagacaataaggcaagtgctgatgctctccagaagaacacggtggcgtccattcctaaacttgagaggcagaaatcattcatcaaaccgaagccagaggagccctctgcacccacactggagaaacagaaggcgttcaccaagccaaagccggaggaaccctctgcaccttcggctagtcattagtgaatgatcatgggcgttgcaatgtttcagagattgtacaccggcagctcttaaacattcagtagaagcatgaataggatgacaacactttcttgtagtctatcgttaaaaatttcgataaactagtttcatacttccccaaaaaaaaaa

SEQ ID NO: 20685 - DNA, 1494 bp, Triticum aestivum
  unsure (1)..(1494): unsure at all n locations
  Clone ID: PAT_TA_20685
cccacgcgagcggacgctgaacatcgaagacttgctccaaactcagctcgggctcgacctgctctgcgtcctcctcgtgatctccatggaactcggtgccgacaccaacccgcgcgtgctcgacgcggcccccgagcggggaggtgctgtcgccatgcatgacatgggtggtgccaccgccttccctgatcctaacctcgacaccgggctgcgccgcatgcgggtcctcccccccccgcggatcttgcgtgccgaagccaaggctagcggctacatcgtctacgagctcgcccgcggcgccagcctgcacgagcgagctggggtttcgggcgtccgcgtccgagatggctgccagagggtgcggcggtgtgccaagacgcctaccgatactggtctcatcaacccggtgcccagcatcgctgccgtcatgataggagccgtaggttttcttctggaggagccacgaggcgcatcgcgttgggttagggcagagaggaacatgagcggtggccatattttcagtgacggcggggtcaccgggtgcccaaacacgatccggacgcggctagccgcttaattatggagctcatgctaagagtgcaaggcggtgtcttcgggtccgtgggcagctcactggttgacgtcggctggggcccatggcaccgctccagaggccatcgcctaggcattcccgcaaatcaagtgcaccgtgctggacctacctctcgtagtcgccgggcctcctgcccgtgacaatttgaccttcaacgccggcgacatgtttgagtacatcccaccagcggacaccgttctactcaagtggattttgcacgattgggctgacgaagattgcgtcaagatactgcgccaatgcaagaaagccattccgacaagggacgccggagggaaggtgatagtcatggatatggtggtcggaactgcagggtcacaggaaaccgtgtccaaggagacggaggttttgtttgatgtcttcatgatgtacatcgacgggacccagcgagaggagcatcagtggagcaagattttctatgaagctgggttcagtgactacaggattacaccgatgactggaattcgctcaattattgaagtctacccttgaatacaaatcataattaatacgcatgctgttcatgcatctatacgtattatgcatattgttgtacgtacgtacgcggtacctttataatattattattagtaccattattgtatcatcatcatttaaacaaattaagcaagtgcccccctgggtaaagctcacctccaacgacctantgtctgcgtgaggctgaccccgtanactgctacaactccaagtgctttgaccatctcgcccgggaatccaagtacacgaagaccaacaattcacaaacctaggggcactgttccgtttcagctgacanangagangagactcaaantagtcatgttttttcaacactgtttcgtttcagtcacagtagggnactt

SEQ ID NO: 20686 - DNA, 387 bp, Triticum aestivum
  Clone ID: PAT_TA_20686
accgcgtgcaggacgcggcgaaggccaaggcttgcctccccggaaggagctgcgacgggacggcgtcggcggccgagcgctgggtctacattgctgcgatgtaagcatgatgatgcaggttttttttttgggggaatcccagatccgtgggaagtttctggtagttggattaatccagtgcaccacattatgtccggtgcactcttgttgttcttgtatactgtagttttattatgtgaagtgatgatgtagtgcacgttcgtgtcaacgcttagaggccgcactttagggatctcgatctattgctgtgtgtagcgatttgtgtgactacctagctgtattttttataaaatatataaaacgtggagacgctatatatgatgctta

SEQ ID NO: 20687 - DNA, 780 bp, Triticum aestivum
  unsure (1)..(780): unsure at all n locations
  Clone ID: PAT_TA_20687
cccacgcgtccgggaacgtggatggcgccgtgatcaccacgcccgaggagttcaagtggatgctcgacgagctcttcttcctcaacggcgtcttcaacatcggcgactcaatcccatggctcaactggatggatctgcaggggtatgtcaagaggatgaagaagctgagaaagatgttcgaccagttcctggagcacgtcgtggatgagcacagcgagcgccgacgccgcgaggggcagagcttcgagagcaaggatatggtggacgtgctgctccagtacgccagcgaccccggtcttgaggtcaagctcaacagggacagcgtcaaggcattcactcaggacctcattgctggaggcacagaaagctcagcggtcacagtggaatgggctatctcggagcttctaaagaagccaaagttgttcaccaaagccaccgaggagttggaccgtgtggtggggcgaggacggtgggtcaccgaagaggacatgtggagccttccctatgtagaggccatcacgaaggagaccatgcggctgcaccctgtggcaccaatgcttgtgccccgcttgtcacgcgacgacacgtccatagatggctacgacatcccttccggcacacaagtgctagtcagcgtgtggtccattggtcgcgatccagagttgtggnaagcaccagaagagttcacaccagagcggttcctcgacagtaggctagacgtcaaggggcaggactatgagctgctaccgttcggttcgggtcgtagaatgtgccctgggt

SEQ ID NO: 20688 - DNA, 584 bp, Triticum aestivum
  Clone ID: PAT_TA_20688
gagattgacacagaattcagaacaatttcaccaagggggagcgaaggtgatattgttacaccgaatagtaacttatttgctggtcacccaattggtagagagccagttgataaccatccagggcctgctactcctggtaggacctcaggcaattcaggttgcgatcctcatgatactcctgttcctaggtctccatttggtctttccacaagtatcatggtccctgaaggtgacttgctgcagccggaaaagattgagaatggtattttattcaatgttgtgagaagggatgctctccgtagcgactactagcggagttgaacctcatggatcttcacaggaagcagatgtggaaactgtacccgaccgagtgcctttatggtgcttccgatgacgacgacgacaacgtggaactgaatgcggttcctgaagcactatctgaccctggagttcagagatccccagttgcaggaaacctagatccgtccacttccatggattgtccaagctgaccaaacaagtactccccgttcagaaccccctcccctctttgataccgggggggagcctcccgccgccgcgat

SEQ ID NO: 20689 - DNA, 685 bp, Triticum aestivum
  Clone ID: PAT_TA_20689
cagggcgaagacagccaaaacctgacctcacagccggccggccgtacccgacgtcggagtcaaggcgtacggacggccatggagggcgacgaccggagcgccccgctgctggccaacggcgccggccggccgtcgctccggcggcgcgactcggcgcggtcgctgcgcagcagcttcctgcgccggctgccggacaagatgcgcactgagctggaccccgagcgcggcgccgacgtcgacgtcgcccgcgtcaaggacctctcccaaggtgagagggagtactacaggaagcagctcgccgcgctgaagaccttcgaggaggtggaggccctgtgcatgcccggcgagttcgggtcggacgacgacggcgaccccgacgcctccgacgccgacgacgaggagcagaagcagagcgagttcgccatgaagatatccaactacgccaacatcgtcctcctggccttcaaggtgtatgccacgatcaggacggggtccatggcgatcgcggcgtccacgctcgactcgctgctggacctgatggcgggcggcatcctctggttcacgcacctctccatgaagaaggtgaacatctacaagtaccccatcggcaagctgcgcgtccagccggtgggcatcatcgtcttcgccgccatcatggccactctaggcttccaggtcctggtgc

SEQ ID NO: 20690 - DNA, 898 bp, Triticum aestivum
  unsure (1)..(898): unsure at all n locations
  Clone ID: PAT_TA_20690
tccctccctccctcgctctccctcgaggaaattaatccggtctccgtcccggcctggttcattggaggggagccccaacaggggaaggcgggctgcacaaggaaaggaatcaggagggccggcaggagaaggtgatcgatcggtctcttagattaactctcgctctctctccgggccattttgcttgtcttcggccaggcttggttcatactctcgtctcctgagcaggggattgagggccgcacgaggggagtctcaggtgatcgtctaattgattagcatggacgaacacatggggcgacggacggtcggcggcctcctcttcaccaaggggggctccatccttctcttcagggaggacagctcccgccgcaaggccggcgcttgctgctcgcgcaatggctgcaacggcacccggcattcggcagacaaaggccggccaatgcacagccacagggaagcagcatccgcagcagccaaggaagcagcaccgacccccaggagatcacagcctatcaggaagtctccacagggaagcagcaatccagcagagccctgtagcgaaaccgacaacgggacaggagaggcggcggctcccggtgccgggcgtgactgctggcacgcctcaaggacagggtgaacgcgtcgaggaagcggtcgctggccagggagatgagcagcccgtcgtcatcgttcggtcgattcagtgccagtgctcccggcggcgttcccccccggccgtcgccgccaccccagcccccacgcagggggggggccccgataagccccgcccccccccgcggcttcgcgggccccgggcgcagggcgccggccnnaaccaaaaggccgaaaaaccccncggaangnngggttcccaaagggccnccctnaagaangg

SEQ ID NO: 20691 - DNA, 506 bp, Triticum aestivum
  Clone ID: PAT_TA_20691
ccgcctccatgcctcccatcttctcctcccagtcctccgcctccacgcctcccatcttctcctcccagttcttcacctccacgcctcccatcttctcctccccgtccttcgcctccaccgccccgcctccaactgatgatggaagccaagatccatggcgacggtgcctgaagcggcccgatggaagcggaagccaacaattgccgatgcagcgagcagctgctactcgcaagcaacgaccaaggccatggatctactgcaggggccttctactccgtctcccaggacgcgcagctgcctcgccatccggaggttcggttcagccagcacgggacgaggagaggacgactaccgtgacctgtaggaggcacaagctcgaccttgctggggacaacgacgctccgcacaaggagctttccgcctctccagttccttggacggtgacgactggcacccacgctcgagctcgacaatgagatcgtccgccccgaccaccatgattcccc

SEQ ID NO: 20692 - DNA, 937 bp, Triticum aestivum
  Clone ID: PAT_TA_20692
gaattcgggtcagtcctccgagcaacaagatcagcagctgacctggccgtcctccgtgcagccggggccgcccccgccggcccgcgggccggcgggccggcggccgctccgccggcccgcgcggccggcggccgccgcaccccgggggcgctcctgctgccgcggcttccgaggcggcctcgcctgccccgccgccgccgagccccccgccgccttcccccccccgccgcccacgcgcagcgcctccgccgcctccgcccgccgcgcctgccccgccgccccctcctccccgccgggcggcacgcccgcgccgcccgcaccgtacgcgcccccgtccgctccgcgccgcgaggcacgcagtcggccccggtccgcgtcgcccgcggggcttcaccgtcgacgcctcgggcgccttcccccagctcctactcgctgcacgcctgggtcggcatcgccaccatcacgctctacgcgctccagtggctcgccggcttcctcgccttcttcttccctggcgccgcgccggagaccaggcggtccgcggtgccgtggcacgccgtgctggggctcctcgtcttcgcgctcgccgtgggcaatgcgcagctcggcttcctcgagaagctcaccttcctgcagtccccgcccgcgcgcctcgtcggcaagtacggcgccgaggcgctgctcgtcaacttcaccgccgtcatcgtgctcctcctcggcatcgccgtcgtgatcgccaccgtcaacgccgactccaccagatacaccgccatgtgatcatccatcgatcgagcttatttgtgattatcacaacgctatgctatgcacctgcttatcgatcgatcctacgtatacgtgttggtgctcctgtacaaactttaaataaaacagttaatatgtgttgtgttttcccaaaaaaaaaaaaaaaaaaaaaaaa

SEQ ID NO: 20693 - DNA, 619 bp, Triticum aestivum
  Clone ID: PAT_TA_20693
cgtcgactccagctcgccagaggaggccggggagtcaaaaatctagctagctagcatctgcgccgagccgatcgagcacgcaagcgagaagccacgtccgtgcacagggtaaggcgaggacaggcgccatgctccgcctgctcccgctctccctctccgcccagtgccggagcggcggcccgccgtcgcaccgctgcttcgtcgacggcggctcgccgtcccagagaaccgggccagggctcctcgcgaacaacggagttcgcgttagagtccggaggcgagcgctccgtggggcagacgtccagccggacaccccgccatcgcgcagggacggggataagccgctgcacgcggatgccgaacaggtggagggcagcggcgtggatctgctggactcggtaaagaagctgctgctggaggacgccgagcccggggaggaggagcaggggcagttccccaagcgctgggccattgtcttcctctgcttctccgccttcctcctctgcaacatggaccgcgtaaacatgagcattgccatcatgcccatgtccgcggagtacggctggaacccgcaaaccgtcggcctcatccagtcgtccttcttttggggctacctcct

SEQ ID NO: 20694 - DNA, 1267 bp, Triticum aestivum
  Clone ID: PAT_TA_20694
attgttccagctgtggagaagttccagaagaagaaagagagggacttgaaacgtcggcagcagaagaatgagcgtttggaacgtttagcttttgctaatgttttccaaacccgttcattgcgcgaacgtaaagctgtcagctacgattactctgattatgatcgtcgcataaacgaggcaataaaagctacagcgaaaggaaaggaagctgattcaggcaaggaggcggcaaaaaaggaaaagcaagttcctcgtcaggcagacaacagaactgatataggtgctgacatcgagcataatgaagacagagaacaggaggatgccaaggaggacctagacgatcttagttctggcgatgatgaagtctcagactatgatgacaaggatgacggctcctccagcagcgatggagacactgatgcttctgactcccacgagagcaactcggatgaggaggttattgtaccacgcaagaggacccgccttgctgcccgggctcttgctagcaagcagtttcgaccaggggttcgtcggagtcgaagaaacatgaaaggttctgatgaagagatggtgcacccaggcgaggtgactcctgaagctatgacaaagaaaacaacgaggcaaagaccgacgcacatctccaagcagttctctatgtcaggctctgaagatggctctgaagaagatcatcattcagagtcagctgcagattccgaggaggaacctgaagatggctccaaagatgatcatcattcagagtcggctgcagattctgaggaggaacctgaagatggctccgaagatgatcatcattcagagtcagctgcagattccgaggaggaacctgaagatggctccaaagatgatcatcattcagagtcagctgcggattctgaggaggaacctgaagatggctccaaagatgatgatcatcattcagagtcagctgcagattccgaggaggaatctgactctgagtcgtcttagagatgagtgtctgtgcatctcttttgcattttgtgctatggatggaaggaagtcggcgagttcgataggtttagggccctcgccggcttccacttataccagctcagggtagtgggagtcagacagacaatacccgagttttatcttctcttttcttggcgaagaattgcctgtttgtcttcagagtcgtgggaaatacctgtgtatgctttgttgttgtgattgtacatacttgtcgtgttgcccgacggttcacttaagttatgttttatgaaacttt

SEQ ID NO: 20695 - DNA, 547 bp, Triticum aestivum
  unsure (1)..(547): unsure at all n locations
  Clone ID: PAT_TA_20695
ttcagatggaaaaggcgttatttatcaggcgcggaatgcgaaagaagtctcaatggagatgatcaatatgcatgaaaagcagcagttcatggatgacaaaaaactaattgcaattatatctgaagcgggatcagctggtgtttccctacatgctgacagaagggcaaaaaaccagagaaggagagtacatgtaacactagaactcccctggagtgcagaccgtgcaatacagcagtttgggagaacacatcgctctaatcaaacatctgcaccgcaatatangcttctttttacaaatcttggtggtgaaaagcgatttgcatcaattgtggcaaaaaccctcggggcgcggggagctttaacacaaggcgatcgcagggctggacctctctaagtgctttcaactacnatagcacttatgggaaaaaggcgctaaccatggtgtataggggaataatggagcaagttctttccattgttcctcccagggttntgacaacaagccaagcatcnaagatcatnnngaagcaagtgccccnntatcatt

SEQ ID NO: 20696 - DNA, 628 bp, Triticum aestivum
  unsure (1)..(628): unsure at all n locations
  Clone ID: PAT_TA_20696
cgcggtcgtacgccgagtcgcggcgcggggactgcgcgctggtgcactcgtcggggccctacggcgagaacctcttctggggcagcggcaccggctgggcgcccgcgcaggccgtgggggcgtggctggcggagcggccccggtacgactactggagcaaccgctgcagcggcggcatgtgcgggcactacacgcagatcgtgtggcgcggcagcacccgcgtggggtgcgccatggtcgagtgctacgccggccgcggcaccttcatcacctgcaactacgacccgcccggcaactacgtcggcatgcgcccctactgaatactgatggccggccgctgcggccgccgtcgcgccgcgttgccgctccgctctccgccggccttcgtccgcagccccgttgccggccggcagcgcgtacggcgatgcggcgcggcgtagcactatcttgctgtccaatcattgttgcccatcgagattcaagacaatcgatggcgatgccacaatgtacaaaattttttccgcctgctacgcgacantgccccattttatcctccccgccagaatatatatatcctgttgtggtacgaaacaaatctganatgatccngactcataaaaaaaaaaaa

SEQ ID NO: 20697 - DNA, 767 bp, Triticum aestivum
  unsure (1)..(767): unsure at all n locations
  Clone ID: PAT_TA_20697
gcacgaggcattcccgtccctatctcgtcggatcgccacccactcgcctcgctctccccccaccccactccactccgatcccccgccccgctccgccgccccccagatccgccccaaccctagcgcccccgccgacgccgacgccgacgccgtcaccccctccccgccaccgccgccgccgttacagggtgatcgaggagggagaggggagaagctcggccgagcggatcgatcccgtcgggcagggtggggaccaaggagcggaggatgtcgaggagggcggtgaaccccggccgccgggcctcggacgggggcctgcccaccgtcgccagcctgctccaccacaagtcgcgctcgccctccgtgctcaccatggcactgctcgccctgggagtgattattctcatcgtctacttcaacagcggctcaggtgtaactgttacgagcagagaatctgtgagcagagctgaaggttcttgcacatcagaagttatccaggcacttccttatcttaaaaaggcgtatggcagtgctatgcagaaggttctccatgtaggcccagatagttgtacagtagtttctaacttgttgaaagaagggaaggaagcatggggagtggagccttatgatttggatgatgctgatagtanctgcaaaagccttgtgcgcaagggctttgtccgtttgtctgatatcaagttctctcttccataccgcccagattctttaaccttgttgtcgtgtcaaatgtttggataactgaccca

SEQ ID NO: 20698 - DNA, 524 bp, Triticum aestivum
  unsure (1)..(524): unsure at all n locations
  Clone ID: PAT_TA_20698
atagccttccctccctgcaccggtctaccacacaaacattctcccaactagctacgtacccatctctcccaaaacaagatgtcgacggtgaaggttggcatgtttggcgggtcaaaaggtgatgtctgcgacatcaccggattgtcaagttttgcaccgtcaagcctgaggagcatggagatttggagcacaccggggcatgaaggggtcatcaacgccatacgcttcaccttcgtcgacaccaaaaacaatgcaatcccggtaggtccgtggggcaccccgctccgtggtcagaaaagccaagactattcacttgacaaatgtgcgtgtcatcgagctctccggctacaccaatgggcaatacatcactcantctccttccgcacaaccgacgcccaaaggcatcatggaccaatcgggaaagtgacggcaacaactgggttcgacactatttcgggtcctctcatgcaagggtctatcgtggcttctgcgccaaccgacactactcaagcgcggtgctattn

SEQ ID NO: 20699 - DNA, 387 bp, Triticum aestivum
  Clone ID: PAT_TA_20699
actgcgtactgaagaaaagaaaaccacttgtaaagcagatcacatatactcaccgcaccgcaccgcgcgtcgtcgccgcgccgccccgccccaccccaccggatcccgccagatccaggtgcccagatcccggagcgcccgactggcccgatggacccctcgccggccgcggcggagcgcgaccgctcgccgccgccgccccctgccccgcccccgtcctcctccacgtcgcctctcgccgtcgtctgcagcttctggaaagactttgatttggagaaagaaagaagtgggttggatgagcagggtttaaagattgcggagaatcaagagacgagccagattaaccgacgtacacttgctgagaatactctggactgaaggaaggca

SEQ ID NO: 20700 - DNA, 642 bp, Triticum aestivum
  unsure (1)..(642): unsure at all n locations
  Clone ID: PAT_TA_20700
atttctccccgtcgttccccattcttccttggtcgccagctccctctctccacctcgtcaggccacccctccccttcgtccccaccgccagcaagaggttcgcaaccccttctcttccccgcgttttcatcgaatccggtcgcccaagtggccgaggaggtcccccagctggccagctcggcatgctcgcgagcatcctagcgttaggctccgtcggatgcgcgcgacttccccgcccctgctcttccccgtccttctttgaatccgttcgccgaagtgcccaaggaggcgctcgagctcagcgcactcacgggcgaaccaacgcgaaggcgggcgcccgaagncccgcaacaaagcaacaaagagccggcgtttggtttagcaacaaatctggganatttnnatgctcccacggggattgagcaacaattgtcttccttcccccggttccttttggaangagctanaaaaatttcctttaaantacccctgaaaatttcanngccatttanaaaagcacncccancantttaaaaccncccnaaaatttttngngccccnanaattncattgagntccanattttacccccaattgtccaaagggaaaccaanttcctaacanggacgggtggtanttcan

SEQ ID NO: 20701 - DNA, 1463 bp, Triticum aestivum
  Clone ID: PAT_TA_20701
gtcggcccgggggttagtccccagggcagcccgcacccctgccccccgcgccagcaccatgacgccgcccgcggcggcgacgcggccgtactggccgcggtggccgtgcccgctggggggtccgaagcgcaagctcgcccccgcctcgcggacctggcgcgtcacccgccgcccgctcccgtcgcccctccgcccacgcgcccccccctccgtgcagcgccgccggcaggacctcctcctcttcgcgcacttacatgagggcaagctcattgccattgaaacggacacgcttaaaaccctgcactacgcgctggcaaccacgttattcaacgttctgctcgcagaatacctcaaatacagctctttgtgctcacctaatgatacaagtcccttagaaagaagcgagcttgcaggatgaaagttgtccgcctagagggcgcagctgcaagatggccaaagcattctcgatgttggatgtggatggggatccctctctctatacatcgcaaagaaatataggaactgcaatattacggggatatgcaactcaacaactcaaaaggcttttatagaagagcagtgtagggaaaatgagctatccaatgttgagataattgtagcagacatcagcatgtttgagatggagcgttcttttgacaggatcatatccatagagatgtttgagcacatgaaaaactacaaggcacttcttaagaagatatccagatggatgaaagaggattccttattgtttgttcactacttctgccacaagacatttgcgtatcactttgaggacaagaatgatgatgattggatcacaaggtatttcttcactggaggaacaatgccatcagcaaacctccttctctactttcaggaagatgtatctgtggtcaatcattggcttgtcagtggcacacattatgctagaactagcgaggagtggctgaaatgcatggacaagaacatcgctaccataaggccaatctttgagaagacttatgggagggaatcagctaccaaatggatagcttattggaggacattcttcatctcagtagctgaactttttggatataacaatggtgatgaatggatggttgcacatcacctgttccgaaagaattaggaggtaccgctggacatttctggagcaaagtagaattgtatgttgagaatcatccatcacacaggctgtacctagtattatactccctctgtttgtttctataagacgtttcagacagcctgctctatactgttttgaacagtgtctgaatgtctaaaacgtcttgtaaaaatgagcagaggtagtatattttttctgcgttgagcggttatcctccttgaataaaattgtacctcggtgttctggtacttcagcattgacgctggcaatgtaaaatgttttcttatgtaaatggtttataaaagatttgcagtttccaagcgcgagaacc

SEQ ID NO: 20702 - DNA, 316 bp, Triticum aestivum
  Clone ID: PAT_TA_20702
gaaggaccggcaccggggctccggcggcgcgcagccggccggtggcggcagaggccggcactggcggccgtccctgcagagcatctccgaagccgcggcggggcagagcagcagtagcatctctgaatccactgcgagctaatcgccggattaacaatccgcttttcttctcctttcttttgtttttcttagtagtataaaagtgcttggagttgggacctaccagaccagaagaaaaaacctgtaaaaatcagagtaccagagcagcagcagcagcaataggaacgaagcatctttcatctctaaaaaaaaaaaa

SEQ ID NO: 20703 - DNA, 826 bp, Triticum aestivum
  unsure (1)..(826): unsure at all n locations
  Clone ID: PAT_TA_20703
gatcatctggagagcaggaggagcgcttcttcctctgaacaagtagaccaagaagacatcatcgatgtgctcttgagggtgcagggagaaggcaaccttgagccccccctcaccatgaacaacatcaaagcagttgtcttcgaccttcttgcaggggggacagagacaacatcgacaactctacagtgggccatggcagagctgatgcgaaacccaagcatcatgtcgnagggcgcaagatgaggtcaggggagccttcatgggaaaaaacaaggttactgaagagggtctaggtgagctgagctacttgcaatgcatcatcaaggagaccttgcggctgcaccctcctgggccattagtaccaagggagtgcagagagcactgcagaatactcggctacgacgtgcccaaaggcaccaccattcttgtgaatgtttgggccatctctagagacccagaatgctgggatgagcccgaagaattcgtgccagagaggtttgtggcaagtgctagagatttcaaaggcaacaactttgagttcataccgttcggcgccggtcgtcggatttgccccgggatgctgtttgggcttgctactattgagctagctcttgcaagccttctatttcattttgattggagtctcccggatggcactcttccgagtgaactggacatgacagaagaccatgggactggcggctaagaagaaggtgcctctgtggttgcgtccaactccccaagtatatttgcccttgctgaatcatgcattcatggttctgcatctggtctctccggtgcctccccctgggaantgngagcacaa

SEQ ID NO: 20704 - DNA, 391 bp, Triticum aestivum
  Clone ID: PAT_TA_20704
aggacctcctcgagggcgcggccgccatcagcacgatgcaatcaaactacgccggcgctgactgctccttcggcaccgccttcgcgcccgccgtcaccgccggcaaccgctactgacgtacgccccccgcgccgcgcgaggatctgatggagcgggagatcgagcacgccgtccgtgtgtagtggtactcgtcgcgtgtttgactcagctgcttgggatcgagcgacgtgctacctccttgatctgtacgtgtacgtacgtataaattctgttgtttaagttagctagcatgttactcctgctgctacttaatttctgaatcagaggacagccgatgatgataaactaagcgaggaaagaaagaatcaaacttctttccaaaaaaaaaaaa

SEQ ID NO: 20705 - DNA, 747 bp, Triticum aestivum
  unsure (1)..(747): unsure at all n locations
  Clone ID: PAT_TA_20705
gcctgacctgngncaaggntcgtccgggaggtgccactcagatgagatttcaaccccgcaaaggaaaatatctagcagctgcatcagagaaggctatctacatacttgatggggagacacagcatgcttgtagaagccctttacagggtcatgcaaaggacattcagtcagtttgttgggactctgcgggtgactatcttgcttctgttagtgaagatgctgtcagaatatggtcatttacttctgggcaggatggtgaatttgtgaatgagttgaactgcagtgggaacaagtttcaaacatgtgttttccatccagctcacccttctttgctcgtcattggttgttacgagtccttggaactttgggacatcagggagaagaatgccatgacctttaacaatgctcatgacggtttaattgcagccctagcagcatcgagcgcaacaggcaaggttgcctcagttagtcatgacaggcttgtcaagctctggaaatgacttgtaaaatagtgactgttgtttgttgacttttacattctgttgctagattttatagagaacatgatggttcagataaccacatgacaagaaggtactagctaccaaaagccaggtctgcgatttgtggttgtcttagttgtgttgtatcttgtatgctgcttctcaagtttgtaactcgttacagaatgggctgtttgcctgctgttacaatgaggactttgtgctgattaaaagttacagaact

SEQ ID NO: 20706 - DNA, 939 bp, Triticum aestivum
  unsure (1)..(939): unsure at all n locations
  Clone ID: PAT_TA_20706
cngacaactgagaacttgatagagtcagacacggnaaacaccagcagaggccctagtagcagtaagctggcagtttccccaggtcactctctcaccaaacttcaaacttctgtgtactctggttgtgtcagtaagaggaaaattgacatttctgacgaccaagaaaagcagctagaatcaccgagcaatccgaagcgtccgcacagaacatcaagtgtgcccttcgacctgaacctccccgtcggcgacgatggatccagtgacgctgacggcgacgacggcagcagcaacgacagtccagatgagtccatcgacagcctcatgggtttggtcgacggtgcgatcgaattcaaggcgttcgactttggcaaactcgccaacgacatcctgcagggggtgagcagtgtgctcggcagcatcctgggctcgggctgcacgttggaggtcggcgacggcgcgatggagcaaatgcttgcggcctcatgggcatcggaggacgggcggcggcctctgcgggcctggctggagcaggtgttcgccaggagcctcgaagagctgaagctcaagcgcagcaagcaggcgagcagctctgctcttaggctagtggcctgtgaggacggcgcagcagcagcgacggcggccaaggaagacggcggttttggaccgctgctcccctcgagaataatcctggagtggcgatgaatggatgacgatatctgtatatactgtgatggatcgcgtcattgttggtagctagtccacggtagtatagcgttataagcctggttgcgaattaaataagttgtagtccacactagttgattgctagcagtctaccttagttgatgatgcactgccttcgtcgatcaatatatattggcaagtgtatagaatttgactgtaactattgttgatttctttgccacacaattgtttgcc

SEQ ID NO: 20707 - DNA, 2375 bp, Triticum aestivum
  unsure (1)..(2375): unsure at all n locations
  Clone ID: PAT_TA_20707
gaagacaacggcccaccccgtcctcccacgcgtccgcccgcgcgtccggcggcggcggagcatgagccgacgcgcgcggcggcggcaggcctacgactacgagggcgaccggcgctggggcgccgacggggacaaggtccacgcgctgagccacctctgcggctcctccgacgtcatcgcccacttccgcagccatctcgacccacgctgcacggatctcgattgggtgatcactcctttttcagccactgggcccattctgccaatgagtcctggaatgaggttttttgcttgagcctgtggtgacagcttggcggatccagaccagtagcccagtgatagagcaggctgccgcaccagcggaaggaccgtttgaggggtctgaattccctttctgtgccggtaataggggtgtacctgtcttaggaaatgcccgtgagccaggagagcgacttcttaaggtccctcaaccatatgcaatacagtttgcaaaaataccctgcaagcgctggtaggtagtaccggttaaggactccgtagtaacattgtccagaagttttccaccacgcagaaaatctaacatggttgtgattgatggctggctgcctttcgcacttggtggcaaggtctttattcgttgaatgttctcgatattgctagtcgaatctcagctgcagttaaatattgctgcgctacctgtcttctgctgggcacttgttcatgttgccagattcctagggcgtaacttttgccgctcatctttctacaggggatacttgggaagagccttgcctttgggtgggagacaaacaacacccacgctcagcctccttatgctcgaatgctgaacttgccttggggcttccttcctgatcatatcactgttctcggtggcaggcgcaatttcattccaagacattcatgtcctggcaacgtgctgcatctgatgaaacccgtgttcgtgtgaagcaggataccactagagcgcgtggggccatggtccgggcggaccgtgaacccgtacatcgaccgctacgcaccgttcctccagacacccatctccatggtccagcggtggtggctcaggtagcgagcgagacacgggaggaatctggcatgcgaggcctgtggcggggagaggggaaaaacatatactatctactactactactaagtaactagcatcgaccgtccctggtgatttcaaactataacgctcggaagtcgggactcgaaacccgacgtgtacgtgcttgcgcactttctacccaggtgagggtggtcggctggtcaatgagaatggttcgtcacaagataaatctgaagtgctgttggatggatgacggtgcctgggtttactcaggtgaatagcggcatcctttgatgttatccctctggtgtccacccatattcacttatttgcgcattgaaaatgtgctgttttgcacttgttctttccttgtgatatatactagtctgctgtgcaatacaggcttcatcaatcaatttattatggtaagtgtttgcattttgattgttactatttccactgtattatcaacaatataagcctagttccgtattaaataagttgtagaccacactaccttgaatgctagcagtcgacactaatctcatgctgcactgccttcctcgatcaatatatcttggcaagtgtatagattttggcctgtaactattgttgaactctttgcctgtgtatatagtttgcggaaagggtccatgggtgggaatcgctaaggtacgctgaatcactgggcattgcagccgccgttgactgcctccaccggttgcatcacagtgcgcatcgtcgacgtcgtcaaccaatctgcaaccctcaacggcaccactgtaacacattgttgccggcgtgaggaagtgtgcaagcaccattgcagaccaatgggtgccgtctattgacgaccgtagcatccacgctggtgcagattgatagctgaagcggaaacaaaggtctgaatgccttcgtggtactgcctggcagacgctacctcaaacgcttctatatggaattagtgggcgacgaagtggagaaaggcgaacatcaatgagctgcaccttttcctgttctctcccccgtattcttcccctccatctgtctctttctaggagggtggaggatggattgtcgttgtgttatgctccagcaatagttgacattgattaggtgtgtttagaacttcagatacgctaaattgtttgattaccatgttcatcatgtcgcttggatcttcctttggcctcaaaagtcctcccactatgttgtgctaaataccagcccctataaaaagcagaaaagtgctgtcgctgaaaaaaatatttttttatgacccana

SEQ ID NO: 20708 - DNA, 296 bp, Triticum aestivum
  Clone ID: PAT_TA_20708
tttttttttttatgaaataagtctcttcgtattgcatatcattatttactgcatttacactaaaccccgacaaaataaccctgtagtactacctagagaacgagcaaatttatagcttcaaagccgcacgacttttctttgggagaaagacaaaaaataaacatcatggtacaattaagaaggaacgtcggtccttccgtgatcgtcggacgaacccctgctaacactagtcgaactctagaaccaccttgccaggcaccagtcttttcttcttggcctcatgagctttttttact

SEQ ID NO: 20709 - DNA, 1575 bp, Triticum aestivum
  Clone ID: PAT_TA_20709
caggaattcggcacgagggtcagcacttgcgagtcaccagtagctagctctccctctcctccccaatggcccgcgtcgttgccgcggtgccgctcctcctgttcctcctccttgcttcgtcgtccgtggtcttcgccgacacggtgctcggccgcaaaggcagtaccatggtggaggggcccgtgcagtttccgggggtgggcaagtacgccgtgatcttcgatgccggcagcacaggcacacgcgtgcacgtcttcaagtttgacaacaagatggacctccttgagatcggcgacgacgttgaggtcttcgccaaggtgtcccccgggctgagctccttctccggacggccgaaggaggctgcaaagtccatgataccactgctcgacaaggcaaacagcgttgtgccttggtggcagatgaacagaactccccttaaactaggggcgacggctgggctgaggcttatcggagacaagccatcggagcagatccttcaagcggtgagggatatcgtccacaccaagagcaaattccagtacaacccaaagtggatcaatgtcctcgagggatcgcaagaagggtcttacatgtgggttgctctgaactatctgctggatagattgggaggagactactcgaagaccgtaggcgtgatagatcttggtggcggttcggtccaaatggcgtacgccgtctctccaaacaccgcagcgaacgctccggcgacgcctgatggcaaggacccttatatcaccaaggagtacctcaagggaaatgactacaacgtctacgtccacagctacctgtactacggcaacttggctgctcgcgtggagatcctcaaggccaagtccgggccgttcagctcgtgcatgctgcgcggatccaccggcaactacacctacaacggcgaggtctacgacgctgcggcgtcgccggaaggggcggtgtacaccaagtgcaggaaggaggtggccaaggcgctcaagctggacgcgccgtgcgcgagcaagaactgcaccttcggcggcgtgtggggcggcggcggtggcgctgggcaggccactttatatgcggcctccttcttctacggcaaggccacccaggtcgggtgggtgaagaaggacgccccgagcgccaagtccagcccgggggcattcagggcggcggccaagaagatctgcccgctcagcctggaggaggccaaggcggcgtatcccggggtgcgcgagacgccctacatctgcatggacctggtgtaccagtacacgctgctcgtctacgggttcgggctggcgccggcgagggagatcacgctggtggagaaggtgaagcacggggagtacttcatggaggccgcctggccgctcggcgaggccatcgaggccgtcgcgcccaagaagcgcatccaacatgatccacccgtcaatgttgcatgatcgctagcttgtactatgatcccagcagcgccgtggctccactgcacaagcaacatttcccttttatgttttggatggaaaacgattcgttcctacacctatgatgagtaacttaaacaacctaaaaaaaaaa

SEQ ID NO: 20710 - DNA, 434 bp, Triticum aestivum
  unsure (1)..(434): unsure at all n locations
  Clone ID: PAT_TA_20710
gcttcctctccggcggcggccccccccctcccccgcatccctccggcgctcctccccctcctcccgcgcctcgctgatcccctcctcctctgcctcctgccgccttctccgtgccctcgccccgcgccggcgtctcctctcccgcccccgactgctgccccctgcccctccccgctctccccctcccccgctccctccccctccctctcgctctctctctctctctcaaatttctgtaaccttcacaagtgtaataatcangtactatgtaatgttcagttttgagaagtgtaatatcctactgtttggttcagtttcgaagttcaatataaatgcttgattagtatgtcctgactagttgataccttatcactttganaagtatttgacctgtcatactccggttaagtgaaatacaancatcaaagngaaaa

SEQ ID NO: 20711 - DNA, 437 bp, Triticum aestivum
  Clone ID: PAT_TA_20711
cccacgcgtccggcgtggaagagatgatactgggaggatcgacctgctgctgcttcacccagctgcatcccgccgccaccgccgccaggctgcgcttgccgccggctcgcgccgcgaacacctcctccgagccggccgccgcgcgtctgagggcggtgctcgagcaggtggacgacgagctgcggaaggggaacgacgaggccgcgctgtccctcgtgcgcggctcgcagggggagggcggcgggctccggtgctttggcgccgcgaggcaggtacctcaaaggctttataaactagatgagcttaagctaaatgggattgatacttcttctttcctatctcctgggatcagactttgggatcaattgagagaaatctccaaattgccgcgcttcttggaggtctttctgtttcatttgcgtttgagctttctcaac

SEQ ID NO: 20712 - DNA, 524 bp, Triticum aestivum
  unsure (1)..(524): unsure at all n locations
  Clone ID: PAT_TA_20712
cggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccaaggaggctaggctccccaccaagattctgtggatgcggaggatgcgcgtcctgaagcgccttctgcgcaagtaccgtgagggcaaagaagatcgacaagcacatgttncatgacatgtacctgaaggtcaagggtaacatgttcaaagaaacaaaganggtcctcatgggtgaagtatccacaaagtccaaggaggaatagagaaaccnccccgatnatttnaggcaacncncaaga

SEQ ID NO: 20713 - DNA, 700 bp, Triticum aestivum
  Clone ID: PAT_TA_20713
cggcatcgccgtcaactgcatgaactcgctgcgcggcgtggtgccgggcggtgcccgccggcgcggcgctttcgccgcgtccctccgccgcctcgaacctcgggtcgtcaccgtggtcgaggaggaggcagacctggtggcgaccgaccccgacgcgtccgacgaaggcggcgacacggaggcggcattcttgaaggtgttcggcgagggcttgcggttcttctcggcttacatggactcgctagaggagagcttccccaagaccagcaacgagaggctggcattggagaggggagcagggcgtgccattgttgacctggtctcgtgcccagcgtcggagtccatggagcggcgggagacggcggcggcatgggcacggcggttgcggtcggccgggttctcaccggtgccattcagcgaggacgtagccgacgacgtgcggtcacttctgcgccggtatcgggagggctggtcgatgcgggaggccggcacggatgactcggcggccggagccggcgtgttcctggcgtggaaggagcagcctctggtgtgggcaagcgcgtggaggccatgatcggtggagctgcggccgcctcagcttcttggcgtacgccatgatttgatttgtttccttaatttctttgctctttgcttttgtgtttcgatcgtcctgtaaggttaacaaattcttcttcctttg

SEQ ID NO: 20714 - DNA, 681 bp, Triticum aestivum
  unsure (1)..(681): unsure at all n locations
  Clone ID: PAT_TA_20714
ctgtgctatgttgtgaccaattgcttgaactgatttgtnctagttgctttgatnanttgttgagtcttgattggacaagtgattgncaggcctttgtattattattatttggcaaaagggtaccccttgttccngttaatagaatcattatatgttcacaacatatgcccatcttattacacagtttcattcattactagtttcagcaagtgtcatgtcatagcccattgatacatcanggtgtacatacactgcaattaaagagacaatcatcntacagagcacatcgattttgcccattatcttcacaagtctttcatctcctccattgctgtcaaggccgttcagcagctgttgcttggccatgagcagaggaactgcatctttaaccttctgctctgcatcttcctcttctgtcgttccttcagttacttgtccaacaccccaacctgcgggtattgggattcctcggctaaccaaataatcagcgtagttgcattcccccacaccagcaacttcccaagaaatacaaatcacacgaatcttcccttttctgcacgaatcaaattggtagatcatcaaccaaactattaaaaaaatcaagcaactgaaagcagcagaacaacacttaaacatattattactcaatgattccgggaatttgtanaaanaccnccaagg

SEQ ID NO: 20715 - DNA, 460 bp, Triticum aestivum
  unsure (1)..(460): unsure at all n locations
  Clone ID: PAT_TA_20715
nntcttacctggctgcaatcttccatccatacacaccaaaacccatccatccaccggaggaaggaaccatcatcaacccggaaaagacagaaaaacttgggagacacccagctcaagctcaagccttctacactgttacttacctctctactaatctctaagctgctggcaggcattatatgttagtgcagtacagtacaggggggtggttcttgtagtcattctcttggtggcagcagagctttgctccagtgatctctgccctggatatgacaaagcaaagcagcacacaccatgagcagcacatggtcatttcggcctgtcattctgccagtcacaattcgcactgacaatgttgttagtgaattcatcatcttttcacaggcgatntttggcgtccgggatnatggnggattgnaaattanagggccccntatgcgggtggnnggagaacaagacc

SEQ ID NO: 20716 - DNA, 233 bp, Triticum aestivum
  Clone ID: PAT_TA_20716
gcgcgacgcacggtggcggaggctcgaggcggccgccgacgccaatggcctgagcggtagctaacgagcgtggtgtttgtttgggctttgtacattgcgtgatgacgatgccggccggcgggcaccgcaactgatggcgcggcgaatattcgtgtgtgtgttttccccaggcgcatgcgcctactgatattggactgagataactgcatattcgttgatacaaaaaaaaaaaa

SEQ ID NO: 20717 - DNA, 569 bp, Triticum aestivum
  unsure (1)..(569): unsure at all n locations
  Clone ID: PAT_TA_20717
ggccnacaccaaaccccctaccaccttaagcaccgggttcccagcacttgggagagaagtggaccacagctcttacagtgttgtcagtaaaacactttcagtaggaatgcaagttgacaatttttcggactagcaaacttactccttgattgtaaaactgcatcttctaacaccctgctggaaaggggaaccgacgcttccgttattgtgtttcggatttttaccgctaactatatgccttcactcatgatgaggctgaatcaatcagacatacattttttgcaaatgaatggtgtgataccggccttgtgtttagaaccctgtgcgatgccgggggaggagaagagaatgcacagctgctttgattggccagtcaccctgaaccattttcgcctttcttggcaagcgtgtccgcttgagacgagctgccgccgttcctgctgccgacgcaccccttgagccgcttggcgaagagcctggcgtcctgcggcggcggcccggccccgatccccctccaangagcntattnncgcgcnaangggctcgtttaaactcnnnctgggaaacng

SEQ ID NO: 20718 - DNA, 353 bp, Triticum aestivum
  Clone ID: PAT_TA_20718
gaaggccctcggcgccaaggtcgtcatggactgatcggcccctgcatttcgaggtactgctgaatgtatgaaccatatgattaccatggctgagtgctgcgagcactgcgggactgtcagtgtcaattgaaccttttcaggctcgaaggtttccgtaatgctggattctcttagttgccttcactcctattttgttgatgaattttctgtctaacacgaaatgtggaataaaatgttctaaaaatcagataagaagcatgcgctgaaatgactccgtgactgcaattgagttgccttttgttaagtttggggaacccaagttacactttgggccggcatgcaaaaaaaaaaaa

SEQ ID NO: 20719 - DNA, 913 bp, Triticum aestivum
  unsure (1)..(913): unsure at all n locations
  Clone ID: PAT_TA_20719
ctggaacctcggtgtcctgtgcctcttaggcaactgcttcctcatgggagcttatcttgtcatacaggccccggtgttagtaaaatatcctgcgagcttatccttgacagcctattcttactcatttgccaccatattcatggtgttgactggggtatttgcaaccaacgggctccatgagtgggcactgacagggacagaaatcatagccgttctatatgctggagttgttgcgtcttgtctcaactacgcaatcatgacttgggcgaataaaattctcggaccttctctggtcgccctctacaatccgctccaaccagcatgctctaccatcctctcaactctttttcttggtaccccaatctatctaggaagcctcattggaggagtcttcatcattgctggtctatacctggttacttgggcccgttacaatgaggcgcaggagaatactgatgtctggttatctgaatcctcttcttgtggacgtggaggatgcgccagctcccaagagacaggaaaattcaagcgcagtggttccctgatacgcacgacgttgcctcctctgtggttgccctccaaggcctgcagccgcagttttacgttgtataccactagcacactgcgcccagtgcctgctccacgcggcgtcagttgcgcctttaagntcataccaaatacctcgacataagctggaatggaaatgtgtccaatatcgtctcnacanccgcngagatgctacngnactggtaacatgtgaatntagtcagtcaacaattgtctcacgggcaaggacactnatgataaaganctcaatanngctggaaacganctgaatnatnaancaaangtctcggaagatcaattcggangcaaattgaacaatntnggccaagaaaatggaacanngggg

SEQ ID NO: 20720 - DNA, 754 bp, Triticum aestivum
  unsure (1)..(754): unsure at all n locations
  Clone ID: PAT_TA_20720
ggaaatagctagcaagctacccctccccccccgcccacgcccactcacgcctccgcgcccacgcgcgcccgcccgtgcgcgcggccgccctctggcctcccccatatacagagtcagatgcccatggcactgatcccagatacagcttcaggagcactttgtactgcccgatgtacatcccggatacatacacgcagacatgcaggagtaggggtattatctctccggagagccccgaacctgggtaaaccagcacgtgctactcgcatacccgctcccgggcctatcagcagcagtcttaccctcacactaagcccttgtggcatctgtcgactcgcaagccccccgtgagaataccacgacagttggcgcccaccgtggggcggtactgtgctaccccgctgctgctgggtttcgctgcccgggcgggacccttttttcctccagccctcccgccgccccgtcacgcgtcctcgccactggccgtcgtctcctcggcgcttgcacgccccccgtgtggccctgaggggcggcctgcccgcgcctgccgcctcgccccctgcggcgtaaccgcggcgccggccgtccggccgcgcgcgtgccgtgctagntgtcgttatcacacgtgtgaatctataataaatgaaatatgtattaaaagggggccggaccaatcgccnaaggagtcgataccgcgcnaangcgtcgttaactccgacggaaaccgggtacanttaaccctgaaaancccttc

SEQ ID NO: 20721 - DNA, 301 bp, Triticum aestivum
  Clone ID: PAT_TA_20721
ggcagcggggccgtcgtcgggagggcagcgcggcccaggcgatccgaggaggagaagctgcacaaggcgtaccacatcgtctgctggggacccaactgattagaactaatagtggcacatttttgttctgctgtctaatcgattccggcctctctctctctctccgtttcggtctcttccccgagcggcgcatctgtgaatggcgtgtaaaccgcgatatatgtttgcttccacgcacaaagaaagaaagggagatatataaacggaagagatcctaattcaagctgccaaaaaaaaaaaa

SEQ ID NO: 20722 - DNA, 959 bp, Triticum aestivum
  Clone ID: PAT_TA_20722
cccgggtccacccacgcgtccgctgacgacaagggtccggagccttcccctcctctgttctccccacgcgtccggcacaacgcccgccctccaccaacttcagctccagatccggcggccggccgcgccctcctcccgcaccaaccaacggcgctgatcccctccgccatctccgtccatctccccccaaattaggcgcaggcctagcgatgtcggaggcggtgggcacgccggagagcggtggggcgaaggagcaggagcggttcctgccgatcgccaacatcgggcgcatcatgtggagcggcgtgccggcgaacggcaagatcgacaaggacgccaaggagaagcgcaaggaccatcaacggcgacgacctgatctggtccatgggcacgctcggctcaagtgactacaggaggcccctcaagctctaactcaagctctaccgggagatggagggtgacacgtcaaagggttcgaaatctgagcaggctgcaaagaaagtgggtgcactgaatgggcagcctggatcatcgttcaacggcatgtaaggtggagaatgatactgatcggcggtgtgacaaacatacacatataattcgttggcagtgtgatcctagcagtactgcgcatttgtggccggggaaagtccccagcactctgcttagttctgtgtacccggcatatctggctatctcttctctgggtgtctcccgttctcccccccgctcgtgctctgcccgcgggtcctgtgggtctgtcttacctcttcggtagttctgagttgcccttcccctcgccctcgtgcaggccttgtgtcggttctatccggctgaccttgtgcgaaattcgcagcttccctcgtctaagtttgggcggagtaactgttgcaactgcgggatatcctccgccgccggtgttgaacaggttcgaaaaaccgcagtctttcgcccgtgcaagg

SEQ ID NO: 20723 - DNA, 447 bp, Triticum aestivum
  Clone ID: PAT_TA_20723
ctaccgcgggccttgctcctccgaggcgacgagggtgaaccatgccgtcaccatcgtcggctactgcgaaggccccggcgacaacaacaagtactggatcgccaagaactcgtggagcaacgactggggtgaccagggctacatctacctcgccaaggacgtgtcatggcggacgggcacctgcggcctcgccacctcgcccttctacccaacggcttgacccattccggcttgccggcggagcttttgcattccgccaactgcttgttttgttttattttgtgagagagatgccaatccccttaggtgaagtcctagtgcgccgatcataccatccggcaccaaatgattgaggtaggtgtgggattggttaattttttcagctgtgataatgcacaataagatattaataaagtccagaaccttttggcttccaaaaaaaaaaaa

SEQ ID NO: 20724 - DNA, 619 bp, Triticum aestivum
  Clone ID: PAT_TA_20724
gcggcccgcggcgccgcgtccgcgtccgccggctggacccgccgcggccacgccgccgctgcgccgcctcctcctccccctctccccgccccgcttcgcagccgccgcagcctcctcgcccgcgcggctgctccacgccgctgcggtgcgcggggggagcaggtggctcgcgagcgacgcctccgcctccgcggcgagggagccctccgccgagctggtggaggtgcccctggcgcagacgggggaggggatcgccgagtgcgagctgctgcgctggttcgtcagcgagggcgaccacgtagatgaattccagcagctctgtgaggtacagagcgacaaagcgaccatagaaattacaagccgtttcaaggggaacagtacatgagattcagtttgcccccggtgacatagtaaaggttggcgaaactttacttaagatgattgtcaacggcagtcaagttgtacctcatgatagcctagcttcatcccctgacattccacttggagtggatacttctgcaagtcctttaagtgaaggcaatgctcctcgtgggtctctctccacgccagccgtcaggcatctagtgaagcagtatgggctcaacatcgatgatattaa

SEQ ID NO: 20725 - DNA, 691 bp, Triticum aestivum
  unsure (1)..(691): unsure at all n locations
  Clone ID: PAT_TA_20725
ccgcgtaggctccgccggccgcatctaccacaacgtcgaggtgaggatcgtcgacatcgtcaccggcgagcccttgtcggtcggccaagaaaggggagctgtgcgtgagaggtccttccatcatgacaggttacgtaggcgacaacgaggcgaacgcggccgctttcgattcggaaggctggctgaagacgggcgacttttgctacattgatgaggatgggtttgtgttcattgtgggataggctcaaggagttcatcaagtacaaggcctatcaggtcgcacctgcagagctggagcttgtcctgcaatcactgccagaaattgctgatgccgctgttatgccatatccccatgaagaggcaggagagataccaatggcgctcgtggtgaggcaacccggaagcaaggtcactgaggcacaagtcatggagcaagtggcgaagcaagccgcgccgtacaagaaggtgcgcaaggtggtgttcgtcgactccatacccaaatcgcccgctgggaaaatcttgaggagcagttgcaaatccgtccgccggcctgtcttgtgcctagactctcattgtactccctccgtacttcctccgtagttttcatttgcgatcctggcctcacgtctcaaattttaanggggaacccatccatttcaccatntaantttaaataatgtgcgccaatttt

SEQ ID NO: 20726 - DNA, 801 bp, Triticum aestivum
  unsure (1)..(801): unsure at all n locations
  Clone ID: PAT_TA_20726
cgtccacaaccccagccagcatcagatgcggcctccacgacccaactacctccaaccccctccactccactccactccaccatcagaatcagatgcagccgaccccctgcaaccccttcccctcccctccaccgtcagctgcagcctccacaacccgaacccatcccctacgccccagccaagcctcgcccctttacactcaccgacctggatgcgatacgtcgacgcgtagcagatgcacccatggaagtcgcccgctccgactaccctgacggggatgggcaactctccacggacgtcgacgagatatctcaacgcgtagcagatgtacgcatgggaagtcgcctgctccgacatccagacgaggccctacgatcggccgcaacctccacagtgcgagtacccttcttatgatgtgcctgagcagttgggaaacgccactgctagagccaaagaacaccaacactcatcttcctccacacaagccaagaggcgctaactcatgactccgcgccggtggcgatcctctccgctccgccgtcgtccctcgcatccttctcggtttctctgctaatgtcagctcgtcaagtcncgggccggcgcccttaccactccgggcggacattccctacttctggaactgggcctggacgcaacgcccggataactcctcncaatgagtganaaatggcttggtcgngatgganataacaccttatggctatgganaggaaatctctaagnatcggcatagataanctatggtaacgtacggaannaangagtacactcnggatttca

SEQ ID NO: 20727 - DNA, 714 bp, Triticum aestivum
  Clone ID: PAT_TA_20727
gtgtttataatgctgctgtcatgtctgattatgcatccctgggggctccagatcctgaagaagaacaagagattgataatttaacaatcatggaaacctctcgccctgattccagagacaggcggttgagttttcctcagagtgttcgtgatgttgtgttaggaagtggtgaaattatggtcgatgatgtcagatacacagtctcccacgtcgttgagcccatggaaaggagtttcacgaagataaataagacactccaccaaatatctgagaatgtgaagcagattgagaagcagaagaggaaggcaaaggacgacagccatcttattccactggaatcatggtcagaggaattttcagaagctcaagatcaggttcaaggtggtagttttagtgacagtggattagctaggagaaggtacaacaaatttcgcagactccgcaggtggttctagcagtctggtggtgggttttaaccacggcggctaacctttacccagaagtagaagtttatacatcatttaggacacactgaggcaaaagaaaggcgattccggtgactaatagttgcaggatggcttcggagcttccctagttccttctgtttatggctgaccctggctcagtttcaggaggtgcagttacatgggtttttctatgagagtggccttgtttggtacaagcaaaataaaaaataaaaaattaggctccgat

SEQ ID NO: 20728 - DNA, 561 bp, Triticum aestivum
  unsure (1)..(561): unsure at all n locations
  Clone ID: PAT_TA_20728
gcacgagggagtgacgcggtcgaggaggggcgtgcggggggcagacagagagggagcgcaaagggacggcggaggcaagctagcttcccgggggcggacgcaccgagagagggcggcgggagggaggaggcgcgtgggagccatgcttctcccctcttcttcgtcttcctcctacgaccccaaaggtgactcctttgggaaatcggttgacgatcatatgaggtcaactttgacttttggtgataagcattctgtatttgcaggtcaaaacactgactatggccacccaatggcttgcatttcatacccgttcaacgattctggttctggagtttgggcggcctatgggtcacgggctatgttccagcccctcatggccgggcggaggggcatctgcgaccgcaagagttccattgcccgtccgaactagcagcggatgagcccatatttgtcaatcccaaacaatataatgggattcccccggcgaaggcagctgccccccaagttagaggcccagaataaactccccaaaaacaagaagccctacttccaagatcnngc

SEQ ID NO: 20729 - DNA, 549 bp, Triticum aestivum
  unsure (1)..(549): unsure at all n locations
  Clone ID: PAT_TA_20729
cgaaagcagaggaataccgcggcgccaagggtggctttcctcctcatttctttctttcttccgcgttggttgatcgtctgcgcctcaagcgtcatgtcgtcgtcgttgcttgcctgccctggaagctgccatggtggaagcaagctggcgacgggcagcggccatgcccgcggccggccgcaccggccgcccgtgtgagtctgccttttgtgcggtctttgctttccgcctcttgcggaaatggtccgatcgatcttcaaagctttccgctcatttcttgtaatcctgtcctcccgtccgtaaatgtccgcctgattgttttgatttgttggttgctgtgcattttctccttggtgatcaacttggccgtaatcttttcttcggtgatcgaatatcttttgaagccaacgtcaaagtataanaaaaacaanngngaaaaaataaaaaancnaggggggccggtaccaattccccanatgatctatanccgccacggcgtcntttnaactcttacnggaaaccgggtacaactaanccctgagaaacccn

SEQ ID NO: 20730 - DNA, 501 bp, Triticum aestivum
  unsure (1)..(501): unsure at all n locations
  Clone ID: PAT_TA_20730
gcccgtaactcctgcccactctgccgttatgagctcccgacagatgataaagattacgaggagggaaagcggaatgtgctggatgtgagcgaggatagctcctcctctgatgatggtacagaatcgggggaagaggaatatgtagagagaggtgagagcgagtctggtgtgagcagagtcagcagaggaagatggctgtttctggctgctgcaccagttgtgagtctggtgggcgttgtgttggcaatgtggctaagcagcccacacaggaggggtatagcaatctctcatagccaaagggagaacagaaccagaagatggctgccgtttttctgactgatgcccagatcccgaggtgcctncagaatctgtatttttttaagacccttaaaagatacctgagtttcgtctgctgttatcgacttggtactgtttcacacattagtttttgcgttaactaaagtggctggtgtgcgcggtcaaatatatctgattatcaag

SEQ ID NO: 20731 - DNA, 799 bp, Triticum aestivum
  Clone ID: PAT_TA_20731
ggcagcctgtccgctcgtggatcgatcaactagccagccaaggagcggagtgagagcgtgaggaagatgttcgggtggatgacgccgccgcagctcaaggggaaggtggtgctcatgcgcaggaacctcctcgacttgaaccactggcagcaacccctcagccacgacacctgggacgaggtcaccaccaaaggcgtcacctgccagctcatcagctccaccgtcgccgaccccaatgacgagagtggcaccaggggtctcttgggcgaagaggagcgggttgaacactgggtgctccacttgcccccgatcaaccacggcgataccacctacgatgtcacctttgactgggacgtgaagaagcaaggcattcctggcgccgtcatcgttcgaaactaccacgccacccagtttctcctcaagaccatcaccatcgacgacgtccccggccacgccggtcccatcgtcttcgtcgcaaactcatgggtctacaacaccaacaagtaccactacgaccgagtcttcttcaccaacgacacgtacctgccaagcgagatgccgacgctgctgcagccgttccgggaggacgagctccggatcctgcgaggggacgaccccaggcagaagaacggcgcctacgaggagcacgaccgcgtctaccgctacgacctctacaacgacctccgcgatccggaccacaagaaccctcgccccaccctcggcggccccgacagcttgtacccatacccgcgccgaggccgcaccggcaggaagcccatggtgaccgaccccacgtgcg

SEQ ID NO: 20732 - DNA, 771 bp, Triticum aestivum
  unsure (1)..(771): unsure at all n locations
  Clone ID: PAT_TA_20732
cccggacggaggctcgcaaggctgaaactgcaatcccggcaacggcaaggcttctctttagttagctagcgtagcagacttctgttctcatactggccttgcgtgccttgcacttcttggctagcgcagaggtcggcaaggttgaaactgcaatcccggcgacggcaaaggcttctctttagttagctagcgtagcagacttctattcatatactgttcttgcgtgctctgcacttcttggctagctagctggtcggccatggcggatcaccagaggcagaggatccacccggtggacctggaggcgggccagccgaggccctcggcgccgctggtgccgccggggagctcgttccggtccgacaagggcgaccctgccgcggccccggacaggaggccgccgcaccaccagccgctgcccccgccgaagcggcgcaggggctgctgctgccgcttcatctgctgcgtcctggtgaccgtcatcctgctcgccgtcctcgccgcggtggccctgggcgcgctctacctggtgttccagcccaaggcgccccactactcggtggaccggctgtcggtgtcgcagttccaggtggacccgaccctcacggcgagcgcgcggttcgacgtcacggtgacggcggcgaaccccaacagccgcatcggcatcttctacgagcgcgggtccagcctgagcgtgtggtacgacacccaccggctcgcccagggcgcgctcccgcccttctagtcccccaaaggcacacgnnnnngctg

SEQ ID NO: 20733 - DNA, 855 bp, Triticum aestivum
  Clone ID: PAT_TA_20733
atccttgtccccgtcccctctctcctttccccaacccaaaccaggagcgccctccctccctccccacccaggtgagcctcgattctccgtcgatccgccgccgatccgccgccggtccgcccgattccggcccgccccgcgcggatccggcccgtgcgctcgctgatttcgtgtttttcggcgcagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccactagagttatcccaagtttcacttcacatcgtgatgggtgtttacctttttt

SEQ ID NO: 20734 - DNA, 870 bp, Triticum aestivum
  Clone ID: PAT_TA_20734
cccacgcgtccggagaagagttattgcagagctctccaaggatgaaaaatgttgcgtctgagggtcctgggggctcatcagaatgcagcaatgttctatctacccaagctgaaggtagagagttgtcaccctcaagcatccaagacaagagtggaatgtctgaagcaacttctttccaagaaccaactcctgatcctctgccaggggctgaggctgacaagcatcccatttcaaccagcgagccggaaattattgacaagtctgtaattgaagaggagctggtggtgaatactgaaatcaagaatccgggtgacaaacccaacctgtacaccccggaggatgacgacgacaaagaagtggaggattggctagaggacatggaccatgccgacaacaaaacaggcaatatcacctcggttgggcaggacgaagacgtgtcattcagcgacctggaggatgacgatgatgattaagggttgcctgctggtatataccgagcccagtgcctgatacatatgctgcggcttcaagacatacggatacggtcgctgttaaacgaaggatcgtgtctccgtagccactacaaagcgaacagagcggaagcagaatcacgacaagttgataagtgtatgtctctggggctttgctttctggattctagttgcacgtttacttgtgtgccgtcatggtctgtacatagaaacactagccgtgcgtgtgcaactaccgcttttaagccgcgtcgatgcaagattctgaatgtagatatcagaacatgttttttttagtgaacgcacaatacgacaggaactaaagctgtcagatatcgtgtaaccgttcaagttcaagtaaaactcgttttgtttccgt

SEQ ID NO: 20735 - DNA, 1074 bp, Triticum aestivum
  unsure (1)..(1074): unsure at all n locations
  Clone ID: PAT_TA_20735
tgcgcgtgccggtaccggtccgccgtgtcgacctcaggcgtacgcccacgcgtccgcggacgcgtgggtgttgtcgaaaaaaaaaaagcccttgtccccgtcccctctctcctttccccaacccaaaccaggagcgccctccctccctccccacccagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccactagagttatcccaagtttcacttcacatcgtgatgttgttttaccttttttttcttgtcgtcgtcccgctgcctgctataacggacagcgctccctgttggcgccgccgccggcgggggtggtgccctggcggcggagggtgtatgtcctctgccgccgggtgctcccctgcttgtacctagatggttggttactctttccgtccattgtcaccggctaacattgtgataatatcagtctgggtaatgttagattaaagttgttcaaaaaaaaacaaaaaaaaaaaaaagaagtntat

SEQ ID NO: 20736 - DNA, 968 bp, Triticum aestivum
  Clone ID: PAT_TA_20736
cgtccgcccacgcgttcgccagcctcccatcgtctcctctctcctttccccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggaagatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataaggagcctatccatctccactagaattatcccaagtttcacttcacatcgtgatgttgttttacctttttcttgtcattgtcctgctataacggatagcgctccctgttggcgccgctgccggcggggtgcccttgtgttggagggtgtatgctcccagcgccggggtgcccctgcttgtacctagatggttactctttccgtccaccattgtcaccggctaacattgtgataatatcagtctgggtaatgttagattaagctgttgtcgcccaaaaaaaaaaaaaaaaaaaaaaaaggccccta

SEQ ID NO: 20737 - DNA, 3418 bp, Triticum aestivum
  unsure (1)..(3418): unsure at all n locations
  Clone ID: PAT_TA_20737
cgtccgctccactgnggcacgagctcccggcgatgtcgtggctcgcgcgctccattgcggccaccgtcttcttcgcccccgacgacgacgaagactaccactccgaggcggtctccggcgacaaaagcccggatcacgccgccagcgccgacgacgaggaggacgagcagccggacacccccggccgtggggtcaagggcgacatctccgagctgaccgagtctctcacccgacgcttctggggcgtcgccttcttcctcgcgccaccgccgtcggccggggccgaggccgccgagacgtctaccccacgcgtccgggcggaggcggagggagagtatgggccccagtccccgcgggtcgccgggatccggaacgacctggctgagatcgggggcagggtgaggagcggcatctcgatgctgtccaacgccaacgccgtggcggagatctccaagatcgcctcgtccttcctgcctttcgtgccggaggaagagcgtgttgcgatgtaggagttggagttgtatctagaggtggtggtgttcgtcagacacatctcgacctctcccgagacgtggctcgattcccccctcttcgtcaacgaccggcacgccgatgattttgaactgtcagatacacaatatgaacatgcattggctatagagcgtatagtaccaagcttatcatatctcagaaccgaactttgttcgaccaatatgagtgaagcatgcttttggaagatctattttgtgcttcttcactcaaagctcaacaaggaaaatgctgaagttctttcaacaacacaaattctggaagcaagagaagagttattgcagagctccccaaggatgaaaaatgtagcgtctgagggtcctgggggctcatcagaaagcagcaatgttccgtctacccaagctgaagatatagagttctcaccctcgagcatccaagacaagagtggaattgctgaagcaacatctttccaagaaccaactcctgatcctctgccaggggctgaggctgacaagcatcccatttcaaccagcgagccggaaattattgacaagtctgtaattgaagaagagctggtggtgaaaactgaaatcaagaatccaggtgacaagccccacctcgcctgcgtctcctcctcctttccccaacccagacccggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggacccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaagggccaattcgctgcctacaacaagggcgagagcgctgctgctagctcgccccaaagaaggctcgcggccaaaggaggtgagaggaggaagatggagtggaggaatctgacaagtccaaagtcggtagatcaatgacgacgatgacgatgagggcagcggcatgaggacggaggacgcatgacgtagtgaagaagacgcatcttgtcaaggctgctccggcggacaagtcgggagctgctgtgcgagaacggacctgagctgtgtgcggtggtgtcataaggagcctatccatctccactagaattatcccaagtttcacttcacatcgtgatgttgttttacctttttcctgtcattgtcctgctataacggatagcgctccctgttggcgccgccgccggcggggatgccctagtggtggagggtgtatgtcctcttccgcggggtgcccctgcttgtacctagatggttactctttccgtccattgtcaccggctaacattgtgataatatcagtctgggtaatgtttagaattaagataatatcagcccctggcgtaatgttagaattaagactgttgtaaatgcccgaaaagtctgtaattgaagaagagctggtggtgaaaactgaaatcaagaatccaggtgacaaacccaacctgtacctccccgggcggccgcccgaccacgtagttgcgggttggccagaggacatggaccatgccgacaacaaaacaggcaatatcacctcggttgggcaggacgaagacgtgtcattcagtgacctggaggatgacgatgatgattaagggttgcctggtggtaaataccaagcccagtgcctgatacatatgctctgcggcttcaagacatacggtcgctgttaaaacgaggatcgtgttgaacgtttacttgtgtgccgtcatggtctgtacatagaaacagtagccgcacgtcacttgtaagctgtgttgatgcaagattctgaatgtagatgccaaaaacatgtttatttttctagtgaacgcaaactacgatacggaccaaagctgtcagatatcgtgtaactggtcaagttcaagtgaactcgttttgtttcccttgtccgaatcggggggggccccctagcaaggcaggccattgttgaagggcgctttttttgttgccccaaagaaggcttcggccaaggaggtagaggaggaagatgaggaggagtccgacaagtccaagtcggagatcaatgacgacgacgatgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtccatctccactagagttatcccaagtttcacttcacatcgtgatgttgttttaccttttttttcttgtcgtcgtcccgctgcctgctataacggacagcgctccctgttggcgccgccgccggcgggggtggtgccctggcggcggagggtgtatgtcctctgccgccgggtgctcccctgcttgtacctagatggttggttactctttccgtccattgtcaccggctaacattgtgataatatcagtctgggtaatgttagattaagctgttgtttgtgtcccaaaaaaaaacaaacatcaccctatgccatttgttccggtgcaagggtacggagctccacctggtgcgtaacctcaccccggaggattgcctccaactcggttgtcactagaacattaccaagttaacgtgtgctggttatgccgtcgatgatatatacacgaacaaagtcttcaaagaaaggaaaaaaaggtaagggtggtggcttc

SEQ ID NO: 20738 - DNA, 861 bp, Triticum aestivum
  unsure (1)..(861): unsure at all n locations
  Clone ID: PAT_TA_20738
gccccctcgaacgcaggcgcggcgacggcgacgagacgaagcctcgctccaccgcaccgccgcggcctcgtcgtcttactctgctccggcttcctctcctctcttccccagatggagcgctgcgccagccggacctccgcccggccgccacatccccagcccgctcccgccccagccccaaccccaggccgtggaatatgcatgatgagcaccgcgtggagagacaagcaggaacaccaccttatcaacttcattggcgcgttcctggccgccaacttgtatcgcctaaacttcctgtcgatatctcctgacttcatcttcaacaatggggggctatcagttgctttcatctttgagacgagctgggattgtgggaatgcaagctgctgtttttagcagggtgaatgcattgaagaggcagttcaaaaaatctctatgtcgtttgtccctgttccaacggtggagcaaatcgaatcgtttaatcagtcctaattcaagtatggcatggagcttggtcccctacatttgtgtctgttaacgatcagagatgggatttgagatgatgctcaagantgctcaagcccgtggagtatgcaagcaacaagncatnactcaacaatgaggaatgancgggagcaaacanttaagtgaatggatgccatgtacantgccactcaatcctggaatgatgatnacatgcaatatgcttgccaagctattggtccattaagcaattnaaagcatccgaagttnatccanaaaaacgacctctcagataaggaggaaanttncagttctcagnttcnatttattaccnaannataatttttcgggaattaggcattggacgancgncggaaa

SEQ ID NO: 20739 - DNA, 1871 bp, Triticum aestivum
  Clone ID: PAT_TA_20739
ccacgcgtccggaataattctgatagtgatcgagaagtttctgttgattctgagagactaggcccccgttgcagatcttttgaggatttatgttcaatggacggtgaaaaggttgattacttgagtggcgatgaaacaaatcgctcgaaatcaaatttgcatgtgctttgtgctggaccttcttcgccaggtatctctgaagcattaggcttggaggattgttcgggaggtcgatctggtgctgctgaagatggccaacggtcctctgcaagtgtggatggaaattttgtgagggatgggatgctaagtcatgactactgggatggcaaatatattgctgctgataacaaagcttatccagttgccgcttgctgtgccgattcagggcataattgtgtcatcaatggtgctttagatcaagaaagcaaagagaaattgtggcacagaaatagtgatctctaccatgagtcacttggcattgacatgcctaatttgaagaacctgtctgactcgaaggatattagtgaggaagctgaacacaatgaaactggaatgaatggtgatcagcattttgacgaggacctaaatgaacttagtccaagagcttacagcattaaaaggatcgaggattggatcagccgaattgatattgacagtgacattattgtggaggagcagggagaaagttcaagttctgcatcaacaaaatatagcgagccggtgatcagcgtttctgctgtgcgccctgatgctaaaagtcctcttggcatggagatagcttacacttatatttcaaaattgactcctgtttcttcatccgcacaattgccaaaccttggtttggttgcaatcccaagactgagcgcgttctcaggcctacggctgttgaacttatcagggaattcaatagtgcgcgtaactgcaggagctctcccgaaaggtcttcacatgttaagcctgtcgaagaataatatctcgattattgaaggccttagagaactaacacgcttacgtttgctggacataagctataataggatctctagaattggccatggtttggcttcatgttcttctttgaaggagttatatctggctggtaacaagatcagtgaggtagatggtcttcaccgccttctgaagctaaaagttctggacttgcgccacaacaagatctcaacatccaagggccttggtcaactggctgcgaactacaattccctcgaagccatcaacctagatggcaacccggcacagaagaacgtaggtgaccagcacctgaagaagtacctgttaggcctcttgccaaaccttgctgtgtacaacaagcagcctgtaagagcaactggctcaaaagaggtctcggaccgtcacacacgcaagatctcttcttcccatcgttctgaccgcagttccagatcggaccgcaaatcttccaggttggtggctggcacatcttcacggcatgcccgtcctgcacatacttcaggccctttggtgaagcagtcgaggtcccggaacatgccaatggcggcgctgggctctagaccagtggaatatgcaggtgctggagttccagcgaagcaaattcagatggaggaaaaatcgcagtgagatcatccgagcaaagctgcctagccagccaaggcttttgaacaaggatgttgcaagttttcctgttaagtttgtaaaataattaagctcaaacagtatggtgaagagcacttttcttatactgctaaagacatgtattttttttagtcatagtactacgtggcagtgtttttgaataagagtacacaggaatgttgtaagacaaaacacaaatacctctgaattgaattggtaccgtcagtcggatgtttttgtct

SEQ ID NO: 20740 - DNA, 443 bp, Triticum aestivum
  unsure (1)..(443): unsure at all n locations
  Clone ID: PAT_TA_20740
gcacggtgacttctgtggcaacaatgacggcggtgagcaatgtcggaggcatggtctttggtcgcggtaggcggccctcttcgccggcgtggccgcgcgcgcgcctcgactgcccgtcgcggtgaagtcgaagccacggtggggggccggtggtatacgatgacgcgcgacagatggttcgttcggtgatcctccgtgacgccaaccttgctttgtcttcgtagttcaccgtcggagtcggagctgcgctgtctaagtgtggtttgtatggagtgttgtgctgcagttgttagggctcttttttctttctcttttctctttctttgatcttcggatcgcttggtcctangaccttcatcatcttgttgttttccgttgctctctgctattatcaatgaacgcaactttgctggatcttcaaaaaataaaanaaaaaaaaaaaa

SEQ ID NO: 20741 - DNA, 759 bp, Triticum aestivum
  unsure (1)..(759): unsure at all n locations
  Clone ID: PAT_TA_20741
ctcaagacggtctcgtccaacgccggctccgtcgcctccacggtgcgctccgccggggcctccgtcgccgcctccatcgccccccaggccgaggacgagaaggaccaggttttgtgggctggatttgacaaattagagcttcgtgcgtcatctttcaagcatgttctgctcgttggctactctaacgggtttcaagtgcttgatgttgaggatgctgcaaatgtttgtgaattggtctcaaaacgcgatggtccagttacctttttacaaatgcaacccacacctctttactctgaagaaactgaaggatttagggcatcacatcctatgcttctggttgttgctgggggatgagacaaatggcttgggctatgggtcaaggtggggccgtttaagtgcacggatcaagggatacaagcactgaacctcaaaccgggaaactgcatctctaccccaacagttggtcgctccactccttggagcccacacctccgtactcgcctcttcgcccggccggctgtatgtcattcgttccccccccgggccgtagcgttcacgtcaanacaaccacgctngagctgtacctggagaacattaactctgtcataccttanaaggnactggggaaaatgggtangccaatgtcgttggtcaanaggtggttatccccaaggccgtttacacacggtctcnancanaaactaactttcaagatgggcacaatccaanangactatncaaatnatggtcatacaaacg

SEQ ID NO: 20742 - DNA, 511 bp, Triticum aestivum
  Clone ID: PAT_TA_20742
ggcaagccgtccaccttcgcgacgttggagttctgggcgtggggcgccgtcttcgtcgccgccttcgccacggcgttcgtgaaccccacggcgcttggcaccacggccaggacgtgcctcccgttcatgctcgcttccactgtactgggatacatggttggttctgggttaccgcctggtatcaagaaattgttacacccgatcatctgctgcgcgctttccgcaaatttgtcggcggtcgcatacgggtacctctccgggtccggaatcgatgctgcgctaggtgattacctgacaaaggtgccatcaaatcctggagctggtgacgtgctgatgggctttcttgggtctgtcatcttatcatttgccttctcaatgttcaagcagagaaagcttgtgaaaaggcacgcggcagaaattttcacgtctatcgcgattgcgtcgacattcttcctgtactccacggccattctaggacgcctgattgggctggagccaacattgaccatct

SEQ ID NO: 20743 - DNA, 670 bp, Triticum aestivum
  unsure (1)..(670): unsure at all n locations
  Clone ID: PAT_TA_20743
cataaaattaaacagacaaggagcagaactcgccacgggcccaaccctaagcatgtcaaatttatacatattattcatgtttttcttacttattttcttggggttgcatctcgcaatataatgcgtagattgattttgttatatttggacggggtgtttcggagccatggaaaaaaattgtatatcctacggggtttggttatagcaagataatattttgcaacgaataaaaaaaactattatgtatttcagactaactgtccatctagttttaactaatatacaagatgaacaagccgagaaaatctgttttaagtcgccaagtctattaatatgttctaagtctatgccatgcgctacaacttccaagattaaggcaaggagacaaaacaatgggtgattatttcaataaaataaaacattatcaagtgatggcaaatagtagagctgatcttatatcancctgttcatcgaaggggtgatgggttgactgatgacaggagctggagngacgccatcacctctanaggtgattgaacgtagagatacaaggtcgcntgtagatagactttccccatcaaatattaagcaatatgtcaacgggctgttaaaacatgaggcgnggaaataataattaagttgtttggaacagtccnttgggnaacgcaat

SEQ ID NO: 20744 - DNA, 403 bp, Triticum aestivum
  Clone ID: PAT_TA_20744
atggctatagtgagtcgttcatccaagcatgcgggcgtgatttgcttctctgctgccaaatgctccttaagatcatggttatactgcgcaccatggcttagggcggcgcttaattggtggaggggtcggtgatttgggtggaaggtgttgcgccggcggtcggggcatgtgggatgtggaaggaggaggaggatgggggtcgggtgtggattacctgcctggatagacgaggccgagcagcatgagcgagggtcaccggcgaggaggcggcgctgcaagcaaggagtgaaggtttcaacttggaaaggaacgcagaaatacgggaaatgtggcttttgataagggggggggcacggatgtagatatttctgcggaagccgaaacatttggaatcccttcagcg

SEQ ID NO: 20745 - DNA, 444 bp, Triticum aestivum
  Clone ID: PAT_TA_20745
cctcccagctctgcttttgcagctgttctgtgatgagcagagccagagctgcctggccttgccctcctcctgccggtcgaggccggaacggacagtgatgagtgcacggagtcatgcttgtgagactcggattcgtggtattagcaaccttcgccgcgttcactcttaagcgaggcaaggggcctaagaaagacaatggccaagcgggcaagaggaaggagaaggctcggcatactggacatggggagaaagaagacgaggaggaagaggttaagacgatcagcggcataatcaactcggccccgtcggtggacgacgacgatgaggacgacatgttctcggagatcgagagcctcctgggcggggaggtcgacatcccgataccgggtgacaggtacgacgtcaaggagcggtcccggtacaacgcgcacatggccaacaacg

SEQ ID NO: 20746 - DNA, 385 bp, Triticum aestivum
  Clone ID: PAT_TA_20746
ttttaaaacaaagatgatcatcatactctaaagaaaatgtcaccaatgcaccatccatgattcaatgtaaaaatacattatatgccatcttgcatcttgtttggtacaccggcaagcaagcaaaaatgtaaacgaaatcacacggtgaccttagaactattctaacaacatgatgctctacaagttaacgctagttgcattaatttacacaacaagattagggcattagtcacttgctgtcagccgtgcaatgctggagtagctcctctctctgtctgccactgtgagagctccacgaatatttgtaaactatagggcctctctcaccgagcttcacccgagagtaggtgatactgaacagctccggcggcgaagacccggtcgc

SEQ ID NO: 20747 - DNA, 495 bp, Triticum aestivum
  Clone ID: PAT_TA_20747
aattttctcctccccatcccctccatccctcgaaccatccgcccgtccgtcggccatggccaccgccgccgcgtcccaggtggccttctccgcgcccgttcggaccgcgccgtcagtggttccggaatccagggcatcaacagtctcagcttcggcaacaaatcatggatcggcaccgcattggcgtgcgacagcaaggccgcggcgcagccgaggcatctctgccgggctgtccagcagtcgagcaagagcaaggtttctgtcgcgcctctcgacctcgagagcgccaaggagccgccgctcaacacctacaagcccaaggggccttacacgggcaccatcgtctcggttgagcgggcggtagggcctaacgccccgggagagacgtgccatgtcgttatcgaccatggtggcaatgtgccgtactgggaggggcagagctatgggatcattcctccgggagagaacccaaagaagcctggaaacccacagaat

SEQ ID NO: 20748 - DNA, 1579 bp, Triticum aestivum
  unsure (1)..(1579): unsure at all n locations
  Clone ID: PAT_TA_20748
cacggctcgggcgaggccccccccctccccccctccccccttcctccctcgaaccgcccgtccggccgcctcccaggtcgccttctccgcccccgtcggcggctcggtccgcgccgtccggggcctcggaatccgcggtatcgagagcctcagcatcagcaacaaaccatcgaacggcagggcatgtagcgtgcgacagcacggcagcggggacaggccgcacgcgcgccgggagggcggggcaggactgcagcgggagcaaggcctcggtcgcgcccctcgtctcggtcacgaccacggagccgccgcgcagcacctacccgccaaacacaacctacacggccacggctccttcgttcgcgaggatcggtcgctctggcgccccgctgtaggagcgacacgccacaagcgacccgagccatgttgtaatctaccgtggtggcaagggcccagacagggaagggcagagctatgagattatccctaagagggaggaccaaaagaagactggaaagccacagaatgtcaggttgaattcctttgcagctactaggcactgggaattcatttgtttggaagactgccagtcaatgtgttcgccgtccagtaaattagggtcaggaaagaggcaagggagacccctcgaagaatgtcttacagctcaatgaagtacgaaaaacggcgcgtgggaacatgattcaggagtcagagctcttcggccaaataatgattctccctggctgtgagacgaatgcaaccaaaagccagatcacaactggggactggttcttgctctggtgcacaattatcaaacacgcatgtgagaggatcatgagacaattttcagatttcgtggcctggcttggctcttgcttggtttggctaattcggacagccttctttatgacgaagaattcacaagctacctgaagcagtatccagacaatttcaggttcgacaaagcactaagtagggagcagaagaacaagagtggcggcaagatgtacgttcaggacaagattgaggagtacagcgatgagattttcaagcttttggatggcggtgcacacatctacttctgtggtttgaaaggaatgatgccagggattcaggatacactcaagaaggtggcagagcagagaggggagagctgggatcagaagctatcgcagctcaagaagaacaagcaatggcacgttgaggtttactaggatcggaaccgttcagttatctatgatttgctctgctgtgagacgatgtcagaaaaaggcagaacacacacatgggatgattcttgtgatggtgtagaattatcaaacattatttttgagagaatcataagactgtccatgtaattcataagcttctgcatcacatgatgcgtgaaacgaagcatgtaacttttgttcctataatttcttgaggtgttttgtctgaagccgaatttaagcacctgtcctggttgttcatgggatgaagtgcaatactatattgtagattgttattcattcaaatattcagagggcatatgcatattctgtgcgtcttcataattttctangaaattctgcnatttcaa

SEQ ID NO: 20749 - DNA, 542 bp, Triticum aestivum
  Clone ID: PAT_TA_20749
tgttccgcatttatttctcaacacttcacacgcgcaaatatccttttctggaggcatcttccaagccaattcgctgtatatcccgaggccgccccagccgtccattgagtgctgcaaagcggacaagttctgcaacagtcgatgaaattcacttgcttaacaatggacaagggcttgatcgtgatggcaaagcaaatgcttgctcactgtctcaggatcaaagttcagtggcatgtttgcatccatccaagtttctcaaggtagaaggcgatggaacagagactcacaaaatggtatcccagagtaagcaggctagaaagatggtagtggaagcacaaagtgtcagaactgaatctacgatgtcagactccgacagcattgatgcgagaagttcttggagtggatcagataaggatgaagctgaaactctttcagatgctatgatcttcagatattgtctagaaggaacgtatgagcggtcaacatttcttaaaagcgcagcttcttccatcattgtggacgatttgatcacacttgcaaat

SEQ ID NO: 20750 - DNA, 551 bp, Triticum aestivum
  unsure (1)..(551): unsure at all n locations
  Clone ID: PAT_TA_20750
tagtagcaactctatactatatcaagatgaatctcgccaaggagaaggtgaaggacgcggcaagcgcggccaaggccaaggccaagatcacgcaggctaaggtagccgagaagacagaagcggcgacggcgaggtcacacgacgagcgtgagctggcgcacgagcggggcaaggccaaggtcgccgccgccgaggcggagctgtaccaggccaaggtgacccaccgcgaggaggccatggagcaccgccttcacaagcgcgggcacaagcacggcggcggtcactgatgtgagcctgacggctggccgtaaggctatgaagatggactgtacatgcatcgttcatgcgagcaagccagcctatactggtttctactgtttttccaaaaaccaaaaatcccattgcaaatctgtgttgattgacgtcgggcttaatttggagaggtgacagctgcctgccccatgtgcatatgtatatatgtactgtagtctatccttttggctcctgatcntgaataattaatactgcctttcatagtcataaaaaanaan

SEQ ID NO: 20751 - DNA, 762 bp, Triticum aestivum
  Clone ID: PAT_TA_20751
cccggcgcccccccgcccgcgccccccgcccgccgccgccgccccccgagccggcttccgcggcgccggcgacctgagagggagggagaccggagcacgggtaaagggaggcgggagcccggtgcagaccgccgctattcttctagacctagagacgtcggggggtgcgggcttggagaatgcggagtgaactgctcttcttctcgtcggggaggcggggacccctgtgaccgggtctactggctcatctgggggttcatgctctgcgcgatctgggtctactcctatatggccctcgggctctacttgatgttcctgcacggggcgccatgggcccccgcctgtatcgacgaggggggcgacagagagggggcgcgccagggccataggacgcggagtggtgtttcctgagggctggacggagagcatgcctggacgagattcagcccgcttggttgcttatcttgaggactgtttcatgcctgtccatggcgtgatcgattctgcttggctttttgctttatggattgtctcgctcttttttatgcattcagtgcttgtctctgatggtattgtcgttggatggggcgtgttcctttcttactctcagtggaccttcttccttgtcaccttgtattttggacttggatcgaaacattcgcacttggaaaataacacgaacgcaagtaagttcgataaatcattcaaacgaaagtgcttttatgtaactgatcagggccgggaaagcgtagaagacgattc

SEQ ID NO: 20752 - DNA, 571 bp, Triticum aestivum
  unsure (1)..(571): unsure at all n locations
  Clone ID: PAT_TA_20752
gttagccacaacgtaccactaattacttgagaagcaaaccagctagccaacaaggtagccatgggtgtgggtatgggttccaggaagaaggttattgtgtcatgcgccgtcctaggcctagccctgctcgtcgtcggtgcggcggcgaaggacttaagctactgcggtgagcaatctcatgtgggactggcggcccatggagggacaaagggcgacgaagcgaagaaggaggaggaggaattgggctccttgcgatgccagtggaacgtgctggacatgaagatgaagaaaaagctaagaggaagcaagaggatgccgccgtccaccagaccatcgacaacaagatgtgcacgccaaaccattgcagccaaatcaccagcccatttgtcctccggagcatggactgggaaaaggtattaaattacagccgagaatttgattgttcctgcactgcaatacagacatatgacgatcttccaaccctcttttaatgccgccggaattgtcaaatgtacatctgtgtatcatattagattcaaacctgttgtgcaattccatttcangtgttanc

SEQ ID NO: 20753 - DNA, 672 bp, Triticum aestivum
  unsure (1)..(672): unsure at all n locations
  Clone ID: PAT_TA_20753
agctacgggggcatggtggcgttcaagctggcggaggcgcggagcggacctggtgcggtcgctggccgtgtccgggtccgtggtggccatgacagacgccgtgaaccgggagaccatggagcggctcggcgccgggtcctccgcggagctgctcatgccggagacgctccagggcctcaaggcgctcttctccgtctccatgtaccggaagatgtggttccccgacaggatgtacaaggactacctcaaggcgatgttcacgaacaaggaaggagaggctggagctgctgcaggggttgctagacagcaacatggacgcaaagatgccggctttccagcagaagataatgctgatctggggcgaggaggacaagctcttccgacatagagctggccaagaagatgaaagagcagctgggcgagaacgtgctacctgcagggcatccccaaggccgggcacctgctccacctggaagcgcccctgcgcctacaaccgccactcggcaagttcctcgccaactcaatcccaaggaaaccaagcaccaatttaaccgttaacaacatctcgtcgtctanaggaggaggatgattatttgcaaacaaacaagtggctgtcacttaattntctgcaanancgccgcgttcataatgccccaaggcaaccatggntgt

SEQ ID NO: 20754 - DNA, 809 bp, Triticum aestivum
  Clone ID: PAT_TA_20754
cacggtgcaaggagcttaattcaattattcaaatgactgctagtatacaacaaacggacacgtcgcagaaatatccccagtacttcaagccatgcaatatcacagatcgtcctagctatctgagactgtaaaggtgtacatttgatcactcgctcgaaaagaactcgtaggcctcctcgtatttctctagcacaacgttgtagagcggatgaatttgctctagcaagttcgagtatgggccaagcatgtgctgcggcaaggggcatgaaacggaacctgtcattgcgctgtactggctaactgagaggccactcaggcagtagcatgagtgatagtggtctctgttctttccaggtttatccctcaatcccccctccggcacctgtgcacaaagcaggatatattgttgcagagcaatgttgtggaacagcggacctatttggttgctctgcttcataaaatcaaatccaatcttcgcataatccacaacagaagatttttctgaagccaatccagatgagctggtcccacaagaatcatctaccgaggataatttgctgggctgtgattgtttagattgttcatcagaccctgccattagcttttgagctaaagcaatagcagctccctgccaaaaggagtagcaaccatcaaccaatttatttgtccgtccttggaatccgcattccactccttgacgaaatgccacccagccaatcaagctaggcaaatcgagtttctccacttcattaagcaggaccattgcagccagcccacaaaaagtgtacccaccatgagctcagcagaag

SEQ ID NO: 20755 - DNA, 2843 bp, Triticum aestivum
  unsure (1)..(2843): unsure at all n locations
  Clone ID: PAT_TA_20755
ccacgcgtccggatgtgcatgtccatgtatcgtcatccacatgcgtcaatgcagatgcatgtgaaacttgaactggggtggcttgttgcttcctgaagggggtgcaatctttaagaaatacatttttttatcctggtttactgtactgctttaacctactgctggagtcctatggactaactgttgcagaactgttttgttttcagggtatttctttccaagtgttacgccgaagagtcttcttatctggatctgcggccaggcgacgtaagggcagaacagcatgttaatttcgccgcagctgataatatgtgaaatcaagtcgttagtagcgaagacaataaaatcacagtagcaccaatatcatcttatttatcatgtatatttggttatgatggccagcctctgctgtcaaaactgttttagcgatgttttgtaacgctgtacaccttcaagcgctgttcgtcagagtaagaagtcctggcaagctcggcacactggtatcaagattgttcagcagattgctattctcatgggctgcgctgttctgcctcaccttaagaacctagttgagatcattgagcatggtctaagcgacgagaaccagaaagtgcggacgatcactgccctatctcttgctgcacttgctgaagctgccgcaccctacggtattgaaagttttgatagtgtgttgaaacctctctggaagggtatcagatctcaccgtggaaaggtccttgctgccttcttgaaggctattggtttcatcatccctcttatggatgctctgtatgccagttactacacgaaggaggtcatgcaagtcctgattagagagttccagtccccagatgaagagatgaagaagattgtcctgaaggttgttaagcagtgtgtcagtacagagggtgtggaggctgattatatccggagtgacatccttccagacttcttcaaacacttctgggttaggagaatggccctagatcgtaggaactataagcaacttgtggaaacaacagtagagatggcaaacaaggtgggagtgactggtatcgttgggaagattgttgaggatctgaaagatgaaagtgagccttacaggagaatggtgatggaaacaattgagaaggtggtggccaacttgggtgcctcggatattgatcctcgtctggaggagctgcttattgatggcatcttgtatgctttccaagagcagacaagtgatgatgcaaatgtcatgcttaatggttttggagctgttgtgaatgcgctcggccagagggtcaagccttaccttcctcagatatgtggtaccattaagtggcggttgaacaacaagagtgcgaaagttaggcagcaagctgctgatctgatctcaaggatagctattgttatgaagcagtgccaggaggagcagcttatgggtcacctgggtgttgtgctatatgagtacttgggagaggagtatcctgaggtgctgggttcaattctcggagcgttgaaggctatcgtgaatgttattggcatgactaagatgacgcctccgatcaaggatcttcttcctcgtttgacccccatcttgaaaaataggcatgagaaagtccaagagaactgcattgatctagttggtaggattgctgatcgcggagcagaatttgtaccagctcgggagtggatgaggatttgttttgagttgctggaaatgttgaaggctcacaagaagggtatcagaagagccactgtgaacacatttggttatattgccaaggcaattgggccacaggatgtgttggccactctgttgaataacttgaaggtgcaggagcgacagaaccgtgtctgcaccactgtagcaattgctattgttgctgaaacttgctcgcctttcacagttttgcccgccctcatgaatgagtaccgagttccggagctaaatgttcagaatggtgtattgaagtctctctctttcctctttgagtatattggcgagatgggcaaagattacatatatgctgtcactcccttgctcgaagatgccctaatggacagggatctggttcacaggcagactgctgcatctgctgttaagcatatggctctgggagttgctggcttgggttgtgaggatgctcttgtccatttgcttaactatatctggcccaacatattcgagacatctccccatgttataaatgccgtcatggaggctattgaggggatgcgagttgctctaggtgcagctgtggttctgaattattgcctccaaggccttttccatccagcaaggaaagtacgtgaagtatattggaagatctataactcgctgtatattggtgcacaagatgcacttgttgcttcttatcctgcactaggcgatgatggagacaatatcttcagccgtccagagctagccatgtttgtgtgatcaatatttacatatcctgctttgtgaagacttcacattttgaggagtatcttatgtccagggtatttctttccaagtgttacgccgaagagtcttcttatctggatctgcggccaggcgacgtaagggcagaacagcatgttaatttcgccgcagctgataatatgtgaaatcaagtcgttagtagcgaagacaataaaatcacagtagcaccaatatcatcttatttatcatgtatatttggttatgatggccagcctctgctgtcaaaactctgttttagcgatgttttgtaacgctgtaaaccatcaagctctgtactatgtgtgctgccgcgcgactatgtctagaatgcttgcatagncttgcgttgttttgcaccttttcgtgttaaacgggacnatgttcttcagtt

SEQ ID NO: 20756 - DNA, 1060 bp, Triticum aestivum
  unsure (1)..(1060): unsure at all n locations
  Clone ID: PAT_TA_20756
caacattggagaatggtgtattcttgacagtgaagtggctgagagaaggtgttgcgaggcccaagagagagttcaccaaggaggccaagaaatttgcaaacatccggcatcccaatgtagttggcttgcgtggatactactggggtccaacaccacatgagaaactcatcctgtcagactatgtttcgcccggaagtctggctagctttttgtacgatcggccggggaggagaggccctccactgacctgggcgcagcggctcaagatcgcggttgatgtggcacgtggcctgaattacctccatttcgaccgtgcaatgcctcatgggaacctcaaggccaccaacatcttgctggacggccttgacctcaatgcccgcatcgccgactactgcctgcaccgcctgatgacccaggccggcgtcgtcgagcagattgtcgacctggggggcgctgggctaccgtgccccggagctggcggcatccaagaagccatccccctcgttcaagtctgacgtctacgcctttggtgttgcgctgctggagctcctgactggccgatgcgcgggtgacgtcatcacggggtctgaaggcggcgtcgacctgaccgactgggtgcggctgcgggtggcggaaggccaagaatcggagtgctttgacccggccatggcttcggactcggagaaccagcagggggtgaagggcatgaaggaggtgctgggcattgcgttgagatgcatccgaccggtctccgaaaggcctgggatcaaatctgtctacgaggatctttcatcaatctagctagccaccatcattctgtagctttagagttggatgctcatgtgctgttagcttgtgcctcaaacactgggtgtttctgtaggtgtgtggcatcaacttgatgcctgcaagttcagatggcaatgtctcattggntcccaagtgccgccgtgctgtacttacattgtttattatgggatccgcttttgcaagtanattagcacctttaaaaggangccccaacctgtccttttngaaaacnatttcttccgggtanttc

SEQ ID NO: 20757 - DNA, 415 bp, Triticum aestivum
  unsure (1)..(415): unsure at all n locations
  Clone ID: PAT_TA_20757
gatgcgctgtacatatatagcttggtgctgctctcggcttgttcattgagttatcgtcggtcgttcttaccccgaaagcccgtccgtcgatcatcctggaaacgaagttgtggtgcagcagtaattatcgagcattgtggcggttagaggattgtgggcagcaacaataagcttcttgaactctgaaagaagagaggagggtgtgtgctgantgggaggagggagagtcttcttcctctttacaattttgtctccccttcttcattttagctatttctttatttatttcccccctttcccttctcccagggcttttcgatgatttctttgtggatatgagagactgaagatatgagaaaatcaacaaaaatggattttcgttttgtctcgtgccgggggcccggtacccaattcg

SEQ ID NO: 20758 - DNA, 2314 bp, Triticum aestivum
  unsure (1)..(2314): unsure at all n locations
  Clone ID: PAT_TA_20758
tcgacatgatgtccggcgaggaggaccgggcagaacatcctgaggtccagggccaccgggaaggccgtcctcacgaggccattcaggctcatgtcgaaccacctgggcgtggtgctgacgttccctgtctaccttgtcgacctccccccggatgccaaggtggaggatcgtgttgctgctaccgccggataccttggaggcgctttcgatgtagagtcacttgtggaaaatttgttgcggcagctagctggcaatcaggagctggtggtcaatgtttatgatgtcacaaaccattcaaatcctcttgtcatgtatgggtctgaagtccctcttggtgcaccctcaccctcacacacccgcatactcgtttttggtgatccattcagaaatcatcacatgatatgcagatacagaagcgagccccatgttccatggtctgctattactaccccatctggtgtgttcgttatacttatgcttatcggctacataatatacgctgcgtggaatcgctatgatagcgttacggaagattgccggaaaatggaagcactgaaaaaacgggcggaagccgctgatgttgctaagtctcagttccttgcaactgtttctcatgagatcaggacacccatgaacggtgtgctaggaatgcttgatatgctattagacacagagctgaagtcaacccagagagattttgcgcaaactgcccaaatctgcggaaaagcattgatatccctaattaacgaagtgcttgacagggccaaaattgaagctggcaagttggagctagagtctgtaccgtttgaccttaggtccatccttgatgaagtcgtctctctattttcttcgaaatcaagagaaaagggaattgagcttgcggtatacgcctcggaaagagttcctgaaatcctgctgggcgatcctggaaggttccgtcagataattacaaacttagttgggaactcaattaagttcacagaaaggggacacatttttgtgcaagttcacctggcagaccattcaaatctagcaactgaaccaaaagttgaatcagtcgcgaatggcatcaatggacatatagacgagacaagtgttgtatccacaagcgtgccgcacaatacactaagtggttttgaggctgctgacagcagaaatagctgggaaaacttcaaaggctttgctttcttatgacacaaatngatatggcgtatggaagtgattctgggaatgtcactcttgtagtaagtgtggaagatacagggatagggataccaattcatgcccaaggccgggtcttcatgcctttcatgcaagctgatagttcaacatctagaaactatggtgggactggaattggattgagtatcagcaaatgtcttgttgaactaatgagtggtcagataaactttgtcagtcggcccaatgttgggagcacatttactttcaccgcagtcctgcaacggtgtgagagaaatgctattaatgtcagtaagtctgctttgttgcatcctctgccatccagttttcaaggtctatccacactgctggttgataaaagaccagtaagagcaactgtaactgagtatcatttgcaaagacttggcattgcctcgaaatctgtgcataccattgaacaagcactcagtgttttgcttgggagaaatggcacttcgctacccaggaaacaactttccatgttattagttgagagtgactcatggggcttaaagatggacgtccccttgcgtactagatttttggagatgaaacagaacgggtgtgaatcggtgttccctcaagttattctcctttcattggctgattcagacaaaatgaaagcggaatatggcgttcattctgtcatcacaaagcctctgaaagcaagcacacttgcagcttgtctatttcaatcgcttggtatcagtatcacacaggcaaacaatgagaagaaacatcatggcccggactctctttatgggttgcttcttggaaagaacatcttggtggttgatgacaacaagggaaaccttagagttgctgctggtacactgaagaaatatggggcaaaggtggagtgtgtggagagtggaaagatgcccttgagcttctgaagtccccacaatttgatctctgctaatggatttagatgcagagaggatgggttgaagcacccgcaatacggcattgaacaaggcctgaccgaccacatgctgtattaaaccggacgcacaagaagccatggcttacggcctgcatgactgcagttcagccatctaagatgccaagttgatgatgctctctgaacttnaga

SEQ ID NO: 20759 - DNA, 651 bp, Triticum aestivum
  Clone ID: PAT_TA_20759
ttttttttttttttgataaagcatccacgattgcccccacgagctgaatttgtttctactgcatttacagacgcactttgaagcatggcgttacaataaggaaattaaacactgtttgatcactgtcactgccattgcagaattcaatctatcgacgccatgaatctgcgccgcaacgaaaccatgggaaaccatttacacctgaaaaatgattgactgaaccccagcttgttttcaaaaagaaagccaaccgtggccaacagtcaacccaatatccacccactgaaaccaagaggcacacatatcacatatgtgcgcaaactaaggatggtctgaaagttaagctgcttctcccgaatcacgcatgatcgattgtggcgaccacttcaagatgcaacttcagcttcccggcctttgctccctgcaatgggaagctatcggtgtatccctcttcgatcaaaacctttgtcaaggtcaggatgcaccgtcccatgtaatccctactgaaggtgtcgtgatcataaacttccagcataagcaggtcgtgtgcgcctccctccactccgaggtcttcagtctgggtccgctccggcttcaccctgcctgtcccttccctggtcttgtgctttgtttttgttttcttgagagaaa

SEQ ID NO: 20760 - DNA, 380 bp, Triticum aestivum
  unsure (1)..(380): unsure at all n locations
  Clone ID: PAT_TA_20760
gaattcactagtgattagcgtggtcgcggccgaggtggcggcgcactacggcttcatccccctcgtcatagccgtcggcgtgatcaagtccgaccccaagccctccctgttccagctcctcgccccgttctgatcgatccccgcccccgtccgtccgatcgagagatgcaacagtcagttgtgtccgtggtagttagttatgtcatcatcagtaaaacttgctagaattatctgtgctgcgcctgctattctgctctggatcaaattgaacctgaatcgctgttacatagtactagtataaattataaaatttcggtgatgtttggatgaacaaccaaaaananacaaanaaaactcgagactagacctgcccgggcggn

SEQ ID NO: 20761 - DNA, 624 bp, Triticum aestivum
  unsure (1)..(624): unsure at all n locations
  Clone ID: PAT_TA_20761
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagatatcagctgattgacataactgatgatggatatgtcaagccttctaactgagagtggcaacactaaggatgacctgaactcccactgatgatttctgcttgggcagtcaagacggattgctgatggaaggactgatctgtcgtgattccccatgggtgaagaaagatgcgctgtaaggaaatccgtggtggaataacactgtcgtggtgcctactgcatacttgatcatgctcggtgttggtcaacctctggcacaagcgtcggtggtnacagt

SEQ ID NO: 20762 - DNA, 604 bp, Triticum aestivum
  unsure (1)..(604): unsure at all n locations
  Clone ID: PAT_TA_20762
gccaagatctgctatctgaaaatatccgtgtaaatcattttcggacgcgtgggcggatctggtagttaatttccagaggtgtgcataggctccccgttgttgcttgatttaatcgccgtgcgccatggccggagatgatgaagacgaaggcgaaatggcggcgttgcgggaggctctgcggcagcagagtcttgccgtcgagatgctcaaggccgagctggaggaggagaggcaggcggcgtcgtcgggggccgacgaggcgctggccatgatcctgcggctgcagggggagaaggcggcggtgcggatggaggccgaccagttccggcgggtggcggaggagaggatcctgcacgacgaggactcgctggcgttcctcaagggcgtcgtcttcaaccaaggagatggacatcacctccctcaagaaccgcctgctggccgtctgccggagcaaatggtccctacccgccgcccccccgggccgggaacnggggtcatccaacctccccctggttaaggagggtgggccaaaaaaaactngccctccgggaaggaacnctccctccccgggggnccggtccaaagaactttttctcccgattcn

SEQ ID NO: 20763 - DNA, 620 bp, Triticum aestivum
  unsure (1)..(620): unsure at all n locations
  Clone ID: PAT_TA_20763
ccaaagctcccagctttttccccttccgtccgtcgccgccgccgctctagggtttcctcttcccgatccccgatccggatccagcagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggggcctcggacgccgccgcccccgccgcccccgcggaggacctcaaagaactgggacgcccagttctcaaggtcgacaaagcaacctcttcgactcatcctggcgccaactccctgatcataaaggggttttggactaactgtcanatgttgccgantataaaggcaagacccggaggagatcgcaagactcaacataagaacncttancccccgggggggggatccnagggaaaacatgggccttntaaggacaccagnaancccnccg

SEQ ID NO: 20764 - DNA, 496 bp, Triticum aestivum
  Clone ID: PAT_TA_20764
cccacgcgtccgcggacgcgtgggttactccaagaacccagcggctcgtcaaagcaaagtctccggtgacatccatcgatccgtcgagttcgagtccagcatggcggccgtggcgagagcgatcgtgtgcgaggcggcgccgcagagggtggcgcccccgtcgcagcagcagcagcagcagaagcagacgaggcgggacaagatcctgctccagccccgcctgtccacgctccggtcgtacggcgccgacggcagcggcgcggtgacgcggaagcggctgcccggggaggccctggaggagggcggcgtcgggggcgcgccgccgttcttcgcgtcgctcgccgactacatcgagagctcccgcaagagccaggacttcgagaccatctccggccgcctcgccatggtggcgttcgcggcggcggtggcggtggaggcgacgacgggggactcgctgttcaagaagctggacacggtgcagatcgaggaggcgacg

SEQ ID NO: 20765 - DNA, 967 bp, Triticum aestivum
  Clone ID: PAT_TA_20765
cggacgcgtgggcggacgcgtgggtccaagaacccagcggctcgtcaaagcaaagtctccggtgacatccatcgatccgtcgagttcgagtccagcatggcggccgtggcgagagcgatcgtgtgcgaggcggcgccgccgttcttcgcgtcgctcgccgactacatcgagagctcccgcaagagccaggacttcgagaccatctccggccgcctcgccatggtatacctctctcagtctctctgctctgtgaccgagctctgtttggacaccacaggtgactaaacgacgcgtgcaggtggcgttcgcggcggcggtggcggtggaggcgacgacgggggactcgctgttcaagaagctggacacggtgcagatcgaggaggcgacggggctgtgcctggccgtggtggcctcggcggccacgttcgcgtgggtgtccagcgcgcgcggccggatcgggcagatgctcaccctcggctgcaactccttcgtggacgggctcatcgacaacgtcgtggacgtgctcttctccgacgaccaaatgcaggactggtccgacgacgtctgagcacgcacagacgcagatgcaccacgtacacttgtagatacgatacgatacggctactagacgcagacgctacgtgcgcatgatgatagtatagaactaatactagagcatttccaagttgcatcgctgctgcaactgcaagtggttccttatctcttcaaaaatggatgccatggctatggtacagactacaaagctctgttcatccggagtctctttttgcctttgagggttttctgtgattgcagcgttgtaatctgcatagtatgatggagtactactaccttaagttttaactctaccctagtacctagagctactgatactgtaaaactagaatcatgtactctctctgccttcttgggagcatgttaaatgtataagaaatcatctactagt

SEQ ID NO: 20766 - DNA, 1061 bp, Triticum aestivum
  unsure (1)..(1061): unsure at all n locations
  Clone ID: PAT_TA_20766
cgcgcccgtacaccggcccgtttgtttactccaagaaccccagcggctcatcaaagcaaagtctccggtggttatccgtccgtcgagttcgaggtataccatggcggccgcggtggccaggagcgatcgtgtgcgaggcggcgccgcagagggcggcgcccccgtcgcagcagaagcagcagacgaggcgggacaagatcctgctccagccccgacctctccacgctccggtacttacggggcccacagcagcggcgcggtgacgcggaggcggctcccggccggggcccttggaggagggcggcggccgggggcgcaaccgcccgtgacttgcgcgtccgttgtcgacgaagacagagtggctcccccaaggagccagggcttcgggaaaatcgtccgccgcctcgcccttgtggcgtgctcggcggtgccatcgctggggtcgacgacgcgggactcccggtgcatcaagctggtcacggtgcagatcgaggaggcgccggggctgttcctcgccgtgggggcctccgggaccacgttcgcgtgggtctccagcgcgcgcggccaggatcgggcagatgctcaccctgggctgccactccttcgtgggcggcgtcatcgacaccggccggaaacgttctcttctccgacgaccagatgcaggactggtccgacgacgtctatccgcacgcacatgatgcagatgcaccgcatacacgtgtcgatacaatacggctactagacacagacgccacgtgcggcatgatgatactatagaactaatactagagcatttccaagttccatcgctgctgcaagtggttccttgtttcttcagagatggatgccatggctatggtacaaagctctggtcaactggagtctctgccccttgagggtttccgtgattgcagcgttgtatccgcatatgatgggcagtacacctttaagttttataactgtactagactactgatacgtaaacagaacattctcctcgcctcttggggatttaattatagaatcatatacgtaaacagatatatcnaaaaaaaacgang

SEQ ID NO: 20767 - DNA, 945 bp, Triticum aestivum
  unsure (1)..(945): unsure at all n locations
  Clone ID: PAT_TA_20767
ggcacccagcgagacgcaaagccggcgacggccgccgcgagctggagctgcccctgcccctgcacgccggccgcggccgctcctgcatgaagccgcggcccgggggggcgctgcggccccccggcgccgtccccaggaagcccccggacgagtaccggccccgaccagaagagctcagctagctcgtcccaatggcgccacggggccgtcaggacgacggggtacggcggcgaggtggagctgctcgtgtccatggacgaggaccacgtcgtctaccgcatgatgccgcggtccgcgaaagcgaccggggtgcaggcgcgcatcggtcacgcctccaaccaggtcggcgtggagccggccaaggccgcctaggcgcgcggcttcctgtcgcccggcgccgccggaatgctctcccccgtgatctacctctacttgggcgcgtgcgtcctcggctcggcgcccgtcccccggacgcgcacccacctctgcggcctcccgacggcggcctacgccggcacggtggcgctcgagtaccacagcgcgccggagcacccgttccgcgcggcctacgacgtctcctaggaggggctcgagggggtagggtctcaagcccctgatggccgcggccgcggaagacatcgagttgcaggagcgcatcctcagcttcctccgcaagtgagcggccgcgcgcaccggctggtgaaggcaagggaagggaaggttcccttgatggaataatttttaccgccactgattttccgatgtttgagcttgagagatctcccttcaatttgtttgttcctcggttatgtcctcgccgatgcagtcgactgatgtttatgtcctcgataaattggcgaagagagactagtgggtttcctgacaatccgtgctgaaattgttgttcaatcatccttcccgttnaagccgaaaacaataaactct

SEQ ID NO: 20768 - DNA, 567 bp, Triticum aestivum
  Clone ID: PAT_TA_20768
ccctcactgccgctcggttcattgaggtaactggcttttgtactggtatagccccagatgtgattgggacatacaacggccttcgtgatcgaatattttctaatccagatttgttccccgagaaggcttctactatagtacccaacgaaagaaccccgtaaaaggcgcctcctcatccgtcattctgtcgagcaactcagacgcgccgccgttgctatgcttctccgaccccgccccttcctcctgcaggccctcacaccgcttcccttctcccgtggccccctcgcggtccgccgcacgctctcagcgcacgccgcggcagccggggccgccccccgcggcgatgcgcccgcgccggcgcgaacccgccacaagaactcccggaaggccgagccgcctagggtgcccacggatacggcgctgttcttcccgccgggggtagaccgggacgcggctgtggcggcggagatgttgattccggggtcgaacatcgtggtgggaccgtacgccggggacgcgagggtaaaggaggctgagttcatcgggtgcagcgcgcacgcgcgggac

SEQ ID NO: 20769 - DNA, 698 bp, Triticum aestivum
  Clone ID: PAT_TA_20769
cgccaccccctctccccccacctcccacctccttcttaacctccctcatcttcttcctccgcccgctccccatcggtcgcagcccgcctcgcagcgacgcaatctcaccgatcggtcctcgccccccctcgctcgatcctcggaggcctgggaccgacggcggcggcgcgcgtgcggattggattccttccgagtaccgtgagttcttcgaccagaactgtttgcgacagctagcattctgattgctatggaaggtgggggaatggaccaggtttgcatggtctgccatgacaaaccaaccgtccagtgtccgataacaagccgatgaagaacatcagtggggagatgcctgcaaccgcaaccgcaaacgctggaagccgggtcctttgacttcgacatcttcctcgacttcgctgcagacccagttgttaccctctgtggccatctctactgctggccttgcatctacgagtggctgcgcccctcggtggtatcagcctctggtgccaacagcacttcagcaaggcagcagtgccccgtgtgcaaggccgcgctatctgctgacagcctcgtgccgctctatggccgtggtggtagctcgaagaaatcactggatggcacggccattcctcgacggccaacagtgcaccgggagaatgttgcgcaccagcacgcgcaaagcagcatcgatgatgacc

SEQ ID NO: 20770 - DNA, 749 bp, Triticum aestivum
  unsure (1)..(749): unsure at all n locations
  Clone ID: PAT_TA_20770
aaggctgtttgaacgtgcatgtnttacncttgtcngagtcccggaacccgnnacgggccccggttncaatagggnttttgntgtccgcttcctcccgggcgcccccggggcgctcgcctacctgggccagctcgaattcttcatccgcgaggcccccggagcggatgaagtccattgagcacggggctcttcctggttacgcttgtccttggggttcttccttgagcagcttcctcgtcttcctcgtcccacaccgtgacaaggggggcatggatacggaataacctggatagggggaggcttgacttgttctactggatgctggctgtgcttggggtggtgaacttccttgtgttcgtggtgattgcaaggcggcacgagtacaagcccagcacgtcagtggttgtggctcccgctggggaggacaacgataccaaggaaaaggagatggacgacgtccttgtggtcaatgagaacaccgtggggatggatgtgtagggagtgttgagtttgtaagatatgcatatgaatagcagattgagtgtaaacatagatggttagattttttggtggaaccagcccatcaaaattcaagtttaccagacttgacatgggtgttcacatttttcctgaattttaattcagacatttccgcgtggtgtgcggagtgggggccgatgttcccgtcgattgcaaagtgcctcaggtgactttgttaatctcaagtttgccacctcaaaaaaaaaaaa

SEQ ID NO: 20771 - DNA, 502 bp, Triticum aestivum
  unsure (1)..(502): unsure at all n locations
  Clone ID: PAT_TA_20771
ctnttggtgtgggggacaattgcattgtacgtaaggaaggaggatccctcaccaacggagttaaggcgccgatccccctcaatcaatatgcacacaacagtgccgctgctgttctgctttacagtccggatttcctctgctgttccgaaatgtccaactcgcccatctccacccctaaatttgctgctacctccactacgtacagtgcttcatttctgctactactactgcctgcgttcactacttgctaccatgtccgtgcattgggtttcctctgctgttcgtgagacggcgagtttactggcatttgtgtgtttccatattaaaactaatttacgtatgtgtgcttattgtaagcctgcgactgagtcgtgtttccattttcagaccttttttctttttgcattacctgtttgaactctgtacttctatgcatgtgtgctagctgagaactatgtcgcctatttcagcagtggctgttaaataaaagacttggtttgta

SEQ ID NO: 20772 - DNA, 565 bp, Triticum aestivum
  Clone ID: PAT_TA_20772
ccggctgacgagttcccgccggtgagcgagcgctctgaaccttcttggtttgcttcgtcgagtgccccggcggcgccatgaagtccactgcgtgagcgtaagcagcacaccagcacccgcccgaccagtccagtgtgtgggtgcaaagcagccatgcgcacaacacgagcaattcgcgcggtgtggatgtgatgttcgccgctaccgatgccctggaagaacattacctacccgtgtgcagttgagaagagcttcttttgctctactttttttttggagaatttttggttgtccactcctcctcagccccacaccgtactgcagtcccgcatttgacatggagtaatgcactgcgacaccccggagcggcaacgatgcctcgtgcagttcagaaaattttattttacattttttgtttgccttgagatgtagttcgccatggcctcgaacgtggtctggtgtcacaaccgtttcagtgcgccagcggcaccccttgtgtgcgttcacaaccgttcctttaaaaaaagttcattttgttatttgaaaaaaaaaaaaaaaaaaaact

SEQ ID NO: 20773 - DNA, 616 bp, Triticum aestivum
  Clone ID: PAT_TA_20773
gagcagtttattgatgaaactggtattgatgcattagcagtatgcattgggaatgttcacggaaaatatcctcccagtggaccgaacttgagacttgacttgctaaaggaacttcgcgcattaactatgaagaaaggagttagcttggtacttcatggagcatctggcctccctcatgaacttgtaaaggagtgcatagatttgggggtgaggaaattcaacgtgaacacggaggtccgcaacagctacctgcagtcactcaagaagccagaaaaggacctggttcaggtcatggagtctgccaaggaagcaatgaaagctgttgtagcagagaagatgcgcctcttcggatccgcaggcaaagcctgaatgtagcgacacaatgaaaaactgaagccagcaacactccaccattaggtgttgcatgcccattttagcgatcctactaggcttgtgacagcgaactgcccgaaccagtttcttaataaagcactgatacagttgcctgaagaaataaaataacaaaaattagtaaatcgcagcaacttaccggtgctcccgttcatggttgagtgactagttttgcatttaatataatatttactaaaacctttct

SEQ ID NO: 20774 - DNA, 2985 bp, Triticum aestivum
  Clone ID: PAT_TA_20774
cctcgcgtccgggcgatccgacgtctggccgggggccatggtgcctcagccgctgtcgcgagggcatgtggtgcgcggtccaccctgccttcatgaaggagttgccctgcgttccctcccgcttgaggggcctcgtggtcctttggatgccctgggcccctctgcctcgctagtgagcatacaccttcttctgcggtgggctgatgtgccaacgggctcgctatcggttctcgtgatagcgccctcttctggatcccctggcgtggccctcgcggtgctcttccgctgtctgcctcccgccctgcttctggtggcggtcgctaggatgatggtgctgttgtaaaggtatatgtgacattatctgggctgaaagtagaaggaaggccgcccatgcttaatcaagaagatgtcctgcgctctcttcctgctgagtggccagaagttccaatggatgatctcgtttcctctgcatcccgtgatagcaaaaaggtgcttctagttttcgcggatgatccaactgggctctcaaacagttcatgatatggaggtcttaactgaatggccagttgaagccctcacggagcagtttctgcaactcccaacctgctgttttaatctgacaacacaccgatcatttcttcccgtgaagcctgcacgattggtataagttgtctacgcaaatcttgaggagactgccaagcccggcccttgtcctggttgtacaagggtcttgcgcggtgtttccactcttcgcgcccagctgacaggggtatcgatgaaactggtattgatgcattaccacatggatgcttggataatatgcccattcttccttccaggtgggcggtacactgttgatgatattcattatgttgcagactctgaaagattgattcctgctggtgagactgagtttgccaaggatgcagcttttggctatacatcttccaatctcaaacagtgggttgaagaaaagactaaaggaaggattttggagaaccaagtttcatcaatttccataagtcttttacgtaaagaaacaccagatgcagtctgtcagcttctctgcagcttggagaagggctctgtgtgtattgtcaatgctgctagtgagagggacatgaatgtctttgctgctggaatgatccaggctgaattgcaaggaaagcggtttctatgtcgcacagctgctagttttgtgagtgctagaattggaatcaagccaaagccacctatccgcccaaatgaccttggattaaaaagaaatttagcgggaggcctcatagttgttggttcttatgtgccaaaaactacgaagcaggtcgatgagcttcgctcacaatgcgcacaatccctcagagtgatagaggtatctgttgagatgatctcactgaaatcaactgaggagagagaccaagaaatcagcagaattgttgaattgggaaatgcttatatacagtccgggagagacacgctagtcgtcaccagccgccaactcattaccggaaaaactcctgaagaaagcttagaaattaattacaaagtgagctcagcactagtagagattgtgcaaagaattgatagtcgaccccgttacatccttgcaaagggaggaatcacttcatctgatcttgctacaaaagctttggaagctcggcgtgccaaagtaatgggacaagctttagctggtgtgcctttgtggcagcttggccctgagagtagacatcctggtgtcccctacattgtttttcctggtaatgttggtgataacagtgctcttgcagaagtggtccagaattgggcttgcccttctagaagttcaacaaaagaacttctccttaacgcggagaagagtggctatgcagttggtgctttcaatgtatataatcttgagggaattgaagctgtaattgcagctgccgaggctgaagaaagtcctgctatcctgcaggttcatcccagttccctgaagcaaggtggagttccgttggtagcatgctgcattgctgcagcagaacgagccagcgtacctatcactgtccattatgatcacggggctgacaagcatgatttgcttggagctcttgaaatgggatttgattcagtcatggtggatggttcccatctaactttagaaaagaacatcttatacacaaagaacatatcttccctggctcatgctaaaggcatgcttgtggaagctgaacttgggagactatcaggcactgaagatggcctgacagttgaagaatatgaagcgagatttactgatattgctcaggctgagcagtttattgatgaaactggtattgatgcattagcagtatgcattgggaatgttcacggaaaatatcctcccagtggaccgaacctgagacttgacttgctaaaggaacttcgcgcattaactatgaagaaaggagttagcttggtacttcatggagcatctggcctccctcatgaacttgtaaaggagtgcatagatttgggggtgaggaaattcaacgtgaacacggaggtccgcaacagctacctgcagtcactcaagaagccagaaaaggacctggttcaggtcatggagtctgccaaggaagcaatgaaagttgttgtagcagagaagatgcgcctcttcggatccgcaggcaaagcctgaatatagcgatacaatgaaaactggagccagcaacactccatcattaggtgttgcatgcccattttagcgatcctgctaggcttgtgacagcgaattgccggaaccagtttcttaataaagcactgatacagttgcctgaagaaataaagtagcaaaaattagtaaaaaaaaaaaaaaaaaaaactcgaggggggcccgggcccaatcccctatatgagtcggttaaattcatggccgggttacacggcggactggaaacccttgcgtccaactaatgcttgcacacatcctttcccactggtaaacaaaaggcgcccgtgcccttcacagga

SEQ ID NO: 20775 - DNA, 680 bp, Triticum aestivum
  unsure (1)..(680): unsure at all n locations
  Clone ID: PAT_TA_20775
ttcgagcggccgcccgggcaggtaccactccatggcaacgtgaagatatactcctccaaggagctcaaaagggccacaaggaatttctgctcaggaaacaaactcggacagggttctttcggctgcgtttacctgggaaagctgaagaatggtcaaaaggttgccatcaaggtgctctcctccgagtcaaagcaaggaacaagggagttcttgaatgaactgagtgtcatatccagcataacccatcacaaccttgtaaaactgcacggctgctgcgtcgatggaggtcagaaaatgctggtgtacctcggccgcgaccacgctagctcncacgaacctccttgggaataccacagtantanccgctttgactggagcacaaaggcgaaaatntgcaattgtgtccccnacggttcaatatctcatgaagaatccngcacatatctccacgtgcatcaaggngataatatctgcttnacaaaggacttagcccaaaatatcggnttcggctacaaactctcccgggaacatnccanatcacacaaggttcaggacatnaggatctggaccgatatnaaccnanggaactacaanaagntgattgtnaactttgggtctgcgctggnatgcaatgaaggganacnacccanatgcncccagttantcnccaaaacggttgc

SEQ ID NO: 20776 - DNA, 538 bp, Triticum aestivum
  unsure (1)..(538): unsure at all n locations
  Clone ID: PAT_TA_20776
gctctanaactatggtccccgggctgcaggatccggacaagggacttgcnccntgatggatacaaagggctgcctctgcaagaaggcgtggactctgcgtcaaagagcggtcnacaaggcttgcggggctcatcgccgtgtccggcaccggcgaagttcctacgggttcaactgcaccggcatgttccggggctgtgccaccgaggacggcttcatggaggtccgcatctgggagtgagcatgtgcgggagctcagccagagatgtctccgcacgtagtgcgtgtacatacatttggccatcctgcgattgccatctggttctagtataggaatcctccgtactacctccttttcaagtttacaaatcctgcgcgtatatataggttgccaattttatcaccctaacataaactatataacacaaaaatataccttttggaaagtagaaacccgaatttatgttgggaattttttggaatatatgattttttttgtggctggacaaatttacnactaagataaannaaangggggggg

SEQ ID NO: 20777 - DNA, 1381 bp, Triticum aestivum
  Clone ID: PAT_TA_20777
cggccgcgtgggcgccgccccggccccggccgtcgccgccgcggcgtggggcagcagcaggagggcggcgggcccgtcgtcgacccgcgtcgcgctcagcgcggcgagaggacggggacgcctctccccggtggtgggaaccgggcggccggcgctctccgtcaggtgcaacgccagctcccgggacgggaggattacacagcaagaattcaccgagatggcatggcagtcgattgttctggcacccgaagtcgccaaagagagcaaacaccagatcgtggagactgaacatttgatgaaatccttgctggagcagaggaacgggcttgcccgtcgaatcttctccaaagctggagttgataacacacggcttctcgatgccaccgagaagttcatccagcggcagcctaaggtattaggtgaagatcctggttcgatgttggggcgtgacttggaagctctgatacagagagcgagaaactttaagaaagagtatggtgattcatttgtctcggttgaacatattgttcttggttttgcggatgataagcgatttggaagacagctgttcaaggacttccagatcactgtagaagccttgaaaacagctattgaatccataagagggaagcaaaatgtaattgatcaagaccctgagggcaagtatgaagctttggacaaatatggaaaggacctgacagctatggcacgtcaggggaagcttgaccctgttataggaagagatgatgaaatccgtaggtgcatccagattctgtctcggagaacaaagaataatcctgttttgattggtgaacctggtgtgggaaaaacagccatagctgaagggcttgctcagaggatagtgcaaggagatgtcccacaagcactgacaaaccgtcgactaattacacttgacatgggtgctttgattgccggtgcaaaatatcgaggagaatttgaggatagactgaaggctgtacttaaagaagtcacagattctgatggacaggttgttctcttcattgacgagattcacactgttgttggagcaggtgccacttctggtgcaatggatgctggcaatcttctgaaaccaatgcttggaagaggggagctacgttgcattggcgcaacaacccttgatgagtaccgcaaatatattgagaaagatccagcactggaacgccgcttccaacaagtgtatgttgatcaaccaacagttgaagacacagtgtcaatactccgaggattacgtgagagatacgaattgcaccatggggtccgcatatcagacagtgctcttgttgctgccgctcttttgtcagatcgttacatcagcggacggtttttgcctgacaaagcaattgatttggttgatgaa

SEQ ID NO: 20778 - DNA, 430 bp, Triticum aestivum
  Clone ID: PAT_TA_20778
cgtcggcctttcgtcctgttgttgttttagcggatgacggaccagacaacgtagcaggagcaacagtgggaacagcattggcgatcgcgctgaggagcggcctgagcagctgcatccccagcctggtgccgagcctgctggggccttggcgctggtgcctgcggttctgcctgtacgtctgcacctacggcagcatctccatgcgcgtcaagatgttcgccgagtggttccgcggccagcacctcgacggctacttggacggatacttggcaggagacttcgtgttccaccccatggggctggacaacgtgcagcggaacaaggagcgcgagatggagcactggatctaccactggctctgcgccactctctgactgcctgcggtgctgctgccacaggccctctgactgaacaaccaggagagggcgca

SEQ ID NO: 20779 - DNA, 674 bp, Triticum aestivum
  Clone ID: PAT_TA_20779
aacctacagcatccgcagcccccctcacaccccaccccaccacaccctcgaatcaccaccaccagcagcacccatggcacccaaggcggcggagaagaagccggtggccacggccgagaagacgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccagacgtgggcatctcctccaaggccatgtccatcatgaactccttcatcaacgacatcttcgagaagctcgccggggagtcggccaagctcgcccgctacaacaagaagcccaccatcacgtcccgggagatccagacctctgtgcgcctcgtcctccccggggagctcgccaagcacgccgtctccgagggcaccaaggccgtcaccaagttcacctcctcctagacaacttaggcttgatcctcgtcgcttcatgcgttctgtatgtacgtagttggcagtatgatgttacaatctttgtaaggattgtgttgcttgctcgcggccttgaaagaaatagtgatgttgttgttgtttgaatacatgttcatttttgttgcgcgtcgctcca

SEQ ID NO: 20780 - DNA, 784 bp, Triticum aestivum
  unsure (1)..(784): unsure at all n locations
  Clone ID: PAT_TA_20780
cccacgcgacccagcagcccccctcacatcccccccaagctcaacctccccacacgctccaaccaccagcacccatggcacccaaggcggcggagaagaagccggtggccacggccgagaaggcgacggcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgccggcgagtccgccaagctggcccgctacaacaagaagcccaccatcacgtcccgggagatccagacctccgtccgcctcgtcctccccggggagctcgccaagcacgccgtctccgagggcaccaaggccgtcaccaagttcacctcatcctagacagcttaggcttgatcctcgtcgcttcatgccttctgtgtgtacctagtcggcagtatgatgttacaatctttgtaaggattctgctgcttgcttgcggccttgaaagaaatagtgatgctgttgtctgatcctcgtcgcttcatgcgttctgtatgtacgtagttggcagtatgatgttacaatctttgtaaggattgtgttgcttgctcgcggccttgaaagaaatagtgatgttgttgttgtttgaaaaaaaaaaaaaaaaaaaacacnnc

SEQ ID NO: 20781 - DNA, 997 bp, Triticum aestivum
  Clone ID: PAT_TA_20781
agatcgccaccgttgtggagagtggccaccttaacccaacccgtttcacctcccctccaccggcgccgaatctacgccccaccaaccaaatcctcctttgcaaagcaaatttacgaaagcacgcacaagaaacacgccgcagcagcagctcgtgtgagcgtgggcggtactgccgagctgacggtgatcaccaccatggcaccatgctcatcgtcgtcctcttcgtcgtagtgtagtacaactagcggcgacagcgaaggcgagcgtgcagtgctgccactgtggatagctttccggtggggcaagaaagaagccggggagggggaggaggcaggaatcattcggctgcaaagttgccggcgccacctcgtcggcactgtccccgctttcccgggccgcgtgggggccgcacctccgtccccgcgtctggttgggtctgggtgtgctgccgctgtctctgcgccaccaccaccaccaccgcatcggcaccagcaccagcaccagctgcggctgctcccatcttttcttctcgagggagatgcttccgctcctccttatatccacgctcccggccttcacgctgctcctcgttgcgcccgcctcctgcaagccctggaagctggtgcgggagctcggcctcgtcgcgctgctgctggcgcgggagctgctccggcactccgcctccgccgccgcgggcgcgggcaggaaggagcagcagggcgccagaatgccgccgtccaagcccaagacgccgccgcccgcattggcggagggcgacgcggacgcgctcccggtgctcgacctgccggagctggcgctggagcgcgtgctggaggagctgtccccggcgtcgctcgccgcgatggcgtgcgtctgcgcggggctcagggaccgctgctccatggacggcctgtgggcgcgccacgtccggcgcaagtggggccgcgtgctcggcgccgccgcgcgcagggagtggcaggcggagctggccgccaga

SEQ ID NO: 20782 - DNA, 1152 bp, Triticum aestivum
  unsure (1)..(1152): unsure at all n locations
  Clone ID: PAT_TA_20782
cgccaanacgtcaagccccacgagtgatgagggagctggtctcctcctcctcctcctccgcggccctcgtcgccgcgggcaacgcggcgctccggggatggtgggaggaggtcaacgagtcgccagcgtggcaggacggcgccttcttctccctcaccgccgcctacgccctcgtctccgccgtcgcgctgattcagctggtgaggatccagcgcagagtgcccgagttcggctggaccacgcagaaggtgttccacctcatgaacttcgtcgtcaatggggttcgtgccgtcgtattcggattccatgcttatgtcttcctcctccaaacaaaagtttataagttggtgttactagacctccccggcttgttgttcttctcggcctacaccttacttgttcttttctgggcagaaatataccatcaggctaggagtctccccaccgataagttgagaattatatacctagccgttaatagcatcgtatatgcaattcagatctgtatttgggtgtaccttggaataaacgacaatgcgttggttgagctggtgagcaaaatcttcatcgtatctgtctccgctgtggcccttcttggtttcccagtatatggtggaaggttgtttgtctttttgacaggtttcccccattgaatcgaaggggggaaaaaagaagctttatgaggttgggcttgtgaggacaatttgctgcccctgtttcctgataaaatgcatcgtggtggcagtatccgcatttgatgctgatgtttctttggaggttttagatcccccacccctagattttttttattaaatgttgacaaagataccccctcccgcgggggcccttttcccccttgggaagctcccccctaagcgagtatgggcgcaaaatccccctattaaataaaggtttttgggcttatgtatgatgttacgcttagaaaaagggatgcacttggaagggcccaaaattttacatgactggccccccccccacgctggtgttcaacctgtgtgttttccaaaagcatcaaagggttgtcgatggctcacccaatgtccagcccagggcccctgtaaaaaaaaaaaaaaaaaaaaaaaaaaaaaaaaaaaaaaaaaaaaaaaaaaaaaaacaccaaacaccgcccgc

SEQ ID NO: 20783 - DNA, 1559 bp, Triticum aestivum
  Clone ID: PAT_TA_20783
ctctgtgcgaacgccaagagcgtcaagctgagggaaagatgagggagctggtctcctcctccagcctcgcggcaaaccacgtcgcagcgggcatcctgcccctccggcgatcggtgggaggaggtcaacgagtcgccagcgtggcaggacggcgccttcttctccctcaccgccgcctacgccctcgtctccgccgtcgcgctgattcacctggtgaggatccagccgcagagtgcccgagttcggctggaccacgcgagaaggtgttccacctcatgaacttcgtcgtcaatggggttcgtgccgtcgtattcggattccatgcctatgtcttcctcctccaaacaaaagtttataagttggtgttactagacctccccggctcgttgctctactcggtctacacctgacttgttctttcccgggccagttgtacttctccgcctacaccttacttgttcttttcttgggcaagaattatatcatcaggctaggagtctccccaccgataagttaaggattatatacctagccgttaatagcatcgtatatgcaattcagatctgtatttgggtgtaccttggaataaacgacaatgcgttggttgagctggtgagcaaaatcttcatcgtatctgtctccgctgtggcccttcttggtttcgcagtatatggtggaaggttgtttgtcttgctgagacgtttccccattgaatcaaaggggcgaaaaaagaagctttatgaggttgggactgtgacgacaatctgctgcacctgtttcctgataagatgcatcgtggtggcagtatctgcatttgatgctgatgtttctttggaggttttagatcatccaatcctagatttcttctattatatgttgacagagatactgccttccgcgctggtccttttcatccttcggaagcttccacctaagcgagtatcggcgcaatatcaccctattaactagaggtttttgtgcttatgtatgatgttatgcttagaataatggatgaacttggaagtgcccaaaattttacatgactggtgcgagctgaatgctggtgttcgagctgtgtgttttccaaaagcatcgaagtgttgtcgatggatcatgcaatgtgcagttcaggggccctatagcagtgaatttcctgtcttctgcttgttctttttttggtggaatttggtcgatagctttgctctagtagaggagaaaatcgtagtggattccctgatgtttatccgagtcgttttgtgattgcccttgccatgtttaccatcggagcgttgctggttatgccgactggagcttaatatttgtaaaatgttaccagtctcttgaattatgtgtgtattgtagagggcctcaaaagtcatatttgtaagtgtaactggtttggagtagatgatgtcctgcgcgttgccaaatttcatttcaagaatgtgagaaatacttgggcatgattgcaatagtatttgtaatcgtactacatttcatttgcaatcatacagctgaatggtgggatgcatcattcggatcaggctaaaaaaaaaaaa

SEQ ID NO: 20784 - DNA, 582 bp, Triticum aestivum
  Clone ID: PAT_TA_20784
ggattgaccgactgagagctctttcttgattctatgggtggtggtgcatggccgttcttagttggtggagcgatttgtctggttaattccgttaacgaacgagacctaagcctgctaactagctatgcggagccatccctccgcagctagcttcttagagggactatcgccgtttaggcgacaagtggcaccgcgtggagcgcagcagcggcaagttcgtcaggcgcttccgcctccccgaggacgccaaggtggaggaggtgaaggccgggctggagaacggtgtgctcaccgtcaccgtgcccaaggcccaggtcaagaagcccgaggtgaaggccatccagatctccggctgagtggacgcgtctcggcgtatgatcatcagggatggagccagtttggttgatgtgtgtgcgaggtctgcaacctgaaagtatgctacagttgtgtcttgttcttggcgagtctggtgagacatctctgtagtgcgtttctttccccagttacttgtgtaatcgccaatagatttggtgatgaataaatgagaaataaatccttctgtttttgagtgcaaaaaaaaaa

SEQ ID NO: 20785 - DNA, 166 bp, Triticum aestivum
  Clone ID: PAT_TA_20785
tttttaatcaaacaagcggtttcacctcgaatttgcaatggataatacaacaacattagagaccgtcgatggcggcgtccaagcgcacgcaacgcggccttgtgcatctaagttcgaacttcgacaagaggactagttctagatcgcgagcggccccacgcgtccg

SEQ ID NO: 20786 - DNA, 665 bp, Triticum aestivum
  Clone ID: PAT_TA_20786
ccacaaaccaaagcaacaccgacaatgtcgatcgtgaggcgtagcaacgtgttcgacccattcgccgacctttgggcttgaccccttcgacaccttccgctccatcatcccggcgatctcaggcaacaacagcgagacagccgcgtttgcgaatgcccggatggactggaaggagacccccgaggcgcacgtcttcaaggccgacctccccggcgtgaagaaggaggaggtcaaggtggaggtggaggacggcaacgtgctcgtcgtcagcggcgagcgcacaaaggagaaggaggacaagaacgacaagtggcaccgcgtggagcgcagcagcggcaagttcgtcaggcgcttccgcctccccgaggacgccaaggtggaggaggtgaaggccgggctggagaacggcgtgctcaccgtcaccgtgcccaaggccgaggtcaagaagcccgaggtgaaggccatcgagatctccggttgagtaccgggtcggacccagtctggttcatgtgtgtgcgagttctgcagcctaaaagtatgctacagttgtgtctgtgttcttgccgagtctggtctctgtattgcgtttcttttccctgtcgtgtctgtgctctgtacttgtgtaatcgccaacagattggcatgaataaatggagtaatgtctg

SEQ ID NO: 20787 - DNA, 759 bp, Triticum aestivum
  unsure (1)..(759): unsure at all n locations
  Clone ID: PAT_TA_20787
gagagagagagagagagagagagagagagagagagagagagagagagagagagagagagagagagagagagagagagagagagagagagagagagagagagagagagagagagagagcgcagtcgccgcagacctcctctcgggaagaaaaattccccacctctcctccctttcccctcctcgtccccgccgcttcgccatggccgacgagcaggtcgccaagccggcgagcctcccgccatatcccgagatgatactggctgccatcgcggcgctcaacgacaagaacgggtcgaacaagtccgccatctccaagcacatcgagggcaagtacggcgacctccccaaggagcacgctgctctgctgacggcgcatctggtgcgcatgaaggagtccggccagctcctctttctcaagaacaactactttcgcaccgacgcgccggacgccccgcccaagcggtgccgcggccgcccgcgcaagcncattgaccccaacgcgccgnccaagcccgtctcgccgcgcccccggggacgcccggtcaagcccaaagaccccgaggccgaagccgtcaacccgtctaggaaggccaagaccgttcccggccttgcgtnnacggttcgccaagcgcgggcggggctgttcgcccaggcgccccccgccaaccggggggggcttactcgttctccgtccacttggggccggtttgggtttttttggtatacccgggggtgggtgggttaattttgtttgtgggg

SEQ ID NO: 20788 - DNA, 718 bp, Triticum aestivum
  Clone ID: PAT_TA_20788
cttgcttgcgcgtgctagcggttcccaaatcccaccagcgccgccacaagccgccggttgccggtcgccgctcccccggatcccgccgtcgcggccccctcgcttcctccgtagtgcacgcatcctccgccggacgccgcgccacctcccccgtggtgcagagcatccaggcgggacgccgacgccctccatcttcctcgacgatgccctcctcgccaccgccctcctagacgccccctcctcgacaacgacccgactgtgcctcctctccgacgccggccgccgcggatctgcatctgcctcgtcgccggacagtgagctcctcttccactctcgatgtttctagctaaatccaaggaagtgatgcaatatcaggtcatggaggggaggaaggacatgcaagagtcagacgctgcacctgttgttcaagtacccagagagcctgccatcgttatcaatggtgtcccaaactttcctcctgatttcgcatctggttcacaacttgcagtaagagatgctccgcggtctcgagttgatcaccgctttggtgaatggctagtagagcggaaagtgaggaagtggtttggagacaagtactatgcagggaacgttgtctggtatgacagtgtaaacaattggtacaccgttgtctatgaagacggagaccaggaagatcttgagtggcacgaactggaggagatcctgctaccgttggaca

SEQ ID NO: 20789 - DNA, 1070 bp, Triticum aestivum
  Clone ID: PAT_TA_20789
gaattcgcggccgcagcaatcaacaccacgatgtcgatcgtgaggcggacgaacgtgttcgaccccttcgccgacctctgggcggaccccttcgacaccttccgctccatcgtcccggcgatctcaggcggcggcagcgagacggctgcgttcgccaacgcccggatggactggaaggagacccccgaagcgcacgtcttcaaggccgacctccccggcgtgaagaaggaggaggtcaaggtggaggtggaggacggcaacgtgctcgtcgtcagcggcgagcgtacaaaggagaaggaggacaagaacgacaagtggcaccgcgtggagcgcagcagcggcaagttcgtgcggcgcttccggctgctggaggacgccaaggtggaggaggtgaaggccgggctggagaacggggtgctcaccgtcaccgtgcccaaggccgaggtcaagaagcccgaggtgaaggccatccagatctccggctgagtattcgggtcagagccagtgtggttcatgtgcgtgcctaaaagtatgctacagttgtgtctgtgttcttgccgagtctggtctctgtattgcgtttcttttccctgtcgtgtctgtgctctgtacttgtgtaatcgccaatattccagtctatgtatgctggtgacactagctttcaatgtactttgtacaaccagcgtacaacaaaacttgtaaagctatatttactattcgattgctaccatattcttttttcctatacaagtatatctgcaaactgtttgaaattctccgggtatggccttagaagttttccttgtggaaatggaacctagttgtggttgtctggctgaattcttttgaaagatccttgagttgtttcgtgagtgttggagatccacaatagaaaacacctatacgagagttcttgtgggcgttggccaaatcagagaacacttttctccagttaggccttgcaaaatgtgtccgaatcttgcttccggagacgatgtcaacaccatttttggcatgctggagtgactgaaccatggcaatcagcgctgaccttgcgcggccgcgaattc

SEQ ID NO: 20790 - DNA, 874 bp, Triticum aestivum
  Clone ID: PAT_TA_20790
gccggccggttcggggctcgcacgcagccgccgcagacctcctctcgggaagaaaaattccccacctctcctccctttcccatcctcgtccccgccgcttcgccatggccgccgaggaggccgccaagccggccacgctcccgtcctatcccgagatgatactggcggccatcgcggcgctcaacgacaagaacgggtcgaacaagtccgccatctccaagcacatcgagggcaagtacggcgacctccccaaggagcacgcggcgctgctgacggcgcatctggtgcgcatgaaggagaccggccagctcctcttcctcaagaacaactacttccgcaccgacgcgccggacgccccgcccaagcggggccgcggccgcccgcgcaagcccattgaccccaacgcgccgcccaagcccgcctccccgcgcccccgcggacgcccgatcaagcccaaggatcctgaggccgaagctgccaatccgcccaagaaggccaagaccgctcctacccctgccgtcgacggatccgccaagcgcggccgcggccgtccgcccaaggcacgccccgccgagccggcggcggcctgactcgtcctccgctccacctgggcgcggctgtcggtttctctggatcacccgggtgctggttggttaatcttgttctgtagtgcttaataattgtcggtcgctctctttagttgtagtggtacttaattgccgggatcgccgtgtcgtgattaggagggtttaatgtgtcgtcgtcgccattgctgtcgtggtcgtagcgctaccgccattgttgtaacctgaggttgattaggatgttgagtgtgctgattgttcagcaaatgtggatctatttgtacaatcgg

SEQ ID NO: 20791 - DNA, 738 bp, Triticum aestivum
  Clone ID: PAT_TA_20791
atttttcttccagcgcacaagccgaagaatagcaccgacaatgtcgatggtgaggcggagcaacgtcttcgatcccttcgcggacctctgggcggaccccttcgacaccttccgctccatcgtcccggcgatgatctcaggcaacaacaacaacgacgagacagctgcgttcgccaacgctcgcgtggactggaaggagacccctgaggcgcacgtcttcaaggccgacctccccggcgtgaagaaggaggaggtcaaggtggaggtggaggacggcaacgtgctcgtcgtcagcggcgagcgcacgaaggaggaggaggacaagaacgacaagtggcaccgtgtggagcgtagcagcggcaagttcgtgaggcgcttccgcctgcccgaggacgccaaggtggaggaggtgaaggccggtctggagaacggtgtgctcactgtcacggtgcccaaggccgaggtgaagaagcctgaggtgaaggccatcgagatcaccggctgagcattggagccagtttagttgatgtgtttgcgagctctgcaacctctgcaacctaaagtatggtacggttgtgtcttgttcttgccgagtctggtgagacatctttgtattgcgtttcttttcccagtcgtgtctctacttgtgtgatcgccaacagatttggcgatgaataaatgagaaataaacccggtcgggttttgagtgcagtgcagattttgcatacaaaaaaaaaa

SEQ ID NO: 20792 - DNA, 1236 bp, Triticum aestivum
  unsure (1)..(1236): unsure at all n locations
  Clone ID: PAT_TA_20792
gctccgtcacaagccgccggtcgccgccgcccactcgcttcccccgtagtgcgcgcatattccgccggaagttgtcgccctccctctgccgccggacgccgccccctcccccgttgtgcagagcatccaggcaagacgcggacgccctccctcttcaacgccggccgctgcagacctgcctctgcctcgtcaccggagggctgtttgtggttaaatccaaggaattggtgcaataccaggtcatggaggggagcaaggacatgcaagagtcagacactgaacctgttgttcaagtacccagagagcctgccatcattatcaatggtctcccagacttgcctcctgaattcgcatctggttcgcaacttgcagtaagagatgctccgcgatctcgagtcgatcatcgctttggggaatggctagaagagcggaaagtgagaaagcggtttggagacatatactatgtagggaaagttgtcaagtatgacagtcaaagaaattggtacaccgttgtctatcaagatggagaccaggaagatcttgagttggcaccaactggaggagatcctgctaccgttggacataaccattccgctcaaaacacttgtgatggacaaattcaaacatcagaatggtgttcccaactacagaactaaggtggctagaccaagaagtaatgttgctagcaatcagatggtggttagagcagtaaatggccaacagtcaaacaacctaccactcccagggttggttcaggcgtcaacatcagcaggagaaaatgctctagtatgtctgaaacctagtgatcaacctaagaaaaggggcaggcctcgaaaggatggaactgcatcaggtgagctttcaaaacaaagaagtacatcaggtgatattcaacctaaaaaaagaggcagacctccaaaagaacctggagagaagagtattgataggcgcaagttagagactgtcagggcagaaaaactgaagagagaaagcatgcttctgcgagggccaccacctggaagtcagtaattctaataatcaatatcgctgttccaatatagtagtactgtacttcctagatacatccgtttgagcgtcaattaattccggacggagatagtagtagatatctctaaatattccaagtctatttatgcttgcgacactagcttttcaatgtattttgtacaaactacacttgtaaagctagattccaagatttactaaaanaaaaaa

SEQ ID NO: 20793 - DNA, 1060 bp, Triticum aestivum
  Clone ID: PAT_TA_20793
aaagggcatatctccttctaaaaccataagcaaaatgagcatatgcttattatgtgctccgcacattctctttcagaggcgaacctgaaaatgaggataactgagcacagggcatatccccttcagaacaaagaacaaagtaacagttcgtcgcaatatcctcaagtcgtcggccgctgcatttttagacatctgcagtttgcaaattgggcaagctcgtagaggcgacaacgcccagactgtttacgcggtctccacatcgggcacggcatcggcatcggcaacggcgtcttcaggcccagcatccttctcgacgaagtcgtacccatactcctcctctgaagcatcctcctctgcacttctgccaaacatgaacggcttcttgcccatcgtcgtgaaaggcatcagtcccagcgcacgcgctgtcttaatctccctcgcaaccttgcgctgagctttcgcacttatcttggtctgactcctcttgatgataatgccagcttctgtaagaaagttggaaaggaatctaacattcctaaaatcggctttccttaaaacctcctttgtagacgtttcaaactgaggtcttggaggattccttggggctgcaggtcttgtaaggtcaagatcccggacattgtaagtcgagccacgcttgtaattcacatctggcctgaaatcgtagtcatcatcctcaacctcctccgtcatatgaaaggtgcgggccgcgtcgtccaacttctcgttcatgccatcgttcaaggaatcgaaaccgtccatgaacccaccattactactcctctgaccaaactcgggccgaccaaaagcacccattccagagcccgtgccgtgtcttccaaaggagctcccaaccccatcgagcttcccgaagaatgaccttgtcatctgactcaaacagacgtttctcaaagtcgtccgcactctcgcccgcgccctctccggacaggaaggagcggcggaagaaggaggctgcggcggatgatgggtcggaagtgagcaggcgtcgggaagagatcgtctcagcgccgagctcgccatc

SEQ ID NO: 20794 - DNA, 1589 bp, Triticum aestivum
  unsure (1)..(1589): unsure at all n locations
  Clone ID: PAT_TA_20794
cagtccacttgcttaagaatcttcaattccatgatccatgtgttttagaaatggggacgcgagtttcagcgggcaacaaaccatcgaccttgaaggaatgcctctacatacacttgtacaaaaaaaaatcagcaattttgcacagaaacaaaatatatgtctacattcttcaaaacgtaggggaatcagctaaagttgaaaattacacgtttcagaaaagatgaaagataaaagaacccaactagcaaaacccgagaatgcgctcaacatgctgtgctacagattttgcaagccgtgagacaaactcatcattgaatagcactgtcccgtgtccattggcctcaaagtagacaccaatatcatattctagagctttcttgtggagatatttcactcctgttgaagtgaagacaacttcaagaccaagatttttaagaaattctgttgatgctccattggcataagcagtttgaactacaccaaaccttgtaggcaataatcctttattgtcttctccattgataatatccaactgttctctaataaagaggacaaatagtgataatatcttatcgccatcgacaagatcaacactagtcttgctaggcgatgtaacatgaaaatacacaagtctatctgcatcaccatcgaaacttgcacacctgacaccaacatcattagggccaaaaccaagaggaagaaccttctccttttgaacaaagtcagcaccacacctctcattaagtattccttctccttcttttcctgaatttctcacaagaatgtttaatctggcaagatttggctttatttgttccaatttcaacccaccaataccatttgcgccatccacaattagtttctcatttagttcatcgatgcctttatcatcaggggttaattccaacaaatgcctgaatgactcagtgatttgtgtaaaataatctgcttcagaggctttcaagcctctgtttttgttccgaaccatccagtgtagctgcggagttgtcaggatccccatgtcaagtgcaactgaacctactattgcgcttatacctttggttgcaacgtcaaggaggtactctccagtgggcctcgtgtctcttgccagcagcacttgtgccgagtgacctccaccaagtgtaatcccctcatcctttgcaaactgaatcaccagctgcaggagggtgttgggggtgggggcattggcgagggcgtcggagaagggctcccaggcctgcgacatcatgccgccgtcggcgtccacgatcttgacgccgttgtcgccgacggggttgtgcgacgccgtgatgaccagcccgacggcggcgccgcccagcttcagcgagcgcagcgccgcgacgatcccggcgcggcacaccgcgggggccatggtgctcccgtcggcgcggaaccccgccgtcccgtaggagaagtcgcgccggcgggcacggggaagagggacgccactgcgagcagcgccgcgcgctgcgagcctcctgggtcggccatggcggcaggggcggatctggacgncggtgggaagcaggggcgcgatggggggaacgagcctgctggctgggaaggtc

SEQ ID NO: 20795 - DNA, 1201 bp, Triticum aestivum
  Clone ID: PAT_TA_20795
aggaattcggcacgaggcggacctagggtttgtgcgaccctgcgagctccgtccccgctctccccgctccacccagtcgcgggcgtaccagccgcctccccgagccgttcgagcacaggcctcctcgcagaggcacctgttgccgcccccgccgccgccaagtacgaggctgtttctagctaaatccaaggaattggtgcaatatcaggtcatggaggggagtaagaacatgcaagagtcagacactgcatctgttgtcaaagtacccagggagcctgctatcattatcaatggtgtcccagacttgcctcctgattttgcatctggttcacaacctgcagtaagagatgctccaggatctcgagttgatcatcgctttggtgaatggctagaagggcggaaagtgagaaagcagtttggggacaagtattttgcagggaaagttgtcaagtatgacagtgaaagcaattggtacagtgttgtctatgatgatggagaccaggaagatcttgaatggcttgaactggaggagatcctgctaccattggacataaccattccactcagaaaacttgttatggacaaattcaaacatcagaatgctgttcctgactacagacttaagggggctagatcatcgcaaggaactaatggtgctagcaaccaagatggtggttagagcagtaaatggccaacagtcaaacaacctaccacaaccagggttgcttcaggcgaccccatcaaatgcagagactgtcagggcagaaaaactgaagatgcagatctccaaaagaaaaactgaagaggtatatcagcctaaaaaaaggggcaggcctcgaaaggatagaactatatcagtatcaggtgacattcaacctaaaaaaagaggcagacctccaaaagaaaagaacatatctggggagagtagtgttcataagcgcaatgcagagactgtcagggcagaaaaactaaagagagaaagcttgcgtgttcaaggggcataacctaacaatcaatctcactgttacaatacagatatttctaaatattccagtctatgtatgctggtgacactagctttcaatgtactttgtacaacccagcgtacaacaaaacttgtaaagctatatttactattcgattgctaccatatttcttttttcctatacaagtatatctgcaaactgtttgaaaaaaaaaa

SEQ ID NO: 20796 - DNA, 929 bp, Triticum aestivum
  unsure (1)..(929): unsure at all n locations
  Clone ID: PAT_TA_20796
cacctctcctccctttcccctcctcgtccccgccgcttcgccatgggccgacgagcgggtcgccaagccggcgagcctcccgccatatcccgagatgatactggctgccatcgcggcgctcaacgacaagaacgggtcgaacaagtccgccatctccaagcacatcgagggcaagtacggcgacctccccatagagcacgctgcgctgctgacggggcgtctggtgcgcatgaaggagtccggccagctcctcttcctcaagaacaactacttccgcaccgacgcgccggacgccccgcccaagcggggccgcggccgcccgcgcaagcccattgaccccaacgcgccgcccaagcccgcctcgccgcgcccccgcggacgcccggtcaagcccaaggaccccgaggccgaggccgccaacccgcctaagaaggccaagaccgctcccgcccctgccgtcgacggatccgccaagcgcggccgcggccgtccgcccaaggcgcgccccgccgagccggcggcggcctgactcgtcctccgtccacctgggcgcggctgtcggtttctctggatcacccgggtgctggctggttaatcttgttctgtagtgcttaataattgtcggtcgctctctttaattgtagtggtacttaattgccgggatcgccgtgtcgtgattaggagggtttaatgtgtcgtcgtcgccattgctgtcgtggtcgtagcgctgccgccgttgttgtaacctaaggttgattaggatgttgagtgtgctgattgttcagctaatgtggatctatttgtctcccggacaacgccaaggtggaggaggtgaaggccgggctggagaacggcgtgctcaccgtcaccgtgcccaaggccgaggtcaagaagcccgangtgaaggccatcgagatctccggttgagt

SEQ ID NO: 20797 - DNA, 730 bp, Triticum aestivum
  Clone ID: PAT_TA_20797
tcggcacgaggcaaaagcagacaacatccaacgatccacagaattttccgagcgcacaagccgaagcaatcaacaccacgatgtcgatcgtgaggcggagcaacgtgttcgaccccttcgccgacctctgggctgaccccttcgacaccttccgctccatcgtcccggcgatctcaggcggcagcagcgagacggccgcgttcgccaacgcccgggtggactggaaggagacgcccgaggcgcacgtcttcaaggccgacctccccggcgtgaagaaggaggaggtcaaggtggaggtggaggacggcaacgtgctcgtcgtcagcggcgagcgcacaaaggaggaggaggacaagaacgacaagtggcaccgcgtggagcgcagcagcggcaagttcgtcaggcgcttccgcctccccgaggacgccaaggtggaggaggtgaaggccgggctggagaacggcgtgctcaccgtcaccgtgcccaaggccgaggtcaagaagcctgaggtgaaggccatccagatctccggctgagtattcgggtctggttcatgtgtgtgcgagttctgcaacctaaaagtatgctacagtcgtgtctttgttcttgccgagtctgacgagccatctctgtattgcgtttcttttccctgtcgtgtctgtactctgtacttgtgtaaggctgctcatagtggagactaacttagactagtaacatgcatatgttacta

SEQ ID NO: 20798 - DNA, 1165 bp, Triticum aestivum
  Clone ID: PAT_TA_20798
aggtcaagcaaaagcacacaacatcctagtcctacctacgatctacagaattttccgagcgcacaagccgaagcaatcaacaccgacgatgtcgatcgtgcggtggagcaacgtgttcgaccccttcgccgacctctgggcggaccccttcgacaccttccgctccatcgtcccggcgatctctggcggcacgagcgagacggccgcgttcgccaatgctcgcgtggactggaaggagacccccgaggcgcacgtcttcaaggccgacctccccggcgtgaagaaggaggaggtcaaggtggaggtggaggacggcaacgtgctcgtcgtcagcggcgagcgcaccaaggagaaggaggacaagaacgacaagtggcaccgtgtggagcgcagcagcggcaagttcgtgaggcggttccgcctgccggaggacgccaaggtggaggaggtgaaggccgggctggagaacggcgtgctcaccgtcaccgtgcccaaggccgaggtcaagaagcccgaggtgaaagccatcgagatctccggctgagcattggagccagtttggttgatgtgtgtgcgaggtctgcaacctgaaagtatgctacagttcttgctgatcgagtctggcgaggcaactatgaacaatgtattgcgtttctttccccagtcgtttatatacttgtgtaatcacctacagatttggtgatgaataaaccggtcggcttttgctcgaatttgcaatggataatacaacaacattagagaccgtccatggcggcgtccaagcgcgcgcaacgcggccttatgcatctaagctcgaacttcaacaagagataaaaccgtacgtagtacaatatttaccgcccacccgcatcatcatcgccccctccccacgatcagttgtggcagatcttggcggtgggcatggtgatgcagacgggggcgtacttcttcttggcctcgggactccccttcttgacgtccgactcggcgaacgccaccccgccaatggccgacaagcgcagcggcggcagcaaacaccacggcacggcggccgtcggtggcgggctccacggctgccatcttgcgcgccggctcctgctggccctcgaccttggcggcccgggccaccacgaggcgcgcgcggggctgccgcggccgcgaattc

SEQ ID NO: 20799 - DNA, 823 bp, Triticum aestivum
  Clone ID: PAT_TA_20799
aggtacaaaaaaaaatcagcaattttgcacagaaacaaaatatatgtatacattcttcaaaacgtagggaaatcagctaaagttgaaaattacacgtttcagaaagagatgaaagataaaagaagaacgcaactagcaaaacccgagaatgcgctcaacatggtgtgctacagattttgcaaggctgtccgctgcttccacggtagatgcctctgcgtatactcttaccacatcctcagttccagatggccgcacaaagcatcgcccgtgagagtaattaacgacttccttatctatcaattcttgcaagccagatggttggcaaacttttcgttctgcatcggttgtaacaatagaagttcgatctttcactttaaccttaagttgtttacttggtagatcagtgtataggtcacaccaattctgaaatgaccatctcttatgctgtaaaacagcctccaccaaaagcattccacttatagcatcacccactgcttgattaattaattgacttgttgctaccaatctcaacgcagcttggtgctgtggagaacctgcagcttcagaaagcctagcagtcaaagactcaagccgtgagacaaactcatcattgaatagcactgtcccgtgtccattggcctcaaagtagacaccaatatcatattctagagctttcttgtggagatatttcactcctgttgaagtgaagacaacttcaagaccaatatttttaagaaattctgttgatgccccattggcataagcagtttgaactacaccaaacctgtaggcaataatcctttattgtcttttccattgatga

SEQ ID NO: 20800 - DNA, 1320 bp, Triticum aestivum
  Clone ID: PAT_TA_20800
tccggaaaaaagaactcattttcctcttgcttgcgcgtgctagcggttcccaaatcccaccagcgccgccacaagccgccggtcgccggtggccgctcccccggatcccgccgtcgccgctccctcgcttcctccgtagtgcacgcatcctccgccggacgccgccccacctcccccgtcgcgcagagcatccaggcgggacgccgacgccctccctcttcctcgacgcccatctcctcgccaccgccctcctaggcgccccctcctcgacaacgacccgaatctgcctcttctccaacgccggccgccgcggatctgcatctgcctcgtcgccgggcggatgttcctcgccaaatccaaggaatcgatgcagtatcaggtcatggaggggaggaagggcatgcaagagtcagacactgcacctgttgttcaagtacccagagagcctgccatcgttatcaatggtgtcccagactttcctcctgatttcgcatctggttcacaacttgcagtaagagatgccccgcgatctggagttgatcatcgctttggtgaatggctagtagagaggaaagtgaggaagtggtttggagacaagtactatgcagggcaagttgtcaggtatgacagtggaaacaattggtacaccgttgtctatgaagatggagaccaggaagatcttgagtggcacgaactggaggagatcctgctaccgttggacataaccattccactcaacacacttgtgatggacaaattcaatcatcagaatattgctcctgactacagaactaatgttgctagcaatcagatggtggtcagagcggtaaatcgccaacagtcaaacaacctgccactaccagggtggcttcaggcgtcagcatcagcaggagaaaatgctctagtatgtctgaaacctagtgatcaacctaagaaaaggggcaggcctcgaaaggatagaagtacatcaggtgatattcaacctgtgcgcaaaacaacaggtgatattcaacctaaaaaaaagaggcagacctccaaaagaacctggagagaagagtattgataggcgcaaattagagactgtcagggcagaaaaactgaagagagaaagcatgcttctgcgagggccaccacctggaagccagtcattctaataatcaatatcaccgttccaatatctagtagatatctctaaatattccagtctatgtatgcttgcgacactagctttcaatgtactttgtacaacccaacccagcgtacttttaaatctatgtttactatgcgactgctgtcaaaaaaaaaaaaaaaaaaaaaaaa

SEQ ID NO: 20801 - DNA, 1239 bp, Triticum aestivum
  Clone ID: PAT_TA_20801
ttttttttttttgggctgaactgttatacattcataatggtgcctcatttagaagggcttgatattatgtctaaggctgtaaccatacaaatggggagaaacaagctaaaaatgaggaatagcttatccataagtcaatactatcaacagtttcatgttttgcggagcgtaagcttccattattctcaagaggcatccatactagataggaaaaatagagtggcatacataacacgaggcactaagtagaagcgagaacttttctataaatgacctactactccagattgtttacgcagtctccacatcgggcacagcatcgccagcagtatcttcaggtccagcatccttctggacaaaatcatacccatattcctcttctgaagcatcctcctccgcacttctgccaaagatgaatggtctcttgcccatcgtcgtgaaaggcatcagccccagtgcacgcgctgttttaatctctctcgccaccttgcgctgagcttttgcacttatcttggtctgattcctcttgatgataatgccagcctctgtaataaagttggcaaggaatctaacattcctaaaatcagctttccttaaaacttcctttgtagatgtttcaaactgaggtctaggaggattccttggggctgcaggttttgttaggtcaagatcccggacattgtaagtcgagcctcgcctgtaattcacatctggcctgaaatcatagtcatcgtcctcaacctcatccgtcatgtgaaaggtgcgggccgcgtcgtccaacttctcgttcatgccatcgttcaaggagtcgaaaccatccatgatcccatgaacactcctctcaccaaacaagttacccatcccaccctgctgactgaaggcacccatcccagagccggtgccatgtcttcctccgaaggagctcccaaccccatcgagcttcccgaagaacgagttggcatccggctccctctggttcccaaacatccgcttttcaaagtcctccgtgctctcgcccgccgcgccctcttcggactggaaggagcgacggaacgaggaggtggcggcgggtggtgggtgggaagggaggaggcggcggagcgagccgcgccgtggaagagatcgcctcagcgccgagctcgccatctcgctcggtgactcgtcggcggcgccgcaatccgtcaccagaggaagcagaggggaggagggttgggggttattggatcggacgcgtgggtc

SEQ ID NO: 20802 - DNA, 1426 bp, Triticum aestivum
  unsure (1)..(1426): unsure at all n locations
  Clone ID: PAT_TA_20802
ccaaatcccaccagcgccgccacaagccgccggtcgccgctcccccagatcccgccgtcgctgccccctcgcttactccgtagtgcacgcatcttccgccggaggccgccccacctcccccgtggtgcagagcatccaggcgggacgccgacgccctccctcttcctcgccaccgccctcctcgccaccgccctcctagacatcccctcctcggcaacgacccgaatctgcctcctctccaacgccggccgccgcggatctgcatctgcctccgtcgccggacagtgagctcctcttccactctcgatgtttctaagccaaatccaaggaatcgatgcagtatcaggtcatggaggggaggaaaggacatgcaagagtcagacactgcacctgttgttcaagtacccagagagcctgccatcgttatcaatggtgtcccagactttcctcctgatttcgcatctggttcacaacttgcagtaagagatgccccgcgatctcgagctgatcatcgctttggtgaatggctagtagagcggaaagtgaggaagtggtttggagacaagtactatgcagggatagttgtcaggtacgacagtggaaacaattggtacaccgttgtctatgaagatggtgaccaggaagatcttgagtggcacgaactggaggagatcctgctaccgttggacataaccattccgctcaacacacttgtgatggacaaattcaaacatcagaatgttgttcctgactacagaactaatgttgctagcaatcagatggtggtcagagcggtaaatggccaacagtcaaacaacctaccactaccagggtggcttcaggcgtcagcatcagcaggagaaaatgctctagtatgtctgaaacctagtgatcaacctaagaaaaggggcaggcctcgaaaggatagaagtgcatcaggtgatattcaacctaaaaagaggggcaggcctcgaaaggatataagcacatcaggtgatattcaacctaaaaaaaagaggcagacctccaaaagaacctggagagaagagtattgataggagcaaattagagacagtcagggcagaaaaactgaagagagaaagcatgcttctgcgagggccaccacctggaagccagtcattctaataatcaatatcaccgttccaatatctagtagatatctctaaatattccagtctatgtatgcttgcgacgctagctttcaatgtacgttgtacaacccaacccagcgtacttttaaatctatatttactatgcgactgctgtcatatcaaattcttctcctagacaagtatatctgcatgctgtttaaaattcctctgggtacagtctttaggattctccttgtggaaagggaacctagtgtggttaatttcaanaaaananaaaaaaactcnaggggggg

SEQ ID NO: 20803 - DNA, 1900 bp, Triticum aestivum
  Clone ID: PAT_TA_20803
ggtggtcagagcagtaaatggcctacagtcaaacaacctgccactaccagggttgcttcaggcgtccccatcaaatgcagagactgtcagggcagaaaaactgaagatgcagacctccaaaagaaaaactgaggaggtatatcagcctaaaaaaaggggcaggcctcgaaaggatagaactatatcagtatcaggtgacattcaacctaaaaaaagaggcagacctccaaaagaaaagaacatatctggggagagtagtgttcataagcgcaatgcagagactgtcagggcagaaaaactgaagagagaaagcttgcgtgttcgaggggcataacctaacaatcaatctcactgttacaatacagatatttctaaatattccagtctatgtatgctggtgacactagctttcaatgtactttgtacaacccagcgtacaacaaaatttgtaaagctatatttactattcgagcactatcatatttcttttcctatacaagtatatcttccaactgtttgaaattcttcgggtatggccttagaaattttccttgtggaaatgaaacctagttgtggttgtctggctgaattcttttgaaagatccttgagttgtttcgtgagtgttggagatccacaatagaaaacacctatacgagagttcttgtgggcattggccaaatcagagaacacttttctccagttaggccttgcaaaatgtgtccgaatcttgcttccggagacgatgtcaacaccatttttggcatgctggagtgactgaaccatggcaatcagcgctgaccttgcgtcgccttcttcatacacgctggtgaggtaattgtgcatctctatgacatcgctgtgatcgttgtcagcgacttcattcatgactcctttgaaccagtcgaaggatccttgctctctggtaacccagtagaagtaagctctccctggcccactgttcttgaagctgcctatctcagaaccgtgtatactttccacctcatcattggactttatgttgttcaagagatctttcaatatgctgatgaaaggagtggcgccaattccaagcccgataagcaaaagaatgtcgtatttcttgtaattttgcgccggtgcaccataagggccatcgatgaagaccttaggaaacctggtgtcttctgtcgcagagtctgccacaactgtagtttcaagtctcgaaagggtggccttcttggaagtaacttgtgcctcgaaacacttcccgaacaagttcttgagttcagatgtccagtcacctagcgtgcggatatgcacgctcaggtaatcatctccaggtgcagaagtaatggagaacggatgccattcgaaaggcgaaacgtcggggcatttcacaaacaggtacatcccactcttgtacttgaaacccggtggcttcttcatgtgaagagagagcacattttatgggtagatcccagccttgagaatgttcacgtggtagttgttttcgcgaacttttctgataatcctctcgcaggcgtagaagaggacagggactatgaggaacatccatgtcgtcttcttgtaccagattctggtgaggaatatgaagtaggaatgcaccacgaggaggacatagacgagcagcagcaggtggtgcgcgtaccagaaggcgttgaagccggccaggtggtgcagcggcgacggcagcttgacgacgctccgcctgaaggtgtgcatggccagcgtgaaggagaaggtcatgatgatgatcatgaggatgccggtgacccctggggcgctggccagcaggtccgggtacgtcggctgcatgaagccgaagttggggcccagcagggccatgaacttgtcgctcgggcaggagatgagcctggggaagtcgcaggtgacgtgggc

SEQ ID NO: 20804 - DNA, 732 bp, Triticum aestivum
  Clone ID: PAT_TA_20804
ccagtgtcaagcaaaagcagacagcaagcccgttcctacctacgatcaaatacataatttccccccaagctacaagccaaagcaagcaacaccgacaatgtcgatcgtgaggcggagcaacgtgttcgaccccttcgccgacctctgggcggaccccttcgacaccttccgctccatcgtcccggcgatctcaggcggcaacagcgagacggccgcgttcgccaacgctcgcgtggactggaaggagactcccgaggcgcacgtcttcaaggccgaccttccaggagtgaagaaggaggaggtcaaggtggaggtggaggacggcaacgtgctcgtcgtcagtggcgagcgcacaaaggagaaggaggacaagaacgacaagtggcaccgcatggagcgcagcagcggcaagttcgtgcggcgcttccgcctccccgaggacgccaaggtggaggaggtgaaggccgggctggagaacggcgtgctcaccgtcaccgtgcccaaggccgaggtcaagaagcccgaggtgaaggccatcgagatctccggttgagtactcgggtcggacccagtctggttcatgtgtgtgcgagttctgcagcctaaaagtgtgctacagttgtgtctttgttcttgccgagtctggtgaggcgtctctgtattgcgtttcttttccctgttgtgtctctacttgtgtaatcgtcaaacagatttggcgatgtataaatgaga

SEQ ID NO: 20805 - DNA, 741 bp, Triticum aestivum
  Clone ID: PAT_TA_20805
gaattcccttttcctacctacgatccgataccgaattttccgagcgcacaagccaaaccaaagcaaacactgacgatgtcgatcgtgaggcggagcaacgtgttcgaccccttcgccgacctttgggcggaccccttcgacaccttccgttccatcgtcccggcgatctcaggcggcagcagcgagacggccgcgttcgccaacgcccgtgtggactggaaggagacccccgaggcgcacgtcttcaaggtcgacctccccggcgtgaagaaggaggaggtcaaggtggaggtggaggacggcaacgtgctcgtcgtcagcggcgagcggagcagggagaaggaggacaagaacgacaagtggcaccgcgtggagcgcagcagcggcaagttcgtgcggcgtttccggctgccggaggacgccaaggtggaggaggtcaaggccgggctggagaacggcgtgctcaccgtcaccgtgcccaaggccgaggtcaagaagcccgaggtgaaggccatcgagatctccggctgactgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaatt

SEQ ID NO: 20806 - DNA, 1158 bp, Triticum aestivum
  Clone ID: PAT_TA_20806
gggggcctttttttttttttttttccgaaaccataagcaaaacgagcatatgcttattatgtgttccgcacattctctttcaaaggcgaacctgaaaatgaggataactgagcacaaggcatatctccttcagaacaaagaacaaagtaacagttcgtcacaatatccttaagtcgtcggccgctgcatttttagacatctgcagtttgcaaattgggcgagcttgtagaggcgacaacgcccacactgtttacgcggcctccacatcgggcacggcatcggcatcggcaacggcatcttcaggcccagcatccttctcgacgaagtcgtacccatactcctcctctgaagcatcctcctctgcacttctgccaaacatgaacggcttcttgcccatcgtcgtgaaaggcatcagtcccagcgcacgcgctgtcttaatctccctcgcaaccttgcgctgagctttcgcgcttatcttggtctgattcctcttgatgataatgccagcttctgtaagaaagttggagaggaatctaacattcctaaaatcggctttccttaaaacctcctttgtagacgtttcaaactgaggtcttggaggattccttggggctgcaggtcttgtaaggtcaagatcccggacattgtaagtcgagccacgcctgtaattcacatccggcctgaaatcgtagtcatcatcctcaacctcctccgtcatatgaaaggtgcgggccgcgtcgtccaacttctcgttcatgccatcgttcaaggaatcaaaaccgtccatgaacccaccattactactacgctgaccaaactcgggccgaccaaaagcacccattccagagccggtgccgtgtcttccaaaggagctcccgaccccatcgagcttctcgaagaatgacttgtcatctgactcaaacagacgtttctcaaagtcgtccgcactctcccccgcgccctctcctagatctctcctgccgccatccgattcgatattttggttcggacaggaaggagcggcggaacaaggaggctgcggcggatgatgggtcggaagtgagcaggcgtcgtggaagagatcgtctcagcgccgagctcgccatcttgctcagtgcctcgtcgccggcgccgcaacccgtcaccagagaagcgaag

SEQ ID NO: 20807 - DNA, 1239 bp, Triticum aestivum
  Clone ID: PAT_TA_20807
cgcggtgctggtgcacgttgctttttcgcgcaggtcgatatcacagggcaaagtgggcaaaggggaagggcatatctccttctgaaaccataagcaaaacgagcatatgcttattatgtactcctactccgtacattctccttccgagcgcaaacttgaaaatgaggcatgactgagcacagagcgtatctccttcagaacaaagaacaaaataacagttcgtgatatccttaagtcgccggccgcttcatttttaggcatctgcagtttgcaaactgggcgaacctgtagaggcgataatgcccagactgtttacacagtctccacatcgggtacggcatcggcaacggcatcttcaggcccagcatccttctcgacgaagtcgtacccatactcctcctctgaagcatcctcctccgcgcttctgccaaacatgaaaggcctcttgcccatcgtcgtgaaaggcatcagtcccagtgcacgcgctgtcttaatctccctcgcaaccttgcgctgagctttcgcgcttatcttggtctgactcctcttgatgataatgccagcttctgtaagaaagttggagaggaatctaacattcctaaaatcagctttccttaaaacttcctttgtagatgtttcaaactgaggtcttggaggattccttggggctgcaggtcttgtaaggtcaagatcccggacattgtaagtcgagccacgcctgtaattcacatccggcctgaaatcgtagtcatcatcatcaacctcctccgtcatatgaaaggtgcgggccgcgtcgtccaacttctcgttcatgccatcgtttaaggaatcgaaaccgtccatgaacccaccattgctactcccctgaccaaactcgggccgaccaaaagcacccattccagagcccgtgccgtgtctaccaaaggagctcccaatcccatcgagcttcccgaagaacgacttgtcatctgactcaaacagacgtttctcaaagtcgtccgcactctcgcccgcgccctctccggacaggaaggagcggcggaacaaggaggctgcggcggatgatgggtcggaagtgagcaggcgtcgtggaagagatcgtctcagcgccgagctcgccatctcgctcagtacctcgtcgccggcgccgcaacccgcaacccgtcaccagagaagcgaagccagggatggggggtttggggcttctttttgcgtttcagacccgccgtagctccccgc

SEQ ID NO: 20808 - DNA, 784 bp, Triticum aestivum
  Clone ID: PAT_TA_20808
catattcctaccaacgatccgatacagaattttctgagctcacaacccgaagcaatcaacaccagcaatgtcgatcgtgcggcggagcaacgtcttcgaccccttcgccgacctctgggcggaccccttcgacaccttccgctccatcgtcccggcgatctcaggtggcagcagcgagacggccgcgttcgccaatgctcgcatggactgggaaggagacccccgaggcgcacgtcttcaaggccgaccttccaaggcgtgaaagaaggaggaggtcaaggtggaggtggaggacggcaacgtgctcgtcgtcagcggcgagcgcaccaaggaaaaggaggacaagaacgacaagttgggcaaccgccgtgggagccgcagcagcgggcaagttcgtcaaggcggttcccggctgcccgggaggacgccaaggtggaggaggtgaaggccggggctggagaacggtgtgctcaccgtcaccgtgcccaaggccgaggtcaagaagcccgaggtgaaggccatccagatctccggctgagtgaatgcgtctctgcgaatgatcatcagggttggagccagtttggttaatgtgtgcgagttctgcaacctgaaagtatgctatagttgtgtcttcgtcttgccgagtctgatgagacatctctgtagtgcgtttctttccccagccgtgtatgttcttgtgtaatcgccaacagatttggcgatgaataaatgaaaaataaacccttctgttttaaaaaaaaaaaaaaaaaaaaaaaaaaaaaac

SEQ ID NO: 20809 - DNA, 598 bp, Triticum aestivum
  Clone ID: PAT_TA_20809
aaagtaatcaaacaagcggtttcacctcgaatttgcaatggataatacaacaacattagagaccgtcgatggcggcgtccaagcgcacgcaacgcggccttgtgcatctaagttcgaacttcgacaagagataaaaccgtacgtagtacaatatttaccgcccacccgcatcatcatcgtcccctccccacgatcagttgtggcagatcttggcggtgggcatggtgatgcagacgggggcgtacttcttcttggcctcggggctccccttcttgacgtctgactcggcgaacgccacaccgccaatggccgacaaggccgcagcggcggcagcaaacaccacggcacggcggccgtcggtggcaggctccacggccgccatcttggccgccggctcctgctggctctcgaccttggcggcccgggccaccacgaggccgcggcgcggggcggccgcgcgccggtcgaccgctacggccgcggagagggacgccatcatggtgagcgacgccatcgggacggagctgctgagttgttgggacgatctgcgctgggagcgtgtgatgatgatgctagtggggtcccgaaaccggccggc

SEQ ID NO: 20810 - DNA, 843 bp, Triticum aestivum
  Clone ID: PAT_TA_20810
caccaaatctattggcgattacacaagtaactggggaaagaaacgcactacagagatgtctcaccagactcgccaagaacaagacacaactgtagcatactttcaggttgcagacctcgcacacacataaaccaaagtaacaccgacgatgtcgatcgtgcggcggagcagcgtgttcgaccccttcgccgacctctgggctgaccctttcgacaccttccgctccatcatcccggcgatctcaggcggcaacagcgagacggccgcgttcgccaatgctcgcatggactggaaggagacccccgaggcgcacgtcttcaaggccgacctccccggcgtgaagaaggaggaggtcaaggtggaggtggaggacggcaacgtgctcgtcgtcagcggcgagcgcacaaaggagaaggaggacaagaacgacaagtggcaccgcgtggagcgcagcagcggcaagttcgtcaggcgcttccgcctccccgaggacgccaaggtggaggaggtgaaggccgggctggagaacggtgtgctcaccgtcaccgtgcccaaggcccaggtcaagaagcccgaggtgaaggccatccagatctccggctgagtggacgcgtctcggcgtatgatcatcagggatggagccagtttggttgatgtgtgtgcgaggtctgcaacctgaaagtatgctacagttgtgtcttgttcttggcgagtctggtgagacatctctgtagtgcgtttctttccccagttacttgtgtaatcgccaatagatttggtgatgaataaatgagaaataaatccttctgtttttgggtgcaaaaaaaaaaaaaaaaaaaaaaa

SEQ ID NO: 20811 - DNA, 1313 bp, Triticum aestivum
  unsure (1)..(1313): unsure at all n locations
  Clone ID: PAT_TA_20811
ttttttttttttttttaagcaaaacgagcatatgcttattatgtgttccgcacattctctttcaaaggcgaacctgaaaatgaggataactgagcacaaggcatatctccttcagaacaaagaacaaagtaacagttctcacaatatccttaagtcatcggccgctgcatttttagacatctgcagtttgcaaattgggcgagcttgtagaggcgacaacgcccacactgtttacgcggcctccacatcgggcacggcatcggcatcggcaacggcatcttcaggcccagcatccttctcgacgaagtcgtacccatactcctcctctgaagcatcctcctctgcacttctgccaaacatgaacggccctcgtgccgaattcggcacgagggtcaaccaaaagcagacagcaaccccaacctacctacgatccaatacagaattttcctagcgcaagagtcaaagcaagcaacaccggcaatgtcgatcgtgcggcggagcaacgtgttcgaccccttcgccgacctctgggcggaccccttcgacaccttccgctccatcgtcccggcgatctcaggcggcagcagcgagacggccgcgttcgccaatgctcgcgtggactggaaggagacgccctgaggcgcacgtcttcaaggccgacctcccaggcgtgaagaaagaggaggtcaaggtggaggtggaggacggcaacgtgctcgtcgtcagcggcgagcgcacaaaggaggaggaggacaagaacgacaagtggcaccgcgtggagccgcagcagcggcaagttcgtcaggcggttccggctgccggagggacgccaaggtgggggaggtgaaggccgggctggagaacggcgtgctcaccgtcaccgtgcccaaggccgaggtcaagaagcccgaggtgaaggccatcgagatctccgtctgagtgaatgcgtctctgcgaatgatcatcggggttggagccagtttcgttatgcaacctgaaagtatctttgttcttgccgagtctagtgagacatctctgtattgagtttctttccccaagccgtttctgtacttgtgtaatcgccaacagagggataaatgagaaataaagtgtgctgattttgggtgcagtgatgattttgatacacaaaaaaaaaaaaaatgtatgtagtactaaatgaacaaacaggaagcgactggcttcatcgaccgaacaacaaccttgatttcaaacttgtggcttaaattacgcngtcggatgtgggacggacgggcggatcaggcgcaggtgtagcccgggggcacggtgacggt

SEQ ID NO: 20812 - DNA, 692 bp, Triticum aestivum
  Clone ID: PAT_TA_20812
caggtcagcgttgtgatcaattcattttcagggaagaagatcactcgacagacgaaagggcgcgtgcatgaaagtaatcaaacaagtgcggtttcacctcgaatttgcaatggataatacaacaacattagagaccgtccatggcggcgtccaagcgcacgcaacgcggccctatgcatctaagctcgaacttcgacaagagataaaaccgtacgtagtacaatatttaccgcccacccgcatcatcatcgtcccctcaccccggatcagttgtggcagatcttggcggtgggcatggtgatgcagacgggggcgtacttcttcttggcctcggggctccccttcttgacgtccgactcggcgaaggccaccccgccaatggccgacaaggccgcagcggcggcagcaaacaccacggcacggcggccgtcggtggcgggctccacggctgccatcttggccgccggctcctgctggctctcgaccttggcggcccgggccaccacgaggcccgcggcgcggggctgccgcgcgccggtcgaccgccacggccgcggagagggacgccatcatggtgagcgacgccatcgggacggagctgctgagttgttgggacgatctgcgctgggaatgtgtgatgacgatgatgctagtggggtgcgttttggtgcggggctactcgtgccgaattc

SEQ ID NO: 20813 - DNA, 1107 bp, Triticum aestivum
  Clone ID: PAT_TA_20813
gttttccctattcctgtgtttcggaaatcctacaaatcaaaggggccctaaattcaattccccagtggtcacattcctttaatacacacacataaccaatgagcttgatcatggatactaactggcattaaacaaaaatacttccttcttacactgttctttccaagacgtctcggacaaacaaaaatgactttcaaaactgaagccaaacagccacagtatgcttgcacactactcaaggatgagcaatagatatggtttaacaatgctaaacttagttcatccgctgcgcagcctcctttgcgataagcctttccctggccttggtcttcgcttgcgacttggagcccatgacaccaccaccccacttcttcctaacctcatcaaatttgtcgttgaagttcgccttaatagcctcaaggatcttgctgaactcaagcttatcctcattcttcactgtggtcaggcacagaacagaggcagtcttcttgtgaacaatcgatccaaggcgagattttcccttgacaatgcagtaagggacctccattttcctgcaaagagcagggagccacacaaccagctcaatcggatcaacatcatgagctatgacaaccagctgggctttactctgctcgattaggtaggtaacatggttaaggccatacttaacaactattggcttcttggcctcaacagtcttcccttcagcttcagcctgggccctctttagaagcctctccttcttggcagctttgtcttcaggccggtacttaagaagcatcttgaacaagtttgttgcaaggttcttgtcgagggtgcgggtgaactggtggagtgccgggggcaccttgaggcgctgcttgaggatgcggcgctggcgctggattcgcacaaccttgggccacttaacgaagcggtgtaggtccttcttgggcgggagggcgccgccgataccgaattgcttcggcctcttctcgaacagcgggttggtcaccttatccgttttcttcttcgccgggaccggcgccttgccgcctcgcttaggggccatttcgccggcggctggttgaggtcagcggagcgacggcgagggggcagacgcggacg

SEQ ID NO: 20814 - DNA, 766 bp, Triticum aestivum
  Clone ID: PAT_TA_20814
tcggcacgagggtgtaaagcaaaagcacacagcatcctagtcctacctacgatctacagaattttccgagcgcacaagccgaagcaatcaacaccgacgatgtcgatcgtgcggcggagcaacgtgttcgaccccttcgccgacctctgggcggaccccttcgacaccttccgctccatcgtcccggcgatctctggcggcagcagcagcgagacggccgcgttcgccaacgcccggatggactggaaggagacccccgaggcgcacgtcttcaaggccgacctccccggcgtgaagaaggaggaggtcaaggtggaggtggaggacggcaacgtgctcgtcgtcagcggcgagcgcaccaaggagaaggaggacaagaacgacaagtggcaccgcgtggagcgcagcagcggcaagttcgtcaggcgcttccggctgccggaggacgccaaggtggaggaggtgaaggccgggctggagaacggcgtgctcaccgtcaccgtgcccaagactgaggtcaagaagcccgaggtcaaggccatcgagatatccggctgagtattcgggtcagagccagtctggttcatgtgtgtgcaagttctgcagcctaaaagtatgctacagttgtgtctttgttctcgccgagtctggtgaggcatttggtctctgtattgcgtttcttttccctgttgcgtctgtacttgtgtaatcgccaacagatttggcgatgaataaatgagaaataaattgttctgattttgagtgc

SEQ ID NO: 20815 - DNA, 1121 bp, Triticum aestivum
  Clone ID: PAT_TA_20815
ctctgggttcccgtgtgtttcccttttttggtgggttgttttgattcttgtctttttttttttttttttttcttttttttttgttttttttttttttttttttttttttttttttttttttcgacaaaaatactaactggcattaaacagaaatacttcattcttacactgttctttccaagatgtctcagacaaacaaaaatgacttccaaaactggagccaaacagccacagtatgcttgaacactactcaaggatgaggaatagatatggttcaacaatgctaaacttagttcatccgctgcgcagcctcctttgcgataagcctttccctggccttggtcttcgcttgcgacttggagcccatgacaccaccaccccacttcttcctaacctcgtcgaatttgtcgttgaagttcgccttaatagcctcaaggatcttgctgaactcaagcttatcctcattcttcactgtggtcaggcacagaacagaagcagtcttcttgtgaacaatcgatccaaggcgagattttcccttgacaatgcagtaagggacctccattttcctgcaaagagcagggagccacacaaccagctcaatcggatcaacatcatgagctatgacaaccagctgggctttactctgctcgattaggtaggtaacatggttaaggccatacttcacaactattggctttttggcctcaacagttttcccttcagcttcagcctgggccctctttagaagcctctccttcttggcaactttgtcttcaggccggtacttaagaagcatcttgaacaagtttgttgcaaggttcttgtcgagggtgcgggtgaactggtggagtgccgggggcaccttgaggcgctgcttgaggatgcggcgctggcgctggatgcgcacaaccttgggccacttaacgaagcggtggaggtccttcttgggcgggagggcgccgccgatgccgaattgcttcggccttttctcgaacagcgggttggtcaccttctccgttttcttcttcgccgggaccggcgccttgccgcctcgcttaggggccatttcgccggcggctggttgaggtcagcggggcgacggcgagggggcagaccggacg

SEQ ID NO: 20816 - DNA, 705 bp, Triticum aestivum
  Clone ID: PAT_TA_20816
gcagtcttcttgtgaacaatcgatccaaggcgagattttcccttgacaatgcagtaagggtaatcaaacaagtgcggtttcacctcgaatttgcaatggataatacaacaacattagagaccgtccatggcggcgtccaagcgcgcgcaacgcggccttatgcatctaagctcgaacttcaacaagagataaaaccgtacgtagtacaatatttaccgcccacccgcatcatcatcgccccctccccacgatcagttgtggcagatcttggcggtgggcatggtgatgcagacgggggcgtacttcttcttggcctcgggactccccttcttgacgtccgactcggcgaacgccaccccgccaatggccgacaaggccgcagcggcggcagcaaacaccacggcacggcggccgtcggtggcgggctccacggctgccatcttggccgccggctcctgctggccctcgaccttggcggcccgggccaccacgaggccgcggcgcggggctgccgcgcgccggtcgaccgccacggccgcggagagggacgccatcatggtgagcgacgccatcgggacggagctgctgagttgttgagacgatctgcgctgggaatgtgtgatgatgatgctagtggggtgcgttttggtgcggggctatttggttatgaagatacggccggctgggctgcaaggcaaggcgcgc

SEQ ID NO: 20817 - DNA, 1038 bp, Triticum aestivum
  Clone ID: PAT_TA_20817
tttttcgacaaaaatactaactggcattaaacagaaatacttcattcttacactgttctttccaagatgtttcagacaaacaaaaatgactttcaaaactggagccaaactgccacagtatgcttgcacactactcaaggatgaggaatagatatggttcaacaatgctaaacttagttcatccgctgcgcagcctcctttgcgataagcctttccctggccttggtcttcgcttgcgacttggagcccatgacaccaccaccccacttcttcctaacctcgtcgaatttgtcgttgaagttcgccttaatagcctcaaggatcttgctgaactcaagcttatcctcattcttcactgtggtcaggcacagaacagaggcagtcttcttgtgaacaatcgatccaaggcgagattttcccttgacaatgcagtaagggacctccattttcctgcaaagagcagggagccacacaaccagctcaatcggatcaacatcatgagctatgacaaccagctgggctttactctgctcgattaggtaggtaacatggttaaggccatacttcacaactattggcttcttggcctcaacagttttaccttcagcttcagcctgggccctctttagaagcctctccttcttggcaactttgtcttcaggccggtacttaagaagcatcttgaacaagtttgttgcaaggttcttgtcgagggtgcgggtgaactggtggagtgccgggggcactcttgaggcgctgcttgaggatgcggcgctggcgctggatgcgcacaaccttgggccacttaacgaagcggtggaggtccttcttgggcgggagggcgccaccgatgccgaattgcttcgtcctcttctcgaacagcgggttggtcaccttctccgttttcttcttcgccgggaccggcgccttgccgcctcgcttaggggccatttcgccggcggctggttgaggtcagcggggcgacggcgaggggcagacggaggcgggggagtttttttaaatttttttttttttttt

SEQ ID NO: 20818 - DNA, 1360 bp, Triticum aestivum
  Clone ID: PAT_TA_20818
gggtagaaatcgtcactttttgaaatcattagaaaaatgaagttgttgttcaagggagcattgcagacgagaatggaattacatcaccaggataaacagtttgaggttggtacacaatacaattacaccttccataggaaccggatatacaaatcttacaagatgaatatcaaacggaaagatgataataatagtaataataataaaataaattgtagtagtactaaatgaacaaacaagaagcgagtggcttcatcgaccgaacaacaaccttgatttcaaacttgcggcttaaattatgcgcgtcggatgtggaatggacggacggatcaggcgcaggtgtagcccgggggcacggcgcagcccgcagtcgttgacgagcagctggagggcgagcggcacgtaaagggcgaggttgagcaccttggccttgatggcggtgcagaggcaggccgcggcggtgagcccggcgatgccctgcaccagcgggcagcacttgacgctggcgtcgccgatgtgcagctcgttgccgagcaggtccaggcacacgcccagcttcagcgtgtcgatcgggcacgtgtcggaggagggcgtggggctcggcgtgggcgtcgggggagtcggcgccggggttgggggagacggggtgggggttcgggggccgaggagggcacgccttgcgtccgccgtggcggctcttgggggacggggagccgccgatgatgggagtcacgacgccgatggcgggactgatgacgggagtgacaactcccccgacggcggggacgccgccaaccgcgccgcctacggtgccgacgacaggagagaccacgccaccgacggcagggacggcgccgcctacggtgccgacgacaggagagaccacgccaccgacggcagggacggcgccgcctacgaccggcgtgactttgccgacgacaccgccaacggtagggaccatgccgccgacgaccggggtgaccttgccgacaacaccgccgacggtagggacggcgccgccggcgactggggtgactttgccgacgacaccgccgacgaccggggtgactttgccgacgacaccgcccacggtcggggcggcgccgccgatgatcgggagtgacggtgccaacgacaccgccgatgaccgggggtatgctgacgccgccggccggagggcgtgccgctcgacggggtgccgctgccgcacccggaggcgggggagcacgcgagcacgacggtgggcgaggagagcgcgagcatggcgagcaccagcagcgcggagatcttcgtggactccattgcagcagccacctgtgagctgaggcgattgatcgtgtccgtgttacgtggggtgctg

SEQ ID NO: 20819 - DNA, 697 bp, Triticum aestivum
  unsure (1)..(697): unsure at all n locations
  Clone ID: PAT_TA_20819
gcacgaggccagtttctgtggaactacctcatgcaatttactcatctagttgtcagggatcgagtactcggactgccaggagaacatcaagctctcgttttgagcaaagccccccacaaacatttcgcagtctggcgagggagagaggtggacacagacgcataaacatggaaggcattgcagaggtattgctagtgctggagaggattgaacaagaagctgagcttacttatgagcaattgcgggtactggagacaaatctgttacttggtgccttcgcctcgcatgatcagcatagcgacatgcggatggatattgacaacatgtcctatgaggaactattagcattagaagagagaataggatacgtaagtactgctctttctgaagaacagtttgcaaaatgtatcagaaggcgtttatatagaccagttgctgcaaaaggaaacagttcagccatagatgacatcaaatgcagcatatgccangagggggcccgggagagcgaagaggtngcaagttccgtgtnagcacaatacaagtgtgcncattnncaatggtccctgcagaagactggggcccatccgtnaacccaacgctgcctcnctgaacgaacgacaccntnggacnaggcncaaaccgttaataattacaagtgatgttaatatccggtctggactgtganaactggtgggcc

SEQ ID NO: 20820 - DNA, 479 bp, Triticum aestivum
  unsure (1)..(479): unsure at all n locations
  Clone ID: PAT_TA_20820
gcccccgcccccggcctctcgcccgcgccgccgtcccccgttcttccccgccggaacgtcgagcccctgccgtctccgccgcgtccctccccggtctcgggccgtcgggtctcctttgcttgagtttgtcattgttttggttgcaaatggcgactgaagctgcctctcacatctctggcggttcggagtcaacaacggtggctttgctagaacaacttactgaagtatttggcaagctgaagtcccacacagaagcatccctacaattgcaaagtggcatccagtgggaagatatcaaagtacatttcctgaaccttgagaagtcatacagaagcaagtgtgatgaactggaaggaaagcagaaggcattagaagaacagaaagctggaagtcgtaggctgattgctgagaaagaagctgatctttctgcaaaagagcgtgcttctgtgaacaagcttcangagctgaaggatgctgcc

SEQ ID NO: 20821 - DNA, 852 bp, Triticum aestivum
  Clone ID: PAT_TA_20821
gctcattcctgccagtgaattgtcccagcatatcagtaccgctggaatgcgagccggcgcgaccagcaacatgaagtttgcaatgaatggctgtattcttattggaactttggatggtgcgaatgtggagatcagagaagaggttggagaggagaactttttcctctttggtgcacatgcacctgaaatcgctggtttgaggcaagagagagctgaagggaagtttgtgcctgacccgagatttgaagaggttaaggaatacgtccgcagtggcatctttgggactggcaactatgatgaattgatgggttctttggaaggaaatgaaggttatggacgtgcagattattttcttgttggcaaggattttcccagttacattgaatgccaggaaaaagttgatgaagcataccgagatcagaagctatggacaagaatgtctatcctcaacacagcgggttcccccaagttcagcagtgaccggacgatccacgagtatgccaaggacatatggggtatcagccccgtcatcatgccctgaataattcaagcagcttccaggaaccttgagagtctatgaggcgcgattggtcgctgatttgccttgattcagcgagaatgtattgctccccccagttttgtataggcatatgcaagttctgacatggacctgagtgctgagagcatgcagggtagttcatccttagcaatattgcatgtcagttagccagtattacccaggcttatggtgtgtgtatttcgctgaataaagttggagcagagtcatcaaacaaacatactttggtgtatctgtaatgataaataaatggtacatgtgactgaacaaaaaaa

SEQ ID NO: 20822 - DNA, 905 bp, Triticum aestivum
  Clone ID: PAT_TA_20822
gtctcctcctctactagcttcgggagtaagacagacagaatacatggatggatcaattatgggcatgggtggcaacaaggttaactatggtggattgtacaacatccaggggtggggcgcaccctacttcacggtgaacatggaaggcaacctgtgtgtgaaggcggatgggcaggagaccaaggcagggcaggagatggacgtgctgcacgtcattcaagctgcaaagcaaaagaggaaggacatccagtttccgatgatcctccggttccccaatgtgctcaagcaccgcctcgacgctctccacgccgcattccacacggccatcagccgcgccaggtacaccaatacataccagggcgtgttcccggtgaaggtgaaccaaaacagggccatcgtccacgacttggtttgcttcggccacgcttacagctacgggctggaggcaggctccaagccggagttgctcatcgcgatgagctgcctcacaaaggaggctaattccagagccttcctggtttgcaatgggtacaaggacgccgagtacgtgaggctggcgctgtcggcgcgtgccataggcctgaatgctatcatggtgctggacatggaggaggagctggacatcatcatccaccagagcagcaagctcggggtggagccggtcatcggcgtgcgcgccaagttgctcaccaagataccaggccactacgggtccacggccggcaagcacggcaagtttggcctgcccgcggacaggatctacgaggtggccaagaagctcaagggtctcaacaagttgcactggctcaagctgctgcacttccacgtgggctccatgatcccgaccacggagctagtggccaaagcggccacggaggccgccgacatctactgcaccctggtga

SEQ ID NO: 20823 - DNA, 580 bp, Triticum aestivum
  unsure (1)..(580): unsure at all n locations
  Clone ID: PAT_TA_20823
ggaaatcacacgctctggaagctgtgtttccgctagcccgcgtgtagggatagattggaagatgggacgcatcttgctcctctgcgcattcctcctcgtcctgctcagcgtggccagcctcatggaggtaacggaagggaggggccgaggcggatcacgcggcggaggaagcggcagcccgcgtggcctcagcggtggcacctgggtggcgtgcgtcggctcgtcgctgctggccgccgcggccatgctcctgtaggcccgagctgcgtgcctcagctatggagtgatatacggccggctggcggtctcctgcgtgcgtccttgggtgattgtggggggcgtgacttgtgtctgcttgacgtcgtgctgtcggttctcctggttgtttcccgcgtctacagtgggtcctgcctcaatgcgtgaccttctcctcggacatgtatgtttttcctgtcggttccccgggacgtaatagatactcaatcgttttaatatagttatttagatatcaatatgacaatacggcaaataataancaccctaaaactcatatcatcgtagtatcatatcaatcctannn

SEQ ID NO: 20824 - DNA, 816 bp, Triticum aestivum
  unsure (1)..(816): unsure at all n locations
  Clone ID: PAT_TA_20824
gttcaagctataccaggaactaatactacccatttatctcagcaagttcaacctatacaaagaaccaatcctttcagtggtactgtcaagaaaagtgcccctcagagatctctcagtgcgccaatagcatctcaggggcaacaaggtcagctggcagcatcttcacaggctgcctcaaatgtagtgcacggcgtaggacctcaactttcccggtgcacctcgcttatgaatgagagcagacaattcctgccagaaccagtaatcgatgtttccacacaaagctgggcaagacatacttgctagtgtggcatcggatctggggagtattagatgatcctgcttaacaataccaagtactcnacggtcccaaccacctggtggaggacttccccccactccgcctgccgggccaaacaagggggggaaggcctcgggccgcgtcgccgcgccgccggcgtctgccgtctcctgggggtggcctgcacggcatgcttccgtggcggtcccaggcgggggcccccacgaccttgcacccctggctacggtggaccccccgattatcgagctgtcggtgccaacccccgcaactggaggttgccctgcccccctggatctcgtttgggcaaggcgccacacnggacccccggggggtccaacccctaaggggcgcctacccactcgggcttggaagcctaacgcggggtgccggcctggatttccggcggcagttttcggaatagncggggtacttccgggcctccccgccctttggggggatttcccttaaaataaaagggaggggggaatttccagggg

SEQ ID NO: 20825 - DNA, 552 bp, Triticum aestivum
  unsure (1)..(552): unsure at all n locations
  Clone ID: PAT_TA_20825
ctagattcagatttacatgaaccaacaacgggctgtgagaagcgacaatgctggaggagaaaatgtgctgaaactggatgtgtatcatggtcctttcttcttcgaggagacggagcatggcgcaaactgggggtttgcctatacgtgattctgaaggaggatcagctccgcttcgatgcatacttgctgcaggcataactaggcgccgtgcctatggtatatcgagctatagtgccgcaagacgcggggtatgcctttttattgtagggcaagtatagtgtttggctcctctttgctcgttgcatgttcacatgctgcctgggtctcgtctctatttttctcttttgtgagagctccctgatctcatctcactaggcagtaacttgtatgagcactgccatgggtttagtgcaacattcaagagtgtacatgtttggagctgtttcatgttaaacggatgaccgcgttcatgaaaagaagagatgtaancgtcnatggtagaaaaattaacaacgttcaatatactcagtctttgcctccaaaaaaaaaaaa

SEQ ID NO: 20826 - DNA, 946 bp, Triticum aestivum
  unsure (1)..(946): unsure at all n locations
  Clone ID: PAT_TA_20826
cccacgcgtccgccacgcacgtcagtccagcctcgtctcgtttcgtgtcgtctgctcgggaccaggaaagatgacgccgctccacgccgccccgccgccgctctccgcgtcggccgcggtctcctcatccgcgccacctcccctcctcgccaaagcttaccatcccaaggccgcggccctttgctcactcaccgtgaccgccgccaccccatcaagaaaagcttttctcgcatgcccggatcacggcccggcgggcgggcggtcgctgacgccggcgcgcggcgctcccgcctcgtccccggcgctcatctcggccgtcaaggacctgtacgagttcatctgcagcgggccgctggtggacaggatcggctacacccgggagaagatcgccgagtccatcgaccggtggctgtggtgcggctcgcaggtgagccggttgttccgcatcgacgagctccggctgacggacgccgagaagtcgcggatataccacttctacatacccgtctttctctggtgcgaggaccaggtcgccgaccacaggtccaagtacaacgacggcgacgagatccagccattagtgattggagtcagcgctccccaaggcagcgggaagacgcctcatggcttcgctcttgttcatctttttcgggtttctggtaggaattctgaggaattctgtatcgatgacttccgattgactctagcagaccagggagaactggggtaaacacatgctaaacatgctcttggaaaatgctcttttaaaagtttcgtggaaaatgccggnaaccacgannttccaaattttnaattgacacacnttgaagtcacttgatnaaactaacaaaaggaaggnccgaanatgaaannttncccggtntgacaagtccnnttttgngggaaaaggggancganntnnccctttnanatggncagaaggnta

SEQ ID NO: 20827 - DNA, 1160 bp, Triticum aestivum
  Clone ID: PAT_TA_20827
gggcaaacgaagcaagccccctccggccctcttatcctcttcctctcgcgacggcggtggcgccgagtgcacccaggcctcattccaccttaccacgcaggtaactgtgctttgtgcaaggccgggtttatacaaaatggttctctgtcaaggcttatctgctgggcaggggcagcttcttgcttttcctgctgctaagcctcctctcttaagaagatcttgcattcgtataccagcgggatcaccgggtctaaagagtgctcggctttcatccaagaggaagaaactttcagtgcaagctgtacgagccggcactggttttcttcaccatgacatgctcacatcatctctgatggagggttcgatcaagggcattccatcattattgacccggcagaatcagcgtcgaagatcggaagttggctgtcgagcttcctctctagcatcattcagctaccctgaattgacttccaagcccagatggtggtggagaacccttgcatgtgtgccgtacttgctgccactccacaacatgtggtcgtatgccgatgtcatctaccagttgcacacgtacttgcagggcttttcattggtttatactttcatcgacaccatgacactgcttccagggtggcgcttgctggtgatatttatgaccgtgtacttcttcgtggtgagacgcaagtggtcaccccacttcatgaggttccatgtgatcttggccatcctcctggacaccggctcccaagcagtggcaacaatgtgcacctggatgcccagctttgtgtatcaggggaagcccatgcagtatttctggatggccgttgctttcatgcagatcttcacggtgctagagtgcatgcgctgtgctctctgtgggatgtatccgaacgttcctttcatatcccacacagccttcatccattctgatctgaatctcttcaggtagccacctgctcaccatgtcgggtttttgatatcagaaggatggaaagtgagatggaggtgcaaataggtagtactttttttttgcagtagctacttacagttctatagactgttttgtttatacttaaattttgaagtctcgttgtaattgccaggatcgtgacctttttccgttatggcaaaatccaaatagtgacgcgattgatttttgc

SEQ ID NO: 20828 - DNA, 1064 bp, Triticum aestivum
  Clone ID: PAT_TA_20828
gattggggctgaccggacggcgtccattgagacgctcatgaaccatctgcaggaaactgcactcaatcatgtgaaggtcgttgggctgctaggagatggcttcggttcgacgccggagatgagtaaacggaacttgttctgggttgtcagccaaatgcaggccatcgtcgagcgttatccatgctggggtgatactgttgaggtgaacacctgggttggccatcatggtaaaaacgggatgcgtcgggactggcatatacgtgattctgtgacgggccttacagtactgaaggcgacaagtaaatgggttatgatgaacaaggttactagaaggcttgcaagaattccagatgaagtacggactgaaatagagccgttcttttctgagtatgctgctattgatgaccaagacaaccgaaaatttccaaaactgccggagcatgaccgtgctacctcagccaaatatgtccggacaggcctgactccacggtgggctgatcttgatatcaatcagcatgtcaataatgttaaatacattggctggatccttgagagcgcgccaatctccatcctggagaaccatggactggcgagcatagtcctggactgcaaacgggagtgccgccggaacagcgtcctggagtccacaccacggtgcacaccgactgcgccgacgagtccggagaaacaactctgcactgcgagcatctgctgagcctggagtcaggaccgaccatcgtgaaggcccggaccatgtggcggccaaagggggccaagtcccaggaaacggcggctctgtcgtggtgattttcggcggggacggttcggtcaagcccggagcaaccacccgtacgcgttctcttctggaaaaaatcacacattgcacatacatatggatgcctataatcccatcatggcattgcgaagggatgcccaagttatatacatatacatagaatggaagtgtgtgaaggtggagggggtcagaggggtataggagagcgatcagaagccgagaaggcaaattggtgttgtaattatctgagtttgtagctactgcggtg

SEQ ID NO: 20829 - DNA, 459 bp, Triticum aestivum
  Clone ID: PAT_TA_20829
atcagtccagttcaaaatggccagcggaattcaagtcggcgatgaggtcgtccaggccttcaacgatgtcaagaacggcaagcccaagctccgttatgctaccttcgtcttcaacgattccaacactgaggtcgttgtccagagcaagcacagcgagggcacctggcaggagttcgtcagcagcctgaacgccaagcagggctgctacgccgtcttcgactatgactgcgaggttgaggctggtcgcagcacctctcgcatcctcttcatcacctgggcccccgacggaggtcccatcaagcaagaagatgctcctgtctgccaccaaggccgagctcaagaagaagttcgtcggtatccaggttgaggttcaagccaccgacctgtccgagcttgacccttctcagttctctgccaagctcaagtaaactgaaagcttttttggttgtgtaaaaaaaa

SEQ ID NO: 20830 - DNA, 566 bp, Triticum aestivum
  unsure (1)..(566): unsure at all n locations
  Clone ID: PAT_TA_20830
ccgaacaccaagcccccaaatcccgtcgtctccaaattccacttcgccccggccgcctgtagcaatagcaacaagaagctactcctagaagaaatggagggcgacgagatctttgcaagcctagactcgctctggttccactccagcgtcctccaccggcggccgcgcttcaagcagcactcggaagagctgaagccgcccaggaatcaagatcaagcatcccaaatgcgtcgacggcgaggtgacgctgggagcgagaagagcggatccgggaagcaaggcgcttcaaagagcgcatcgagacatggcaagaggagcagtggcggcggacgctcgtcgtcgccgcaccgccacggtgctcgcccgtcagcgatggtgtggccatgaaggtcatctcaagtccttgggctcatgccgttgcttgctccgtcagatgaaggcctccatcagttcaaaatcttgcaatttggtacattcttccgttggttgctcacatacgagtaaatctgaaataaagacatctccccggtgccccaagtttaaaaaaaaggggggcccggtancaa

SEQ ID NO: 20831 - DNA, 403 bp, Triticum aestivum
  Clone ID: PAT_TA_20831
gttggttgctgtgatggaacagtaaagagaatcttacggtgtgctgcgtggtcattcagaacaagtatggtcagttgattacttcactaccaaaaaaggctttcgccccgctttatatagagcaacaattctcctgcaaggtttctagttactggatctatggataagactgccaaggtatgtgcagtaagcactaggctttgtatactcagaacacgatgtgtaacaaaatgttgggaagaatcaattaggtgtggaggtgcaatacaccaaacggattatatttggggctgcatctaattacagaaccggaagccacgcttatacatgcaaatggggtaactgcgacctgctatgtccccggagttgaaagttatattaatcatccttgggaaagttaaaa

SEQ ID NO: 20832 - DNA, 1265 bp, Triticum aestivum
  Clone ID: PAT_TA_20832
ctaacccgccgccacgccgccctcccgccacccgcgccggcgccgcttctccccgccgatacaggccaaaaccctcgcgcgggggcatcggaggcaggaggagggatggcgtccaacggggacaacaagcggctgttccgcgtgcggcgcacggtgctgcagatgctgggagaccgcgggtactcggtgaaggacgaggaaatcaagctgtccctgcacgagttcgtcgagcgctacggagaccccgtccgccgggacgagatcgtcatccattgcgagaagcagggcgaccccaacgacaaggtcaacgtcttcttcctcgacgagtccaagaccggcctggccgtggtcaggagctgcgtcgagaagatgaagctggggaacgccaccaatggcatactcgtcctgcagaaggcgctgagcggcccggcccggaccgaggtcgcacagagcaagaagtaccacctcgaggttttccaggaaggggagcttcttgtaaacattactgaacaccatctcgttccgaagcacgagctcctgagtgacgaggagaagaaggagctgctgcagaaatacactgcccacgaaactcagctcccgaggattcagctcacggatccggtagcaagatactacggcatgaagcgtgggcaggtgattaagatcacccggcagagcgaagttgccggacaaatacgtgacctaccgctacgtcatttgatcctcaccaacatatcaaggcttgaggttggtctgggaattaaaatggttccttcgtcgccaaaccctcccagtaccagaaagaagcattgctgtgtgtgtggaggaaccaaggtgctcgctgaagtggctaggtgcccctttgtaccttcctggcaatttccctcccagtgcccgggtgctccgtggctgtgtgtgtgtgtggaggaaccaaggtgctcgctgaagtggctcggtgcccctttgtttgtaacttgctggcaatttggcatgagtgtgttagctagaaaaatacagtaggtttctgtgtagatgtgctgtgttccgtgctgctaaatacgtgactctcgactgtatacgtgagatgccttggtctgttccgaagaaattcagttacttgtgccccccgccattttgaccagatggaaggagtatgcctttctgggtacgtctgtaggagtatcggttaagactggcagcaaagtggcaatttcgagatattttttttgcgcaaaaaaaaaaaaaaaaaaaaaaaaaaaaaaaaa

SEQ ID NO: 20833 - DNA, 446 bp, Triticum aestivum
  Clone ID: PAT_TA_20833
cccacgcgtggagacgaccggtagcaagatgctgaagccggtgcactcggcgccgcacccgctcgcaggcgagatggtcccgctgacgctcttcgaccgcgccgccatggacatctttgtctccctcatcctcgtgtaccccgcgccgactccgtccaacgaggcactcgtggagggcctgcgcagggctgtcgcgccgtaccctcacctggccgggcggctcgccgtcgaccactcaggcaggcgctccatctacctcaacaacgacggcgtgcttgtcctggacaccgaggtccctgtcgatatggcgagcgtggtcgccgacggctgctttaccgccgccaccgagggcctgtaccctgcactgccaccgccggaggagaacgtcggggcggcgctgctgcagatcaagctgaaccggtacaagtgcggcggcctcgtgatcg

SEQ ID NO: 20834 - DNA, 1774 bp, Triticum aestivum
  unsure (1)..(1774): unsure at all n locations
  Clone ID: PAT_TA_20834
cctcttcagctttttagctttatctaatggaacttctgggtggattctccttttagaagaattaccacaacaacgtggaattgttcgtgtcactgcccccttggctggatctgatccaagaacagatgaaaagcatgtgaagtggttgcatttaaatattcgtccttcaactgttcctttccttgatccggaaaaattcaaaggcaagacaaagaagtatcttgttgatgggagatggacccttgccttcagagatgagcaatcttgcaaggcagcgctcgatgcagtagttgcccttttcagcagggctaatatatcagcagatgttcgtgtagttggtggctggctttttaggcaactgctgccccatggagaggacgagtttactgcttttcatctaaaattactaaaggattcacacaaggattgcagtgaaaagctgctggaagaatctggaggatgctggtgtgacttgcttcttcctatccttagagaagcttggaaaaattgcaagaaagatatcaattcaggcatcttcaccacccaaaggatccaagtctattatttcacctttggattcgtgtttatttggaggtgattcttctatcgctatcgcggagagaatctatgagatggttaagggttttgtgctacagcatcaagttatactcttctgccttggagaaactttcactgatcagccgcctatttactctccagtcggatctgcctgtaaataagcgagcaaccgcggcaggcttcgatggttcagtgcccaagcctgggcttgaagtcaacttagttgatgcaattccttgccggatagcatttgaaaggggcaaagaacgtcacttcagctttttagctctatctaatggaacttctgggtggattctccttttagaagaattaccacaacaacgtggaattgttcgtgtcactgcccccttggctggatctgatccaagaatagatgaaaagcatgtgaagtggttgcatttaaatattcgtccttcaactgttcctttccttgatccggaaaaattcaaaggcaagacaaagaagtatcttgttgatgggagatggacccttgccttcagagatgagcaatcttgcaaggcagcagaggccatggttattgaagagatgaagctccagcaagatgccgtcagggaacagttgaaggcattgcttgaacttaacatgcctgagaatgggttgcagcatcctcagctttcccaggaaacctcttctgatgacggttcatgaccggttaaagtttcttgtgcagtgttgaacttctaagaaatggcgacaggaagtcctccatgttggcgagtaggtcgccatgctctgtatattacatcggcagattagatatcttgtttacacacacacactgtagagtttcaacccttttgaggtaagttaggtctataggattctttgtacaatagtctgtatctgtcctttgtcccgtgtaatgttatatacatatcgcagtccattctttgataagcttcagggacagagttgggcggtcagtgtacactaattgtttgaagagcccggcctgcaaacaataagatctcttgtcaagtgtacactagctgtttgagagaggcctgcaaacaatcaggtcggttgtcaaatgtacactagccgtttaaagaggccgcaaacatcaaaaccgttgttaaagcgaacacgccaataataaaagttggggggggccggtaccaatcgcccatagnagtcgnantacgcgccccan

SEQ ID NO: 20835 - DNA, 165 bp, Triticum aestivum
  Clone ID: PAT_TA_20835
gataaatcgaatctaattttcctgagatgtcaactggtcctatcaagtctagatattttcgcaggctatggatggtggtgcattcttttgatgtattgatgtgagtgtccatcaatgagggccatgagaaatgcagctgtttggtttcgttttaaaaaaaaaaaa

SEQ ID NO: 20836 - DNA, 369 bp, Triticum aestivum
  Clone ID: PAT_TA_20836
tcgcgatctgaacagatgaacccgctcgtctccgtgctccacctctacgacgtcgtcaacacgcccggggtcaccgccgacgtcagccacatggacaccagcgccgtggtgcgtggcttcattggccaacaacagcttgaggcagcacttacaggaatggatcttgtcatcatccctgccggcctcccaagaaaaccaggaatgacaagggatgatctgttcaacaaaaatgctgggatcgttcgctcgatctgtgaaggcgttgccaagagctgtcctaatgctattgtgaatttgatcagcaaccctgcatgcccgccaacaactggaacattgacttctctcggatcaactccaaggacttccgcc

SEQ ID NO: 20837 - DNA, 730 bp, Triticum aestivum
  Clone ID: PAT_TA_20837
ccccactgcccagatccccctcgtcgtccctccccgccgcgccgccgccgccatgcatcccgacgccacctccccctcgcaccgcatcgcccgcgtcgccgcgcacctcaaccccacacgcccgcagatggaggagggcgcggcgctgaggcccgcggcgtgccgcgccaagggcggcgcgccggggttcaaggtggcggtggtgggcgcggccggggggatcggccagtcgctgtcgctgctcatgaagatgaacccgctcgtctccgtgctccacctctacgacgtcgtcaacacgcccggggtcaccgccgacgtcagccacatggacaccagcgccgtggtgcgcggcttcattggccaacaacagcttgaggcagcacttacaggaatggatcttgtcatcatccctgccggcctcccaagaaaaccaggaatgacaagggatgatctgttcaacaaaaatgctgggatcgttcgctcgatttgtgaaggcgttgccaagagctgtcctaatgcaattgtgaatttgatcagcaaccctgtgaactcaaccgtccccattgctgcggagggtttcaagagagctggaacttactgtcccaagcgtctccttggagtgacaacacttgatgtagcaagggctaacacctttgtggcggaagtgcttggagttgatccaagagaagtcaatgttccagttgtttgccggcatgcaggggtcactata

SEQ ID NO: 20838 - DNA, 930 bp, Triticum aestivum
  Clone ID: PAT_TA_20838
tttttgaggctgtaaacatgttcggtccagctattcacaaaagtatacgttcgttcttgtctagtacgagtacatgatttatattccacgacgggggaaaaggctcagtgcagctaaaggagtactagtactgtcttgcacatgcaggggtggctttacaggtattggagcactatatcacactctttctttagtctttgcatatctgtataggttggggacggtccattcgtacgatctcacttgttcatgaacgacacgcccttctgaatgctctcgctcagctccttcttcgccttctccaggccggctctctcaaagtcattcagtggcccaagagggagaatctcctcggctccaccgcgacctaacctcaccttcgatgcgaagaacggcagctctgtcacctcagatgcgacgtatgaacactccacgatgccagcatctccgcgcattcctcgcaggcacgcgtcggcgaattttgcagcagcaaaagccattgacaaagttgcagagcctgctccagcctttgcctccacaacttctgtaccaccgttctgtatgcggttagtcaaatagctgatttcatctggagtgaatgagcatggggggctgacctgtgacaggaggggtaatatagtgacccctgcatgcccgccaacaactggaacattgacttctctcggatcaactccaagcacttccgccacaaaggtgttagccctcgctacatcaagtgttgtcactccaaggagacgcttgggacagtaagttccagctctcttgaaaacctccgcagcaatggggacggttgagttcacagggttgctgatcaaattcacaatagcattaggacagctcttggcaacgccttcacagatcgagcgaacgatcccagcatttttgttgaacagatcatcccttgtattc

SEQ ID NO: 20839 - DNA, 2157 bp, Triticum aestivum
  Clone ID: PAT_TA_20839
gagagagagcacgcaaattacatgccttaactttatagaaggcggagtgtaaattacaagaaattcagacaagcttgcatcacagcctggtcagacattacgaagttactgatgatcacacacacgctgagaaaaagatgcatacgatttgacctctcatcttactaactaagacaacatgcttgcacaattaattaaaagtttacaacacaccggcttaacgatcactcactcacactacgttacatcgatagaacatgtctctcacatgtcggcggcgatcccctcgtcgcgggtggcggcggtctcgatgtcctggacacgcctgttgggggcggcgcagttgttccggatctcgcccttggtgccggtgaggaggtccatgttgctcatcttggtcatggacctggcgaactgctcgaagaaggcgccctcgttgagggagaagcgggtggccatgcgcttggtggtggggtggtcgatgaggccctggtccgacttgaacagcccctgcctcgcgatcaggtcgaagtagtacttgttgtcgaaggcgtccggcgtgcgcacgtcgaggttctgcgtgagggtgccggcggggttgtccccagcgcacttgttccggagagaggtggcgaacttgttttcgatggcccttgtgtcgacaccggttggctgtccccgaagacctctttctcgaaccatagccaaagccttatttttcgctgtatggtgatcacactacatatggtgggtctcctttcactaaggcatacggtctggtttagtaatagtattacaacaatattccaagacgaggccacaagccccatggaacctttatacaatacacacgatctctcatttcctcgatgaaggcgcttgactaacactcttacctagatgacgcagtgtccatagtacaggtatttgccgaaagcacgccaacatgacctttagtgcccggacatgtgcggatacgttcgggccgcgattcctcgatgcgctccctcatttggtacgtatcgttctccagggcctcgcccgtctgcgcccaagaacgccctccgggtaaggccaaaccctggtccccgtacaagcaggctcacgggtggcttcggatggatcctgcgcagcgacaacagcgacggaatggcacatcatagcagaggaggagtggacggatgaccacggcctccttgaggcgccgcggctggcgggttcctggtccgccttgggcacgtcctacgcacacgcggcatttcgctggaacgactagtttcgggacgcttgccgggcgggtaccgctcgttgcggggggagggggtcgggaggaggaggaggagtgggcgaggccgagggtgtgggccccgagagagggggagcaggtcgcgcccgcctctgaggctccgggtcgccgagaggacgggaggaggtccggcacggcgaaggacggctgcggtagggggaggacgccccgccggcgacgctggggcgagcgcgtcccgtcggcccgcgagctgcgtcgaagcgcgggccgccaggccggacgggggcgtcgcgggtagcaagcgtggatgggggcgcggcagagggcgggcgcgccgccggcggcggtgcagcggccgccggcgacgtggagctgcgggatgtggcccccggtcctggcgcgtcaggggcggggaaggcccccgagacgctcggccacggcggcgcggatgggcgcgcagagcgatcccaggccggcgggggcggagggtgtggtggaggccgccggttgaggctcgctgccaggcgcccgtgcgcagcgcaacggatcgcgtcgcagccctgcgggcaagcagtcgtggaagaggatgcggatgagcgccggcgccacgccgacgtcgcggcggaacgtctcggcgacgtggaactccacgatgtgctccaggtccgggcacgtcgcggcgtggaagttcggcgagagctggccctccgacgagtggacggcggcgcagaccaaggccaggacggcgacggccgctgctgctctggacgccatcgctgaagctgagcttctagcttcttgcacctagctgcctagctactacctacgtctgagggagggagggtctgcgtcccgaggccggcacgagctcgtgccgaattcggcacgag

SEQ ID NO: 20840 - DNA, 333 bp, Triticum aestivum
  Clone ID: PAT_TA_20840
gcacgaggccgccgtaaccaagttaaattcgggcggatcatggacggacggacggacggacggacggtggccggcggcgagacgcgggatctagggggaggaggggcgatctgtcttcttagccattttgggaactgaagccaccaccacaaatttacccatccatccctcggagtcctgttgttgctgtcgcccccgaaattaagctcaagctttttctttagtttccgttaatgtcaattaaatgttctcccctccaaatgatgatgattctgattctgattctgatgatgatgatataatatgggccgttaagaaatcaaaaaaaaaaaa

SEQ ID NO: 20841 - DNA, 539 bp, Triticum aestivum
  Clone ID: PAT_TA_20841
taacgttagtgctccctgaactcgataaaaggtctttctgggctgatccaagtgattttggagatatatttgatgtgaaccacttcattaattcgttaagagacgaactaaaaattgtcaaagcactaccattgaaactccagctaaaaactaggagaagactttattcgatgcctcctatcagctggtcaaacgatacgtactacctaaagcgggtattacctcttgcaaggaagcacaaggtcatccatttcaataaaacggatgcccggctagcaaacaatggcattcctatccatctccaaatgctgcgctgccgtgtcaactttgaggctttgagattcactccacagattgaggccctcggcagaaaacttatctccacccttcagcgaagtggggaatttgttgtgcttcacttgcgttatgaaatggacatgctctccttttcaggctgcacgcatggctgctctgataaagaaactgaggagctcactaaaatgagatatgcttatccatggtggaaagaaaaagagatc

SEQ ID NO: 20842 - DNA, 963 bp, Triticum aestivum
  unsure (1)..(963): unsure at all n locations
  Clone ID: PAT_TA_20842
ggtttttgtgtttttnttttgaaaggaggggaggttgggggtgttggggggttaatttaattaggtgtntcatatattgtgttagctagctaattaatagagagaagtgtcctctcttatgtccgtgcttggacgctatgtactatatatacataagtgatcgagagaaccattcagtacagaagttcgtcatgcataccgagagaagtgatcgatcgacctctccttctccgagagattggtcgaacaacaagttttcgtatcatgtatccgacgctactggctacatacatgtacaatatgtataagatctcttataattacaaacccctagctaggatttgaaatcaacttccacatggtattctccggctttactgatgacgtggtcaagaaagaatcccgccaattcctcttgaattgctttcatgcgatctggttctaggagttcattccgcatctgccacgtctaatttgaagaagggagttaatacatatatatgaatgaaactcaacagaaatgatagtgtaataaaatgaaattgtgaatattattgcttacgcacttcatattgtcttttagagtagccctgcttatttttcaaagtcgcgttgtanatgaactcgcacatgtagtatccacagaaattattcccttgatcctgccacaagcactttacgagaaatagaggtcaatcaaactgataatgaagcattataaatggcattgatgaaagtacagctatagaatcaatgggaagatgcgcgcatctagctagctagtagtacttactttcgggtatgtataatgcaactccctcggaatctcggaacttcncggtgaacggtttcaaaccctccaagacaaagaaaataattatatacttgagataccanaaatgacaaaantgcnatatgggcataatgttaatgactactgtgaaattagcagtcncaagttgg

SEQ ID NO: 20843 - DNA, 336 bp, Triticum aestivum
  Clone ID: PAT_TA_20843
ggcacgagggtccctgatcttccaactctcgtatctccacaaccgtaactccgtttgaggtgaatccaaagctcagttcttcgtctcgtcaagctctatctgttaatatcattttcactaggtggtcccactataaaaatgacctttatacccttgcccttatcagtcccctctgagagtgaagcgttccggcgaatcgttctgcgacttcaccgcacgtcttcccagagtattcttcatacccaaggcaagccacaatagccatttgaagatggattcccagtagccatggtttctacttaaatgtttaataaatgtttgcctctcctccttcta

SEQ ID NO: 20844 - DNA, 1317 bp, Triticum aestivum
  Clone ID: PAT_TA_20844
tgttatccgccacgccccacgttcgtgtttcaggacatggaacaacaagtgttcagctttgcattgctctggcaattctatacaatgcggttggtgctgcaatggtttcatctttggtcgttattattattgctgtactgtgcaatattccattggccagacggcaacacaaatttcagagtaaacttatggaagcacaggatgtgagattgaaggccatgtctgagtcatttgttcatatgaagatctcggaacgttatgcctgggaagctctcttcaataaggtcatcgcggggttgtgagaggttgagtacaagtggttcgcaccattcctgtttaggagggcataccatagtgtcctctgttgggcatccccgtattttgtttctgcggcgacctttataacacgctatcttttgaaaacccctcctcttgctggccatgtcttcacttttgtggcaaccctgcgtctcgtgcaagagccagttaggtcaataccagatgttatccgcgttgtgatacaagctaaggtggctttcactcgaatatcgaagttccttgatgcatctgagcttaacgggcaagttaagaaaaaatacaaccttggcattgattaccccacacccttagcgatgaattcgtgtagcttctcatgggatgagaatacatcaaaaccagctctaaataatataaatctggatagtgaaagctggagaaaagattgctcggtgtgggcacggtggtcctcgtgtgtccacgctcttggccgctcgtcgtgctggggtcccagacaccacgggcccgatcctccccgccgcgcaattcgcttttatttctcagaatgcatggatccaaacaggaaccgtgcaagacaatattctctttggatcaccgatggacgtggaaagataccagaacacactcgtgaggtgctcgttggtcaaggaccttgagatgttcccatatggagattgtactcaaattggggagagaggagtaaatcttagtggtggtcagaagcagcgggtccagcttgctcgtgcactataccaaaatgcagacatctatcttcttgatgaccctttcagtgccgttgatgtccatacagccacaagtctcttcaatgtaaggatcgtatcagcatatgcataccatattactatttgattatcgtttttttacaaagctctttgtaacatgaatatgtcatgagtgctctatcagataagatcgttcttttggtgacccaccaagttgattttctacctgtatttgactccattttggtacctctctccacttggaaatgtcaacgta

SEQ ID NO: 20845 - DNA, 542 bp, Triticum aestivum
  unsure (1)..(542): unsure at all n locations
  Clone ID: PAT_TA_20845
ggcaaccggaggggcgtccccgtgtgcatcctctcggcgctcggcgccaccatgttctccgtgcagtaccgcttcgaccggttgcccacggctgcccgcggtagcgctgacatggccgatgtcactgatccttgtctgatggaaaactatattcctggactcaagtcgatcaggctaaccgatcttgagcccacgcactcggacaagattaggctggacaaaatccttgaagcatacccgtatgtgaggaaagcacaatgtgtcatcttcacctccttctacgagctcgagagcaacgccattgactttctaaggcaagagctcccctgcccggtgtttgccgttggtccttgcatcccattcatgtcactccaaagaaaaccaggcagattcaagaggaagaacaaggctacaagacttggctgggacacacagccggcgagctcaatgctctacttctcactcggcagcttcctctccgtgtcgtccgccaactcgacgagatngccattggcctggcgcaaagcaaggtcaagttcctt

SEQ ID NO: 20846 - DNA, 573 bp, Triticum aestivum
  unsure (1)..(573): unsure at all n locations
  Clone ID: PAT_TA_20846
cgagtttttttttttttttttttttttttttttttttgctccaatgaagcattcatatcatcaagtaagaacggttgcatgtttatcaccttctccaaaccaatgaaattgatgttgtaacacattgtgcatgctaagaaagaaattgatgaggacaatattacatttcttcttacagcagcatacatgcaccatataagaggtctaaatcttgatgataggttcatgcataaaggaagcgaatttgaacaaacatatcagaatcttacgaaatgatcttaactccatgcaaagttgcttaagtaggaaaaatagcagtgaaggatcaaggtggacaacaaataacattaatataatactccttcaaggnaaataataaaaaatgaaatcatagggggtacaagtattttgaatagtgaagagaagtacgatataccgtgcaatgcacatttccaaaattcctatanatgaatatangtcaatataanttttgctaatgccatagtttggcatgctcactaacaccntatcatgtcaatcatgggggccatccctttgtgctnnaattttaat

SEQ ID NO: 20847 - DNA, 833 bp, Triticum aestivum
  unsure (1)..(833): unsure at all n locations
  Clone ID: PAT_TA_20847
cggaaacttgtacaacgccgggtacggggtcaattcagccgcgttgagcacggcgctcttcaacaacggcgcatcgtgcggcatgtgcttcaccatcacctgcgacgcaagcaagacgccgtcgtgcaaacagggcacgtccatcaccatcacggcaaccaacttctgcccgcccaactacgccctggccagcgacaacggcggatggtgcaacccgccgcgacagcacttcgacatgtcgcagcccgcgtgggagaccatcgccgtctatcaagccggcattgtgcccgtcaactacaggagggttccctgccaaaggagtgggggcatgaggttcaccatcaacgggaacgactactttgagctcgtgacggtggcaaatgtcggcggtagcggcgtggtgtcccaaatgtggatcaaggggttcaaaactgactggatggtaatgagcaggaactggggtgctagctggcagagcaatgcctacctcaacagccagagtatatccttcagggtacagaccgacgacggacgggtcatcacggccgacaatgttgcgccgtacaactgggtggttcggtggcacctacacttccgtggcagcagttctaatatcttgcgaggtactcagtcaaagggtactcaaatagtccgggcccgatgatttcatcctgaggctgtatctccccttttgttcctttgtaatctctgttttgccctgtccaagttttttgtacttggcttccatttattcccccgggtcgctaaagatcataagattaaagtgtnttgcccaacacccnaagaggtggagctgntttaaaaaaaaaaaa

SEQ ID NO: 20848 - DNA, 525 bp, Triticum aestivum
  unsure (1)..(525): unsure at all n locations
  Clone ID: PAT_TA_20848
ccaacaatgaaactgctcaagctctttctcgtcctatcaatcttagctgctttgtgcacctcaaatgtgtcgtcgcaggttagcccgctagggaagcagccaaaaaaagcgccgaaagttggtgtgccgccggtgaaacggcagaggaaaatgcctcccgcgccaaagccgtcgatgtgggtgagccctgaaaagccaatgactccaccaccacaaacatagaaagagccgaatgcagtcggtgcgctcaccaccgcctccaccgcatcgccagaaagagcatataaagggtatagttcaagccagttgtgctccccgccggccttcaccaatgagcagcatgttttgagctgtngtgcaatccgttggggcctacattttctcctccggtcaacaattatatgctcatcaanatccttacttttcgcaangcttaacatggttgtacccattttgcgganatttttacacacaatgtatttttttgtcaaataaantcataagtgggagattaaaaaaaaaaaa

SEQ ID NO: 20849 - DNA, 1114 bp, Triticum aestivum
  unsure (1)..(1114): unsure at all n locations
  Clone ID: PAT_TA_20849
cccacgcgtccgggcgagggttcggccatggaagaactcctgctgcgccacggccgcctctcgaggccggtggcaacccgccgcctccgcgtcgtcgccgtcgcgctaaggtccagaccgagcagcagcctcgccgtccctgggtttccgcccgcgacggcgccggccccggcgcctgccctggagcacgtgctaccgtcgccgcatgtggccgcagacgccgcagctgtcctgctcgaggcgggcgtgcgcccggaggatctccggcgcgcggcggggatgtgccccgagctgatgtccgtccccgtcgagaccatcacggccgcgctgcggttcctgaccgacgaggccggagtgcccgccgaggagctgccgcgcgtgctgaggcgacgcccacgcctgctcgtgtcctccgccgccgcgcggctccggccgacgctctacttcctccgggcgcttggcgtgcccgacctccaccgccgtgccgacctgctctccttctccgtggaggacaagctgctcccgcggatcgagttcctcgagtcgctgggcctcccctcccgcgccgcgcgctccatggcacgccgcttcccggcgctattctactacggcattgacggcaacatgcggcccaaggctgagtaccttctgggcgtcatgggccgcgacgccgacgagctcttcgacttcccagagtacttctcctacgcgctcgacacgcgcatcgcgacgcgccacgaggcctgcgccgcgcgcggcgtgaggatgccgctgcccgccatgctccggcctggggagcgcaagttcgaggactgcctcgcgggctgcgtcggctccacgccgccacggcggcggtctcccctttggcacgcctattgggtggatggcgacggcgccggcgtcagcgcggtggtaaagaaggccagacgtgacgacgcgatcgtggcatcataccgccatgtgcattattagtaatacaatagtgggcgatcttggatgttgtaagctgtgcatacatgtgatctgtaagtatgataccatctggttggactctcttgttaatcaatcaatcatcaaggcatggccttatagttcaaacttntttnnatagtag

SEQ ID NO: 20850 - DNA, 1082 bp, Triticum aestivum
  Clone ID: PAT_TA_20850
gcacgaggacccaacccccttctctccctggtagaggaaaaaaaaactctctccccgtcttctcgactcaagtcgcaaagccttcccctcccctggattcctcgaccccacgcgagagcctcccaaccctatacgccagatcggctcccaccaccgcacgcgcagaatccgtttggagtttcgccgccggcgcggcagcgagcagccggtcccagggcgtccgtccctggctcccctgcgggcaccagcaaggcgaaccttgtttcgacagaatgcaagaccctagaggtatggcgcgagaggatttctcagcgtcgaagtcacagaagaggaaggttgtgtaccggcctttgccctcagtccagataaaaactgaacctgaacttctgcggagggacattccacatttgttggccaatacacagaagccacctaagagaagcttcaggagtgagccccgccctcccatgccgcagtctgacagaggaactccggactcgctaccagattctggtcctgcggatgaatatcgggcgctacggaggaagtacatgatgctggaggaagagaactacacgctggatgcacaattaggcatggcagaaaaggaagccaaaactcttgaggatgagaagtttgcattgctggatcagcttgttgtcttggaaggtcttgtggagccttcgcagctgcagacacagcgaaggctataaggcatctatgtgtgacccttcgttttttcgtagtgtaattctgcatctggtattgttaggtgtgactaccctcaagatgtacccattgtagtggctattttactctagatagttgctctagacaggacaactatctggagtatttgtgcacgatgaaagagaatgatactccctcatcccaaaataagtgtcgttgatttagtacaactttgtactaaattagtgacacttattttgagacggagggagtacatatcatactatcaaatgaaatattggccgcaaattgtggtgtaagaactatggaattcatgaatgatgcaactgatctaaatgatttacctcgctcctatgtgatgctactgccct

SEQ ID NO: 20851 - DNA, 448 bp, Triticum aestivum
  Clone ID: PAT_TA_20851
ccacgcgtccgcccacgcgtccgcccacgcgtccgctcctccctcctctgtctcttcttcttcgtccgtcccttgcacctcggccttggctcatcttaaacccctcctccgttatcgtctgtgtgctccgtcggagtagaggaggggcgctctgagggagggagggcggcaatggcccccaagcacgccggccgtggcaagggccggggcggcggcggcaagggcgaccgcaagaagaaggaggagaaagtggtgccgagcgtggtggacgtcgcggtcaccaccccctacgagtcccaggtgacactcaaggggatatcgacggatcgcgtgctggacgtgcggaagctgctggcgtcgaacgtggagacgtgccacctcacaaactactcactctcccatgtggtgcgtgggcaccggctggaccaccgcgtggagatcgtggcgc

SEQ ID NO: 20852 - DNA, 790 bp, Triticum aestivum
  Clone ID: PAT_TA_20852
gaaaatgttggggtacaacatcgtcacgcaggaactctcggtgatctggccgccgtcccagcatgagtactactcttgcactgtcctcgtgaaagcggatgatggcaagctggggttcgccggcgtgcagaatggcacgctctacctgtggtcgatgaaggacggcgccgacggaaatgtggaatgggtgcagcgcaaagttatccagcacaagacgatgctccgcactcgtggcctctcgacaccacctgaggtcgttggcttcgcggatggtcacggattcattttcgtgaggacaggcaacacggtgttctccatggatctcaagtcaggccatgtccgtaaggtatacacctgcaggtcaagaaactacgacgtcatcgttgttccctacatgagcttctgcactccagatcgtgctatgggcagactgccatcgccacgaggacccactgtcatcctgtaacaaggacttgctgctcttggcttgttgcatagatgacgctccaagtattttgctttcaaggtggactgtttaagtagttaccatggtcaatgttggtatgtttagtttacagtgtggcagttgaaacaaggaaaaaagtaatatgtaatcacggtcagtttagtatgttctctttgcagttgtgaagcttaagcaagactgatggttaattagtatttagtattgtatctttgagtgtctggattgtggcaaccagtatgatctatgtagcagatttacattctggttttcttagtgtctgcgtatttcatgctttgcaagctc

SEQ ID NO: 20853 - DNA, 506 bp, Triticum aestivum
  unsure (1)..(506): unsure at all n locations
  Clone ID: PAT_TA_20853
ttcgagcggccgcccgggcaggtaccattagtagctcaagagtatgcatccattctacatttttcttcccgagatgctattacatggaaaaaattcatggaatggagtatctggtctattattatgaagtccatttcttcccgagtgtggttatcccttgcaagattcgagctatgctacaggagtatgccaccagacttgaggctatgctttgcttattattgtgcagtcttcccaactggccacaacatagtcaaagatgacctggttcagcaatggattgctctgcacctcgttgagccatctgatacattgtctgccgcacagatagctgaggagcatattaccaggcttcaggacatggcattccttcaaactgcagagctggaccacgtgagtaattgtctacgactcgttcgctcctcgcccgcgtccgcgctattttagagacacaaaagttgaagtaaaatttaggtgaaaaaaaanaaaaaaaaccccaggggggg

SEQ ID NO: 20854 - DNA, 1211 bp, Triticum aestivum
  Clone ID: PAT_TA_20854
gagggatgcaccccaacatcccaaccccctcattaacaaagcacccaaccatccaaccttgagaaggtgagagctcagctgggagaagagaagagaacacaggagaagagcaggaaagggagatcatcatcaggctctgaagaaacggagaaaaagtaactaaccggtggttgctgcctgacgcccggtggccatggccaccgtcgggccacccggcgcctatcggaggatcaccgtgcactacagcaccgccggtgatgatgtgaaccacgatgacttcctcgagtatgtgatcggtgatgttcttcaacaccaggagggcctgcaccaatccttcggcacaggggcccctggtgcatcctggaagcatgcattgctgccatggggagagcagcagaggcacagcagcagaaacctcaggaagttcagatggaacagatcgctgccgacctcaaatacgccaggatgctgcaggagatggaggatctggatgtggacacgcctcccaacgaagacgaacaagacgatataagctgtgtgccttccccatccgacacggacgacgacgatgatcgcggcgatgaagaggacacagctgggcaggatgacgatgacaacgacgacaccaacgacgatgttgatccggacaacatgacatatgagcaagggcaggaactagtggaatcagtgggaaatgagagcagaggtttatctgatgagctcctgtcatacttggtgccatggaagtacaggtcaggatcagggttcttctcaaggaagacaaaccatgatgacacttgtactgtgtgcctgtcagctttcagaaaccgggagaacatcataaccttgccctgcaaacataattaccatgcaagttgcattagcagctggctcaagatcaacaagacctgcccagtttgcaagtatgaagtgtttgggccctcctagcatgtcatcagcagccaatcgaagctcacaaggcggcgacacgtcttcgcgccgctcgcttgctacgcctactcattcagtacaaaaaaagaagaaaaaaaaaacagaattttagttggatttcactgtcaaaaaagaaggaaaaggaagaaaaaaaacatagttttagtttaagttcaaaagccggttatttagttggatttcactgtcaaaggtaaagaaaaaaaaaaaaaaaaactcctcctgcccgggcggccgctcga

SEQ ID NO: 20855 - DNA, 1325 bp, Triticum aestivum
  Clone ID: PAT_TA_20855
cccacgcgtgcgcgcacgagcgctctcgccgtctcgctgccggctgccggctgcccctccccctcgccgcgcccgatttctccgccaactcccatacccaagttctagggaaagatacactgctccgatggcggtcagagttccgtccatggagctgaaccgctccccgccgctcctctccggcggcagaggcaaaacatgccttcagaagcctttcattgtccaagcaaagagatcaggtggattggagaaagcaaatactaggtcacgaggaccgcaagcttctgaaaaactcaagaaaagagaacccctgactcgtgggactgttagtgcgcctcttccggtaccaggacacatacctcgacctccttacgttggatcaaacaaaatgcccgagatatcgagtgagagacaaatgcaggacaaagacaccatcgtgcacatgaaagctgcatgtgagcttgctgactcgtgttcttcaaaatgctggccatggggtccagccccctcgagcgccacacgtgggtggtcggccggtccgccggatgatcattgatgctggagcctatccatccccgcttcgctacggtgggtttccaaaacgtgtatgcacatcagtgaacgaatgcatgtgccatggtattcctgattcacgagaactaaaggatggagacataattaacatcgatgtcactgtctacttgaacggttttcatggggatacctctaaaacgtttttctgtagaggagttgacgaagctgctaaaagacttgtgaaggttactgaagagtgcatgcttaggggcatatcatcctgcaaacacggtgtgagctttaagaaaatcggcagaagaataagcgagcatgctgagaggaatggatttggtgtcgtggagcaatttgttgggcatggagttggcagagtttttcattcacaaccaattatatatcaccagcgcaacaacatgccagggcagatggttgaaggccagacgttcacaatagagccgatcctgcccatgggaagcaacagcaacagcatcgagtgcgacatgtgggaggacggctggacggcggtgacgacggacggcagcctggcggcgcagttcgagcacaccatcctcatcaccaggaccggcgcagagatcctaaccaaatgctagcaaagccagcgctgaaggcgtacggatcctgaccgcgtagatcacgtgatttcttcttatgttgtatgccaaagcatcactgtaacagctgcttacgtataaccgatgattttttttttcgaaacgtaaccgatgatttttgggaccggcaaaaaaaaaaaa

SEQ ID NO: 20856 - DNA, 450 bp, Triticum aestivum
  Clone ID: PAT_TA_20856
ccgaagaggaccacccgacgctgtgccgctgggcgagggcgtacagggcggacgaggccgtgcggcagtgcctcccggatagggaccgcgtgctcggcgccttggcggcgaggaaggacctctacgtctccattgccaaggccatggctgcacagaagtagcacatttcacgacgaagaaggggatgcaaagtcaatgcttcggccgttgtggaaagtggatccgatggaataaaaaagagcaatttgtcgccctgtcttcggccgttgtggggtatatatactggccacttggagccaactttgcttgatttgtgagcaatgaggccatgctagagttagccatggttgttaaccagcataatctaattgcatcggtgtacttaacccgaacatatattatcgggtctgtatcaatcaacatgtaccccggttttagaaaaaaaaaaaa

SEQ ID NO: 20857 - DNA, 1255 bp, Triticum aestivum
  Clone ID: PAT_TA_20857
ctcgtctcctccgctctctcccccatttccgccgccgccgcgcctcaccattcccgtccccccccccccctctcaagccggcccccatggggaaccagatcggcaccggcaagatggaggcagatctgatcggcgccggggtcgggaccgggaagacggaggcggctccggtcagcgccggggtcagcaccgggaagacggaggcggctccggtcggcgccgggaagatggaggcagatctgatcggcgccggggacaagctcgggatccccgaggagaagggcctggagatcaccgccgaccagctcgaggccctggagaaggcgtctatcgatcttgccgtcatcaagcttcgagaggcatctgattacttcaacgctgctggctgcttcgcggctgcgaggcaggtctcctatctgcccgaaccagagcccttagcccccgtggtcatacagaaagtgaaggaagcaccgatgattgtccatgatctcttcgaggatattatcttccaccgcatgagccctcgcgcgagaatccttagcggtgtctacggggccactcctgctcaggttcgagctgtccagcagtttacaaggaagcaactcaagttggacccagtggtggtggatcctatcgccgccgaagttcaccgggagttcacaaggactgcaggcctggcagagaacgtgatgtccgccagtgatgtggccaggatcctcaagatcagggagggtatgtcaagcctccacccagatgatcagaagaagctggagatgatcaagatcttcgtggacaacataaatgctggctcagctatctgcacggctggtggttccgttttgggaggcatgtggactcttcgccattggaatacaagtttccccatgtccgacctgccggaagattgggtttggtagggaggtgccttctgtttgatctcttgcgccactcacagttttggagtccttagtccttcctgcaataccttcatccttgttttgcggttgctagtctgttctgcggtatcttcagttcttattttgcaagtcctgatgctagattttgccagactgtgttttgcaacggctgcaacgaattatgcaagtcattctgcaatgattggaagctacagtcatgtggtgttattatgaacatgggttcatgaaatggtttccttgaatggaatttggttcaaaatcaaaaaaaaaaaaaaaaaaaaaaagaaagaaaatagagtccgttcactgtgtttggg

SEQ ID NO: 20858 - DNA, 642 bp, Triticum aestivum
  Clone ID: PAT_TA_20858
gggaacttgataagcacatttcatatacataatttgggcacacaaattcaccatttattgacaaatgtcaatcgtttcttgcctagaattatcgaatattcaaatgatattcacaaaagaggtcgtgactatttgtttgtttcttttgcagaaaagtgcgacaaggcactataatctagaagtttctgtctagaaagaattgaggaacaagatcacgggcaagaagagaagaaagagggactcaagcttgaagaagatcaaagcttatgggggctagcttaagaagtggagggatcatcttgtgccaaatgaaggaagaaggagggccaaagtgaaaacattcagatctgatcggaggggatcaaaatccctagcatccttcattcccaaaccgggcctggcatctacatctatctccctcacccctacttcttcacctccggacgacgacacggccaggccggcgtggtggtgcgcctccggcacccatccagccatccatcaccagcaacaccgtaccccagcgcgccactaacgccttcatgcaccacctgcgccatgcattcaccaccacacctcgtgcgacctctccctacagacggcgcgcctctacctgctgatgtaccaatttcttcttcccct

SEQ ID NO: 20859 - DNA, 778 bp, Triticum aestivum
  unsure (1)..(778): unsure at all n locations
  Clone ID: PAT_TA_20859
tgagcatgtgcttccgcaactacatcagctacatcttcacagagggtgaaagagtttccgacgccgtggcggatctctgcccgctgctcgccatcaccatcattctcaatggcatccaacctgtactgtcaggtgttgctgttgggtgcgggtggcaacaatttgttgcctacgtcaacgtcggctgctactacatcgtaggtgttccccttggtgttcttcttggttttgtcttcaactttggcgtaaagggcctttggggtggcttgattggaggaacggccatgcagactgccattctgttgtgggtcaccattagaactgattggagcaaagaggtggaggaggcccaaaaaaggttgaaccagtgggttgataccaaaggaggagccccttcttgttggcgtcacaggttgataactagtggaatcgccggggggtcattattgcttttgggttttgaggtctgccgtccggcattgaggctttgaccggggagcgtcggaacccatgtgacctggttcttccagtnggattaccggagagtttctgcacttaatttggttggcctgacggtcatatgcttcttagtatgtagagtagacatggttggcaagttagatttttctttcgtttgactgtcttgatgttattgatctttctctcttactagtaaggccactgtctggcaattttgtaatcaatattgtaataagttaggctatatgcatctatcatgtagaggtgtggcaataaaattctctattatctaaaaaaa

SEQ ID NO: 20860 - DNA, 592 bp, Triticum aestivum
  unsure (1)..(592): unsure at all n locations
  Clone ID: PAT_TA_20860
gccaggagccccagcagccagcggcacaagtccacccccaaatccgcacggaacaggggcgaaccctctccccatggaccagcccaagccgacgccgtcggcggccgcctcgccggcgggggcggacgcggcgcccaacccctacgccttcacgtgcgagctcccccagtcgatctacgcgctggccttctccccctccgcgcccgtcctcgccgccggcagcttcctcgaggacctccacaaccgcgtctccctcctctgcttcgactccgtccaccccaccgtcgcctccttccgcgccgtgccctcctctccttcgaccacccctacccgcccaccaagctcaagttcaacccgcgcgccgctctcacgccccctcgcctctctcgggacgcctccgcttggaaaggccactcccaccctctcgctcgccccgccccgagtcccggcccctcaaaacgcangctccgctcgaatctggggccctaatccttnacggaagaatnanccgcgatcgacgctatnaacactgactcngaatcnccggtnttaaacantaccnaaaaagcttnnaacangggagcggtttctt

SEQ ID NO: 20861 - DNA, 883 bp, Triticum aestivum
  unsure (1)..(883): unsure at all n locations
  Clone ID: PAT_TA_20861
gaccaaagcaagttcaacaaaatgtcacccactcaaaccaagaatagctctcaggatctgctccaggctcaagttgacctttggcaccatgcattgggatttgtcaagtccatggcactcaagtgtgcaatggaactgcaaatccctaacaccatccaacaccatggtggggctatgaccccttctgagttggccgcaaagatcgggctccatccatctaagcttccacgcttacgacggctcatgcgggtgctcaccgtatcaggcatctttgctgtccatgaatccaccacggcagacaaggagtctgtttatgtgcttaccccaaccacttgcctccttgttagcgatgaagttaaatcgaatttatttcctattctgtctttgatgcttgattcaactgtcctttcccccttttttggcatgaactcatggttcctagatgagcactctacatccttgttcaaaaaggctcacggccttaccttctgggagatggctgacaagaatgattctttcaaccagtcaatcaacaatgcgatggtttctgatagtaactttctcatggatatcatcttgagggagtgtgggtgatgtatttcttgggtataaactcgcttattgatgtcgctgggggccatggtgggagctgccagtgcaattngcgaaggcattccccgcaaatgaaatgcacggtgttggttctccctcacgtgggttgaagaactcccaactgacgacatgtgtcattttttcctggcgatatgttcaagnacattccacaagcggagcctttccctgaatgggntttcaagatgggggcacaaagatgtgtcaagatactaaaaaangcaagggagtatcctccagaagagnaggggga

SEQ ID NO: 20862 - DNA, 599 bp, Triticum aestivum
  Clone ID: PAT_TA_20862
gccacatataagaatcctgccgagagtcctgcaactgttgttgctgttctgccccagcattcggcaacagctcctatggcgtttcatcatttggggccacaaatcttgcataagaatccatatggaagtatgttcgaaacggccagtgtagtagggtatccacatgatctagttgggagtatgacgctcccagtggtgactgcggactccaagtaacatggttgataagctcaatgctggtagcaatgttacatccccgcgagactggcctgcatagtgcagaatgggcagttattgggtacttcattgctaccacaaaacttatttccatgactataagctggaagcttgtcggctctcacccgggtatttcatctggcttcctttttattagccaagcagattgggtacaagatccttctactctttttttctgctgaagggtcaatccgaaataagaatgatagatttagtccagtgatgatgctggcgtatgtcctcacttttaatggacatatcttgcttgtaaccgacagttggcgatgaacctgtgcctttgcgatatgaatatatgacgagtttacatcaaaaaaaaaaaa

SEQ ID NO: 20863 - DNA, 1408 bp, Triticum aestivum
  Clone ID: PAT_TA_20863
cggacgcgtgggcgaatccagtgatacttttttgtcatttctatctcgcaatcttctcgtaggtagctaggatcgctgtgattatacgataccggaagaagcattgctgttgcgctggaggtggtctggtttgtacgttttggaggcggcggagatgggtggctcggaccagaaggcggccggcggggccgtgggcggcaaggcggcgcgcgcgtgcgacgggtgcatgcggcggcgggcccggtggtactgcgcggctgacgacgctttcttgtgccaggcgtgcgacacgtcggtgcactcggcgaacccgctcgccaggcggcacgagcgcctccgcctgcgcgcgacgtccccgctgccggccgagggcgtggccgcggtgaaggggtcgccggcgacgacgtccaagtgccttgacgtcgcgccggcgtggccgaagcggaaggcgcgcactcggcggccgccggtcaagagcgtcgggcagctgctgtcgaggcgcctcgtggtgcccgaggtgggagccggggagtcctccacgtcggacgagcggagggcgcccgaggaggagcagctgctctaccgcgtgccggtctttgaccccgccctcgccgagttctgctcgccgccgccgatcgatgactcacgccacggtgaggacgtcgaaggcgccgtggaggacacgaaggagcacatggccacaccgtcccccgtgcaggagctccccgattgttttgccagtttcggcccgacggacgccgatctcagggagttcgcggccgacatggaagcgctcctcggccaaggcctggacgacggcaacgagctggaggactcgttctacatggaggccctagggctcatatcgccgccgggggaacacggcgggcgggtaaaggtggaggccgacggcagccttgtctcccgaagcaacggcgttctggcgtctggccatgacctgaagcgggagttcaacggcagcccgccgacactggtggatgacgacgacagtttcgagcacaagacgtcgacggcgagcaacggagacgccgttgacgatgcgcagttcttgaagaggagcctggatcttaggctgaactacgaggcggtcatggagagctggggcagctcgccgtggaccgacggccggcggccgtccggccagctcgacgacttgttgctccacgaccacgcgggcatgtggacggccggaggaggaggacggcatggcgatgcggcgtggccgccgaggccaaggacggacgagtggcgggaggcgcgggtgtcgcggtaccgggagaagcggcggacacggctgttcgccaagaaaatacgctacgaggtgcggaagctgaacgcggagaagcggccccggatgaagggccgcttcgtcaagcgcaccggcggc

SEQ ID NO: 20864 - DNA, 635 bp, Triticum aestivum
  Clone ID: PAT_TA_20864
cgtccgcccacgcgtccgcccacgcgtccggacaagggaggaggagagggaggagtcctctgggtcttgggtgctcctgggtcctctttctttcttcccggcgagcgagcagcttgttgagatggggcgcgggaagatcgagatcaagaggatcgagaactcgtccaaccgccaggtgaccttcgccaagcgccgggccgggctggtgaagaaggcccgcgagatcggcgtgctctgcgacgccgaggtcggcgtcgtcatcttctccagcgccggcaagctctacgacttctggacgcccaagaccacgctgccgaggatcttggagaagtaccagaccaactccgggaagatcctgtgggatgagaagcacaagagcatcagcgcggagattgacagggtgaagaaggagaacgacaacatgcagatcgagctcaggcatatgaaaggcgaggatgtgaactcgctgcagcccaaggagctgatcgccatcgaggaggcgctcaccaacggccagaccagcctcagggacaagatgatggaccactggaagatgcacaggaggaatgagaagatgctggaggaggagcacaagctgctggctttgaggatgcaccagcaggacgacctgagca

SEQ ID NO: 20865 - DNA, 1128 bp, Triticum aestivum
  Clone ID: PAT_TA_20865
ggtttcccgacgtccgaccctggggcgagccgcaagcccccaggccagggaggactcctctgcgtctgggctcctggtctccctgggtcctcttgccttcttcgccgcgagcgagcggcctgcagaaacgcggcccgcggagaccgagatcaagcggaacgagacacagaccagggacaggggaggcgtcggcttccggggcgcgggtgcgcctgggtcctctctctttctcgtcggagggggtggagctgatggggctggggaacatcgagatcgagaggatcaggaactcgacctcccgccacctgaccttcgcctaccgccggccccggctggggaagaaggccagtgcgatcgagatcctctgggacgccgaggccgaggtcgtcatcgtcaacatcgccagcgcgaacaaggactacgacatctggaagaccaagctcacgctaatgagggtctaggaagagatcccctaccagcacatgcagggggacgagagacacgaggcactcaacccggagagtagaagtcgacagagtgaagaaggagaacgacaacatgcagatcgagctcaggcatatgaaaggcgaggatgtgaactccctgcagcccaaggaactgatcgccattgaggaagctctcacgaacggccagaccaacctcagggacaagatgatggaccactggaagatgcacaggaggaatgagaagatgctggaggaggagcacaagctgctggctctgaggatgcaccagcaggacgacctgagcagcggcatgagggagatggagctcgggtaccatcagggtagggatttcacttcccagatgccgttcaccttccggctgcagcccagccaccccaacttgcaggaagacaagtaggccaccgaatcctgccacggcctgtgtcaactgaagctcctctacctgcaggccacaactgccagcttcaatttccttgtgcaaccttaaaaatgtatcttccttttcatgtctggcttgatgaacttaacagcgctagttggttcccagcacataactttaactaagacagttcctgtccctgtcaagatgcttgtataattgctgcctatccggttacagtggaaaaaaaaaaaaaaaaaa

SEQ ID NO: 20866 - DNA, 639 bp, Triticum aestivum
  unsure (1)..(639): unsure at all n locations
  Clone ID: PAT_TA_20866
gcccctctgcgccgtcttgcctccccacgcgtccggccgccttctctcggccaccctcctggcacattcttctgggcctcttccccggcgctcgaactgcagcggcggcggcgccgctcctcctcacgggcatggtcgcatctggaggagtaggccgtggtcatggcggcgcgcgacactaggctgtggcgctgttcgtcgaggcggagccgcggaggtgagtggctgcggtgatggcagatgtatgaggaggaggaggccacggacccatggtcatggcggtgcgacggagttcgtacccggccggcgcggcaccaggctgcgaaggagaaagttagaggaaataggagaggtaggcccgacaacagatggggagagggtcaccggccggcgtcggcctgtgccggcgaggttgctcgccttgttgcgcaggagggaaaggcaacgggaccagcatccggggcggtggcggtggctggccgaggtggttctcgccaaagaagcaggtggcagtgcaaggcagcacggcgcagcaagcatgagctgcttgagagtgcggctggcaaggcaggaaagggaaaaagctttttgtggtgatcgggatcaatacctncttcagtagcaagaagtgacatgatt

SEQ ID NO: 20867 - DNA, 523 bp, Triticum aestivum
  Clone ID: PAT_TA_20867
ggtgaaagttacacgagcaatgcagggaagtctctgggcggatgcccaaaatcaagggaatcaggctagggctcctgatattgatatgtccgaattagagaccttgttctccactgctgttgcaaccaatgcaagtgaaaaaggagcaacgaagcgtggctcagctattagcaagccagaaattgttcacctggttgatatgagaagagcaaataattgtgagatcatgcttaccaaaatcaaaatgcctcttcctgatatgattagcgcgatcttggctttggatacgtctgttcttgataatgaccaagtggagaatctcattaagttttgccctacaaacgaagaaatcgagatgttgaagaactaataacggcaacaaagaaatgcttggaaaatgtgaacagtttttcctggagactaatgaaagttcctcgcgtcgaggtcaaactaagagtttttgctttcagaattgcattctcaacacaggctgatgagttaagaactaacttaaccaccataa

SEQ ID NO: 20868 - DNA, 607 bp, Triticum aestivum
  unsure (1)..(607): unsure at all n locations
  Clone ID: PAT_TA_20868
acccnctggaaggggtttntcaggntagttgtacncaggtttccngtncgcgtttaaagacgccgtgnggggtananccncttaggngattgtacggccccccctgagccacccngagtanccncacaagngccacttctggcccattcggtttcgagatcaaccccatatatgccacatgtcagcctcctgtatggggatctaacagacgaggagaaggaagcagcaaggaagaaggtagaggaaatggacagtgaactatctggactgcagtttgagatctctgagctcgcactttatcgaacggatactgaggataaaagcttggagtcctgggaactggtggaggtatgccaccttgggaagaagtgatcgattcctcccgatgatatgcttctgctgtaagttgtgactgctcttggggtcttgtaatattatgttttcacctttaagtgtttgatgtaatgatgtgaatgtccggcacccctgttgctttgaataaggaataatgtgaacattggacctaccttggggctttaccttgccacttgtggggtttaatacaaagttgaccaaaattgcctttcgtctaaaaaaaaaaaaaaaa

SEQ ID NO: 20869 - DNA, 768 bp, Triticum aestivum
  unsure (1)..(768): unsure at all n locations
  Clone ID: PAT_TA_20869
actatcgaaggcgagcaggagaaacccagcccagaaacctgccctcaccgtcgccgcggaagatgccgcagcagcagccgggggccggcgcccacgtcctggactccgtaccactcttcgtcgtcatcctcggggccgctcacgtcctagccctcgtgttctggatctacaagctggcttcccagaagcagccgacgcggagcaagacgcactgaccgcgcccgcggtcgcatctcacgatttcgtgctgtctgttttttctttttagggtagatcgccttcgtttcctccccagtgagtcctcagagatgatgcagctcttctggctgggagggcaccaccaccgtcctataagttcttcaccaagatgtggcacatgttcggcaggcattatctgttctgtagtctcctttctggcatgtatggacacatccctgattacccgttttcgatgtccgaataatggagtatatctatttagacataacagtgacagtaatttattcagtgggctatctcttgtcttgtctgtaaagatcttagaaataattgcttcaaagatatatagccccccaaaaaaaaaaaaagcagattggcgtcgtttaaaatctgaccgggggcccggtaccaatcccaccgggaatagcccttcgcaacggggtanacaaaagccncacatgcctcaaaattgncacctaangnaaggaccccttnngcnaaaccggggttgggtaccantacgaaattcannccacncgcctttttttn

SEQ ID NO: 20870 - DNA, 764 bp, Triticum aestivum
  Clone ID: PAT_TA_20870
gtgtttccccaggcggtcatggtgggtgcagaggagggggggttgcatcgaggtgctgacagatgctcggcaccttcgtgatgtggagatggcgctgccgacttcccaccagcttcctctggcgagggagatggctcggccaagccatggccctagcgctgcagatttcggcggccacgagattgtacaccacccatggtagcgaccagctttgctttgtgctgtgaatgacagctacgggttccatcatatgttcagctagaatggatttgtaatgaatggatgttgcagcttgtactacggatgcttggaatctttacataagtttgatgaacctgccgatttggatggttattggtctcctacatatgttacctgaagatgtctaaagcttccttaagaaatgtgattctgctcttagtcaatagcaggatgactagacacatactcatatccgctcgttgtagattatgtcgatattttttggatgatcgtcatcgggacagatcttgtcgtcgcctcgccaccctcgccatcaggattgtattaatgacacaagattctggccctggtgtcttctgttagtacaatagagagttatccaattggtggatccacgacatgtatgggagcaagggaaccggaggtgctagatgcaggcactaattgattttagagttcggctgcaacaatcaagtcgtttaggatggtactaatgtgttgattattttcgatgccatcaacatcagctacaatcttggact

SEQ ID NO: 20871 - DNA, 673 bp, Triticum aestivum
  unsure (1)..(673): unsure at all n locations
  Clone ID: PAT_TA_20871
anaaggggnttttggaagccanccctttgttgaccgtttgcantcccccgntgactttattggttgaggagctcccgccnttacccagtaccgtccattaaggaaggatgtacgaatcttcccanatcagtggcaggagnttttgcttggagaagcccncgtcaaggttggttggccccaatcatgcccgcggaggatttctccttttacacgcagagattcccaggggcatttttcatgataggaacccgcgacgaggccatggcaaccgcggtgcatccactccactcccccaactttgtgatcgatgagggtgtgctcccggtgggtgcggccttccatgctgctgtggcgatggagtacttgaacaagcgcggaaccgtggcaaactaaactaaattactgatgttcgcttgaaatttaggatgccgcagttggcagcctgccgataattgttaggtcgggtgcgggcattcataggtacgtatgagcataatagttgttaggatgtgattgcgacatggagctaagcttatgagtgtttactgttgtaagagctaacctcacttttcattgtgcaaagctttgcacggtgtgagttggctgggttatgcaacccttccattccgaaaagacaacccacaaagtaaacgtttanctcccanaaaaaaaa

SEQ ID NO: 20872 - DNA, 612 bp, Triticum aestivum
  unsure (1)..(612): unsure at all n locations
  Clone ID: PAT_TA_20872
agcgacagagccccttagcggccaccaataatcactctctctatgcttctctagtttctagccagcaagtttctctcactaggcagcaagctaaacttggtgtagagctaggtaggatgggagggaaagtcgcccttctccttcttctgcccgatgctcaagcttcctgtccgaggtccgagtccgagcccgaggtacgacgacggctacatgagcgactggggagggccggcccgaggtgcgggagcaaggtgcggtccagcgacgaaggactcccggctgggtgggtcccggcgagcgcgacgttcgaccgcaaaggccgccaacttacatcaacganttcccaccaagaaaaagnaccaccaacacctaacttgggtgcatgcacatcctccatgcatcaaccgtgtatcaggagcccaagacacnaaggtccttgaaaggtcccccttttacaagcagttgtgttgattttaaaggaggacganttttttgcttgggnaagtaatcnaagtgncctgtntnccctntggtgtccgggatcctncaaatgtattgttgttgctgcanataacgatatataantaaaaaggngttcgtaaaaaaaaaaaa

SEQ ID NO: 20873 - DNA, 412 bp, Triticum aestivum
  unsure (1)..(412): unsure at all n locations
  Clone ID: PAT_TA_20873
ctagcatttccgttcttttagtgcccccaaaaattgatttcttatctatacaaagctacatcaattgttccgagagcatctattttcacactgaaaattgcacgtggcagctacaccttctttgctgcgggtacagacataaacaaatgcagtactgtgcacgaaacatacagggcaaacatggaacatcggtcgaaccacgaaaaacaacgtgcggagaggtggtacagcgcatgcatgcatgcacgcacggtcgccggcctgagaatcacatgacggtgcacgcactgggcgggtactcctcgtagattgaacctcccctcctgcacgatccggcagcccttgcaccctctgcacgacgacgccggcccgccgcagcccatcggcgggggctgcatcatctgcancggcg

SEQ ID NO: 20874 - DNA, 531 bp, Triticum aestivum
  Clone ID: PAT_TA_20874
gctgcttctcttcttccccacgcctctactgctgcatctcccttgccacgtccctggtccttcttctcttcctactgctgcttctcccttctccaacctcctgctgctgcctccttcttctcttgccctgctgctcttcctcctcctcctcctccttccgctgcttgctgcttctttttcctcccttctcaatctgctgctgctactcttctccttacctcgctgctgcccttctccttctcctaaccttgctgctgttcacctctgaatcctcaccacgctgctgctctctccctctctgttgctcttctctgaatcccgtactgctgctgctcctctctccatgccccagttgctgcttcttctttctctaatctcctgctgccatctctctttctccttctcttctctgaattttctgtagtttgtgacgtgtagtctgtaacattcagattctaagagtacttgtttcctgtactagttacttctactatctatttttgggttgatacacccgttgatcgggataca

SEQ ID NO: 20875 - DNA, 537 bp, Triticum aestivum
  Clone ID: PAT_TA_20875
gttacctcgagctcgtgccaccggcggtgagcccgccgtgcaactgctgcgaggtggagaaggcgcgcggcagtgtgccatcaacgagctgccaccttgacgccatggacgaaatccggaggcgcgcgtggtgattgaaatccaggggggggtaggctttgttagttcaaacttcaaagtcggactcgtcttgagccttcgatctaaaagcatggtgtgactggaagtcagcctaccccctatattttttgtgagaatgagacaccagtcgtctgtaacggtggtgagtacccaaaaacaccagttgtttgtaatggtaataagcgtcgaaataaagtgaaaatgccgatttgagccagggaaagacgctatgcggacgccacaagatggctttttttctatttctcttttgcttccttggcttgattgtgctgtggccccaacaatggtatgtcgagtgttgttgaacttgaattgtatggatcgttgctttatttataaaacggggcaaaagcctatttcaagaaaaaaaaaaaa

SEQ ID NO: 20876 - DNA, 661 bp, Triticum aestivum
  unsure (1)..(661): unsure at all n locations
  Clone ID: PAT_TA_20876
tcaaaacattcgcagttgccgcctaagagctttcgcccagccaggcttgagagctaatgctgctaattccttccttggatgtctgagccttgttaccatccccattttgtctttgtttcagttttattagtctgttgtctgcactgcatggctctttgcattaaatgaagatcagttgaaggcttgtttacatttttgagctcccccctccgcggcggcgccaccgccgccgccccccgcctcgccctccttccacgccggtcccctcgttctgtgtcgggatccattgttgaaaagcaatggtgaagcgtgagtgcctatcaacaatgttgaacaagtgttccgttgccacctgaaagaatgagaaggaaagaagggcaagactgagcatggatatggatatttttgttattaggtgttagaagacctgtttgtgtgcatgttgtatggttcctgtgctgggttacccaacatgcttgtgtatgtacttcggtgtgtgcatgaagactaacagggtccttggttggtcgaggatgccctttgtatttttgttgaacatttgtaatggatttgagttctttctaataaaagtgtgctgtttggctcacctnacatccaccccncntttgnaacccgngggggggcccggtaccaaattcgc

SEQ ID NO: 20877 - DNA, 477 bp, Triticum aestivum
  Clone ID: PAT_TA_20877
gcaacggcccctgtggctcaccgacgaactgcgtggagggctgcaagtcctccggccgcgcgccgtgcttgagcgcctgcgcaagctcgtgcagcccctcggcggggaatacctactgctccagcttctgcgccggctcttgcagccacatcgactacgaaaccgcgtgcaagagtaggtgctgcccttcccgtcggcagtgcgacgaacgcatcagcggcatcatccagacgtgcatcaccggctgcaccaccggctgccaggccaactgtgtcaccgcctgatcgactcatcgtcagacaactccgaggactgcatctatgtacgtatgaatacgtgcctaatctttgttgtgctcgtgccattgttgtccatttacgacttacgctgcttgtaaccagatgttttgaccttgttgtcctgacatctgttttaataaaacctgtgaggtttctcctctttttcaaaaaaaaaaaa

SEQ ID NO: 20878 - DNA, 436 bp, Triticum aestivum
  unsure (1)..(436): unsure at all n locations
  Clone ID: PAT_TA_20878
ccttcttcctcccctgctcgtgcccggttgaccaacttccttcccgcatcggagccccaccagagcaaccccgccgccggccattgcgccccagcccacctcgcaccgccactgcccctcccgcgccgcgcaactctcccctacgctggatccatggtggccacggccctcccgcgccgcccaactctcccctacgccggatccattgcggccacggccctcccgcgccgcccaactctcccctacgccggatccatggcggccacggtccttccgcgccgtccattctntccaacaccggatccatggaggccacaacccctcccgtgcactgtcggcgatggatccgggcactaccgccaggccgctcaaggacggcgatgaatcggaccttcaccgccaccccgcgaatggccgacgatggatctgggcacca

SEQ ID NO: 20879 - DNA, 1230 bp, Triticum aestivum
  Clone ID: PAT_TA_20879
cggacgcgtgggcagcgagcgagcgacccgtacccatcgcctccatctcctcaaatctttggctagcatttttgtcagggcaacaatggccgacgaagttcaggcgctcaccaaggccttctcaggtctgggaggtctgggcgtggacgagccgacgatggtggcggcgctggcgaactggcggaggcagccggagaagcggtccgggttccgaaagagcttcccgggtctgttcaaggagcacggggtgatcgagcggtgcgaggacgagtacatgctgcacctggccgccgagttctcccgcttcaagaacctcatggtgctgtgggcgatgcacccgtgggagcgcgacgcccgcctcgcgcaccacgtcctccaccaggcccacccggccgccatcgtcgtggaggtcgcctgcacccgctccgccgaggagctcctcggcgcgcgcaaggcctacatggcgctcttccaccactccctcgaggaggacgtcgcctaccgcgccaaggacaagccctactgcagcctgctggtggggctggtgagcgcgtaccgatacgaagggcccaaggtgagcgacgacacggccaaggcggaggccaaggcgctgggcgcggcggtgaagagcgccgccggcggcaagctggtggagaacgacgaggtggtcaggatcctcaccaccaggagcaagcctcacctcgtccagaccttcaagtactacaaggagctgcacggcaagcacatcgaggaggatctgggaagcgaggaggctctgagggagaccgtgcagtgcctggcgacgccggagaggtacttcagccaggtgatggcggcggcgctgagggagggcgcagaccaccacgggaaggaggccctgtcgcgggtggcggtgacgcggtcggacgtggacatggacggcatcagggcggcctaccaggagcagttcggggccaagctcgaggacgccgtcgccggcagcgcgcacgggcacttcaaggacgcgctcgtctcgctcatcgtcggcaagtaaaccatatccggagggggttcttcttcgtcttccagtggtgatggcgcgccggccgtgcgtgtgtttttcttcctgcttcatctcgtgtcgtgtgtgcctttgtatgttgaattgttgtcgagcggggcatgtaaacatttgcagctgaggtcgtgtacggctgatcggggatcaaataaagttgaacatttgggtct

SEQ ID NO: 20880 - DNA, 591 bp, Triticum aestivum
  Clone ID: PAT_TA_20880
ggcgacccgctacataaggcaagccatcggcgcgagctagcaatgctccattccatggcgcccctccacgccgccgccgccactgcgcagcacgcagccgtcggcgcggctccaagcagagatgctgccccgaagaagaacggcggcagcgttccagccggacgcgacaccaggagggcgttcctgagcggcgtggtggtcgccgcagccggcgccggcgtgctgctgggccacgtggacgcggcaccggcggcgtccaagaggcgggccccgccgccgccgtcggaggagaaggagaagaaggacccgaacctcagcggcgtgcaggccaaggtgttggccagcaggaagcggaaggaggccatgaaggaagccgtggccaagctgcgggagaaggggaagaatcccgcggacgcggccagcgctgtaaccggaataaagcccagatcgacaggggccgttgtagagtgagtttatttgggtgccgcttttttttctttttgagaataatttgggtgccgcttaatttgccagcttctcacttgtcgatgacgagcacataacagagatcgatccgccgtatcctagcat

SEQ ID NO: 20881 - DNA, 568 bp, Triticum aestivum
  unsure (1)..(568): unsure at all n locations
  Clone ID: PAT_TA_20881
gcacgaggcacgcctgcctctctctcccctctccaccgcctctctctttccccttctcccctatccagatccaacccaagcgcccgtcctccaccgccgctccatcccccgccgcagccgcgatgtcacggccgtgctccacccacctcccacgcgtccggtccgctcgcgcccttgctccctctccaccttcggggccgcgcccttgcgctgctccccgacgacgcgggagggcgcgtgagcctcgacctgcggggctcgtccatgtggcgggcgacgncggtggtggcggcaccagggtcgtcgcgagggggccggaggaggcatcttcctggccatcgcctacttcgaccgctttcttcctccgacgacgtcccgattcccttgttctctccctccctgtcaactccgcccatgccctcctctcgcggccctgatcccaaccccaccgccgatgttctccttcccccagcaccgccgcccccaccttctcttcctctnnannnnnaagggaactttgccgctgtctcgtctcgtgcgcccctgcaccnnnnnnnnnnnncgccgg

SEQ ID NO: 20882 - DNA, 278 bp, Triticum aestivum
  Clone ID: PAT_TA_20882
atcttgactcatcaaggcaagtgagagacgagaatcgttggctggaatatgcaagacgtctagtgtgcatcctacgtagccatggatgatagacccaccctctctgtttgggacgtggcgattttgtatagcagtaccgggtgccagtgtgacttccatgttaggtttatttgaaaccatgcttgtgctcttgtgccacgcaacttgggatggagttgtcttagatgacttgtggctggtgaagcaccatttccacgttgatgaaagtgtgttacgac

SEQ ID NO: 20883 - DNA, 1140 bp, Triticum aestivum
  unsure (1)..(1140): unsure at all n locations
  Clone ID: PAT_TA_20883
ctcctaatcttcttaagtagaagacgaggtagctgcctgcggcctacctcactcactcacccaaccgcgcgccggcccgctcccgcactacacccagaggcttcctcccaccggacgcaggatcgcgaccgcctagctacccggagcttgggataattcttacgactcnagaccctgcctgagctctccggtgggtcttccttcccagcatcgatctgctccttgggcgatcttgggtaggggctagctaatggaggcggcattggttctggtggtggcggtgctccttgggtcctcagctcttgttgcctcagatttctgcgtgtgccggtcggagcagcccgacggcggtgctgcagaaggcgatcgactacgcctgcgggcagggcgcggactgcacggccatcgcgcagagcggggcgtgctacagccccgacgaggtcgcctcgcactgctcctgggccgccaacagctacttccaagaattcaggtcctccggcgccacctgcgacttcaccggcgccgccaccctctccaccaacgaccccagtttctccgggtgcacgttcccttccagtgccagcgccgccggcaccgccacgggcaccgggacagccacgacgggcaccgggacgacgaccgcacgcgacggcactaccacggggggcaccttcagccccgggatgggcaccggcttcaacagcaccgggttcagcccgacaaccgggagcatggacggcaccgccgcggcggccggcttgcttccgtcgatcagactggcggcctccatcgccgtcctcctcctctcctacttggcgctcccctgaactctgcctccctgtccgtctcttctcatggcaagaacacattagcagttagcttcaagtggccttctggcctggcctgccaagaagcaagctgagagtgttggttttgtctaatggaatccatcgatttggaagagttgatcgccgttattgttccctaagtgtcatggggtggttagcttggggtgtcatttgggtccaacttaattttnatttaatataatggctcccaacagctggagagttgtgtatattttggtaggatggtgtcnctttncctctgcaaagaccttgtcttcaatgtccgtttttt

SEQ ID NO: 20884 - DNA, 2001 bp, Triticum aestivum
  unsure (1)..(2001): unsure at all n locations
  Clone ID: PAT_TA_20884
ctacatcatacaagccatcggcgcgagctagcattgctgcgaccatggggatggtagaggcgtgcccgtgcatgtgccanccgggccaccgttccaccctagccttaacgtatgccgcgtagccggaggcggtggcgggggaggaactgctggcgacaccaggcgaggagggatgagttaagcactgagggggcgggtcgaaccttgggaaggattttccgacacctaaggagatttccaaggggctcgataagtatgtgattgggcaagaccgagccaagaaggtgctatctgttgcagtgtacaaccactataaacgtatataccatcagtctctacagaaagggtctggagcagatttgggttgttctgatggagaagctgatggtgaagacaatgttgaactagagaaaagcaatatactgttaatgggccctactggttcaggtaaaactttgcttgcaaagacattagctcggtttgtgaatgtgccatttgtaattgctgatgcaacaacattgacccaggcagggtatgtaggagaagatgtagaatctatattgtacaagttacttacggtggcagattttaatgtgcaagcagcacaacaagggatggtgtacattgatggggctgctgcgttcgccaagaaggctgagagccttaacatcagtagagatgtatcaggcgaaggtgttcagcaggctttgttgaaaatgctggaaggcacaatagtcaatgtccctgagaaaggagcaaggaagcatcctcgtggtgataatatacagatagatacgaaggatattctgtttatatgtgggggtgcttttattgacttggagaaaactatatcagagaggcggcaggattcttctattggatttggggcacctgtccgtgcaagcatgaggactagtggtatttcaagtgctcaagtgacatcgtccttgttagaatcagttgagagcggcgatcttatagcatatggactcattccggagttcattggacgttttcctatccttgtcagcttggcagcactaaatgaggaccaacttgttcaggttctcaccgagccaaagaatgctctaggtaaacaattcaagaagttgttcagcatgaataatgttaagcttcacttcacggatgctgcactaagaataattgcccagaaggcaatgtgcaaaaatacaggtgcacggggcttaaggactatccttgagaatattctcatggattccatgtatgagattccagatacaaaatctggagagaagcgaattgacgcagtggttgtagatgaaggtgcagtaggattggtggaccgacctggctgtggagctaagatcctttacggcgatggtgcatttgatcgttatctatcccagataaaggcaatgggagacggagcaggaagcgaagtggacggcgatcctgacctttcttcgtcaagagccatgagcatgtgatttcatggttcctctagctctactgtacactgtaaaatctgatcctagctgtattaatgtaaagaaaaaaaaacacatgtgcagtacccattgctaattcaaaccccaactgtctggccgtcctgcctcacgccttgcataatctgtagcaggattgggaagtgtatagtggagcaagttgggtgtcgacgtgtgtgtgaaggtgagagactttttatgtgaagaaatgtaatgcttgccagatgttgtaaaacttcaaacactgaaatgaaggggttgaatttagcatggagatacgaaattatgttatcagctccttgaccgaattgtgctgtgtggggtaccacccctgcttggtagaaaaaaaaaaaagatccgaatgctttagggacttgggagtttttgctcctgggctcaaagcactctcgtggtttaaaaaaaaactacctttgtccccttgtgaaacattgttgtatgcctgtacgtccaaattttttgtgaataaaaaaattcctaagggggggtttggttt

SEQ ID NO: 20885 - DNA, 526 bp, Triticum aestivum
  unsure (1)..(526): unsure at all n locations
  Clone ID: PAT_TA_20885
agaaggtagggttgcaggtggccagggacgacgatgacgggtcgttcgaccgccatggcgttgcggctgccgtccggaccgtcatgctggacggagaagccaggaggggatttgtggcgagtgccctcaagatgcaggcgatcgtagccgacaaggaacgccacgagagatatatcgacgaatttgttcaacagctcagatcgtatctgccaactgacgatctcactactaccacccccagctcctccagctgagattgagagagccttcacgaataagatgggagtacgccaggatcaggtgcctccgaaattgtgccttaatttgacttcccaaaggctgtccatagcagtacagtcagggcacccctcaaacttgcttcgctgtctaaagcggttatgcatcattccattcggcgggccgatttcactttttttccttaatttgacttcccaagggttgtccaaaccatgcaaccaggatcttcaanacggcttcaacttggttgggtttnaaaaaaaaaaaa

SEQ ID NO: 20886 - DNA, 1423 bp, Triticum aestivum
  unsure (1)..(1423): unsure at all n locations
  Clone ID: PAT_TA_20886
tttccggcaaaaatattccgttccacgctcacatcttcttccttctccgagagacagagatataggaatttccccggccccggaaaaatccctcttttcccgctgctcgacggcggccggcggcagcgtccatgaccacagtcgcctcgctctccctggtgccgcacctgctcatcaagccctccctccgctgcctctcccgaaagggagttggcaggtatggtggaatcaaggtgtacgcggtgctcagggatgacagtgccgactacctgaaggataaccaccactgggaggccctgttccatgtcgatgaccccggcccgagggttccgatcgagaagggccagtacctggaggccaagcaggcgctcgacgtcgtccgcttcgacatccagtactgtgactggagggcccggcaggacctgctcaccatcatggtgcttcacaacaaggtggtggaggttcttaaccctttagcgagggacttcaagtcagtcgggaacctgaggaaagacctcgacgggctacaggaggaactggcaaaggctcacaaccagctttatttatcggaatccagagtgtcgtcggccctcgataagctagcgcaaatggagacggtggtcaatgaaaggctgttgtcggatgggagcgctttcgcaaacacggccgattgcgcttctcttgatccgagtacttctcttgatacaactacgagcacttcctccacggtccgagtcggagctaaaaaaccgaagcggcgcagtctcaacatttctggcccgggcacgccctgccctcccaatctgttggtccccggggtcccgctggccctgtccagtgacctggggcctgactcgttggtgcccagggattgtttcggggagccgagcgtccgattccgcggaaaagataaaaggcctggatgtgtccagaatacatgtgctcacagagcctgtcctcttgatcttggttcagtgaatgagggtagaatcacttgcccttaccatgggtgggagtattcgactgatggaaaatgcgaaaaaatgccctcaacaaagatgctcaacgtgcgcatccgggcattgccatgcttcgagcaagaaggaatggtctggatctggcccggcgatgacacgccgacacccaccatcccttccctgctgcccccttcagggtttacaatccatgcagagatagtgatggagctaccggtcgaacatggacttcttttggacaatctattagaccttgctcatgccccttttactcatacatccacctttgctaagggctggagtgttccaagctttgtgaagttcttgacacctacatctgggctccaagggtactgggcatccttatcccatcgataatggagttaccgacccgccctgncattggttcttgtccaaccatttgggca

SEQ ID NO: 20887 - DNA, 587 bp, Triticum aestivum
  unsure (1)..(587): unsure at all n locations
  Clone ID: PAT_TA_20887
cccatgccttnntcgggggtcctctttgtggtgttcgcccggtgncgtttggggcccagnaaccagngaggccccnccgttgttgttggcgaacataantcccggggntgttcccccggcgggcccgccccttgccccgttgggggcgcaggaagcttgcttcaagttcgttggacacctcgcaggtgnccatgggcccgcacgacagccccgggtactggctcgccaccggcgcgaggctcgacgtcgacaagggcaagatctcgctgcacgtcaagttctccctgcttcgccccgtcgccttcctgacagttccagagtctgtacagttctcctgatgccaaatgctaactgaaccctgtaattaacatcaagggaggctccctgcttctctcgtttctcatttctaccatccttgcggatttttggttttggttcgatcctgtaaatgctgcagccccacgagtgtgaagtcattcagtactactgtaaaaccagaggtattgttttgatagagcaaggaaaaagatccttcgtactggtcatcccgtcccgctgtcggcgcgccttcatacaaaaaaaaaaaa

SEQ ID NO: 20888 - DNA, 1245 bp, Triticum aestivum
  Clone ID: PAT_TA_20888
gtactttcagccccacctcgcctccctccattaaagcccgcgccctcctcctccgctccattcccctcgccaccgcccagatccagaccatgacggtgccgccgtcgccggagccgttccgcgtcttcgtcgggtacgacccgaaggagcacgaggcgtacgaggtgtgccgccgcagcctgatccgccacgccaccgtgccgctcgacgtgcgccccatccggcagccggacctgcgcgcgtcgggcctctactggcgcacgcggggccacatggagagcaccgagttctccttcacccgcttcctcacccccttcctcgccggctaccgcggctgggcgctcttcatcgactgcgacttcctctacctcgccgacgtcgccgagctcatcgcctccgccgtgccctcggacgccgccgccgcaaagcgcctcgccgtcgtctgcgtcaagcacgagtacacgcccctcgaggccaccaagatggacggcgccatgcagaccgtgtacccgcgcaagaactggtcctccatggtgctctacaactgcgcccaccccaagaacgtcgccgcgctcaccccggatgccgtcagcaccaagaccggcgccttcctccaccgattctcctggctcgacgacgacgagatcggggaggtgcccttcgtctggaacttcctcgtcggccacaacaaggtcgaccctgacgacccgaccacgcagccgaaggccctgcactacacctgcgggggaccctggttcgacaggtacagggactgcgagttcgccgacctctggatcaaggaggcagaggagctcagggcggagaaggagaagcgcagggccgagaaggagaggctcgagcttgaggacgacgaggacgacggggggaattgatggatgatggggccggccaacaagtttactgcattgcattgcattggttcttttgcgccgtgggaattctttcgattcaatctgtttgttatgctggtttcttggtataggtggtaggggaggccatgagtagatagctcgagtatattggtttagtgtgcccttgtgtagtagcggcaatcgatctatgaatgaaccagtcctcattgccaatagattttaacctttggccttgcgcctaacagttctgcatctcttgttctgatcacacaatgcttactgaattaatagcgatcacctcctcgtcgccctgttaaaagcacgatcatcgggttgtatctggcacataaaa

SEQ ID NO: 20889 - DNA, 655 bp, Triticum aestivum
  Clone ID: PAT_TA_20889
aggaattcggacgaggatccctcccgccgcgcccgcgccggcgccgagcgagccccaaatctacagccgtgaagggggcggagagcacgctgccggcagcttcccctcccctcctcgtctcgccatttccacggattcgaagcagagcagaccttgtccgacgacgtcttcttggatggctgctgctgtaaaaacaagcggtggtttctgtaacacacagcagcagtggctacactcaacgagagatctgtttttacatggatccactcattcaaatgccaaagaatgcaaaagcaagaaggcaaaaaagcccacttcactgcgtgttaaagctacttccacgaaagtggaattagattttaatgatccatcttggaagcagaactttcaagaagactgggataatcgttttaatctgccacgtattacagatatatatgacttgaaaccaaggccaactacattctcactcaagaaacagagaactcctactggtgatgaagatagtacacctatggatatgtggaatggttacgtgaacaatgatgaccgggcgcttatgaaggtgataaagtattcgtcgcctacttctgctggagcagagtgcattgatcctgactgtacctgggtggagcaatgggtgcatcgtgcaggg

SEQ ID NO: 20890 - DNA, 574 bp, Triticum aestivum
  unsure (1)..(574): unsure at all n locations
  Clone ID: PAT_TA_20890
cccgggtgctctccgcatcccctgcgccgtcgccgacttccgccgcctcctcctcggcctctccgaccccggctgccaggccaccgacgacgacgactccgcgctctactactagccatctggcccgtcttccccgtctcaccctcctcgttcggctgccatggagggcgtgatggaaaatttgccccctggcaaaggcaaatcggtgaaccagcagagcaaaatgccagctgctgcgttctgaccgatctgcccctgcgtggatgctgtacatagggaggtcgctggagggtagcacggggaatccccgggattttcccgcagttcccaccgctgctcaccggctgcctggccctgctgtcgcgggggttcctccgccgtcgttgctccttctcccttccttttccgtgcgggctccgagcgacctctccttccacccctggtgctgcaatgcgagcttcttcttccccttcaccggcgttcccttttgaggccttgatttcgcatcgcgtattgccgcaangttcgcctcgtatgaatgaaatggatgatttgctactgcaaaaaaaaaaaa

SEQ ID NO: 20891 - DNA, 1610 bp, Triticum aestivum
  Clone ID: PAT_TA_20891
gccggccaggcgcagtcgcagcagaaaccatccacctcatactttctcttgcaacaagtcagtaaagattccgtttggagagcgagcggagctccggtgtaaaatcgatgggtctggatgtaggagagatcggcatgggcgcagatttgagcctggatttgaagatgttcgcggccaagagcctggggcgggtcagggaagcgccggcggccgccatggacgactgtatccggaggctggaggaggagaagagcaagatcgaggtgttccggcgcgagctccccctctgcgcgcgcctcctcgctgacgtgattgatgtgatgaagaaggaggtggaggagaagaagagaggcggcgatcgaggaggggacagggaggacgccggcgcaggcgacaagagcaactggatgagcaccgcgcagctctggacgggcgattccgtccagggggacgatgcttccgagaaggtggatgggagcaggatctcgtcggtgccgcgcgatgacggcggtgccttcagacattcctgagccgggagttcaggctagcctgttttggtgtaggcgaggtggtcgagcgttgactggtttgagaggatactcttgctgctattatgtaagcccctcccgatgaggccatccctggctcctgctaccggcggcgctaaagtaagccgctcgcggcagagggggcgtgcgcgccaagcgccttggcctccgccccccctgccaccggccgccccttccctaagcctccaggcgcagtcgcagcagacagcacagcagcagcagcagcagcggcaagcgaggaaggcgcggcggtgctggtcgccggagctgcaccgccagttcgtcactgccctgcaccaactcggtggtccccaagctgacactcgggggggtccccccaagggtttgcctgaacttcccaaaaagcataattcggtcacccgctacatataatagcaattataactaatttcatcgaggcataagcatcaaattattgagtgcttacatggttgttatccttggcatgattgcagttgctactccaaagcaaatcagggagctgatgaaggtggatggcctgaccaatgatgaagtgaagagccatctccagaaataccgtctacacaaccgaagggcgccaggatctccggcagccaaccggccgatcgtgctcatgggagggctctggataactcaggaccaaagcagctcccagtcaggagggtcacctccggggccccttcacttctcaagctcaggcgtagctgcctcatcggtgacggtcagcggcgaggaggaagatggcagatccgagagctatggctggaaatgatcaacaagttatattagagtttgttcggagtttccgggtcgcgcgatgacagtggtatcttgagagattcctgagacatgattgtagtgtagtcttttttgttgtatgcagggagatcaagccttgagtgctttgagatgaaactcttgctgttattatgtaagtacatcgggaagaggttatactagttacagttttgcggatatgttactctaaaaaggttggggcagagctacaattttcgcccagagaatttactaccaaaa

SEQ ID NO: 20892 - DNA, 698 bp, Triticum aestivum
  unsure (1)..(698): unsure at all n locations
  Clone ID: PAT_TA_20892
tgcacatgcgcgcgcacggcgacgagtacaagagcaaggcggcgctcgccaacccgaccaccaggctgttcgcgacctccggcgaggacgccgccgccgggagaccaaggagcagcaagtactcgtgcccgcaggacggctgccggtggaaccggaggcacgccaagttccagccgctcaagtcggtcatctgcgccaagaaccactacaagcgcagccactgccccaagatgtacgtctgcaaccgctgcaaccgcaagcacttctccgtcctctccgacctccgcacccacgagaagcactgcggcgaccaccgctggatatgctcctgcggcaccaccttctcccgcaaggacaagctcgccggccatgtctccctcttcgcaggccaccagcccgtcgcgccgctcgctcccggcagcggcaggcacggcaagagatctcgttattgtccacgtcctccgccgaccttgctggaaactgcacaacaccgcttctcaattatcctcctacatgacatcattgtgcaaatgtggctccctccctcctactgagccatgaaactgtnataatatatagcgggcttgttaacatnatggatttttcaaatatatagggcttcatacctggaatttnggcattcgactcgaaaaaanaaaaancaggggggccgnacaatcnccananggtctttaccg

SEQ ID NO: 20893 - DNA, 1252 bp, Triticum aestivum
  unsure (1)..(1252): unsure at all n locations
  Clone ID: PAT_TA_20893
ggcaccgggcgggcggcaccttcttttgcttccgcgcggcgatctcacgtccaaacccatccatccaacccaccgcccaaggtcgccgcggatctagcgagcctcggcggagcggagatgaagatcacggcgctcgtcgtgctgaagccgtcggccggaggcgccgggggctcctcctccagcggcgggcagggctcggaggcgctcgtgctggccaacgccacggacgtcagccacttcggcttcttccagcgcggcgccgcccgcgagttcatcgtcttcgtcgcccgcaccgtcgcccagcgcacccagcccggccagcgccagtcggtccagcacgaagaatacaaggttcactcacacaacagaaatggcctctgcgtggtggcatttatggatgatcactatcctgtacgaagtgcattttctcttctgaataaggtacttgacgaataccagaaggcttttggggatgcttggaaagccgccacagcagattccactcaagagtggcctttcctgatggaagctttgacaaaatttcaggatcctgcagaggctgacaagttaacaaaaattcagagggacttggatgaaacaaaaattatcctacataaaactatagagaatgtccttcaaagaggagagcgattggatagcttggttgaaaaaagctcagacctgagtgctgcttcacagatgttctacaagcaggcgaagaaaacaaacagttgttgtactatactctgaagcttgaactgtgatccttcaatctttccttggaaggctccagaaagaaaatcaacccaatctcggtggctggtaccttcatacatgctccttggacctttaattgtacctgcatagttcccaggaactttttgcccctgttttcaagaaacaaacaatcgatatcgttgtgttgtaccgtaagtccgattgctcatgaaaacgtgctgggccatcaactactgtatcttttttctttggtggtgcactttgaatagcaactaacatcacttgtcggtgctaaactaaattctccctgcgctatactccttagcaatggccaacatcaattcgcccgcccgtcttctgcaataggttgttgatatctcagttctcaaggttagtatgttggagcaccgttgctactcttaatttaagtatgttggggaacaaccnggggtggccanccttgtnaanttaatgttccnaaattggaanaaatggnttgntaccnaaagccttc

SEQ ID NO: 20894 - DNA, 614 bp, Triticum aestivum
  unsure (1)..(614): unsure at all n locations
  Clone ID: PAT_TA_20894
gtcgcgctcaccgtcgccgcagccgccaccgccaccaccgccgacccgctcctcggcggctttcgacggcgcgtcattcgaggacttcctcttcagatcctcccccgagatgttcatgttcccagccctgcaaagctagcacccacgccacggccatggcagcagcacaagcacgagcgcgcaacaaaagagatgatccatcttttttcctgatgcttctggtgtttcaggttaattactacagtacaaaaaactgggagagccgtggagtttttaccgcacctaactaagctagctgctggggttaattagtttataattatcatgtgtaatctgaactggtgtgtgtaccaagtgatgatggttcttaagcttagcatgcatgcatcaccatcatgtgatccccctatgtaagaaggaagaagcagttagctctctctctccctgtgctgttgctcagacaaagcaagtgccatatataattactctacttacttaaaaaaaaaaaaaaaaaaaaaaaaaaactccgaggggggggccccggtacccaatttcgcccctaatagtgnggtcgtanttacnccgcgcctcactggggccgtccgtttttacaa

SEQ ID NO: 20895 - DNA, 671 bp, Triticum aestivum
  Clone ID: PAT_TA_20895
ccacgcgtccgcaggtcttgaagtggtaggagacggcggcggcgtacgagatgaaggacttggtggggctggggcacttgttcgtggtggcattcctcttccacttctcctccttcatggtgctcccggcgatcaccgacgtgaccatggaggccgtctgccccggccgcgacgagtgctccgtcgccatctatctcagcggcttccagaacgccatcacagggctgggggctctggtagtgactcctatcgtcgggaatttgtcggacaagtacggccggaaggcgctgatgacgctgccggtgaccgtcgccattttgcctctctttatattggcgtgcaaccgatcggaggtgtacttctacgcgtactacgtgatgaagatcctcgccgggatcttctgcgagggcagcatccactgtctcttgcttgcttacgtggcggaccacgtagggaccaaacggcgggcggcggcgttcgggctcctctcaggcgtgtcggcggcccggcttcctctcggggaccctcaccgcgcggttcctcgccacctcctccacctttcaggtcgccgcggccgtcggtgcagcgggagccatctacctcagggcattcgtcccggattccggcgctgctgtctccttccatgacgatgcctgcgatcccctgctcca

SEQ ID NO: 20896 - DNA, 686 bp, Triticum aestivum
  Clone ID: PAT_TA_20896
gcacgagggaaggatgaagctaatgggcagctggatatcaacaacgatttctgggcagagctattttctgatgattttggagacggagacgggtctgggctgtcagagttggagggaaggagacctgaagatatcgatgaactggctcagcagttggggtatctgagttctactagcccgcagtagagttttgttcacagtggttcacttcaaccaacaaacattgcttctccagtactactattgcagatcatcttgaacaatctgatttagttgattggtggcaacatgactggctatctgaggtgttccataccggagattggaacacctctgggtagagagtagaagctgaagactaattgctgcgtcgcttgatggagacccatgacgtgtattgaatgggtacctaaactcgctactctgaagaagatggtccagatcgtcgacattcggttggtcttgagctggtgttcagcaccagtagctgtggaagtgtgtgactgtatatactcgtggggcggaggttcgcgggggtagtctggtctgtagtcagccgttggcatctgggtgtgggtttacccatttctcctgctgctgtccatttgccaatttaccttacttttagggcctgtgtcctgtgtgatgattggtagtgtatgctggaacctctgttatattgagat

SEQ ID NO: 20897 - DNA, 851 bp, Triticum aestivum
  Clone ID: PAT_TA_20897
gaggcggaggcgctcccgcgggtgcggctcgcggccgtcgacgtggagtgggcgcacgtgctcgccgagggctgggcgtcgccgctgcgcgggttcatgcgggagcacgagtacctccagtgcctccacttcaactccctccgcctcccctccggcggcctcgccaacatgtcgctccccatcgtgctcgccgtcgacgacgccgccaaggaccgcgtcggggccgcccccgacgtcgcgctcgccgggcccgacggcgagctcctcgccgtcctccgcagtgtcgaaatataccctcacaataaagaagaaaggattgcaagaacatgggggacaactgcgcctggcttaccttatgtcgatgaggcgataacaccagctggaaactggctgattggtggtgatctggaggtgttgcaacccattaagtataacgatggccttgaccattacaggctttcaccccagcaacttagggacgaattcgacaagcgtggggctgatgctgtatttgcattccagttgagaaacccagtccacaatgggcatgcactgttgatgaatgacactagaaggcgtctcttggaaatgggtttcaagaatcccattctactgctacacccccttgggtggttttacaaaagctgatgatgtcccactgcctgttagaatggaacaacacagcaaggtcttagaagatggagtccttgaccccgagaccactatcgtgtctatattcccctccccaatgcattatgctggtccagcagaagtgcagtggcatgcgaaggcacgaattaatgccggtgctaatttctatatagtgggtcgtgatccaactgggatgggcc

SEQ ID NO: 20898 - DNA, 1146 bp, Triticum aestivum
  unsure (1)..(1146): unsure at all n locations
  Clone ID: PAT_TA_20898
cgccacacgtacccgcctcacgtactcgcatccatcacactagcttgcttagcatcgccacctgctcttagaacggcgggctactacaacggcggcggcaggaccatgtcctactccaagccacgatgagtgcttcgatggcggcaggacgatgtactccaacaccaccgacgactccgctacgacgccggcgaagcacggggtcaccggggcacgggccatggcccatgggccatggcggggcaaacatgtacgctaacaccactgacgtggaagtgcttcgaggactcccggacaggcacggctacggtaggcctggcggcaggaccatgtactccaaccaccgtcgacgaggagtgcttcgactccggcaggcacgggcatgggcacggccacggctacgggcacaacgacggtagggccatgtcctactccaccaccaccgacggagtgcttcggcggaggcgagcagggccaggggtactataagaaggaggtgaagcagcacaagaacagggagcgcgtcggcgaggtcggcgcactcgccgccggtgccttcgccctgtatgaggggtacgaggtgaagaaggacccggcacacgcgaggaagcaccagatcgaggccggtgtggcgggggcggcagcgctcggcgccggcggctacgcgtaccacgagcaccgcgagcagaagcaggccgcctacggcgggcagcaggagtacaggatgcccgtccacaacggctactgcaactaagtgcacgctaccaacgtcgatcgatcgtcgtatagactccaataataaaatcgacagagcatcatgcaggcaggcatgctgcatgcatgtgttgcttaagtattgttaatttcggcttatctacaataagctagctgcatgcgtacgttcatgctaccagtcgcgtgctctgtggtgtaacttgcatatggtacaatacggtcgacagtatttacgcgtgtatggattgtgtggtcttgaaaaataataagaaataacattatgatcgagtgaaatataaaaaataataaaaaaacatatacaagtatataaaaacatcaaagaatcaatcagccggtagatataagccctcacgggccgcctttataactcctgactggcaaactgnnttc

SEQ ID NO: 20899 - DNA, 560 bp, Triticum aestivum
  unsure (1)..(560): unsure at all n locations
  Clone ID: PAT_TA_20899
tccgcccctcgctgccgctgcgtctcgtctccaccaccccacttgcccccggacccaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcacttttgttgccattggacatctttaaatgggaaagaagtttgaaggatatcgttccttcaatccccacaactggtgacgtcccccatgtttgacccgccaaagattatcaagctggatttgacataactggatgatggatatgtcaagcttctcaactggagagtgggaacactaaggatgacctgaacttcccaactgatgatgttctgcttgggcaaatttaagacngttttcctgatggaaaggctgatccgcctgtgatgcccncaggggnaaanaaaatntgcgctttnaaaggaaccggggg

SEQ ID NO: 20900 - DNA, 1019 bp, Triticum aestivum
  Clone ID: PAT_TA_20900
gcacgagcttagctgcaattcgcggcccctcggcttccaagttccaacgatctcgtagacactctctcgtttcaatctcgagcgacttttattatttcaaagtgcaatggctgcagcgaacgctcccttcgctctcgtcagccgcctctccccggccgcgcgcctgcccatccgtgcctggagagccgcgaggccggcgccgctctcgaccggcgggagaacccgcccgctctccgtggcctccgcggcgcaggagaatagggacaactccgtcgacgtccaagtcagccaggcccagaacgccggcaaccagcagggcaatgcagtccagcgccgccctcgtcgcgctggatttgacatctccccgttcgggctagtggacccgatgtcgccgatgaggacgatgcggcagatgctggacacgatggaccggctgttcgacgacgccgtggggttccccacggcgcgtcgctcgccagcggcggcgagcgagacgccgcggatgccgtgggacatcatggaggacgagaaggaggtgaagatgcggtttgacatgcctgggctgtcgcgggaggaggtgagggtgatggtggaggacgacgcgctggtcatccgcggcgagcacaagaaggaggccggcgaagggcagggcgaaggcggcgacgggtggtggaaggagcgcagcgtgagctcctacgacatgcgccttgctctgccggacgagtgcgacaagagccaggtgcgggccgagctcaagaacggcgtgctgctcgtgtccgtgcccaagagggagaccgagcgcaaggtcatcgacgtgcaggtccagtgatgagttcgtgtgagactgtaccctgcatctgaggctttaagatttcagctgtccgaggtgtgctctttgtagagtgtgccgtttttctccaatcctctttgcgcactcgttgtgcgaaagcggccgcgctctctgtctctcctctctccctaataataaaataataaaacacaaaaaaaaaaaaaaaaaa

SEQ ID NO: 20901 - DNA, 1109 bp, Triticum aestivum
  Clone ID: PAT_TA_20901
gcacgagagcaccgcttagctgcgactcccgcaattcgtagcacttggacatccgctttcgagttacatcgatctcatcgtctctctctcgtttcaattcgcgtctgactctttaagcgcgcaatggccgccgcgaacgcccccttcgctctcagtcgcctctccccggccgcgcgcctgccgatccgtgcctggagagccgcgaggccggccccggtctcgaccggcgcaacccgcccgctctccgtggcctccgcggcgcaagagaacagggacaactccgtcgacgtccaagtcagccaggcccagaacgccggcgaccagcagggcaacgctgccccgcggccgccgagtccagcgccgctctcgacccgctggatttggcatctgccccctctggctactgggccggaggtggccgatgaggacgatgcggcggatgcttgacacgatggaccggctgttcgaccgacgccgtggggttccccacggcgcggcgctcactggcggcggcgagcgtgacgccgcggatgccgtgggacatcatggaggacggagaaggaggtgaagatgcggttcgacatgcccgggctgtcgcgggaggaggtgaaggtgatggtggagggcgacgcgctcgtcatccgcggcgagcacaagaaggaggccggcgaaggccagggcgaagcagcggaaggcggcgacgggtggtggaaggagcgcagcgtgagctcctacgacatgcgcctggctctgccggacgagtgcgacaagagccaggtgcgcgccgagctcaagaacggcgtgctgctcgtgtccgtgcccaagagggagaccgagcgcaaggtcatcgacgtgaaggtccagtgatgagtacgtatgtgcgagactgtaccctgtgtctgaggctttaagatttcagctgtcccaatatgaccgtcggcgagtgagtgctctttgtaggcgtagtgtgccgttcttctccgatcctctctgcgcgctcgttcgcagaatacgtagagctttatgtaaatgtacttggcaaatcaatgaataagtgttcggctgcttgatcagctgcacacacttcgattaaaaaaaaaaaaaaaaaa

SEQ ID NO: 20902 - DNA, 1438 bp, Triticum aestivum
  unsure (1)..(1438): unsure at all n locations
  Clone ID: PAT_TA_20902
cggccgggaaggtccatagcagtgagggagtaggagtaanttccccgattccctctatctagtccttcactaatgcgccttttacgccggctagtgcttctgctagcctgttgtgcagcagcgttggtcccatcccttccttctaccagcggagtgcggtcgcgcctgcctttagcctgggaacccccgccactcgtccatttccagctgccgcccactcccctccctctcatcccgtcaaagaagaggagacgagaaagcgaagtcaatcaaatccatggggatcgtggaggaggcacacaacctgcgggttgtcggggaggggaagcgcggagtgatcgtcctggcgcacggcttcggcacggaccagtcggtgtggaagcacctggtgccgcacctcgtcgccgactaccgcgtcgtcctcttcgacaccatgggcgccgggccgaccaacccagactacttcgatttttcccgctacgccacgctcgagggatatgcgctcgatctgctcgccatcctggaggagctcgggatcgcctcctgcatctacgtcggccactccgtctccgccgtaatcggcgtgctcgcctccatctcccgtcccgacctcttctccaagctcgtactcctctccgcttctcccaggtacctcaatgatgtggattactatgggggatttgagcaggaggagcttgatgagctctttgaagcgatgagatcaaactataaggcctggtgctcaggttttgcaccactctgtgttggaggggacctggaatctgtgtcagttcaggagttcagccgaactctcttcaacattcgcccagacatagccctgagcgttgtccagacgatcttccagagtgatgtgcgcaccctcctaccgctcgtctcggtcccatgccatatcgttcagagcaccaaggacctcgcagtgccagttgtggtgtcagagtacttgcacaagcatcttggtggcgactccatcgttgaggtgatgccctctgagggccatctcccccagcttagctcaccggacattgtcacccccgtattgctccgacacatccagcatgacattgcattctaagtagtgcaaccatggctcatagaagctgttgcttggaagctttatgaggtcagtatctgcatttacttaaggattcaccacatgatgtaaattcttggcggtggaaattgtagtgtacattgtaaacctttgcctacttcaaaatgtgtataataatcatgttggatcacctagcagaacacatgccctacgaattcctactctgttttgtctcaatggttttagtctgaactctgaaggatgtgctttttctgtagttccgtgctaataagaaaagaaaacgtgttggagagaaaaaaaaaataaaaaaaaaaatatgaaaaaaaaaaaaaaaaaaggccccta

SEQ ID NO: 20903 - DNA, 1352 bp, Triticum aestivum
  unsure (1)..(1352): unsure at all n locations
  Clone ID: PAT_TA_20903
attcaagagaatatcttattcgggcagccaatggatgctgaaagatacaaagaagttacacggtcttgctgtctgcaaaaggatttggaaatgatggaatttggtgaccagactgaaataggggagagagggatcaatctcagtggcgggcagaaacagcgcattcagcttgccagagcagtttatcagaattgcgatgtatatctccttgatgatgtcttcagtgctgttgatgcgcacactggttcgtatatctttaaggaatgtctaaggggcatgctcaagggaaagaccatcttgcttgttactcaccaagtggatttcttgcataatgtggacaacatatttgtcatgaaagatggcatgattgcacagtcaggaaagtttgatgagttactagaagcaggctcaggcttttcagctcttgttgctgcccatgatagttcaatggaactggtggaacagagtcgacaagtagagaagactgaacattctcagcctgcagtagtcagaatcccgtctcttcgctctagatccatcggaaagggcgagaaggtgatcgtttcaccagaaatagaagcagctacttctaagatcatacaagaagaggaaagagagagtggccaagtaagttggcgtgtgtacaagctatacatgacggaggcttggggatggtggggggttgtgggcatatttggattatcattggtgtggcaagcttctgatatggctagtgactagcgcgtggcatatgaaacatcaggcggcactccgttcaatccgtcactgtttatcggagtgtatgttgccatagctggcgtttcaatggtacttcaagtaatcaagacttttcttgagacggtcatgggacttcaaacagctcagatctttttcaggaagatgtttgacagcattttgcatgccccaatgtcattttttgacaccactccttcaagaaggattcttagtcgggcatcatctgaccaaacaacgatcgatgttgtgctggcatttttcgttggcctgacaatttcaatgtacatttcagtattgagcaccatagttgttacttgtcaagttgcctggccatcagttatagctgtaattccgcttctgctattgaacatttggtacaggaatcgctatcttgcaacttctcgggagctaactcgacttgaaggagtaaccaaggcaccggttatcgatcactttactgagaccgttgtanntgctacaaccatacgatgttttaagaaggaaaatgaatttttccaggagaatttagacagaatcaattcaagtttgcgcatgtacttccacaattatgcagcaaacgagtnnnnnngggttcc

SEQ ID NO: 20904 - DNA, 805 bp, Triticum aestivum
  unsure (1)..(805): unsure at all n locations
  Clone ID: PAT_TA_20904
aagcagacaagtcaaaaaataaccagtgtttcgcatcagtagaggaagaagagagcagggaaagaggagggagaaatggctgcaatatcagcagcaatctccggctggtgctcttcgtcctgtctgtcccagtcccagcggggcctaccgtcccccgcaaggagaaggcacttcaaggtcacggctatggctcccaagaacaaggtgaacaagtacgacgatgggtggtccaagcagtggttcggcgcggggatcttcgcggaggggagcgaggaggcgtcggtggacgtgttcaagaagctggagaagcgcaaggtgctgagcagcgtggagaaggcggggctgctgtccaaggcggaggagctcggcgtcacgctctcctcgctggagaagctcggactgctctccaaggccgaggacctgggactcctcagcctcgtcgagagcgcagccacggtgtccccggccgtgctcgcatcgctgtcgctgccgctgctcgtcgcctccatcgccacggtcgtcttcgtgccggacgactccaccctgctggtgactgtccagacggtcgtcgctacgttgttcgcggccgtcgctgccgggctgttcgtcggctccgtcgtgctcgacggactgcaggacgattagcgccttcactccgttaatgtttgttttgtagtaggatagaccaccagtcgaccactgctactacgaataatagtgagttatatgcgttcgtgggtgttattccattgccccacttttgaaaaaaaaaaaacaagtataatgcccgnatttgccacgggcc

SEQ ID NO: 20905 - DNA, 623 bp, Triticum aestivum
  Clone ID: PAT_TA_20905
cccgcgtccgccttccacccttcctcctcctctcgcattccagtagaatcgtctcggttgctagggtttgatcctacccttcctggcacgatggcgcatccgcccccgcggaactgggccatggcgccgccgtaccactaccacgggacgtcgcagcaggagcaggcggcgccagccgcggaggacgagagcggagccgggtccggagggcaggaggcggagtcgaggtcactccggatccgcgaacttttcccctggatggacgaggactacctgcgcagctgcttcacccgctcgcccgagcttgtgacagcagtgataacgcggaacaaggagaccaagcaatctgagggtttcggttatcttaccttttctgaccatgccactgctgaccaaatcctccagagctacaatggccagaagatgcctaatgctgacagggatttcagcctcagctgggtccagtatgctggtcctgatgatgattgtgccatatatgttgggggattgggctttgatgttacagacttcatgctacaccacgtgttcaagaatcgctatccatcagttaagagggcaaaagttatatgggattatcttgctagacgctcaaaaggctatgg

SEQ ID NO: 20906 - DNA, 886 bp, Triticum aestivum
  Clone ID: PAT_TA_20906
tcggccgccgcttcctcctctcgctccacgtcgcgctgctgctgctagtcccctgcacctgccaggtcggggattcgtgctcggcggcccgcgactgcggggtgggcctctactgcggcgattgcgccgccgccggccggacgcggccgtcctgcatcagggacctggccatccagcccacctccatcgtgaaggggctgccatttaacaggtactcatggctggtgacccataattcattctccatcgtcggcgagccgtcacgcaccggggttgagagggtcacattctacaaccaggaagacactgtcaccaaccaactcaggaatggagtgaggggattgatgctggatatgtatgacttcggcggggatgcctggctctgccactccttgcaagggcaatgctacaacttcactgctttcgaaccagcaattgacacgttgaaagaggtggaagcatttctatccgagaatcccacggagattgttacaatattcatcgaggattacgtacatgccccgatgagattgagcaaattgtttactgctgctgacttgatgaagtattggtaccctatctcagaaatgccaacgagtgggcaggagtggcccaccgtcacagatatggttgcaaagaaccacaggttgcttgtgtttacttccgatgcttcaaaggagtctagcgaaggaatagcttaccagtggagttatttgctggagaatgagtgtaagtatggctttctgggctttattgaaaaaaacagaggttctatcgattctaggtagcgatagctataccacaatttgcaaatctaaaacccaaaatacaaatttcttcttggctttctatgtcttgagatagcctaccccaacttgtttgggac

SEQ ID NO: 20907 - DNA, 577 bp, Triticum aestivum
  Clone ID: PAT_TA_20907
cccacgcgtccgcccacgcgtccgcccacgcgtccgcccacgcgtccgcccacgcgtccgcccacgcgtccgattctgttggactacctcagatggtccaaacttgctatgctgcagctggaaatagaatcccgaacttcatagctgtgaatttttacatgcgaagcgatggtggtggtgtttttgatgttcaggacagaatcaacggccttacgctatgtggttgcaacaccattgctgcttgccaggctggggcaccagcgggcgcatgcaagaacactggagcacctaatcgaactacctcttctgtaaacgggaacgtctattcaggaactgtagaattcaagacttctgcttcaagggccagcagtacttccacctggagcaacttggttatttcgctaagtcttgctttgattcttaagccattttgaaccttcgggctttggtttatgtgtctttgtgggtttgtgagctgtccttttcttctttcataccggcgtatgtgtgttgtcatgttgcttccgtgatgggatgatggtcagcagcttgctacctctctaggctatattcagag

SEQ ID NO: 20908 - DNA, 1605 bp, Triticum aestivum
  Clone ID: PAT_TA_20908
gaaaagggcaaccatgtagtgtttcccctcctttcccttctcgcagcagcagatcactaagctcactccatggtggagagagtggttggtggccactaatggcgcgcctctcccgtcgccgcttcctcctctcgctccacgtcgcgctgctcctgctagtcccctgctcctgccaggtcggggattcgtgctcggcggcccgcgactgcggggtgggcctctactgcggcgattgcgccgccgccggcaggacgcggccgtcctgcatcagggacctggccatccaacccaccaccatcgtgaaggggctgccctttaacagatactcatggctggtgacccataattcattctccatcgtcggcgagccgtcacgcaccggagttgagagggttacgttttacaaccaggaagacactgtcaccaaccaactgaggaatggagtgaggggattgatgctggatatgtatgacttcggcggtgatgtctggctctgccactccttgcaagggcaatgctacaacttcaccgctttcgaaccagcaattgacacgttgaaataggtggaagcatttctatctgagaaccccacagagattgttacaatattcatcgaggattacgtacatgccccgatgagattgagcaaactgtttactgctgctgacttgatgaagtattggtaccctatctcagaaatgccaacgagtgggcaggagtggcccaccgtcacagatatggtcgcaaagaaccacaggttgcctggcgggcaggccgggccctctgtcacagatatggtcgcaaagaaccaccagtggagttattgctggagaatgagtctggagatccgggtattgaccctagcgcttgtccaaacagaaaggaatcacagccactaaactcaagatctgcgtctctatttatgcaaaattatttccccacaattcctgttgagagtgaagcatgcaaagagaattctgttggactacctcagatggtccaaacttgctatgctgcagctggaaatagaatcccgaacttcatagctgtgaatttttacatgcgaagcgatggtggtggtgtttttgatgttcaggacagaatcaacggccttacgctatgtggttgcaacaccattgctgcttgccaggctggggcaccagcgggcgcatgcaagaacactggagcacctaatcgaactacctcttctgtaaacgggaacgtctattcaggaactgtagaattcaagacttctgcttcaagggccagcagtacttccacctggagcaacttggttatttcgctaagtcttgctttgattcttaagccattttgaaccttcgggctttggtttatgtgtctttgtgggtttgtgagctgtccttttcttctttcataccggcgtatgtgtgttgtcatgttgcttccgtgatgggatgatggtcagcagcttgctacctctctaggctatattcagagaaatagataatgagtttgggctcagcgtggatagctataccacaatttgcaaatctaaaacccaaaatacaaatttcttcttggctttctatgtcttgagatagcctaccccaacttgtttgcgac

SEQ ID NO: 20909 - DNA, 383 bp, Triticum aestivum
  Clone ID: PAT_TA_20909
gactgccccgcacccgcaacaacggtggcgacagggagctcgccgcggttcgacgtgtacggcaacgacttcgggtggggcagccccgtggccgtgcgcagcggctcggggaacaaggtggatggaaaggtgaccgtgtacgagggcagaggcggcggagggagcattgccctggaggtttgtctgtcaccggaggcgtttcccaggctcctcgccgacgaggagttcatgggcatggtgggcgcgactgattaatagttgtgccgctttctgaattgctctgcttgaataacacgccttgtcgctcgtcagcttgatgggacacactgtgtctttttttctctctatatataccttttcctttaaaaaaaaaaaaaaaaaaa

SEQ ID NO: 20910 - DNA, 647 bp, Triticum aestivum
  Clone ID: PAT_TA_20910
gcagtctgttgaggcgccgccgccccgccccgcccactgcctccggtcgcgccgccacaagcacaagcaggaccgtcggcagcatcgatagccccaccgccgacgcgtgcgccgcaagcggtgccggcgccgggtgcgcccgctgccctttcccatggtacagttctccacccccctacctcacttgtagtagtactacttcatactcattggcggtcccggacgggttaagtgccaccaaactggtcgacggcggctggacggggagttggtgggtggggtagcgctcgtccgttgagacgttgctggttttccccaactcctggatggcggtgttgcgactctcagcttcttggggcgtcaggggagggaggaagagaacatgggcgttgtagttgctacacatcaagcaaagagttgctcaaaatcagtcaaggtagcaagataggtgattatttatgtgagatgggtgatggactagcttcagagattcagacataagccgttgacatgatgggctagattcagtgctgctctcgtactgtatcttttttcttctcttcacatgatgcaagttttgtggttggtaaggatcaaagtgtatattgaaaattcagtttaaatttctgaataaaaaaaaaaaaaaa

SEQ ID NO: 20911 - DNA, 781 bp, Triticum aestivum
  Clone ID: PAT_TA_20911
gccacgcgcgggcagaggtcggaagaagaggaaggaaaaggctctatctcccgcacggcggcgcggtgtagccggcggcgatggctttctggcaggcgcgcgacttcctgttctgcggcgtgtgcggcaccctcctcgacttcaactcccaccgctacgcctcctgccccctctgcggcttcaagcgcaaggccaaagatatcgaagggaaagaaactcggtacgcggtcaccgcagaggatattagaagagagctaaagataaaagcgtttgtggttcttgaatcggcgccaaatttggacatagttgtgcaaaggatccctgacagagcgagcctgtgccggaatgcaacaatcctgaactcgaattttacacgaagcagcttcggtcatcggataaggggccgacgatcttcgacgcgtacccggagtgcggccacacgtgcaatgagaactcctaagaaagtaggttcctactagcagtgtatggatatggccagtggaaaactatcgcctgtcatcgatagtccgtctgccttggattgaccttttacggccctgcttttcggcgtgtatgcttatcttcaatgttacctgggatatgttaatgctcctttctatctaacggtttttgatggaacctgtctgtctgatgtatttgactgaatgtggccatagaaagagcaggatatattgtttctaaaggtgattggactggttgctgcattttagtactgcatcggattattcaaaagtaatacactctcgaccgattcattttg

SEQ ID NO: 20912 - DNA, 911 bp, Triticum aestivum
  Clone ID: PAT_TA_20912
ggccaagggcacacaaggaggaggccgggggagattatctcgggggacaaaaggcaaaggaccccacaatccgaaccattaccagatttccacatatggcgtacagaagggccggaatcgatctattcggttcgttctctctcgggggaccgaaggcagaggatagaacagtccgaacccttccaacgacctacaagatctggataacaaaaggatgcaagaaggagttcatggatttgcaaaagtatctcaccacatcatgcactcctgggcctgcttgtgcggatccattccactggcaggccacaatcaggggctcacctgaccgcccctactaaggacgggcatcttcctgtccacctccatttcacccctgattgcccctttatgcccccaaaagagagatctccaaacaaaggtgcatcaccccgaacaccaactcccaccgcagcatctccctggcccatgctccaaggaacaggcggcagcccggaaatgaaaccaatgcaccggcctactcgaccatcagggtcccttgactcaaccgtaccccctaacctcgacgaccccctagaccccgggagatcgcgcagctctacaagtatcccaccagtggcccgctacgaaggagaccgcgagggcctgggacccatgaagtacgtcatgggcagatccgctgccaaagatgaccttgcacaacggggtaagacaacttctgtgtcgcgccggtttcccgccctccgagtttccaccccatatctggctttctctgaacaagttttacttgctgtacagttgtcaaaactgggtgatgtttgcattctgttccaaactttgggtgtacccctgtccctgaagactgttgtacaacacagaacattttaaagaattgtggggtttcgtaaaaaaaa

SEQ ID NO: 20913 - DNA, 654 bp, Triticum aestivum
  Clone ID: PAT_TA_20913
atttcacaaagacagcctcctgcgtacattcctcctgcgtagcaccacgccgagccaacacccaagaacggcggcagccagctagcttgcagactcgagggtcggggccgtctccatggaccgatcggtttccggcgggagagggtactactactcggcggcgccggtgggcacgggcatgggcatgggcccgctcgcgggccagctcggcgagtggctgctccgggccgtgcagccgccggcgcccacgccgtgcgggtcgcccggcgggcccccgatcaccgcgccgcgggtccggatgagggacggccggcacttggcgtacgaggagtccggcgtgtctaaggagaccgcacggttcaagatcgtcttctcccacggcttcaccggctcccgcctcgacagcctccgcgcatcgccggaggtcgccgaggagcttggcgtgtacatggtgggattcgaccgcgccggctacggcgagagcgaccccaaccctggccgctccgtggagaccgcggcgcaggacatggaggacctggccgacgcgctggggctcggcgacaagttctacgtcgtcggcttctccctcggctgccacgccgtgtggggcgcgctcaggtacatcccggagcggatcgccggggcagcgatgct

SEQ ID NO: 20914 - DNA, 446 bp, Triticum aestivum
  Clone ID: PAT_TA_20914
cgtccgcgccgctttgggtcggggttttagcgagctcagggaggccggccggaggcgacgaccgccgtcggggaagaagaagaggaccacacacgctcgtatatgtcttcttgccccttcgccgatctggtggtagtagcgctgctcctcgccgccgccatcgtcgccgtcgtcctcctccacgcactcgcctgcgccccccgatctatgcaccaggggctccacggctggaacaagtcctcgtcgatgctcagggacgggttcggggtgaagtattccggattcctccacataaggccgtgtagtttcttgcgaggagactgacggagtcccggtgattccgtccgtcgaatttttgacacccaagagagagaaaaagttgtccccttttcctagtagagtttttccccttcagttttgttagtctcagtcagtgttagaggaag

SEQ ID NO: 20915 - DNA, 1908 bp, Triticum aestivum
  Clone ID: PAT_TA_20915
ccgcgcccccgcgttcgggcgggctcgcagcggccggcgggaggcgtgggcgacgccgacccccgtcccggtcgacgacaagaaggcgccccacccccccttcgacgcttcctgccccctccccgctcccggcggggctgcccccccccccccccccgccgcccgccgtccccccccccgcccccccgtgcccgcccccgcccctgcaccggcggctccacggccgccaccgctgtcggctgctcctccggcgcggcttccgggagacgtccgccgggctgctccactcacgcacccgtagttgccctcggacctgctggctaccagccgggcagctccgccgctgttccctgtgtcgcctccaagtcccagaagtcgtgggaacagatgtccctttttccaagtctaatttttccccttcagttgtggaaggaggagactgtcgggggcttatgaccggtcatcgcctcccggaacgaccaccagatgggccttgcgcgcccggctgccaggagcaccatgacgatgatgctctcggggtgcgtcgtccagcccacagctgctttcgcccggtcgccgcggcagcaggcgccgtcgctgctggccggggcgccgccctcggcgccggctcgctcccactttgcgggctgcgactttagccacacgaataggacacttgacgacgaggcggctgtcgccgcgcctgcttcgtccaagcgctgcttcgagctgttccttggcaaggccccgccggccaaggtgtttgccaagccggtcactccgaccgccgcggcttctgctgtcgctgcctgcaccaccagcagcgccgagggccaccgtggggtgcgcctccgcaagtggggcaagtgggcggccgagatccgcaacccgttctccggcaagagggagtggcttggcaccttcgacactgccgacttggccctccgccgcctaccagggcgcctcccaggagctttgatcgaaggcgaagcggcgccggccagtgtcagtccgtgggctcccgccttccgtctgctgcgtcaacaagactgacacaacaccgacctacacttacggctaccaccaagcggtatcttccgtcgtcctcccacctccgctggtcccttccgcccacccttcgccctcctcatgtcctggaggccaccaagccaccaaccgagtccctgttcccctgaagccgaccccagttccggtcatgttgtccaccacggctgagactgcgcagcttcctgacgacccagagttctaccaggacctcctgcgtggtctccagctgccggacatcgacccgatggacttccgcgccgggcttgatgccttggacgtctccgaggcgtcggcttacttggacggcgaacaggacctgctgctcggtgacctggccgacgaggacctcgagctggacatggacctcgacatcggcgacgacttcctggagatgcctggctgcgactttggccggggcatggatgatttcctgcaaaccgtcgatttctgcgtgtgaattaagagaggtttaaggtttatctttaagtaatgctggtgtgatgggcctcctgtgagtgtaatccgtgtgcattgggagggaggagatcctcttgggtttttccccgggcagctcaaccagctcgtgcccaagatggtgtctgttttccctagtctcccgagcacattagcgttatggtggtgagagtgaggagagtatttttgatagtaggttacattgtgataagttatagtagctgctggttatgttatgttcctcctttatgttacctgtcaatgttggtccagacattgtagctagctcaagacaagtcttgtggctgttgctcctagtagtatgaatgaaaaagaaaaataagttcgcattataaaaaaaaaaaa

SEQ ID NO: 20916 - DNA, 474 bp, Triticum aestivum
  Clone ID: PAT_TA_20916
cccacgcgtccggcgccgacatgccctgcaactaagcaggagattttccatctgtaagagcagctccgaagatgctggatccgatgctcccctgccgcacggcggtgaccaacgccagcaggaggtgcttgcgaaaatcgccatgcttcagacgcagaaggtccgcatcacaaacttcctggatgagcggtctgcttacctgaccaagttcaccaaggacgccgacaccgagtttgatatgattgggcagaacgccatgaaagagctcgatcaaattggggaccagataatggagcgtcttgacagcaagatgcagtcctacgaggagacagctgaaatgcaaaggcaggagatagaaatgaacgagagggtgttagaagacttcgaagattggattgaagaggagaaaaacgaaggcatgttcttcaaaagccttgggaaggtccaaaaacctcaaaacaatgaggaaatcaa

SEQ ID NO: 20917 - DNA, 1457 bp, Triticum aestivum
  Clone ID: PAT_TA_20917
gcgcgcggttaatcagcagcccaccacccgccgcaacgctcagacccagatgctcaagcggcgcagcttactctccaccccgctcagacagcccttcccccgccgcgcagatcctctctgcgccaacagcccctgcaactatgcaggcggcgatttcccatctgtaagagcagctccgcggctgctggatccgatgctcccctgccccacggctggtgaccaacgccagcaggaggtgcttgcgaaaatcgccatgcttcagacgcagaaggaccgcatcacaaacttcctggatgagcgggctgcattcctgaacaagttccccaaagacgccggaacagattttggtactatagaccgttaagacaatgctacacttcgatcacataggggcccagcacagagatgcactgcgacaagcaagaaggagaccttccagctgtgattgcagtaatgcaaaggcaggaagataggaactgcacgagaagggtgttgaaaagcctccgaaggtggtgttggcgaaaagagaaaaacgaaaggatgcagaaggtcagcatcacaaaaatcctccaaaaagcggtcagcaaaccggaccaagttcacaaagggacggcgacaccgagttcgacatgattgggacagaacgccatgaaagagctcgatacaaattggggaaccagataatggcagcgactcgacagcaagatgcagtcctacgaggagacagctgaaatgcaaaggcaggagatagaaatgaacgagagggtgttagaagatttcgaagactggatcgaagaggagaaaaacgaaggcatgttcttcaaaagccttggcaaggtcaaaaaacctcaaaacaatgaggaaatcaaggtgaaggccaagattgaagcacagaaggtcagagagattgcagaggagagtgcggggtcaaaagctcggatgaatatttaccttgcactgacggcgatactcggtcttacaatcgcaaatgccgtctttgcaacgccagaggtggaatggaggaaggttgctgctctgggtctaattttcattggcctggttgctcaggtaatctatgagcaagatatatccccaccggtagctgacaaggatgaaaaaagagaagaatgaaagagctgtgcaccctgagtgaaacatcaaaaagcagcaagagcttcatcgatatagacgtagactgtataaattcaagatatagattgtgtaatcttagttatcatttaaggtgtagcttggcctataaaccacaggtttcttacacctgaggtctgataaactcaagctgtgttcaatcttgcatcaaagatatgtttcagcaatataactttcaaagccaaaaccatgtaacgaagttacaattttgatgcacacaacacgtcaagttatcaaattcaaataaaagacctcggccgcgaccacgataatcacttagtgaattc

SEQ ID NO: 20918 - DNA, 711 bp, Triticum aestivum
  unsure (1)..(711): unsure at all n locations
  Clone ID: PAT_TA_20918
cttgatcgattaanctgtcctcaaccatcatggctgccattatggcggcaggtctggtagtactggcactcctcgctgccgtcgccgctccggcgcacgccacggactacgtggtgggcgactcggccgngtgggccancggcgtngactacgccacctgggcgagcggcaagaccttcgctgctggggacaacctagtgttccagtacagcgcgatgcacacggtggcggaggtgagctccgcggactacagcgcctgctcggccagcaactccatccagtcctacagcgaccagaacaccaaggtcgcgcttacggcgcccggcacgcgctacttcatctgcggcgccccgggccactgcggcaacggcatgaagctcgccgtcacggtcgccgccgcggccgccaccaccaccccggcgtcgtccccgcccgcccccgccgcgccgcccacgcccccccccgccgtcccggtctccccccacgccgacgccccccccgtcgcgccgcccctccgcccgccccccccacgccgcccgccccgcccgcgtcggcgtcgccctcgcgctctggcctctctggcgcggcccccgcgcgccngccgcgccctgtggggtttggcgcggcgcgccctcccgggctcgccctcccgggccagcttggtggccttggcttttccggttccctcagtccctgctctccgtggttaaa

SEQ ID NO: 20919 - DNA, 1545 bp, Triticum aestivum
  Clone ID: PAT_TA_20919
catgccatggacgcgccacaccaaccagacggaacacgttaaatcgccctcccgggcaccgccccatccgcacgccacccgatcttcaaagaaaaacgtactagcatcgaagcagagatgctcctggctcgcgcctccccggccttcctgccctccacctcctcctcccctaccccatcgtcgcagacgctaccgccgtctgcgtccttcgggaggagccagcgcaccggtggcagcctaaccgtggcatcgccgaactgcaccgttagacggcccgtgatggcgggtgcggcagcggcagtcccggcggcaaagctggaggacgcagaggcgcttatcgactctgtcgagacgttcatattcgactgcgatggggtgatttggaagggcgacaagctgatcgacggcgtgccggaagacactcgacctgctcagatcaaagggcaagaggctggtcttcgtgaccaacaattcgacgaagtcgaggaagcaatacgggaagaagtttgagacgctcgggctcagtgtcaacgaggaagagatatttgcttcgtccttcgcagctgctgcgtaccggcagtccatcgatttccctaaagacaagaaggtttacgtgattggaaaggaagggattctcaaggggctggagctggctggctttcagtcccttggtggaccgacagtcgctggcaagtagagttaacgcctgcctgccacatggagcgtgacaaacatgttggagcagtggtagtgggatttgatcgctattttaactactacaaagttcagtacgggacactctgcatacgtgagaatcctgggtgccttttcattgcaacaaacagggatgctgtcacccatctcaccgaatgctgcccagtggtgggcaggtggcgggtcaatggtcggcgctgttcttggttcaaccaaacaagaaccgcttgtcgtcgggaagccgtcaacattcatgatggactacctggcaaagaagtttggaatcacaacatctcagatatgcatggtaggtgaccgtttggatactgacgttctatttgggcaaaatggaggctgcaaaactcttctggttctttcaggtgtgacttctgagcagatgcttcaaagccccgacaacaaaatccagccagatttctacacaaaccaaatttctgattttctcacccttaaaacagcagcagtatgaacagaaatgtgaacggactgttttacctggggaggcccatcacttttgtatagcaacgaagagatcacagggatggttttctttttcacatcgatttgtaatcgtgagacagatgtttaaatgcaagtatgtatatcattaaatgcatatcaatttgatgctgctgcctacttttccttggctcaagattaacacacagaagatctatgccaaaatatgcctggttaatctcgaaatgtgagcctatagaaggcaaatatgatcccagaaggaaaaataagttgcatcaacaaaaaaaaagggggggcccggtacccaattcgccctatagtgggtcgtattac

SEQ ID NO: 20920 - DNA, 407 bp, Triticum aestivum
  Clone ID: PAT_TA_20920
agatgccatacgccttgtctacactatttttgcgagagggaagagcgatgtgcttgccggtattattactggttaaatggcttgctgcaggagggaagagcgatgaactagccgggtgttgttactgccactggagaggcgcgaagttttggtgattcagcgtcagccttatcagttaaatgcccccttcgatttgttaagtatgcctcccatctgtgatgtcagtcttcctaagatatagggtatatcaatcatatattcggttgtaactcctactttccagttgattggcgataggtccgttttttcctttgtaaaagtggccgtgttactgtattatgcattcacagcatatgtttcggacatccttaagtttgattatattctcctgtaacaaaaaggggggg

SEQ ID NO: 20921 - DNA, 572 bp, Triticum aestivum
  unsure (1)..(572): unsure at all n locations
  Clone ID: PAT_TA_20921
ttgcactgttgttaattggaatatctgttaatcagctgaaatcactgcctgaaggttctactgcacttggtcttcctgttgcagctggggcctacctatacacactattttttataacagttcctgcattggcttcagtttacaatgaaaaggctctgaaaagccagttcgataccagcatatatcttcagaacttatttctgtatggatatggcgcaatatttaatttccttgggcttgtgatcactgccctcgtccaagggcctcgtagctttcacattctggaagggcattcaaaggccaccatgtttcttatttgcaacaatgctgcacaaggcatactttcgtcatttttcttcaaatatgcagatacaattttgaagaagtactcatccacaatcgccacaatctttactggggtagcgtctgctatactgttcggtcagactcctgactaataaattttgttcttgggaatatcggtaagtaatttatcatcgctgcagcacgcgccctccgcaaaacaaaatttaagggtnaaagttgccaangcagcaaaatccgagatgtcn

SEQ ID NO: 20922 - DNA, 663 bp, Triticum aestivum
  unsure (1)..(663): unsure at all n locations
  Clone ID: PAT_TA_20922
ctcgtgccccccgacttcacagcgtatcatcgttttccatcgctcctactcctatcatccagaaaatctgagcggtattgatggcgcccaaggcggagaagaagccggcggcgaagaaggtggcggacgaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctccccccggtacaacaagaagcccacaatcacttccggcgaagatacacaccttccgctcgcttcctccggcccgcgcaactcacccgctcggaggtccaaagcgtaacaatccaccctcctacccctgttgtagctcttctggcggtccaataaaaattattccctccacgatagggggttgcggggtttaggttatggtttcggttaactactggggagtctcgggttgnttcttggtntnaaaaaaaaaaaa

SEQ ID NO: 20923 - DNA, 650 bp, Triticum aestivum
  Clone ID: PAT_TA_20923
caagagcagcactgaagcaccacttcctgcactcactgtgctagctgctcaaaccgtagtagtaacagtccatcaccaccaatggctcccaaggttgcgctcttccttgccctgagcctcctgtttgctgccaccgcgcatggctgcgaacccaactgttctggcccagtcgtcccaacgccgccagtcgtgccgactccgtcgtcgcacagccacgggcgctgcccgatacgacgcgctcaagctcaaggtgtgcgccaacgtgctaggcctcgtcaaggtcggcctaccccagttacgagcaatgctgcccgttgctggcagggtctggtggcacctcgacgccgcattgtgcctctgcaccgccatcaaggccaacgtcctcggcatccacctcaacgtgccccttagcctcaactcatcctcaacaactgcggcaggatttgcccagaggacttcacttgcccaaactaagcttgggatccttgtgtgctcatctcgcgatcttttacaacattcggctcttgcaatattacgaataattgccttcaaatcttcctgtaaacacaaggtttgggttggtaagttaatttaagtttaaaaaaatatgtttttttaaaaaaaaaaaaaagcggccgttccgaggtttt

SEQ ID NO: 20924 - DNA, 359 bp, Triticum aestivum
  unsure (1)..(359): unsure at all n locations
  Clone ID: PAT_TA_20924
gccagcccaaaaccactctccatagaaccccatttcagctccagctcgaaggaggacgactcctccagcctcgagaccattgtgaagtgcaaggaagccgaggcaaaactgttccagaaactggccaatgatgcccggaaggaagtagacagctaccggcagatcgtgcgcgccaagacccataaactggaggaggagtacgccgcgaaggtcgcgaagctgtgcttccaggagacggaggagaagaggaggaagaaagtcgaagagctgaaggtgtcccaangggggggcccggtacccaatttcgccctatatggaccctttaccacntcactggcncctttttacacntcctgact

SEQ ID NO: 20925 - DNA, 697 bp, Triticum aestivum
  unsure (1)..(697): unsure at all n locations
  Clone ID: PAT_TA_20925
cgccgtctgccttctgcgcctccatttcggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaagctgactgtgctgtccttatcattgactccaccactggtggttttgaggctggtatctccaaggatggcaaacccgtgaacatgctctccttgcgttcacccttggagtgaagcagatgattgctgctgcaacaagatggctcaacaatccgaaatacccaaggacttatgataaatctgaggatccactacccaagaaattggtaaacctataaatgccttgtcattcggtttgggggcatattagtcacagccaccgcttggcgtccgcgcacctctannnctacaatacnaccagngctanaaa

SEQ ID NO: 20926 - DNA, 636 bp, Triticum aestivum
  unsure (1)..(636): unsure at all n locations
  Clone ID: PAT_TA_20926
ttttttttaagcgctagaatataaattatcatgttcatcacacgcagaaccaaacacttcagaatttataccataacaggcaagttcaaaacttaaccgccacagatgcaaccaaagatctaaaagaagtttagcatagtaggacaacaactacgaatagcagtgcgatcaagaggcaaccaccgcgaagtctaaacgcggtcacggcgggggaccaccgttactgcgggcggccgttangcgggggcgtttggaacctccacctgggcgctcaacgcccgggcaagtccgccatnccccgaggcagcganatctcccaggcncccttttccacgcggtttccttccacctnccacgcgcttttcccggacgaatcccatgcgggtcgcgtcctcctcctggaactttagcnaatccncgactgggcgcgctggagcgncacaagngggtacngaccacactnttccgagcttcaaggaaaccaacccccanactcttttgggtggatcagggatcggatatanccntacnccgaggctctaggctgngcgaccancagtgctcgngggccgacaaggggccgtccattccaaagntnttaccccnngctttttanncggngaacngtncatnacc

SEQ ID NO: 20927 - DNA, 626 bp, Triticum aestivum
  unsure (1)..(626): unsure at all n locations
  Clone ID: PAT_TA_20927
gttccgttccgtcgcagaaatagaaaaaaggctttcttgtcccacagggcagggagaccgagagagcagtctagtgattagttgatcaccagacgtccagacaccatgagctcccgcatggctggagcagcgcttctgcgccacctaggcccgcgcctgttcgcggccgggcctgcggtgtccgggctcaccgcgaggggcggcatgcccgcggccgcgaggcttctccccgcgcggatggccagcaccgccgcggaggctgccagagaggacgccggtgcaaataaacggcacggcggcaccgagaacatgaggaggangcagcatgcgggcagagcaagaagcccgtttcactactggggcatcgacaccccaactccgttaaggaaactgcacggagtgaagtgacacctccggcctgggccccccacctccgcacgtcatccaccggaggcacacgccccccacgcctccccaggagcggctgcccgcagccgccctcncttcccanggctctctcaacgccggaacaacaacccngtgncaaacgtnnggcttccggatgtggcgatccncactggncntcgcgntcacaaaggggtggttcccctncagagcaaanacca

SEQ ID NO: 20928 - DNA, 728 bp, Triticum aestivum
  Clone ID: PAT_TA_20928
ctttcgcgtccgcctcagcccgccgcaaggagaggtaagttcaggagacatcttcgagaagctgaaatggctcctaaagctgctcctgccaagaagggtgatgccaagacccaggccttgaggcttgccgccgctgtggagtcggggccagccgagaagaagaccaagaaggtccccacgtctgtgacattgcaccgccccccgacgctttaagagggctagggaccccgagtaccgacgaatgagcactaccggaaggaacaagtttcttcagtaacaattccccaagccaaccccttgaccacgccaagcacccgatgatgaagattggaaaggcaataacacccgggcctacattattagaccccaaggcaatacaaacaacacgttacatgttgcccgccaagaagattgaagacatccaaagcccagaagtcaacactgagcttcaggactggaaggacaagatgaaggttacttttactaaacccccaccatgaacgcttggtggggcaaaacaatcgaaacacccgttggaacataacccacttaccccaaaacaataagttaccaaatttacaagataggcatcagcaaaaccaggcaccttcctaaattgactcacagttattcaactgcctgcacttcccagtcaaaaccttgacacttctagcggcgcctcggtggctccatggtcctggccttatgcacacttacgaatttgatat

SEQ ID NO: 20929 - DNA, 661 bp, Triticum aestivum
  unsure (1)..(661): unsure at all n locations
  Clone ID: PAT_TA_20929
gaaaagacgacatcatatataccgtacgttatagagtaggaaaatagaaatacgaatgatgatcacgggagggcagcgaaaccctgcaaggctgcaggtgtcgtcgtccttcctgcttgcccttgttttcgcatcatcggtgcttgtcggcatcgtggccggcggcagcttctacgaggagtgcgacgcgacttgggagccccagaactgctgggcctacgacgatggcaacaggctctccctcgcgctcgtcagcagttcctcaggttccatgatccggtcgaagcggcagttcgtgtacgggaccgtgtccaccatgatccagcttgtccccggcgactccgccggcaccgtcaccacctactatacgtcgtcgctgggcgacaaccacgacgagatcgacttcgagtcctgggcaacgtgagcgggcagccctacacatccacaccaacgtgtacgcgccggcgtggcccacgaggtctgcatgcatgctggcctcgccccacgcggctacactctgcactcctctgcgtgccggcaggggcctgcgctctccgtccaggcgcctggcccgtccgccggcagcacggggggntccanaacaccattagctancaaatcggcgcgaganggcaanaggggccgtaaggcncggcaaggg

SEQ ID NO: 20930 - DNA, 586 bp, Triticum aestivum
  unsure (1)..(586): unsure at all n locations
  Clone ID: PAT_TA_20930
ctgatgatctctaccctgggcctggtgcaggcttctaccctcacagtggcattgggagcggtggcagcatgcatgttggtcctaatgatccgcgcttctttccttctaatcccttctctgccccatttggtgggcttgggagtgttccaccaggtagtcgctatgatccaattggcccacctgacgtcccagggtttgagccatctagctttgttaggcgtccaaggcggcctccaggcgggagcacccaccccgacctcgagttcttccagcaaggcccagacttctgagagtcgcgcagaggccggccggagcctcgccctaccctcacgaaataacttcaaaatgctgagccctcgagctagattctcgcttggtgtgattgcaactgctgtatcaagtatagtcctagtgcgctttggctgtaaagatggatgtgaacatcgtcctgtggttactccccttcatccatcctcgctggctaacctagaaaganggaaanaannctcagggggccngngccattgnctnagtggcgatanggnnatgcgcnttaaagtgtanggaaacngggtccactangctn

SEQ ID NO: 20931 - DNA, 883 bp, Triticum aestivum
  unsure (1)..(883): unsure at all n locations
  Clone ID: PAT_TA_20931
cccagcctagagccgaattgaaggccgctctagcccagcctagagccgaattcaccgaccagcctagagccgaattcaccgatcagcctagagccaaattcaccgatcagcctagagccgaattcaccgatcagcctagagccgaattcaccgatcagctagagccgaattcaccgatcagcctagagccgaatacaccgatcagcctagagccgaattcaccgatcagcctagagccgaattcaccgattagctagagccgaatcaccgatcagcctagagccgaattcaccgatcagcctagagccgaattcacccagcctagagccgaattcaccgatcagtctagagccgaattcaccgatcagcctagagccgaattcaccgagcagcctagagccgaattcaccgatcaagatagactgttaaactgggagatcaagaacttgaagcctcgtgaggttccctatggtaagctgggattctacctgacagagtgttatagccaagctcaagtatctcgagggcgatgaagccttcctatatcatccggggagtgaccctgtgaggccggtgttggtgaggttgaggatagagaggaaagagaggttacagagttgagggctgactccctacaaaggatgtccgcaaatcgaggaatgaccacgctgggggggggaaaaatacgaggggaacgaggggtgaccgattagaagggtgacctccctaccaaagggtgtccgcaatcaaggaatgccatgcggggggtgaaaaaacagggggttccggtgagaatttaacatttaaacgtcccccagggggccacttccaagggcttacgccnggcntgttanncgagggaaccggtncattancgnaaaan

SEQ ID NO: 20932 - DNA, 605 bp, Triticum aestivum
  unsure (1)..(605): unsure at all n locations
  Clone ID: PAT_TA_20932
ttagggattcccacacgagcaccaagccgaggggaggggcgatggcgagaggtgtggtgtcagcgaagggcggcacggccgcgggcaagaagaaggggtcggtcgccttcacgatcgactgcaccaagcccgtggaggacaagatcatggagatcgcctcgctcgagaagttcctgcaggagcgcatcaaggtcgccggcggcaaggccggcaacctcggcgaatccgtcatcatctcccgcgagaagaccaaggtcaccgtcacctgcgacgggcccttctccaagaggtatctgaagtacttgaccaagaagtacttgaagaagcacaaggtgcgagattggctccgtgtgattgcagccaacaaggaccacagcgtctatgagctgcggtacttcaacattgctgagaacgagggcgaggaagaagattagactgcattgcacttatatctcagttttgaactcattgaatttgatacttgtacccgtagttttgcaaatgcccccatgttatgctctggtgaattttggttggtttttttgtttgctagatcggtgccctatttaaaaaattataaagtctaaggaaaantaattaaaaac

SEQ ID NO: 20933 - DNA, 883 bp, Triticum aestivum
  Clone ID: PAT_TA_20933
gcaagaagaatggcaaccaaagcagccttcatggctgtggtcttgctcgtccttgtggtcggcgatctcgcccatggccacgccgtgccacccctcgggcgcggccggcggaaaggagggccgcctagtggagtgcaatcatcagacactgcttctactgcccgccaaggcgccatttcttgggtggataaaggtagagggctctgcgccattgcgttgatagttttctggtggtacgacaaaaagggtcacagaaagagaagcagacagaggagagcaaacagaaccgccgcatcatctttggcgtggaggaaggcaagttcgtcgcgcctgtgccgggattcaagctcccgccccttcccccgaacgctgcctgagaagaagacatcacacttcacaccacagggcgagcatgcatgcatgccgtggcattgaccatcactaggtctgtcagcaaaggtgccggagcgttcaacgatgctttatatatattgttcgttcaataagtaaggcagcatcgatctgctagtatgatgccgtctatgttcagtaattgtaaggcagcatcggctgtatcatctttggcgaggaaagcagccgggaggaaggcaagttcatcgcgcctgcaccgggattcaagctcccgccccttcccccgaacgctccctgataagagatcacatcacagggcgagcatgcatgcatgccatggcatcgaccatcactaggtctgtcagcaaaggtgcccgtagtgttcaacgatgctttatatatattgttcagcatcgatctgctagtatgatgccgtctatgttcagtaattgtaaggcagcatcggctgtaatggaataaaaacagtgaacactctgcttgaaaaaaaaaa

SEQ ID NO: 20934 - DNA, 594 bp, Triticum aestivum
  unsure (1)..(594): unsure at all n locations
  Clone ID: PAT_TA_20934
gtcatatctagctagtagctccctgaaaagttcactagagaagcatttgagggaggagccatgtctgaggagaagcaccaccaccacctgttccaccaccgcaaggcagaggaggaggaaggcgcctccggcgaggtcgactacgagaagaaggagaagcaccacaagcacatggagcagctcggccagctcggcgccatcgccgccggcgcgtacgctctgcacgagaagcacaaggccaagaaggacccggagaacgagcacggccaccgggtcaaggaggaggtggccgccgtcgccgccgtgggctccgccgggttcgccttccacgagcatcacgagaagaaggacgccaagaagcacgcccacaactgatccgtcgcaagctgcctcagccgaagcaacagcacatcgtcgcggttgctgtttcatctgttctcccagcctcgtcttcctctactgtgtgccgggcaagccttgatttgaggctttgagctaccgatatttgcacggacgtaggaacggtgttggccttcggcgttcttgtacaagttaatcaagcctcataatgttgtgttnanaaaccttttttaa

SEQ ID NO: 20935 - DNA, 598 bp, Triticum aestivum
  unsure (1)..(598): unsure at all n locations
  Clone ID: PAT_TA_20935
gttccaaccaattaaccaccagcatcagcagcgcgcagcttcacttgatccagccgccgccaccatatcatcgatcgcacgcacgcacgtactatacgttcaacggataacaacaagctagctgagaacatggacagcaataagcggctgggcctgggcgtgcagcacgggcaccacagccacaacggcaccatcgccaagccgccgccggcgcaaccaccaccaccacgcacggaggaagcaggggaggcagaacggcggcggcggcggcaaggggatcaaggtggtgtacatctccagccccatgaagctcaccgccagcgccgaggagttccgcgccgtcgtgcaggagctcaccggccgcgactccaacgtcgccgaccacgaacctcgacctcgancgacggcgcctgttacagctactcctccttcaaacgcgtcgnctccccgaangggacccgacagnacggcgcccggcggcggngctgcggngggacccgcctcntcccgacacacacaacgccggcggtcnanacaacnccgatatatgcgcccctggcgaccgcncgcgcgttcaggngtttcatacaaacacaca

SEQ ID NO: 20936 - DNA, 889 bp, Triticum aestivum
  unsure (1)..(889): unsure at all n locations
  Clone ID: PAT_TA_20936
cggacgcgtgggcggacgcgtgggcagcgccgtgctctccgaatctctcgcgctcccggaggccggagcacgcaggagatcgaattcgccgcgccggctcgccggagacgacagacccccacagagtggtggtgcgtataatgaacaaaggcagcatccacaaaaaggagacgcacggaacaagcgacgacataagcgagaacacgcctgtggagaaggtcaggggccccaatctgtttgaacggaccaaggaagagatcgaggctcttgtggcggctgttcacgataagatggagcaccattccagtccccgcgggaaggagggtgaattgcacaaggattccaaggaacacagcaaggcagacatgcataagaagacccacgagaacgaaactcatggtacaagcaatgatataagtgaggacacgccggtcagcaaagtcaaaggcccgggcgtgtttgaacgtgccaaggaagagatcgaagctatcgttgaggccatccatccgaagaaagaatccgacaagtgaagatcgaccgcatcgtgtacattgtgtcttcagtattttcagtggctgtgaaaactatgtgggctatgtccaggtggatgcattatttgcatcatatccacttgcaatctttgtattttgcattgccaaactctatcgctgcaagagctgaatgctccatcgtatcgccgccgcttacgttgagcagaagatgtataaaatgtgacatgactgtacaactactttgttgtgtttgaattgccaagaagctgtatgcaatttatcagttagaactgctaagaacttgtgcgcaacacataacaaaaaaaaaaaaaaaactcgacntgcccgggcggccgctcgaaatcattagtgaattc

SEQ ID NO: 20937 - DNA, 631 bp, Triticum aestivum
  unsure (1)..(631): unsure at all n locations
  Clone ID: PAT_TA_20937
cccagctgcccaggtcttcgtcgggcccctcgccggcgacgagcactcaacacactcaccaggatggcgctgaggggggtctggcagctccagaagctcgtggtaaactactgcgactggggaagggagcagcaggggcatcagagccttcatggaggcacatcttccagcctttaaggaaaagattccacacttagaagtggtgacagagcttgtccgcggtcaacatcctaacttgaagggaatttacaagaaccataacgagcgagtggtctgcgtgnagaaatttaccgccaagaagaaatactcctgcaagccaccaggctaaggaactctctgggcaggaaagtggtgaagctgcggaccagacacgtaacgaagcggcccagtgtccaggggacgtggacgacggagctgaagttgtgacgcctacctcgcggtctcggtgctgcggggttctccgtggtgtcatcgctgcgatatgtcggctgtgcccattacccccctagacggctcccgctatgccagcctatttcgatagccaaactatttacaccttttgttccgactaaaggctgcctcgagcagtattcngtaaanggtccgtanccttgactctaaaanaaaaaaa

SEQ ID NO: 20938 - DNA, 802 bp, Triticum aestivum
  unsure (1)..(802): unsure at all n locations
  Clone ID: PAT_TA_20938
caaggccccaactacccccagtctcggaagggaaccttccagaagcgcaagactccaaaggccgtcgccttcccatccatcccttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgacagccagatcccactggactgggccaaactcaatcattggcagagctgttgttgttcacgctgatcctgatgatcttgggaaagggtgggcacgagctcagcaagagccctggaaacgccggtggccgtgttccttgtggggatcattnggacntccaaggctgaaaacgatttcccccttcggggggcggaccgtccgtctcccgccgtcccancanacaacctgaacattccgagantcgtgaataagncgtcctgatcgtgatnacntattgtcatatcacctgtanaacgatggctgaattgccggatatcngttggtnactatagtgtanagtcggtttgagtaaccaacttcaagtgttttgaantgttcaaattca

SEQ ID NO: 20939 - DNA, 1339 bp, Triticum aestivum
  Clone ID: PAT_TA_20939
tacattctgaatcttttaccatggttaactgtgagccaggttttactggcattcgtgagtaatatatttgatatttatcgtattcaacatcttccgagccccgccgaggcgcgcacgagggacagccttcgcccactatagaaggcccgcgcacaccggctccactccccccgcttcccccacatttgacccctttcccccccgattcgcgtcacccccctttctccccgcgtccgggaggggccggtgcctgcgcccgggctgcggcacctgagcggcgtcatcgcccaccccacggacggaccgccggccgacggcggcggcctgagccagaattgtgagtttagtggtgattatggctgctctctgggtaaaagggcttccatggaagacttttatgagacaagaatttaaagtgttagatggacagcttattggtttattcggagtttttgatggtcatggtgttgcaaaagtagctgagtatgtcaaacacaaccttcttcagccatcttcttaggcatccaaagttcatgagtgacacaaaaagtggctatagatgattcttataaaagtaccagacagtgagttcttggaatctgacagtactcaaaaccagtgtgggtcaacagcatcaactgctgtacttgttggggatcgtctcttggtcgcaaatgttggagactccagggcgtacatgttcaggacaagaaatgctctacctgtaccgaaggatggcaagcctgttcagacagatgagcggcaccgtattgaagaagctggaggtttcgttatgtgggcaggcaagtggcctgtcggtggggtacttgctgtttctcgcgcttttggtgacaagctcttgaagcactatgtagttgtggatccggagatccgggaggaaatcgttgacgactccctggagttcctcatccttgcaagcgatgggctgtgggatgttgtctctaacgaggaagctgtcgtcatgacccgctccatgcaggacccggacggtgctgccacgcggccctgcctggaggccttcttgcgggtgagccgcggcgacactgcctgcggcgtcgggcgcctcttgctaggacaacggagttgtgggcccgctgtgtgcccgtggcctgagtttttcccatcttctcgcggggtggtggtccgatgacccgttcatccgtggtttagttcgtggatggtgttgggtctgatgagtgtgttgtatcttgttgtggattgccaaaccatgtgtgagtgtgatgtaagcgattattgccgctctgaggttggccattgtcgtggttctgtgagttgggggggcgatcttaaaaaaaaa

SEQ ID NO: 20940 - DNA, 967 bp, Triticum aestivum
  unsure (1)..(967): unsure at all n locations
  Clone ID: PAT_TA_20940
tgaggctgttgatctttacaacaagcattacaagcgcgacgacacccgcatagggcttgcgtttgacgtaatgggtcgtgtgccatacggaacatcgtttctggataaacaggccgaagaaaggtcatgggacatcaacctaggatggttcttagagccagtggttcgtggtgactaccccttctccatgagatcattggctagggaacgactacccttcttcaaggacgagcagaaggagaagctcgccggttcctataacatgttggggttaaactactacacctcacggttctccaaaaacatcgacatctcaccaaactactcacctgtgctcaacactgacgacgcctacgccagtcaagaagttaacgggcctgacgggaagcccattggtcctcctatgggaaatccatggatctacatgtaccctgagggcttgaaggatctccttatgataatgaagaacaaatacggaaacccacctatctacatcaccgagaacggaatcggggatgttgataccaaagagacacctctacccatggaggctgccttaaatgactacaaaaggctagattacatccagcgccacatcgctactcttaaggaatcaatagacttgggatcaaatgtgcaaggctacttcgcttggtctctgctggacaactttgaatggttgccggcttcaccgaacgttatggcattgtctacgtcgaccgcaacaataactgcacgcgctacatgaaggatctgccaagtgggtgaaagagtcaacaccgcgaaaaagcccancaatgaagatcttacccagcttaaaaatcggggcccatatgtgggtgcacccataaaacgttggtttggaccaanattcctttttttcncacaaaagtcccggaggatatcncacacgnggtataccgtgtcaatcatcggcttgtatcagaanaaaatgaggttcccgttn

SEQ ID NO: 20941 - DNA, 481 bp, Triticum aestivum
  Clone ID: PAT_TA_20941
tattggcatggctgactgtagagataatgacgacacatgaattttactggttgaatagttcctttttgaagataaagatggtgccttcaatatagaactagaagcaacggtggcattttcctcctaattttgattcagcagaaatgaagtgataattatgagatcatcgagacatccatgcctgggcatactgcttacgacaccatcgacaccgagttaactgttcatgaatttccgaagcttgttttatcccccgtctggggcgagttttggttagtctgtaacacactgggaaactctcctaacttaattgcaatcccttgtgctcctcaacttgactggagctgtgacatttgctgacagcccccaaaaaaaaacccggcaaaagggtctggtgatacctgtacttatttcccacggcgactttgcataaaccaatgcctaatgaatgttataccgccgttcccttaaaaaaaaaaaa

SEQ ID NO: 20942 - DNA, 571 bp, Triticum aestivum
  unsure (1)..(571): unsure at all n locations
  Clone ID: PAT_TA_20942
ctctcatcctctctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgagggcgaagcctagccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccggccgccgccaagccgaaggcccaagtncaaanaccgctgtgaagaaagcccaaggncggtgcnaagaaggnccaaggncgccancaaggcccaagncgaagncnaagggcgaaattcccccgncaagggga

SEQ ID NO: 20943 - DNA, 645 bp, Triticum aestivum
  unsure (1)..(645): unsure at all n locations
  Clone ID: PAT_TA_20943
ggcaatttcagcctcagctgaaggtcactgtctctcttccatctttttctctctcaacaaaactccctgaattgcaaactccaccaaaacaaactccaagcccatccatcaccagtcctctgtcccctccccgaccgcaacgatctgctttgcatcttcccctccctccaattccagtcccatgcgtaatcgtctttcggaattgaatctctccatgtcatggcgctctgagcaagtacangctgcagccagtgagaagaaatgtaggcaccacaaatcagtccagccaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgttcgcattgcttcaaccaaagatccatccaaactctgaccccagaantagtacgttcggggggnatgaanggctnatnttcaagaganagcggngcgcaatgtgcggccggaacgcttanggcggtgtgctggcagtaaagaaggatgtgtgtcantactgtacgcgcagcaggntcggagcgcgcnngact

SEQ ID NO: 20944 - DNA, 595 bp, Triticum aestivum
  unsure (1)..(595): unsure at all n locations
  Clone ID: PAT_TA_20944
accgggcacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgccaacatctccggcgggcacgtgaacccggccgtgaccttcggcgccttcctgggcggcaacatcacctgttccgagggctcctgtactgggtggcgcanctgctggggtcaacctggctgctcctgctccctctcgacggcgggaagcacggcacttcgggctgacggctgtcgtgtggaggcctggtgctggagatgtatactcggctgggtcacgtgtcccccccgggaccgaaagggactggacatccccatgcatngttcannggggca

SEQ ID NO: 20945 - DNA, 559 bp, Triticum aestivum
  unsure (1)..(559): unsure at all n locations
  Clone ID: PAT_TA_20945
cgcggcccgcagccacggccttccgtaatgtcataactccccttctcgagtccatctccaacctcatccctcccaccccaataatacatccagccggcgccatcaggcccggcaacgcgcaagcggcgctgaccatcgaaccctagtccccggccgagccgccctccgccgagccttgcggccgctctgcgtcatccctcttagtctccctccgttcgacacggcttggatccgagatggaatcaccgcccctcacagctgaagcaattgcttatacagagaaaaagatggacatggctttggaggatataattaaaatgtcaaagaaaaagaatcctggaggcaagaaacccccgaggcagccgataaaaaagcatccattccaagaatggcaactctaataaagggaatggcaaggtcaaagttttatggagcctggatcattcactggtcttgtctgcgtgcacagtggtgacaagctccggcgcaatcgctccctgcgtcttagccgntgcgaggggcggcgttgacagcagtnagtacttntnaaagagcttag

SEQ ID NO: 20946 - DNA, 650 bp, Triticum aestivum
  unsure (1)..(650): unsure at all n locations
  Clone ID: PAT_TA_20946
gggagatgatttcatgtttcaattatttggaaagtacagagacatggccttggctgtgaaaaatccatgccatctcaatatggctgcatgcctgatcaaactaaagagattcgatgaagctattgcgcagtgtagcattgttttgacagaagatgaaagtaatgtcaaagcgctgttcaaggcgaggaaaagctaaatctgaacttggccagacagaatcagcgagggaagatttcctcaaagcgaagaagtactccccagaagacaaggagatcattcgggagctccgtttgctcgcggaacaagacaaggcactataccagaagcagaaggagctctacaaaggtctctttgggccaagtcctgaagcgaaaccgaagaaggaaagtactcgttgtgttttggcaatgctggtgcatttacccttcatctggctggggtcaacggaccacgagtagattttcccagaaacttgagactgggcgatcggcccgctgattggcgatgttgtgatacgtagctggcgcgccccgagcataccgcgtgcgcgtattatgtgaacacacatctcgtgtcaccttcagcangggcccgacctctcccaagggcccgcacctccccgccgaacccgagccccctgctctttatnc

SEQ ID NO: 20947 - DNA, 547 bp, Triticum aestivum
  Clone ID: PAT_TA_20947
acgcttcaaggctgagtaccccatcttcgacaaggttgatgtcaacggtagcaatgctgcgcccatctacaagttcttgaaatctagcaaaggtggccttttcggcgacagcatcaagtggaacttttccaagttcttggttgacaaggagggacgtgttgtggatcgctatgctccaaccacttcacccctgagcattgagaaggatatcaagaagctgcttgggagctcttaatcagtatctgggtgcaaagctgtagaaaaacatgtatcaacaatgccctgagcgataaaatatatgataagttgtattaataaagtattgtcgtacttgagaggttgcagtatctgctctatttcccttgcatacactccgtacttgtatatccccttcggagctgatttggtgacccgggatcccaggaggatcggaggggattgagaaggaaattagttgatttcccccttaatccccttcaatcctcccgggatccccttgtcaccaaatcagccctcgaatgaattccaatgctgtaaaaaaaaaaaa

SEQ ID NO: 20948 - DNA, 409 bp, Triticum aestivum
  unsure (1)..(409): unsure at all n locations
  Clone ID: PAT_TA_20948
tgactacgtggtgcccaagggctcagcgatcaacttcatgctgtacgacctgggcatggacgacgccacgtgggaccgcccagcagtgttcatgccggagaggttcctgcccggcggggaagccgaggcgctggacatcaccggcaccaaggagatgaagatgataccgtttggggcgggcagaaggatctgcccgggcctcaggatcgctctcctgctcctcgagtacttcgtcgccaacctcgtagcgaccttccactggaaanaggtggaagagggcgacgtcgatgtcaccaccgaggacgctcagctcaccgtnctcatggggaaccggtccggggctgcttgttccaagaatgnattcgctgctaatttttttcacaaccagggggttgttncantgtgcacg

SEQ ID NO: 20949 - DNA, 553 bp, Triticum aestivum
  unsure (1)..(553): unsure at all n locations
  Clone ID: PAT_TA_20949
gcgctcgtgggccagcccacctcgctcgcccccttcagcgagtcggaagtgagactcgctgaaggcgagatataagggcgcccggcccgccccgtatgcccatgctgtcatgggcatatggggtgggctgggctggcccaggctgccaggtctatgggcaccgtgtaaggcccgtgtcctcgtacgtcctgacgtcccccttcctcgccaactgaaacccttggtgccgaactgctccatgtctcagtacatccggcgtagacggctatctcccccaacgcaacctttcccacgaccttccggctcttcctccgcaccgccttcatcaccctagagctgcacactacacgtcgcgtcacggcggtgcaggccgtggcgtacaggggaaaggggcagcgagcccggggcgaaccgctgcagggtttagcccatgaggaagtcgagaattcgttccttaagcgcgtggcccctggagcaggagaaaagacagagtttttgggcagttaaaaagggtccgagtcggcttcccgcagttgaagccccttttttatnn

SEQ ID NO: 20950 - DNA, 576 bp, Triticum aestivum
  unsure (1)..(576): unsure at all n locations
  Clone ID: PAT_TA_20950
cgaaaaccctaatggcgtcccgcctccttcacctccgccgcctcattactcctccctccaccgtccccgccgcttccttctccaccgccgtcagcgcgaccccgcgcgtctccgcgctcgtcgacgagatctgcgggctcaccctcctcgaggcctcttccctggccgatgccctgcgcggccgcctcggcgtcgaccagttgccgccactagctatcctcacgggcggcggcgcaccgctcgtcggcggcggagtaggtcccggcgcggccggcgaggaggcgaaggccaaggaggagaagatggcgttcgacgtgaagctggaggggttcgacgccgcggcgaaactcaagatcatcaaggagctgaaggcgttcacgaatctgggtctgaaggaggcaaggatntcgtggagaagcgcccgccgtgctgaaggctggagttccaaagaggaggcgngagatatcccgagaaaatccggcgcccgcgcaagattgtctccantgaacacaaactgtgatcccccttctnattgttcgggttctgttaaaaaagaaaatttggaaagggtataat

SEQ ID NO: 20951 - DNA, 700 bp, Triticum aestivum
  unsure (1)..(700): unsure at all n locations
  Clone ID: PAT_TA_20951
ggaggacagcacgcgccgtcgcgccggagccgcccaggtctcctgtgtctctccccttccccccttgctcctctctctctctctctctctctctctctctctctctctctctctctctcggagctcttatcatctcaccgccgtccttcgtttacaggagcaaccatggatgctccgcgttcaaggtgtacaaggccgatttggagtggttccctcgcaagcccctgctattccccacctctcgcggcgttctgcatctagattgttttcttcggtggcaggaaggtttccaaggaggtacagatagcgaggttcaaacaattcagtgcagcagcagcaacacctccaaggctggccggggcctggcggtgcgccgccgctgtcgcacccttgccgggggcgtccggggaccgcggcgtggtggcttccctgcagtctgtgtgccgcctgtgtccccatctgaaaccgctcacgagctggtgcccttctcggtagttcgtccggtgcggcattctgtgtgcctcgatgcctgggtcgccatgccctgttcgttggtcggtgtaccaattgtgggtgctatcctagattgattcttattgggcagggatgtgattcgttctccggtgcangcacgggccctttgcatcttcctaattatataagcacggatgacttgtcggtcaccgtcaaaaaaaaaaaa

SEQ ID NO: 20952 - DNA, 523 bp, Triticum aestivum
  Clone ID: PAT_TA_20952
gttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgctgctgctgctagttctgcttggagggcatgggcgtccatcatcgtggagatgtggccatgcgggacacccaccgccgaataaaatgctgtacttatatgcacgcacgttagaaatgcattagtgtctgtttgatgtgatcttttgtgtgtgtgtgcccgcatcttcatttgcactggaaaatgctttataattgtgaaggtctgtaaatctgttgtatgtacttggcagatgacctctattattgtgccataaaaaacgcttgattggacaaatcctttcgaagttt

SEQ ID NO: 20953 - DNA, 741 bp, Triticum aestivum
  unsure (1)..(741): unsure at all n locations
  Clone ID: PAT_TA_20953
ccgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttgggagccaagagaaagcggatgagttcaaaaagggtgtcgaagggtgcaaccaatttctccttaacaagctgaaggactccaatttttgttggtgatccatgaaggatgatcctctgtggtatcgcctattacaaggatggtgcactaatccgacatcctcaattcgccaaggtctaaggaataatgcaagcgtcgggaaatactaccatgttggtacatcatgtcatatacatcaaacatattgactgctaattaccaaagggttgtgaaaattttccaggtgttgctttagccaatgtatgagtttctaaaaaaaaacccgggggcggcaatcccaaggtttacccccggcgtttancnagaaccggtccann

SEQ ID NO: 20954 - DNA, 868 bp, Triticum aestivum
  Clone ID: PAT_TA_20954
tggtataggacggagctgagcttctagcaacgtacagtgtatccgccatgagtcctttcggggcggtgatcacgccagaaaccctcaagtacatgtccaagtaccagggacgtgagatcacgcaggtggactgcgcacgggaggcgatgaggctgatccacgcggaagacaagaacctcaaggccgaggactcagcgtgggagctgaagaagaagttcggcaacggcgtgagcaccatggtcctcgtctacaacgccaccggggccagcctgagcctggtggacgacgggaaagactggatgggctccgtctacagctcgccgatcccggacaccttccacaacgggcagtggatcgccttcctccacgtcaagcccggctcgctggcgcaaggcagccaagccgccagggtgttccgcggcagggacgtcgatggccggactcgggacttcgtcgtcgcctggtaatcccgtgggacaacataccgacacgagcttacactgaaatcggcagtaataaaaacttcgagagtcggtagaacgttaggcataaagggttacgcggcacagggaaagtggtaatggtcaagggctaacaccgcgcgataactctcagcatcggtggctacactacagccttctgcatcgcagtcctacaacaccagttccagccgctgccggaagagcgcgaataatcaatcaatcgatcgatcgagtttgcgatcgtgttacctcctaaataaaagttgtcacgcgaagtactactccaagtatttacatgtatgtttctagcaagtgtacgtacgctactcctgaataaattgtggtgcacgcaataaataaataattaatgctccaaaaaaaaaaaa

SEQ ID NO: 20955 - DNA, 405 bp, Triticum aestivum
  unsure (1)..(405): unsure at all n locations
  Clone ID: PAT_TA_20955
aaatccccaaagcctcccgcccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtaagcggaggttggcggcggcggtgctgctgcatctggtggtgctgctgccgagctcaggggggggaaaagaaggaagaggagaaggaaganancgacga

SEQ ID NO: 20956 - DNA, 978 bp, Triticum aestivum
  unsure (1)..(978): unsure at all n locations
  Clone ID: PAT_TA_20956
cgcgcctctgaaagttcggagcccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccaaagcctttggggccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcaagaaccaagatgagatgattaagtctggtaggctatcagagccgtacaagggtattgttgactgcttcaaacgtaccattaaggatgaaggttctcttcccttgtgggaggggtaacactgctaatgttatccgttactccctaccaagctttgaacttggcatttaagggactacttcaagaggttgttcaacttcaaagaaggataaggatggctattggaatggtttgctggcaacctggcctccgggtggtgctgctggtgctccccttgtttttgtgtcccctggacacccaaaacaaggtggctaatgacccaaagctcaaaggaagagtgaaggaattaatggctntccattcacgcaagaaacaatcgaatggatgctggcttacgtggattaaacccggttgaacatgtaacgggcctatttgggccacaccaccancgtccctaagttcncagaattnttcattccccggtgngaaaaagggcggctgactaccanacntcaagntaanaccgggntaanaaaccctgcnccaaann

SEQ ID NO: 20957 - DNA, 439 bp, Triticum aestivum
  Clone ID: PAT_TA_20957
gtcaacaccattatggagtgtttcagcgaccccaaacctaagaagaaagctgcacgggagaacgccgcacaaggggcattatggtgccttgagcgctctggttatgtcaagtcatcttcagatgttcctgacctgtgcggccatcagcccttctgctagccagatctacccttgtaggagtattaatgttggtagacgggtgcagcttgttgctgtggcacagtggttatccatgcactgatgccatgatactcttgagaagttgagtcccttatgaatcttgagccggctgtgttggctcgtgtacctagtctctagctcgtttggttacatgccaaacgcctgcacttgtactgtgtaaatactgaactccggcgatcagtgcaatcaaactgggaactcctagccgagctctgtcttgcaattcaaaaaaaaaaaa

SEQ ID NO: 20958 - DNA, 607 bp, Triticum aestivum
  unsure (1)..(607): unsure at all n locations
  Clone ID: PAT_TA_20958
gacagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttgggctttgggccaagagaacaccaactttgcaattgaattgacatacaactatggcgttgacaaatatgacattggaacggctttggcattcgcaattgctaatgatgatgtgtacaaattaactgagaattcaaatccagggtggtaagataaccccgaacctggccttcaaggaagatcactgtattgcctccacaggatctgacggcaatgttgactaccagaggctgcacactcncctcttccagccctgcgcttcgactcccaatctccacccttgataccgccaga

SEQ ID NO: 20959 - DNA, 603 bp, Triticum aestivum
  unsure (1)..(603): unsure at all n locations
  Clone ID: PAT_TA_20959
tctcaaaccatccgaccccacctcgccgctcactcccaagccagtccctgccggcagcgatggcccgcacgaagcagacggcgcgcaagtcgacgggcggcaaggcgccgcggaagcagctggcgacgaaggcggcgcgcaagtcggcgccggccacggggggcgtgaagaagccgcaccgcttccgcccgggcaccgtggcgctgcgggagatccgcaagtaccagaagagcacggagctgctgatccggaagctgccgttccagcggctggtgcgggagatcgcgcaggacttcaagacggacctccggttccagtcctccgccgtggccgcgctgcaggaggccgccgaggcctacctcgtgggcctcttcgaggacacaaactctgcgccatccacgccaagcgcgtcacatcatgccaaggacatcagctccccgccgcatccgggccaaaaggctgacanccccgtctctgctgtgttccttccttcctattcttacccgaaaactacgtttagggaanaatacnctttaattgggttntggtaagaanaagaatttcgttgttcatcatgcccctananaaacgtcgctgtcgttt

SEQ ID NO: 20960 - DNA, 401 bp, Triticum aestivum
  Clone ID: PAT_TA_20960
actagctgcctcaccaggccgaagtagctgttcggaaaggcgtcgccaggccacagccgaactataaggcccttcatggcctgttcggccgccttgtgcagctcgaccagctgctttagctggtcgctcagaggcatcgggtgtttggtcccagtatactgagaccagaacaacttctccgttgagcttccctcctcggcctggtaaaactgtgcggcatccaacacgctgcggggcaaatctgcgaatgctcctggagagctccgaattcgggtaagtaattggtaatttacttttacatgcttgctctgcatatagaatgccttacccaccgctatcttcttcatagcgtcaatctcctgcagggcctcttgggcttcggccttggaccttttcgcgct

SEQ ID NO: 20961 - DNA, 574 bp, Triticum aestivum
  unsure (1)..(574): unsure at all n locations
  Clone ID: PAT_TA_20961
cgatgccctctccttcccccttccccgcttcgacaagtctcgtcccccgcccccttattccattacgagcaactccgccgccgccgtaaagccatctcccccatccgccgccgccgccaccgctgctggtgggacgggccgtgcgtccgttccagcgaagaggagcagcgggtcggaggagccgccggcgaggtcgggccgcgggggatcgagatggtgctgtgggagctcacggccatcaccgcctacttcctcgggctgaggcgcacctaccgcctcgcgctccgcatccagcgccgcctcatcccgcccaaccaccccaggatccgggacttcgtctacaggcgcacacgggatgtcttcaacgtcgcagtgtcggtccacaagaacattcagcaagagagacatagaggcccggccgcgcgcctcgggtctccgagccttcgctggcttggtggctcgcccctttacgcagcatcgccccggccgcgagctaaattttaccnaaanggcngggnaaaaatcttttttaaattnccanattaaggaaattttntgcnaaaatggcaaattc

SEQ ID NO: 20962 - DNA, 586 bp, Triticum aestivum
  unsure (1)..(586): unsure at all n locations
  Clone ID: PAT_TA_20962
gccggcggccagggtcacgcccggcagcaaccacaccgatatccctgcagtgtccgccgcctacggctccggcggctggttgtctgccggcgcgacgtactacggcgccccaaacggcgacggcagtgacggcggtgcgtgcgggtaccagaccgccgtcgggcagcgccccttctcgtcgatgatcgcggccgggagcccgtccctgttcaagggaggcaagggctgcggcgcctgctacgaggttaaatgcgacagcaacccggcatgctccggccagccggccaccgtggtcatcaccgacgagtgccccggcggtgtctgcctcgcagaggcggctcacttcgacatgagcggcacctccatgggcgccatggcgaacccggcatggccgacaggttcgctcgccggatctcaaatcaagtcaagaggtgccttcaagtcagcgcgtgaaatcgcttccggtggacaaggttcaaccgttcactggagtgtcacaattcagacgcagggcactgacgcgtcacttatgaggcggtcgaactgacccatgtgattgcccgcccttgcgcaaacgaagntagct

SEQ ID NO: 20963 - DNA, 593 bp, Triticum aestivum
  Clone ID: PAT_TA_20963
atctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacacaacctctgcgccatccacgccaagcgcgtcacatcatgccaaggacatccaacttgcccgccgcgcgccgggagaaagggctaatgctcagactttctgtcacaatgccccttagaagattgatagggcctgtgctttgttggtggggtactgccacactccagtgttgcggggacttatttcagaagacataacggataaacgtttcattccttatataaaa

SEQ ID NO: 20964 - DNA, 645 bp, Triticum aestivum
  unsure (1)..(645): unsure at all n locations
  Clone ID: PAT_TA_20964
gacgagacgaccgaccccaagccaaaggaccaaagcaaggctaggcaagcagcgtcactgaagcggaaaacgcgtcgccttcaccagtctccactccagagaggagagctttgattgctggtggtctggtcggcggcggcggcggcaatggagcccctggaggtggccataacgatcatattcgacgcgctgctgctggtgttcatggtgaagctcttcttcgccatgttccagatgaagctcgtcgtcatcctcttctacctcgtcatcctcctcttcgccatggccttctccggccgggcgcccagcagcttctagctcgacgatcgtagcagcagaggtggcaaaaattgaagctttcttctccctccccctctttcgtttcttctcccccctcctggagggtggatcggtggagtcttgcagcgctacgtacgttctgtgaaaaaagacaatcatctcggnttttggtggatggcaactaattaattctcctangaaaaaaagataagaagaacgccatgatcgaggccaaatnctaactnaananaagaattatcatcnaanttcattcccctccagntccanttcaagtagaatctgcgtcnccgcnttgtaggttctgtncaacatgngantaaaaaa

SEQ ID NO: 20965 - DNA, 606 bp, Triticum aestivum
  unsure (1)..(606): unsure at all n locations
  Clone ID: PAT_TA_20965
aactttgggtatgattgtccgttgacggcgagtaagaaggtggattatcctgatatgacacctcaagcccagcgcatcatttcgtacttcgccagcgcggccggaactcctcagagtgaggattgtttgacgctgaatatttggtccaaagcaacgcccaactctgccagagcaaataagcctgtcttggtcttcttctatggtggacgctttgctatcggcaacaccgacagtccattctacaatggcaaatacttcgctgacgcagaggacatcgtcgtcatcaccgtcaactaccgtatcaacatctttggcttccctggtgcacctggcgagaccaagaacctaggctgcgcgaccaacgactgctgtcgatgggttcgcgacaacatctggagattcggcggaaccttccaagagacacgctggcagctctggcgcctcgcgggttacggctgaccaccgacagaccgtcgtgatggtccggcccctaggatcgcccacttccgtaaccctgtttctccgtaaatccgcggcggcctagggaaccgcctcggcctgcacctggttgtggcgcttaagggccgttcatccaggtacngaagn

SEQ ID NO: 20966 - DNA, 600 bp, Triticum aestivum
  unsure (1)..(600): unsure at all n locations
  Clone ID: PAT_TA_20966
aggaaggcgaggggagccgagcgggcaaccggcggcgacagacatggcggagcagcacaaggaggagtcgggcgtgacagtgctggacaagatctccgacaagctccacgggcgcgggggcggctcgtcttcgtcgtcggactcggacgacgagcgctcgtcggcgacggccgccgtgaaggccaagatctaccgcatcttcgggcgcgagaagcccgtgcactccgtcctccggcggcggcaagccggccgttctgtttctatgggaggaacaagaggtttctgggtggggttgctccgcaggcgcaactgccttcctgggctgctgtttgangtcatggattacaacctcctcaacctgctatccactgcctcatcctcaccctgggcatcctgttcccccggccctgctccctcttttcctctccctctcctccccaggtccccccgagactgcctaattgcccggccttaatttctcttcccgttgcactttcggaaggcttgcctccttaggattttggctcgcatggcccttgtttctcggngttccactcgtgtccttcgtcgggaacnggganttcccacttntaaantttt

SEQ ID NO: 20967 - DNA, 765 bp, Triticum aestivum
  unsure (1)..(765): unsure at all n locations
  Clone ID: PAT_TA_20967
cgggtttgcaggagcggcccctgcctttgcccggtgctgggggatttgcgggctttcgtttttcgctgggttcccagttgacctgcgaggactccgtagggggggtttagccccatcttttttgacgacgcccctttttttgtttttttttttttttttggaaaccaaacaactgagcacattttcatatatccaatcgtgaaaggatgaacattctgatacattttattcatgcataccgacgatgccattatttttactagcaatttattggaacgaagcacacacatccattattcggcgacggacatgcacgcatgacatgtccgagttattcattttatagatttgattctcagccgatgtggggtgcctccgcgacggtgtcgacgaagatgcgaacgcggttggggcggaaatccatggtcaccggcgtgccgacgggcagcacgacgatgtcggcgtcgggcttgtcgcacaggatcaccctcttggcttcttccaggctgagcccgaccacttccggccaagacttcttggcgccatcgtcgccgcctgtggagctcatggtgctcggctgccgatggcgaactgaaagggcaagagtgagcgtgagagagagagcgagagagagcgagagcgcccgcgaccgggagacctacagaccgcgtaggcttcccgggcccctgctctcncctgcnaagcccctcccccgccggtanacannggccnacgttcctcaaatnccnccnaaggnanggcccc

SEQ ID NO: 20968 - DNA, 420 bp, Triticum aestivum
  Clone ID: PAT_TA_20968
tttcaccaggcaatgtgggtgctgcggcgatctggtcgaggacgaggagaggcgtgagcacctagaggccgcctgtgaccttgcaacccactacctctgccacccctgcgccctctgccaggagggtcgcgagctgcgccgcagggttccccaccctggattcaacaatgggcactccgtctttgtcatgatgccgcccatggagcagaccatggggcgtggcatgtgagctattccaccaccttccctgccctagttttatctgtgcttcccgtggtttatcatctgctgctgttggccttgatgtgtgatgtgtcctttgttcctcagtaaatacgagtttgtgatatgaggtcctgctgggaacttggattgtttcctcctatcgactgcagttggatccggaccaaaaaaaaaaaa

SEQ ID NO: 20969 - DNA, 603 bp, Triticum aestivum
  unsure (1)..(603): unsure at all n locations
  Clone ID: PAT_TA_20969
ccgcagacccacagccccgcccgtccccgtccgtccacagccagctccgcctcccatccagcgcccgtccacagccaccgcagttccagtgagattgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactagtagtcgttaggttggtagccaagagaggttctttttccacacctcccttgcgcaagtgagtcctgtcctgagcggatctaccaacactgccatctgtttttactgtggctgttgggttccgccagtttctcgttggtcctgggttgctagagagatagagagaaaaaaaaaaaaaaaaccgagggggggccggtaccaattcgcctatatgagtcgtatacgcgcgctnacgggcgtcgtttanacgtctgacnggaaaacctgggttaccaactaatcgcctgagaaaccccttcgcagcg

SEQ ID NO: 20970 - DNA, 740 bp, Triticum aestivum
  unsure (1)..(740): unsure at all n locations
  Clone ID: PAT_TA_20970
attggggcccaactgcaacatagaaagcacaatagtgtaccaacaatgggagccaaaatattttgcctccttatgctccttggtctttctgcaagtggtgctaccgccaccattttcccccaatgctcacaagctcctatagcttcccttcttcccccatacctctcaccagcggtgtcttcagtttgtgaaaacccaattgttcaaccctacaggatccaacaggcaatccgcagcaggccattttccctttatcccctttttcccccaaaaactcactcccccatattacaactttcatttggggcatttagttggcacaaaacatcaagggcacaacaactacaacaacttgctgctagccaaccctcctctgcagactcctcaaaagcacatccgttttcttcaattcaacccaactgagctgcattgaactcaggctgcttaattgcaaccaccaattcattctgcaaaccaacctgctgctgccccccccaattttttcttccaacctacataaacctccgccatttaccacagccggctcatcaacggcaatcaactaagccactccgcggccaccaagtactccttacccgccgccgaaaacaccgatccgtaacttgtcctcaacactgctaccttagcaaccacgcgtgaccaccgccgctgcttaatccnggtgcgtcactgtgcggctggntcggaccctaaatgaaaatgncatcacacatcttnaa

SEQ ID NO: 20971 - DNA, 557 bp, Triticum aestivum
  unsure (1)..(557): unsure at all n locations
  Clone ID: PAT_TA_20971
gtggaaaggagacgtctctgaaccgaggctgcgactgcgagggcatcagggcagcgaggcctcttgtcgcgtgaatcccctcgagagccgccggcggagcatggcgcggtccccagctgcctcctcctcctcctacacggatagcacgggatcctcctccgactcaggctccagctcatcgggaatcgaccgccgccgccgccgccaccgccatcggagcagccgccgcaaggagggcacgtcctcgtccgcgctgaaggcngcnaaggaccggagtccgcnacaaggcgngccacgagggganggcggcggtccngtccgacgacgacagctacanagcacaantttatgnagtgacgtgagtgtttgnagattcggaaataagaagananagttagaaatttaggaagggacggnaaaatagcatatagcgancaagattaacacaaggagaaagatgacatntgtgcttcacttcaaantttgaggcaagaagagagtntacggtnatttgtaaaatatatacntnnaaaagagcagacngncacganaattna

SEQ ID NO: 20972 - DNA, 658 bp, Triticum aestivum
  unsure (1)..(658): unsure at all n locations
  Clone ID: PAT_TA_20972
ctacccccgccccattctgcaagccttgctccatttgcgactcgcgagctcaccttccacaccctacctactcctccactctgagctcacaccaaacagcccgtgcaccaaggccaccattcacctccaccaacaacaaacgggaactcttcacagcttcgcacctcgcgtcacaacaccaagacgcacgtaggagggaacctcaagcttcagtcgtccatggctcagcagcaaacaaatcctgaagaggtggtcctcgggcaggaggtcggggccgcgagggtggccactctcaaccgcccgcgccagctcaacggcatctccgacagagtggtgtacctcctcgcacagtttctggagaaatgggagaaggatgagaacgccaaattcgtcatctttaagggtgctgggcgtgcattttctgctggtggggacctaaagatgttttatgaagggaaatcaaatgattcctggggggccgnaccaangcctanntgatntatacccctacggcgtnttanactctacggaaanctgcgtnccactaacnctgagaatccctttnacngtancaaagnccacnttcttcaattccactatgaatgaccctncggataccggggtttgggtcccantcgaattcanccnnccccttttt

SEQ ID NO: 20973 - DNA, 558 bp, Triticum aestivum
  unsure (1)..(558): unsure at all n locations
  Clone ID: PAT_TA_20973
ccgaatcccatgtcgtcgctgctcctcctccaggccctggctccagccatgaccgtcccccgccaccatttcctcatctcccctctccgcctcgcctctgcagccacagttccgttcgctcgacgcttctccaacgccgcttccagcaacaagccggagccactcctctcggaaccggatctggagtcaggtctgtatcttgtgtcaacgccaattgggaaccttgaagatatcaccttaagggcactgcgtgtcctaaaatgtgctaatgtgatactatctgaagacacaaggcattcaggaaagctacttcagcattacaacatcaagacacctcttcttagcttccataagttcaacgaacgggagagagagcccactatcttaaggaggctcatngaaggtgaannagttgcactgataagtgatgctgggacgccaggtattagtgacccggggatcgggctggcctaggtgtgtgcgactgcctgtatcccattctgggcantgtgaatgtgtctttgatcggttgcacaatgatcnattgttggtttacaa

SEQ ID NO: 20974 - DNA, 714 bp, Triticum aestivum
  unsure (1)..(714): unsure at all n locations
  Clone ID: PAT_TA_20974
cccagacccagcagctattgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcaagtcaccggtgggcctgagatcccttcaacccggcaggaggacaagcctcagccgccaactgaagggcgtctcctgatccacaagggttctgacaactgagcaatcttggaacaaatggttgagtattaggaatgttcctcccgggggcaacttggaagcgcaaaacgcgtctgttgggggggcgacaaccccttcgcctgcatcttatgaggataggttggagggcggctccccacaaaccgggacaactntttccccctgnanaccaanaaggtttttaaaaaggcccncncccagggttnttaagcnt

SEQ ID NO: 20975 - DNA, 616 bp, Triticum aestivum
  unsure (1)..(616): unsure at all n locations
  Clone ID: PAT_TA_20975
ttcaaatcgctctctcgacccaactgtactcgccgtcgtcaattcatcatccatccccatccccccatcgactcccagatctctatccccctctccctgtcctcactctctcgagcgcgttgtggcggatgtcctcgtcggcgcgtttcgatctccgggcctcgtcgcatcagttgcagccgccgccgtcgcacgccagcatgagcagcgacgggggcgcgttcgcaaacgcggagaaccgggagcactgcgcccggtacctgaaccagacgctcgtcaccttcgggttcccggcatctctcgacctcttcgccaccgatccggtctcgattgcagaacttgtaactgcatctatcgctgctgcagcaacgacagagggactttgtctagggnctacaaatgacagcgggaacggatcatctgatactcacggtggaactaaattgagaaagggtccaattgcggcgatgtactggcttacaccgtagcggacgnggcaaacacgctctctaatccagatgtaactgaacagaaantgtgaattaaaaaaggtnnggaatnacaatncnaccagaantcanaatgagagaaggaagatcntaanttaggaagtaat

SEQ ID NO: 20976 - DNA, 727 bp, Triticum aestivum
  unsure (1)..(727): unsure at all n locations
  Clone ID: PAT_TA_20976
ctttgttcccatttctggttttgagggcgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggtagtcacctttggtccaactggcctgactaccgaggtgaagtctgttgagatgcaccacgaggcacttcaggaggctcttccgggtgacaatgttggcttcaacgtgaagaatgttgctgtcaaggacctcaagcgtgggtttgtggcctccaactccaaggatgaccctgccaaggaggctgccagcttcaactcccaagtcatcatcatgaaccaacctgggcagattggcaacggctatgcccctgtgctggactgccacacctcccacatcgctgtcaagtttgctgagctcattacaagatcgacaggcgctctggcaaggacttgagaaggagcaaagtcctgaagaacgtgatgctggtatggtgaagatgataccacaagccatggtggtggagaatccaaggtacctcccttggaagttgcgtcgntaataggaaacgtgctgtgggtntcaaagtgagaaaggccaacgggccagtgcaggtctcaaaaa

SEQ ID NO: 20977 - DNA, 589 bp, Triticum aestivum
  unsure (1)..(589): unsure at all n locations
  Clone ID: PAT_TA_20977
gccccacgagcccattcccctcagcccttcaccatctccggcggccgcagtggcatcagcagctccggctcacgcgcagtgaaggaacgacaatatggcgaccatcgtaaacacgacggaggaggagccgatgctggccgtggtccgcttcaccgctgagctcgcctgggccgacgcgggcccggaggtcgccgaccccgaggtcacccgcctatgtctcgaggcgcaggagcatatcctcgcggggcggtggctcgacatggcctcccttatgctcgcctccgccgacctcctcctcacctccccgtcgcgcgtctcggacaaagacctggagtgcgttctctccgtcatctgcagcttcgtcaccaaggccggatccgaggaccaggcgctgagatcaccgaaccattgcgctaagtcaccagcaacacgtgacaagcaggctggcctaaagttttttagttgaaattgctccgagcccgtcggaaggattgtttaaaaagccttactccacggtgaaagtgtgataacacccattttaagaattgagttngagttggggattgnanttgaaaaggntncttcntac

SEQ ID NO: 20978 - DNA, 770 bp, Triticum aestivum
  unsure (1)..(770): unsure at all n locations
  Clone ID: PAT_TA_20978
gagagagacccagttctggccaaccttatccagtacatcattgctcaagagcatttaaaccagcgagtgatggattatctccagagcctcgcagatttaaatcctcagattgccatcggcagaccactaagacccgacccggagagacgcatacatcgactggtcaatccactgcctccaattgaagaagaatgtatccctttaccagagacattttatcaggaccccgcccagttaccgttttctttttagacgtcactactgtatttgttcttcgcagcatttatttatgtgtgtgacttatgcgtaataccctgagtttgtacgacgagtcaattatttggcttctgcttatgtgtgtagtttttgttgtggtttatgctcctttaaattaactgtttttccctcgcagaaccctggagtgagatttttcttttccctgagttgctacatctacactttctcacgacgtggattatttaatttcactcagcaccacgcagcagactcacaaccttaatcattcggacacatacactggttgcaaacttgcgcgtcggcgtcacctccaccgtttcgcccccccgtcgactgcgtgcgcccggcccaccccggctccccctctgcctccccgccccgccgcgtgctacacccgagccgagatcggatactcgtgaagatatgccacagagcacagagagcccagagtgtgcagcctcgatttaggatanaacagtcggatgctcgcattagagctgacggtttgnaga

SEQ ID NO: 20979 - DNA, 780 bp, Triticum aestivum
  unsure (1)..(780): unsure at all n locations
  Clone ID: PAT_TA_20979
ggagcacggaggcgaagggggtgccgccagcgcgcgccgccccgtggcgccgccccccccccagcgcgcccccccggggcgaggggtgtggagacgctcgtgaaggcgctctgcgcccccgcgctgggggcgcgccacgcgcggcgcggcttttttgctcccaagccatcttctggacctcacaagtccagggagtgccttcctctgatcctcatcatcaggaacaggctcaagtatgctctgaactaccgtgagatcatttctaccctgatgcaaccccatgtacttgttgatggcaagggcaggactgacaagacctaccctgctgggttcatggttgtcatttccatccccaatgacaatggagaactacaggctgctttatgacaccaagggccgcttccgtcttcacccaatcacggcatgaagatgctaaatgcaatgtcggcaagctgagttctattcattttcgaccagaagggcatcccaatatcggaccacatgcaacggctgcactatccacttcccgcgccgctcatcaactgcctcaccaccatcaaggcaacgacacagcaagatcatttgggacagcaagacatgtggtctcacagttctgttaggaactcccatgggacggcgtaggagacggcacaggggtgaaaaagggagacaaagggggtttggcaatcccgcgtccccggcacagggcacttgggcaacccacggggaatgcctcttccaacgggaggaccctgcccctacaggcgagcccccncaaat

SEQ ID NO: 20980 - DNA, 910 bp, Triticum aestivum
  unsure (1)..(910): unsure at all n locations
  Clone ID: PAT_TA_20980
cagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtgggcaaggaggatgcaaccaacaacttcgctccgtggtcactacacaattggcaaggagattgttgacctgtgccttgaccgcatcaggaagcttgcagataattgcactggctctcaaggctcctcgtctgaacgccgttggtggaggaacgggcctccgggcttggctccccccccgtagcgctgtcgcttaccatccaagaagcaactcggttcggtgcacaccgcccccaaagttgttgtcacctaacccagaccaacctggtgccctacccgacgcccactaatgctttcgtcctaccccctatcatttctgctgagaaggctacaccaacagctgtccgttggtgaaatcacaaaaaggccttcagccacctccatgggcaaantgcaccccccaaggaaatttatggaagctgcccagtacgtgggattggtccangattaactgctgtggcaaanaaacaacnncacattctgatgggccacggtnaatggganaaacacncaantctc

SEQ ID NO: 20981 - DNA, 690 bp, Triticum aestivum
  unsure (1)..(690): unsure at all n locations
  Clone ID: PAT_TA_20981
gagttttttttttttttttttatagtttaatcaacttcgtcgccggaatagaaaattgacaaggaacaaaaaaaagaattgtccaagaacatcttgtaaccaaggaagcaagcattcgattattctaagtataaatgtgtgatccagcaagaatccattattgcaagctcgggcttaacagcaagagcgcccgattccttatacacacacacatacaaccaggtgtctgtctacacggtgagttccgtcctggagacaagaatgccatcgggatcggcgtaaagccactcgccgtcgcaaatcctggttccagcgatgttgacggggacgtgttctcgcccatccccttcttgttggccttcatagggtgcgagctgagagcccggacaccgattccaaccgttgtttcatcaactccctgatgcagccgttgacaaggatacagccaccgttgttctgcgcctgctggacgggttcccccaggatgcccaaccatctgccgccgccgtcnacacaagacctacgtggcttccccccaggggggccgtaccaatccctaaggagctatancccccacggcgtctttaaantcgnacggaaaaccgggttccactaacnctgagaatcccttccacgggtaacaaggccccttccctccaattccccaagaaggccccttggnaaaacggg

SEQ ID NO: 20982 - DNA, 661 bp, Triticum aestivum
  unsure (1)..(661): unsure at all n locations
  Clone ID: PAT_TA_20982
cctagcagccgcccggtgctccctctctgcagatctcccttcgcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgatggacttgtgaagggtctccgtgaggctgccaaggccatcgagaagcacgccgctcagctttgcgtgcttgctgaggactgtgaccaagccagattatgtcaagctggtgaaggcactctgcgcggagcacaatgttcacctggtcactgttcctgccgctaaagacccttggcgagtgggctgggctttgcaagattgactctgaaggcaaggcaaggaaggttgtaggctgctcctgtgtcgtcgtaaggactacgtgaagattaaggcttaataatcacgagtatgtaagtccactaaatgtttacatttcagtatacccttaattggccgggcctaaatatctttcaccggggtctcgaggtataattattncnaaaaaaccaaaggtatttgaaaattgaaccgantttttgtaaggcnccccggttannaacataaacnattttcgattgttactttaaaaaaaaa

SEQ ID NO: 20983 - DNA, 474 bp, Triticum aestivum
  Clone ID: PAT_TA_20983
gccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaataatgcgtggttttctggcttaaaaaaaaaaaa

SEQ ID NO: 20984 - DNA, 549 bp, Triticum aestivum
  unsure (1)..(549): unsure at all n locations
  Clone ID: PAT_TA_20984
ctggatttgagcctgtttagcagcgctatccgcttggcccaattcgtctactgctcctccagctcctccgctgcgccgccggtcgccgcccgacaccgccgaagaagagcagacgccgagtccaaggacgtcgccgcggggctcggggaacgcggtgttgccatcgcgaggaaggtcggaagttcgctgttcgcccgccggttcggcaccgtccccaccgcccatggcaaccgtcgcccccgtcgtctccgacctcgccgtctccctcaccgcgtccccccccgcctttcccgccgttcccgaggcgaacccggctgaaggcggcggggttcctgtgccgtcccggcgggaggggtgggccggttcccgcccgggcttttttttgacccgcccactcagcttgtccctcgggcatcgggcaaaatacttgtggaatggttcaatatggtgaacactanagccttgctnaagtaagctgntcaaggtacaaagagtacttaagttgggtaaactatgtgtggtttgaaatggttaacgtattatgactga

SEQ ID NO: 20985 - DNA, 1089 bp, Triticum aestivum
  Clone ID: PAT_TA_20985
cacacaaccattattcttgttcaactgcatcaggtcgtccaactcaccaagcggcaagcgccatgccttcttccgcgcaggttctgctctgcctcgccgccgtgctcgcggcggcggcggccaccaccgccgaggcgcactcgcagtgcctggacaacccgccagaccggtccatccacggccgccagctggccgaggccggcgaggtcgtccacgacctccctggtggcctcagggcctacgtcagcggcgccgcgagctccagccgcgccgtcgtcctcgcctccgacgtcttcgggtacgaggcgccattgctcagacagatagcagacaaggtcgcaaaggcagggtacttcgtcgtcgtgcccgatttcttgaagggagactacttagacgacaagaaaaacttcacggaatggctcgaggctcactctccggtgaaagctgcggaagacgctaagccactgttcgccgctttgaagaaggaagggaagtccgtcgcggtgggaggctactgctggggagggaagctgagcgtggaggtggggaagaccagcgacgtcaaagctgtgtgcctttcgcacccgtacagcgtcactgccgacgacatgaaagaggtgaaatggccgatcgagatcctgggggcccagaacgacacgaccacgccgccgaaagaagtgtaccggttcgtgcatgtgctacgtgaaagacacgaggttccctactacgccaagatttccagggagtcgagcacgggttcgcctgcaggtacaacaccaccgaccctttcgccgtcaagaccgcagagacggccctcgcctacatggtcagctgggtcaacaagcacctcaactgaatcaagcctgcactgcacccaccagactgaattcaataaaccactgcagtgctgtgatattttgtttcgattcatggctccccagattgatttgtcatggctaagacctctactactgtaatttccttcattttttgtctcttcaaactctctgtattcttttttttgctttttatgatcgcaataaagttcagtaggggtatacccctcctgtttgcttcaaaaaaaaaaaa

SEQ ID NO: 20986 - DNA, 678 bp, Triticum aestivum
  Clone ID: PAT_TA_20986
ctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggcctgtaccagggagacctccatgctcaccttccgagggccagaagttccaggggcccctccgccattgcccggcaagctcggatctctccctttccaggcctgcgagcatcagatcgtcaccgtagactgccagccatcgggtccccagggaggcatgctcgtcttcgtctcccggttccatacgcaccggccccgaggagcaccccatcaagttctcccaggcattccatttgctgccggccgctgggtccttcttcgtgaagaatgacatgttccgcctgaactatggctaaagacacccgatactcttgtgatgaaggaattgattaagggtttaatgttgaaactatcaatacttcttgttgccgatactctgctttggtttgtatcttctttgtaggtgtggacactttataataagaaatcgctagacttggattatctcagtcgttttgaatcatgtactggttgcaccatttctttgtggaatgtgattgaaacggtcgtagctaaaaaaaaaaaaaaaaaaaaaaa

SEQ ID NO: 20987 - DNA, 274 bp, Triticum aestivum
  Clone ID: PAT_TA_20987
cggacgcgtgggctgaatcagttgagagggatcatatatgattatgatgtcccaagtttgatttttgtgtgctttcttcccgatctaataaagctgctacaatctctaagctatagtagtgacgccgagcgcgagaacaccgggcaaagtgtggacgtgataagtttaaaagtttgtatttgtaactaccaaaggggcctattgtttgatgatgttggtgcttgcttatgtgaaatgcctaaacactcttattttcttatatatttggaattgg

SEQ ID NO: 20988 - DNA, 1178 bp, Triticum aestivum
  Clone ID: PAT_TA_20988
tcctcacgcagcgtgaaacagtgataaacgagctgctcgcgctaggcccacaccctgagcgccagcccgccgttacaacagccacagctcaacacatcacttgcaccggtccggagtcccttgatcatcacagcaatggccctccaccgacagttggacccacgagatcgaatcgccggtcgccgcgtcgcgcctcttccgtcgccggcgtcatggactggcacacactgggcacccaagctcgcgccgcacatcagtcgcccgcgcccaccccgtcgagggcgaatggcggtatcgctcgacacatgatttgcaccggtcgtccttagatcttcacatgcaatggcctccaccgacacgctggacccacgagatcgaatcgccggtggccgcagcgcgcctcttccgcgccggggtcatggactggcacacactggggcccctaagctcgcaccgcacatcgtcgccaggcgcccaccctgttgagggcgaaggcggcatcggcagcgtcaggcagttcaacttcacctcagccatgcccttcagcctcatgaaagagaggctcgagttcatcgacgccgacaagtgcgagtgcaagtccaccctcatcgagggcggcggcatcggcaccgccatcgagacgaccacctcgcacatcaaggtggagccggcggccaacggtgggagcgtcgttaaggtggagtcgacctacaagctgctgccgggcgtggaggtaaacgatgagatcaccaaggccaaggagtctgtcacggccatcttcaaggccgccgaggcctacctcgtcgccaacccggacgcctacaactgaaccagctgagagggaacacatatggttatgattatgattatgctggccctggtatgatttttgtgtgcttttttcctgatctaataaagccgctccaatcgcaagtagtgacgcgggagcactgagcagagtgtggacttgacaagttaaaaaggtcgtgtattcagtatttgtaactatcaaagggtgccatgctgttgtttgatgatgttgttgcttgcttatgtatcttcctcatggttttgcccggaataaaaggaaatatttgtttgctttacttgaaaaaaaaaaaaaaaaaaaaaaaactcgagacacctcggccgcgaccacgttaatcactagtgaattc

SEQ ID NO: 20989 - DNA, 609 bp, Triticum aestivum
  unsure (1)..(609): unsure at all n locations
  Clone ID: PAT_TA_20989
cttcaaccccgtttcgccgcccctagcccaaatcccccacctactcgccgccggcgccgtctcagcctcatccttctccgctagccatggccgccgcgggtcccgggctctactccgagatcgggaagaaggccagagatctcctatataaggactaccacacggaccagaagttcacgctcaccacctacgccgccaacggagctgccattactgctgcaagcacgaggaaagatgaagctatctttaatgaaatccaagagccagcggaagcacaacaatgtgactgtggatgttgaaagcaacttcaagaatcaaatgttgataactacaatcacagttcatgactggggacaccaggcttgaaggcattttatgtgttcctttcccgttaccagaatctgcaaagctgactccagtatttgcacaacatgctggtgttgctgcagtgttggcctaaatgcaaccctgttgttactttcggggtttgcagctaagtattgtgcggcgggccgtgccgcgttcgttcccgccggggcttaccatatgtccggcgccgagctgcccgantgtcngacantgananagggaaatgcgttcancancggn

SEQ ID NO: 20990 - DNA, 703 bp, Triticum aestivum
  unsure (1)..(703): unsure at all n locations
  Clone ID: PAT_TA_20990
gccgtcccgccccttaaccctcgttcctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaaattccgcacccacttcggtggtaggcaagtccactggccttcggcctcatctacgataacctcgagtctgccaagaatttcgagcccaaataccgcctcatcaggaatggtcttgctactaaggttgagaagtcccgcaagcaaatgaaagagcggaagaacaaggcaagaagatccgtggtgtcaagaagacaagcttggtgacccaagaagaattaacatcattaattcgtatacgtctgaccctgggtggcctctatccatgtataatgggcttacttgttccacaacattattaatttttatcagtaaacaacgttggctcattgattaaagtttagacttgggatttccgaagcaaaccaccggattccccttacangttgtgaaataaaaggtanttgtcaaaaaaaaaaaa

SEQ ID NO: 20991 - DNA, 265 bp, Triticum aestivum
  Clone ID: PAT_TA_20991
agaatatattacttaagtttgtgaagtagtgttattttatttttggtgtaatttattttgtctgtgagtgacccctcacatgcatatcgctctttttttactgtattctgagcaaagttttacatggttatcatgatcagattttagaggactggactagtacatttttttcctaccctccaagtcttatattatatggttttctaaaaaaaaagggggggcccggtacccaattccgccctatagtgagccgtattacgcgcgc

SEQ ID NO: 20992 - DNA, 805 bp, Triticum aestivum
  unsure (1)..(805): unsure at all n locations
  Clone ID: PAT_TA_20992
gccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggctggggaacgccagcgcggccgccatcgtcaaggccttcccagacatcaagtgcaccgtgctcaaccttcccagggtcgtcgaggagacgacgaccaagaccatcaccatcccgcctgcgcaggctgtcatgctcaagtcgtcctgcacttctggagcgacgacgactgcgtcaagatcttggagctgtgcaggaagccatcccttcccgccaagaaggagggaaggtgatcatcattgagatactcctgggcccgtacatggggccggtcatgtacgaggcccagctgctgatggacatgctcatgatggtgaacaccaagggcaggcagcgcggcgaagacgactggcgccacatctttaccaaggctggcttctccgactacaaggttgtcaagaaaatcggagctcgtggtgtcatcgaggtctacccatgatccatgatcgatgtcatgtgactgtgagaggacgatactgtacaattaaataaacggggtatctagctactactcagcttttgtacctcgagatccatgcatgttaattacttgcttccatctgttttcaaaatgcatctatgtaatgtacttcgcttcttcaaaaaanaaaaaaaactcga

SEQ ID NO: 20993 - DNA, 1226 bp, Triticum aestivum
  unsure (1)..(1226): unsure at all n locations
  Clone ID: PAT_TA_20993
ccctttttccgccgctnttgatnttaggaatntggtttagaacgagtgattcccttntcgaccttantgccaaccggngagcgnccgctaatgtgttccacttattgaacagggtctatggtcggtccgtgacccctggacgccgagggcgtccttggggtgatctcgtagttcctacggggtggagacaatggggtcggtccatggattttccttccttttgctacatttcgctcaaagggttgaagggagatagtgcatcaagttattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactatcattaccgcctggacaattagacagccaacccgtaatcgcaacgacccaattgcaagagcggagtctaccaactgagctatatcccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactccccgttgtactgcgctcttcaagtgtgcttcttcccccttctccctcttaccatggcaagtccttggggaaataactccgatgggcagaaaaaggaaggcgttaagagaccctcctgggcccaaccctagacactctaagatcctttttcaaacctgctctgctcccatttaaggaaaaagaatttcacgttcttcctgaaaggaagggaggattaggaaagtcctattgattgctgctttctccaaaccgccgggaaaagcatgaaaaaaaggctcgaatggtacgatccctccgtcaccccagaatgaaaggggtgatctcgtagttcttgggtccgtgaagatgcgttgttaagtgctccatttgcccattgaggacgaactcaacctgtgctccaaggggggccactaccaattcgcctatag

SEQ ID NO: 20994 - DNA, 606 bp, Triticum aestivum
  unsure (1)..(606): unsure at all n locations
  Clone ID: PAT_TA_20994
ctcgtgccgtttagctcgtagttcaccatgaacttaaacgagcagtacgggttctgcaactctgggttcgcagtttacctacaacaaagctgaaatgctagtaggggtagacacaaccacacaagagcgagcaagcagtacatattcttcagctctgctctggctgcgcagtttacctagaacataagtaacaacagaaatactagtggcgtagacacagcaacacaacaacacacgtttttattctgatgatgaagatcccctgcttctaagctgaaccatcaccggtctagaagcagagttagagcacatccattcttattccgaagagcctcctgctgccaggccaaatcacttggtggcaatgaacaaccccactctgctcgccggcagactccgtttcagcttcgcgttccaaccattcacaaggtcgtcatagcctcctgggtgaatccgccaagaatgcccttggtctttcaactcaactatctcctccgttgaacatcaagaacgcccatgcggtctccgcgatgacattatgaaaacagcatcctcancatcgtcataagcctcacgtcggaaggcatacctcncgcttatgtanna

SEQ ID NO: 20995 - DNA, 541 bp, Triticum aestivum
  unsure (1)..(541): unsure at all n locations
  Clone ID: PAT_TA_20995
tgggaacctcaccctcctaggctctgcggcgaatctgattgtctgcgagcaggccaggcgggcccagttcttcggctacaacctcaccttctggagccacctccgattcggggtcccgtcgaccatcatcgtcacggcgattgggtttgctcatccgtcatcaagttactggaaacagctgaaggcagaagagcgttagtgtaagagaagcaagaatgggataaaaatccttccaaataagaagtacatgtaaattaggcttgccctataactcaagtgtgttaccggtactttatgcccccgtccgtgcccttggcccctngagcaagcagcacatggctgaccgtgtacctgcatttcccattggcataatagctttatgaagatgctttgggatttggtttctgctgcccgactgggttctgggcccgtgcgtctgtttcctccggggattcttacttcgatcttgtttcattcccctatctgcgggtatcccttcgctgaaaacgggattcanatatcttccgggaaaaaaaaaaaa

SEQ ID NO: 20996 - DNA, 767 bp, Triticum aestivum
  unsure (1)..(767): unsure at all n locations
  Clone ID: PAT_TA_20996
ctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgattctgcaagagtaggcagccaaaatggagtccaaatgttgaccccctcaggaaatcccacaaagggactgggttcccctctgacttcaccttcggctgccgccacttcagcgtaccaaattgaaggtgcttggaaatgaagataggaaagggggaaatgcaactgggaatcacttctgccacagtcatccgggaaaggatactgggacgggagcaattcaagacattgggagcgactgcgtacaatatgttcaaaacggtcgtcaagattgctcaaggaaatgggcatggacgcatataggtcccgactcttggaccaaaatacgccgaagggaacaaagaagcaggattacccgatggaccaatactacagaacccacaactgtgctgcaaacggataagcatattacaattcacgggatgtccaagaaaaaaagagggggggaaacaagcacacattacatctaacactccaatccctaggaagtggcctgtggcccgctcccagtgtccttcgtcgccttcatgggccaaattnttcnttcacgaangggcttgccagggg

SEQ ID NO: 20997 - DNA, 513 bp, Triticum aestivum
  unsure (1)..(513): unsure at all n locations
  Clone ID: PAT_TA_20997
tccctctccgtgtctccgattctggatctgcccatgccgtaacccgcaggctcccggcatctcgctcttgcctccaaaattcaccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgangctgttccctccccgggcgccctcggcgcggactcgcacgcgtcctgcgaacgcgccgcgccgctgaagcaccgggcgcgccnggcggaggaacaattgaagtagtccgggaacanaggacaggaaggactaaaatnaaacccaaaggacaaanccgaattcttcttcccgcaaagaaaaagnaaantctcgntctg

SEQ ID NO: 20998 - DNA, 556 bp, Triticum aestivum
  unsure (1)..(556): unsure at all n locations
  Clone ID: PAT_TA_20998
cggaaatcaagtgaggaagccacaccaaaagttgtggcgttcagtccgctagaagcagctatcgctaaacctagaagtagtcccctgacaagtgagagttctaaagtaaggcgatcagagatagcaacccaagtcaccttttacatgatcccagccctgcttcttgcctccaagaacagcataagtacctcccttctgggtcggcgccgtgttccatcaagtatacatgttccacaaggagattcttcctgggactacgtgcaccatgatatcaccagaaagtgggcttggatttacttcaagctgcttttgctggtggatggcgaaaggacaccatcatgttcttcaatccgttccaaacccctcctcccttctccccatcctgnctactcgccccgtccctgctctcggtgatgattgtcggcgtcgtctggccccccgtcctgctcccccctgcagtctccttttgccaacccgatgcatctaatcagtagcgtcccggggctgactcgtcatctgtgtttcctgggcgcaccataaaaatataagcattggc

SEQ ID NO: 20999 - DNA, 397 bp, Triticum aestivum
  Clone ID: PAT_TA_20999
cttcaacacacacaaacacttacgactttttcgaagaccttcttcaccaacaactatcaacatgtctccctgctcttgctgcaaccacgaggcctctgcctgcggctccagctgctcttgctgccagcactaaattccctcttccatcaccaacgacactcggccatgactaccacactcgcaggcctctgagggccatgcttccaggttacgatacaggaggacatcaaatgcgagctcaagcgagcaagtccggacggacaggtacaatggaaaggaaagaaagaaatatgagacatgctagcgatggactgggaaccgccaagtttcgatggtagggaagtttagagcaattgcagttcatgcttcgaaaacaaaaaatcacaaaaaaaaaaaa

SEQ ID NO: 21000 - DNA, 588 bp, Triticum aestivum
  unsure (1)..(588): unsure at all n locations
  Clone ID: PAT_TA_21000
caacgatctagctacttcctctctcaagcccataggtgttgtagagcaactcaactagcaatggcttccaagagtacaatgcgttcccttgtcctcatcatggggctcctgctgctctcgtgtagcggcatgagcagcgcggcgcggctgctggaggagatggcgcccaaggaggagtacccgcaccctgaagtgccagagctgcccaagcctgagctcccgccgcaccctacggtgccggaactccctaagcctgatgagctaccgccacatccggtcgtgccggagctgccaaagctgaggtgccagtgcaccccgccgtgccggagttgccgaacccgagataccgccacattcgaccgtgcctgagctgccgaacccgagatccggagtaccaaacctgaggtgcctgacacccgccgtgccggactgccgaacccgacttctcctcacccacgtgcctgagctacaaagccgagtgccggactgcaaacctgggcgctgccccccgcgtgcgcgctccgaattctcctcctcgnctggtaaaaaccnnggggggttnaantnaggggtaacccccgtcgggtg

SEQ ID NO: 21001 - DNA, 685 bp, Triticum aestivum
  unsure (1)..(685): unsure at all n locations
  Clone ID: PAT_TA_21001
ttttttttttttttttttttttgactcagaaccattgcaaactcattaactttagacaaaaaaacatcagtaccgctgtttttaagataaatgtatattgaaaaaaactggcaccactcaacaataaactcagaccaagatgtttataatagactcagctccgaacaacgtttctgtaatagactagaagggataaactggcatcccagcacaaacttgacgagctgagccgctgccgttgcccaaactcagaaactgaactctagatcttgttgaaagccacaatgtcgcaactctggacgtactcattgatgggctcttgcgtaaggtggtcctcaattagagtgtcgatggacacaagatcgtccgacaattgtcaacatgatagtcatcttcttggatgccgtatccaacaggcacaagctttgatgctccccaagtcagacctccatctggacactgcggacagcctcctcaacttcttcatatcagtctcatcgtcccatggtttacatcataaggacggaggattacacttcctttcttttagaaaggcttggaccggagcaccccatagcgcctctgtctcccagttcatacaaaagttagggcacacatctagctatcgaggcagtccgggagtgatccgagnagttaacanacttacaggattnaggaancgaga

SEQ ID NO: 21002 - DNA, 561 bp, Triticum aestivum
  unsure (1)..(561): unsure at all n locations
  Clone ID: PAT_TA_21002
cagacgacaaggcatcggccccggatcgagcccgacccctcttctcgtctcgtctcgtctctgcgctgggaacgccggctgccatggctcagcagaagaacgcgcacgtgcccaagttcggcaactgggacagcgacggcaacgtgccgtacacgctcttcttcgagaacgcgcgcaagggcaagggagccggagccgccggcggcaggatgatcaaccccaacgaccccgccgagaacccggaggccttctccgtggccgcgccgtcgccgccgccgggccgccacgangctcgccccagcgacgcnccgccgccgccgatgtcgcccaacgcctactatccgccgggtcgccgtacancgccacgccgccggtgaaccncnaatgagggccccnggtacagcgtcganagtcgncggngcancctacagtccgaaaangcggttacgnctcgtcgncagntccgtcgacgctccgcgctaagggcgcctncngnggaacgacacccgacaagggctcgcggtgccagttcggnatnngggaccnaccggggtngggntg

SEQ ID NO: 21003 - DNA, 938 bp, Triticum aestivum
  unsure (1)..(938): unsure at all n locations
  Clone ID: PAT_TA_21003
gcagcagaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttccgacatcgagatcgacggcaagcccgcaggccggattgtcatggggctttttgggaagactgttccctaagacggcagagaacttccgagctctttgcacaggagagaaagggtttggcaagagtggcaaagccctccactacaagggaagtaagttccacagaatcatccccagcttcatgctccaaggaggtgacttcactctcggggacgggaggggtggtgaatctatctacggcttgaagtttgcggatgagaacttcaagatcaagcacactggtccaggccttctgtccatggccaatgccgggagagatacaaacggatcccagtttttcatcaccacagtggacaacaatttggttgggacgggaagcatgtggtgtttgggcaaggtgttgtcctggaatggatgnttgtgttcaaggccgaagctgaaggccggcagagtggggacccgaagagcaagnttgtgatagcagatagccggcgagctgcccatgtgacggcgtgctgaattgatgttccatcccccgaaacatgatgaatagatgtcctggtggccgtctgtcgttccaggactgttaggcctccttgggatctacngttttacagttttgaaggatactatggttaaaaatcaaactcgttgcttgaaaaggaaaccanttcaatacatggcaaccaaagntatatttcagttgaaaaaaaaaaaa

SEQ ID NO: 21004 - DNA, 542 bp, Triticum aestivum
  Clone ID: PAT_TA_21004
cggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagtttccatctacagatatacctctagaaagtgaatggtttgctattccaaagggatacaatgctccacagcaggttcatatcactcaaggtgattatgatggaaaggcagttatagtatcttgggttactccagaagaacctgggccaagtgaagtattttatggcaaggagaagctatatgaccagaaagcagaaggaacaacaacaaactatacgttttacgattacaaatctggatacatacaccattgccttgtcgatggcttgagtataacactaaat

SEQ ID NO: 21005 - DNA, 685 bp, Triticum aestivum
  unsure (1)..(685): unsure at all n locations
  Clone ID: PAT_TA_21005
ctcaaattcgttccgtccaggcaaggaagaaatcgagcagccaaggagaggagaagatggctcgtacgaagcagaccgcccgcaagtccaccgggcgccccccaactcgctcccgcccggcaacgaaggaagtcgccacccaacgggacggagaggctgctccgacccacccgaccgccccccaggtcacccggcgccaaggccccggccagccggctcgccaccaaggcggcgaggaagtcggcgccgacgaccggcggcgtgaagaagccccacaggtacaggcccgggacggtggcgctgcgcgagatccgcaagtaccagaagagcacggagctgctgatccggaagttgcccttccagcgcctggtccgtgagattcgctcaggacttcaagacggatctgcggttccagagccacgccgtcctggccctccaggaagccgccgaggcctacttcgtccggctgttcgaggacaccaacctctgcgccatccacgcaaagcgcgtcaccatcatgcccaaagacatccacccgcgccccccccagccgcccgccgcccgcggggcctagctcgcgcccggcccctgtgccggcggccggatgcggcggtgcaattggtaacggtttgctctttggccgtttctnagccgttgccacgtntgaaaatgtatcgtcacaaaa

SEQ ID NO: 21006 - DNA, 560 bp, Triticum aestivum
  Clone ID: PAT_TA_21006
ttttttcgtcgtctcgcacgctctctttctctctctctctctctcttgcccatccccccacctcggctggctcagctcagctcctaaaccggcacctacctctctgcctgctgccccggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagtgactctgccgcttgttgcccgttcttggctgctgttgctggcgagagcgcgcaggaggagcggttgatttttgatcctctctgtccctccctcccttgcttcgcttcgctcgcgcggggtgcctgcacgtaaccaggagaagatgatgcgcccaggccaaaggtacattcgccgaaccccgtggaggagccctcccttcccccccgcccctccccccccggtcccgccggtgaagcagtgaaaaagaaca

SEQ ID NO: 21007 - DNA, 599 bp, Triticum aestivum
  unsure (1)..(599): unsure at all n locations
  Clone ID: PAT_TA_21007
ccaccccctcctagagcggaaccacattccacggctctaaggccatgtcgccggcgtccctcgcagctcggctcctacgccgcgccgcttccacctcttcctctcctctctccgctcttgtccgccgcggtctctgttcctcggcgcccgttcccctcctccgccgtctccctgcggccacctcatcgacggcggggaccaccgcccgccgcttcctgggcgtcgcagtccccggcgtcctcctccacgtcttcggcggacgataacctgaggcgcatcgtcgaagtctgagatcgagtgcgttgtccagtcggaggagagcaacaccgacaagcacattgatctaccagaggacttcccttttgagatcaatagacaatcctggtgatcagtcaataaccctccaaagggagattgcaggggagacaattaaagcggttatatacaccaactttgatacagatgaaatttggatgatgaggatgacaaaagtgggacagatgaggaacttttacaccactccttcggtgcgttgtcactcttaagacaatccnaaattgcgnaacttaagntangacaanatnaatatnggggtgact

SEQ ID NO: 21008 - DNA, 662 bp, Triticum aestivum
  unsure (1)..(662): unsure at all n locations
  Clone ID: PAT_TA_21008
ggncnttntccccccgggaagggtttnnnaggttaattggaaccgggtttccctnngnatttaangagcccttggggggttatagacccctttggggaatttgtaccggcccccttcgccgtcatcgatcgatcgcccgcaaactaacccctaccgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgcattgctgagggacatccttagcctttgtttagtagtatggtttggtactttgttctgtcatcactcgtttatctatccctaatacatgcccgccatgattgtactcccaaaaaaaaa

SEQ ID NO: 21009 - DNA, 725 bp, Triticum aestivum
  unsure (1)..(725): unsure at all n locations
  Clone ID: PAT_TA_21009
cggaggcatccgtcaaaatacacgaagggcaacgaggcgaggcctagtatagaggaaaacgagtgagaggggggaaatgctgcgccacgccgcccgccgtctcgtctcccgcaccgccgcggcgcccaccgcccgccgggcgctcgtcacggcagaggtgcctgcggaggccgccgaggactccacgtttgtggaggcgtggaagaaggtcgcccccaacatcgagcccccaacgacgcccctcttcctcatgcagccgcgcccgcccacgccggctaccatccccactaagctcaccgtcaacttcgtcctcccctacaagtccgagatcgccaacaaggaggtggacatggtaattgtaccaactacaactgggtcaagatgggcgttttgccaagccatgttgccacgattgcagactcaagcctggtgttctctcagtacatgaggggaacgatgtgaccaagtactttgtgaacagtggatttgctttcgtccatgcaaactcaatggctgatattgtggcggttaaggttgtcccggtggttaattttcccaccacctcttatcctgaccactctcacggtatctactcccaacctaggctcaggccgctagtcaactggatcaggcgcacgctcagtgcnntnacgttatggtaccaatgcggcttaatggtaactncaaccaaaattagcccaanaggnaattctttcgaccgnngg

SEQ ID NO: 21010 - DNA, 682 bp, Triticum aestivum
  unsure (1)..(682): unsure at all n locations
  Clone ID: PAT_TA_21010
caaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaaggagaagcagtttgcagctgaagagatctcctccatggttcttaatcaagatgcgtgaaattgctgaagcttaccttggtagcacgatcaagaatgctgtggtcacagtccctgcctacttcaatgactcacagaggcaggccacaaaggatgctggggggattgctggcttaatgtgctgcgtatcatcaacgcgcaacagctgcagctatcgcctatcgtcttgaaaacaacgtctatcggcgtgcgtgagtcccccgtcctccgccgtcgttggaggcaangngancactggggngcttnaagggcacatcccn

SEQ ID NO: 21011 - DNA, 876 bp, Triticum aestivum
  Clone ID: PAT_TA_21011
gaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgttgtttcaacaatcgccagccctatctttgggtgcagtcattggtacaaaccatcagggcacagcagctgcagcaactcgtgctacctgtgatcaaccaagtagctctggcaaactttctccctactctcagcaacaacaatttcttccattcaaccaactgtctacactgaaccgtgctgcttatttgcagcaacaactattaccattcagccagctagctactgcctactctcagcaacaacaacttcttccatttaaccaattggccgcactgaaccccgctgcttatttgcagcagcaaatactactaccatttaaccagctagctgcagcaagccgtgcttccttcttgacacagcaacagttgctgcctttctaccagcagtttgcggctaaccccgcaaccctcttacaactacaacaattgttgccctttgtccaacttgctttgacaaacccagcagcctcctaccaacaacacatcattggtggtgccctcttttagattgcttattagttgtaattcaataataaattttttggatgatgtatgtggccaaccagaaataagaagtacattccaagatttaatgtgaaaaaaaaaaaa

SEQ ID NO: 21012 - DNA, 767 bp, Triticum aestivum
  unsure (1)..(767): unsure at all n locations
  Clone ID: PAT_TA_21012
caacgacaccaccatgtcgtctgtccaggaggagcttaataacacacaggacatgctccaaggttacgtggagctctacaattacagtctctcctacgtgaagaccatggcgatcgggtgcgcgatccagctaggcatccctagcgccatccaccgccgaggtggggcagcaacaatctcggacatcatcaccgagaccggcgtcgacccgtcgaagctcccgtatctccgacggctcatgcgcgtgcttaccgtctccagcatcttggccaccacaggcacagacgagactgagactgagagcgacgacagtactgtttacaagctcactccggcgtcccgcctcctcgtaagcggcgcgggggcaccgacctcgtgcgacatatcgccgatgctggaccttctgatgcgccccactacgtcggtcgccacctacttcagcctggaagagtggttcaaggacgccgggcgccacccgccacgctcttcgaggtgggcgcacggcatgtccccgtggagcttgacgaagaacgacgcgctgtacaacaagaccttgaacgacgggtgcgccggcggacagcaccttcccccatggacacgccccttgagagaccccccgccgccgggtatattccgcgcggtcccgtcgcccgtgcacttcggcggcgcgcaacggcgccgctgcgatggcatccctaaggcttcccgcaatcccggcgctgctntgcccaagggggggggccccgtaccaattcncctanaatgat

SEQ ID NO: 21013 - DNA, 627 bp, Triticum aestivum
  unsure (1)..(627): unsure at all n locations
  Clone ID: PAT_TA_21013
gccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacaagaagctgtgcagcctgctcgatgagtacaccaaggtgctcatcgccctggccgacaacgtcggttccaagcagctccaaggacatccgccggggcctcaaggggcgactccgtggtgctcatggggaaagaacacgctcatcaagcgttgcatcaaggtgtacgccgagaagaccggtaacacacctttgacccgctcatggactcctggtcggcaacttaggcctcatcttcaccaagggagacctcaaggaggtgccccaggaggtccccaagtacaaggtgggggctcctgcccgtgttggcctggttgctccacttcatgttgttgtgcccctggaacacgggtggtccgcccaaacctccctcaagagccagcaaccccaacacgactggaccgtacaaggtatcctgccctccttcgatggcaagggggacccccgnccgcctcagtacatttaaagag

SEQ ID NO: 21014 - DNA, 513 bp, Triticum aestivum
  unsure (1)..(513): unsure at all n locations
  Clone ID: PAT_TA_21014
ttttttttttttttttgaagtaaccatgagaggacagatctagaatagcgcagttcaattatgcagttccaaagggtacacaaggatgattcaggtaaatgactactctgtgcacatacgcaggagatgatgatatacaaacgatgcactggagctagaataccaaaacgagatggtaaaatggcaatagctttaaaagatcaacagcattcagtacgacaagcatccaggtgcattgaaagtcaaaacactaggcagatgaagacttgacagtggcagacttgatgatgtccacgaattcaggcttcaatgaggctccaccaacaaggaatccatcaacatctggttgagctgcaagttctttgcaagttagctccatttacagaccctccataaattatccttgtcaatttcaggcaactgcagggctaacatgtgagtgggagccacttctttcagaccatcatgaaccncctgagggcccaaggggggggcccggtaccatttcgccta

SEQ ID NO: 21015 - DNA, 714 bp, Triticum aestivum
  Clone ID: PAT_TA_21015
cccgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccggagagcttccccgagttaaagcctgaggaggttgctggtatcataaaggactttgatgaacctggatactcttgcaccaactggctcttttctgttggaggtacaaagtacatggtgatccaaggtgaacctggagttgtcatccagaggaaagaagggcactgggggcattactatcaagaaaaccggcatgtcctttgattattggctgtctacgacgagccaatgacgcccaggcaatgcagctggggggtgggcgaggcgctggcgattacctgacacgggctagaattctgtaatattcctctatgtgccatttgggacttttggttgaccaactttgcgccctgtatggtctgggctcgtgcccgtccttggtgtacttcatgcaggtgattaatttatcttcgcgttgggttggtgacaatgttgggaacggatttgaattggggtttatgcttgccatctcctcatatctcgaactcagctgctgtttcactgagtaatgtacatttccctgggtaaaaaaaaaaaa

SEQ ID NO: 21016 - DNA, 759 bp, Triticum aestivum
  unsure (1)..(759): unsure at all n locations
  Clone ID: PAT_TA_21016
tttttttttttttttttcgggtcgttccctccgcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttgggcatcagaggccatcatcaagcagattccccgtctccttggtcctgggtctcaacaaggcaggcaagttcccgaccctggttactcaccaggaatccctcgggggggggcccggcgcccctttcgcctccgtcaacttcctacgccgctcggtcgccgcatgggtgtcgccggtggcaacntnggcnatggaggagaagcagtcaacagacatccagatgangtcaactccttgttcccttctgaagaaaacggcagaattgaatgctctactcaagacacatggggaancatanaggggttcaataagccctttgnaatccgcaagtccggaccaggtttatgaataacttgtaaaatagttttggc

SEQ ID NO: 21017 - DNA, 622 bp, Triticum aestivum
  Clone ID: PAT_TA_21017
gttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcaatcagtcagttgcgtgccatggcatgctctgagtctgagatgatgatatggctgatggcggcctcgtgtccctcccctggcctcctggggcgcttctggcgagcaatgtgttgtgttgtgtgggtgcccaccctacagctaaccatgtgccctgctgtgttgtgtcaccatccatctataatcttatccatacccaaaaatttgtgtgaaaaaaaaaaaaaaaaactcga

SEQ ID NO: 21018 - DNA, 568 bp, Triticum aestivum
  unsure (1)..(568): unsure at all n locations
  Clone ID: PAT_TA_21018
cgctatttatgccactccgggtgctgttgaccgggaagcttcacggacctgccatggacagtaccgtaatcctcgtgcacaaagcaggcacctctggtncggtggccccccagtctggtttcgtgggtcctcgccgaaaggttcaagatcnctgaaagaggtggactgggagtcactgcagaagcagcaagagtcccccggttgaatctgcggttcccgcagcttcgtaaattttgtagggaatccaaaacaaatataatgtgagtgagcgatggttttttactcttttctttatttatgcgtgtaatgaattttgaggatatgtgctccatcttgctgtactttttgtaggttgtgttgcctatttcttccgttgctgggaacacataggacacgtcttgtaagatgtacgattagtttggcgcttaataaagtgtttttcnggttccatagtacactttgatgcttcaactnccaatatttgntgatntactccnaaaaaaaaaaaaaaaaaaaaaaaaaaaaaaaaaaaaaaaaaaaaaaaaaaaaaaaaaacctgcccgggcgg

SEQ ID NO: 21019 - DNA, 764 bp, Triticum aestivum
  unsure (1)..(764): unsure at all n locations
  Clone ID: PAT_TA_21019
cagagatatgcgggcaaccaggaaaggatacagctagagactgctcggttatacaggcaagctggtgtcaaccctttagcaggatgttttccaacattggcaacaatacctgtatggattggtctttaccaggcactttcaaatgtagcaaatgaggggctattgacagaaggatttttctggattccatcactgggtggtcctacaacaattgcagctcggcaaagtggtgctgggatttcgtggctcttcccatttgtggatggccatcctccgctaggctggtatgacacgatatgctaccttgtattgcctgtgctacttgttgcttctcaatatgtctctatggagatcatgaacccacctcagagtgatgacccgtcacagaagaacacactcctcgttttgaaatttcttccatttatgattggctatttctctttgtcagtgccatcaggattgtccatttattgggttcacaaacaatgtcctcagcacagcacagcaggtttgggtgcggaaaatgggaggagccaagcctgtagtgagtgagggggataggaggataattacagcaggacgagcaaaacgctctaatgctcaaccagctgggagaaaggtttaggcaagctaaaagaagaggagagcatgagaaaatcaacaaacatcgctgcaggagaccaaatgcatcgtcatcaacgtatgacatggaggatgaagatccggtgacagacnagaanaaggaaggccctngaggaacatcn

SEQ ID NO: 21020 - DNA, 636 bp, Triticum aestivum
  unsure (1)..(636): unsure at all n locations
  Clone ID: PAT_TA_21020
gaaaaatccccagttctttggtccgcgncagngaggcggcggcgatgtcngggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgctgcaatagctgtgtaatccatcgcttctgcaatgaagcgctttgaagcatgctacgtatgttgtgtctgtgggtgattgtatttctggtagtaacagtgattcttcctgaattttggataatacaagctcattccagtagttccgaaaaaaatcatgtcttacccctgggggccggtaccaatcacccaaantgancctatacccg

SEQ ID NO: 21021 - DNA, 731 bp, Triticum aestivum
  unsure (1)..(731): unsure at all n locations
  Clone ID: PAT_TA_21021
aaacaacctcctctttcctttccatccatcggaccatcgatcacaattttcatggcggtcaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaggacctgtcggtgctgtgcctgaacgtgacgccgccggcgtccacgtacctgttcacgacgatgcaggcgacggtggcggcgcgcaacccgaacgagcgcgtgggcgtgtactacgaccaggcggacgcgtacgcggagtacaagggcgtggcgatcacggtgccgacgcggctgcccgtgcagtaccaggggccccgggacgcgtccgtgtggtccccgttcctgcgcgccccggaaggcggcgtgcagctcccgccgcagctggccgtggcgctggcgcaggacgagacggcgggctacgtgctcgtcgacgtccgcgtcgacggctgggtccgctggaaggtcggtaccagctggatcttcgggtcactaaccacctccgcgtcaactgccccgcgctgctcaaccgtcaacgacggcaaggggcagctaacggcgccaacaaccggcggcggcaccggatacttccgctttcaagcaggcancggcattcgccgtaaactcaacagtctctn

SEQ ID NO: 21022 - DNA, 401 bp, Triticum aestivum
  unsure (1)..(401): unsure at all n locations
  Clone ID: PAT_TA_21022
aactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctgggggcaggagtgatgagccgtactgggtgcgctggtgcctttctgaccggcgccgtggtgtttgttcgtgattcgtaataaacctgattgcctagctgtacgtgaggctgttccttcggtcctggtactgtccctgcagcatgcatagcagtggaccagttggtgataaataagttactgtgcttttcgaacgaatgaaccctttttttgggtcccaaaaaaaaaaanaaaaaaaacggnancnggggggg

SEQ ID NO: 21023 - DNA, 628 bp, Triticum aestivum
  unsure (1)..(628): unsure at all n locations
  Clone ID: PAT_TA_21023
cggtctctctccgcctaagctttcctcctcgcctcctccgcttccacctaattcgcgcgcgcctccgggcttcctccgctcctctcccgccgtccctccagcgaggagtgagggcgggcgggcgggacgacccaggcggcggcggcgtcatggaggcagcggagagaggcggcggggcactgccgcttgccgtgcgggagctcatcgccggcggggtcgccggtggcgtcgccaggtccgccgtggcgccgctcgagcgcgtcaagatcctcctccagactagaagagcagaattccgtgggtctggattggttggatcgtttcggacaatctatcagacagaaggtcccttggggttttacaggggcaatggtgccagcgttgctaggatcgttccttatgcagctttgcattacatggcatacgaagagtatcgccgatggatcattcttggttttcctaatgttcagcaagggcctgttcttgatctagtggccggatcaattgctggaggaacagcagtcgtgtccacatatccgcttgatctggttcgcacaaagatggcttatcagctgcaggttaaagatgcagtgaacctcagtttaagagtgccctctgaacnnnnnnn

SEQ ID NO: 21024 - DNA, 674 bp, Triticum aestivum
  unsure (1)..(674): unsure at all n locations
  Clone ID: PAT_TA_21024
ctcatccgtcgccccacggaagtctcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccgggaggcaacaagaccaagacccctggacctgggtgcccaatctgccctcaaggcgcttgctcgttccgggatgaaaatcggacgcattgaggacgttacccggtcccaacggccaaatcccaaaaaaggggggggagggagggctggcgcccccccctgatttccgcnctggcggtggcatanaacaaccnccnggtgggtgcgtcgtttgcaaacacttatttccangggtccntactaccaacaanattcaggaantttgngagaatgcccattt

SEQ ID NO: 21025 - DNA, 659 bp, Triticum aestivum
  unsure (1)..(659): unsure at all n locations
  Clone ID: PAT_TA_21025
gttcaactcgtttattgtcaatggtcttgatgaggagtatgacgccctagtcgagatcatcaatgagaggggcaactccacgcccatgccagcacacgaggtcttttcacgcctcctgcttactgagcaacgagtcgagacgcgccgatccaggggcaacggcgccctctccggcaaacgccgccaccaagggtgggtccgctcctctgcttcatccaagggctccttcggggcaagtcaccaccacccgcctcggcccctcctcctaactgcgactctaccaaggggctgggcggtccacgtgtgtgccagctttgtgggtcgcgatggggcactgggcctcgaagtgtcacaaagcgcttccagcggggtttccttgggcctccggcaatgacgggaaaggtacacgcaactttgctccgtcaggtccccatggctgatcgtccgccgccgcagaagccacagggacacactcagtcctacttccatggatcctcacgggtacatggactctgggggcgacagagcccctcaccggggtggggantnanatcgtgaactacatggtcnacaagtcaaacgcaaggggaagatgnatcccaaatggcagataatccatacatcaaagngctcaatcaaagtctcntcacgnaacaact

SEQ ID NO: 21026 - DNA, 643 bp, Triticum aestivum
  unsure (1)..(643): unsure at all n locations
  Clone ID: PAT_TA_21026
tcctacctacgcagcagaggccagccacctccccgtcgctctcacgctcttcgtgcccgccgcctctcctccgtctctgcctctctccctctcccctcccgtctgacgcacatggcctccatcgccggatcttcggccctctccttcgccaggcccgtcaaggcaatcaacacaaattctctagctttctccccggcgaggaagggcaacacattcctccgcctgcaaccaatgcctatgagatctgtttcctgcgctgccaagaaggatacaacagacaaggtttgtgagattgtgaagaagcagttgctcttcctgaccatactgaagtttgcggtgaatcgaaattctctgaactcggtgcagattcactgggacacggttgagattgtgatgagtctcgaggagcacttcgatattagcgtggaggagtccagcgcacaaacaatcgccacagttgaagacccgcggacctcatcgacaagcttgttgctgggaaagcgtacttctgtacctcctctcccctgtcctaacagccggagctgctcccacgccgtgcatccgtctttacgccngggttgcgccctttcaaaaacaaantttacggtnanatanggggtacannaacgttggtaaaaaaaaa

SEQ ID NO: 21027 - DNA, 606 bp, Triticum aestivum
  unsure (1)..(606): unsure at all n locations
  Clone ID: PAT_TA_21027
cgcaaacgccaaacggccggcacacaactacacaagccgctggcaaagatggcctcctccttggtcctcatcgcagcggccctgcttgcgctggcctcgtcgtggcagcaggccatcgcctacgatcctagccccctccaggacttctgtgtcgcagacaagaactcgcctgttcgcgtcaacgggttcccttgcaaggacccgatggcggtcaccccggacgacttcttcaacgcggcgatgatcatcgacaagcggagggacacgaacaacaaggtggggtccaacgtcaccaacgtgaacgtggagagcttcccggggctgaacacgctgggcatctcgctggcgcgcatcgactacgcgccgctcggggtgaaccgccgcaatcaaccacgcgctaccgagctgctcaccgtgctcgagggcacctctacctcggcttcgtcacgtccaacccaacgctctctcaaggtggtcaaaaanggcgactctcctcttccaaggcatgatcactccagtgaactnacacaaaacccccgcgggctcctcctaaagcanacctgggtatacatccaagcgtttggtcancgcattggcantctggaa

SEQ ID NO: 21028 - DNA, 347 bp, Triticum aestivum
  Clone ID: PAT_TA_21028
ctctcccttcctctcctccgcttccatccctgggctgtgcgctactactccccctgctggccgctgctctgctctcacgcatgttttcacatccaagcgcctgcccctcgccctcgccgccacagtggtaacccgatccatgccgggcggcggccgctgacttgctgctgttggcttcaacggccgcaggcaaaggtcgtcatcgctttccggcagcccgtttcattgggaaagcgacgacgaggcgaggcgaggcgacggccgcgccctgccccagccgtgccgcactaaccgagtaaccgaccgacgcttgccgttgcagccccaccacgcgcaaaaaaaaaaaa

SEQ ID NO: 21029 - DNA, 386 bp, Triticum aestivum
  Clone ID: PAT_TA_21029
gtagcttatgatcaaacacatgatcatcaatgtctcacagataatagcatagtatctcaagcaagcaaaagcaaacaaagttcaaccacgaagacaagagagaacaaaagcaaactctctctctctctctcgaagcctatgatctatacatttttctccccctttggcagcaagttaccaaaaagttcatagaaaatgcatagtactatatcgtctctcgggcttggtcctcagttggtgggtgtagagatggctcctaggacgaagactttagttgatgtggatggagctgaaggagttggtgctggagctggttgcacttgagctatagttggtgcagatgaagtggctctggtgtctttcactgggctctgcagctgatctct

SEQ ID NO: 21030 - DNA, 652 bp, Triticum aestivum
  unsure (1)..(652): unsure at all n locations
  Clone ID: PAT_TA_21030
aaaatgctgaggagattgagacgtatcagcggtataagtaccctactatgagcaaaacacagggaaatttcaagcttactgttgttgagggtgaatttactgattcccagattgttgttatgcttggtgaaaacgggacagggaaaactacattcatcagaatgctggctgggttgttgaagccagacacggtggaaggaactgatattgaaatccctgaattccaatgtgtccgtacaagccccaaaagattaccccgaaatcccagaataccgtngaggcatttggctgcatccaagaaattccgggattccctatatgcatccgcagtttgtgtcctgatgtggatgaaaccactggcaaattngaacaactccatggaccaagaggttgttaatttatcaagggggagagctcccaaagagttgctatatgcctccgccttggggagcctgcagatacctaccctgattgatgaaccaagtgcttatcttgattcggggcagcgtattgttgcctcaaaagttaccaagagtcatcctcacgncaagaaacgcattatgttggcatgttcacatgggaacatactgctgcaaggcatgttatagggggacttcatgacgtacgcaagcacaaancttanaccggtana

SEQ ID NO: 21031 - DNA, 583 bp, Triticum aestivum
  unsure (1)..(583): unsure at all n locations
  Clone ID: PAT_TA_21031
agcttcctcatggggtggctccgctccctcttctcccctctgaggaagatcatggtccgcgcgcattcggcgcgcaaataccggagggggatgaggatcctgtacaaggacgtcaagtcctgcgaggacgaagatgtgcacgtcctgtggtccatcctggtcgactcgcaccgccacccggccatggtgaagctgaagctctaggacggccatggcggcggcgcgcggttttcgccgtcgagccgccggccatcatctttcgtgtggaactgcacagtttcaatggcaatgccgtctgggaaaagacgagcagatactttccttgtgtgtgtgcgtgtgtgacaccagtctgatgtgtgcatcttgtgactttgtgggtgaggttgagacgtcgcctttgctttgatgtgagtgtgaggttgagctgatgtatctgtatatagagaaagctctgggtgccttacctaatgggtattgatttgggttccttttcaaaaaaaaaaaacaatccanaattccccggttgaacttgggtgcttgttgggtgtttgcgcttcaattgttgggggananttgaataaaa

SEQ ID NO: 21032 - DNA, 700 bp, Triticum aestivum
  unsure (1)..(700): unsure at all n locations
  Clone ID: PAT_TA_21032
gtaaatgatagaagagaggctctccttacagcaagcagacacgccctaatgagaggggtgactactgttgttgatgttggaagttatttccctgggacctcagaagaacaaacttggcaagatttttcagatgtctatgaatgggctcattctatgggaaagatgatgattagagtctgcttattcttcccaatgccgacatggcctcgtgtttctgatcttattcatgaaagaaatcgatccttaagtgggtggattcatctaggtggtgtgaaagcttttcttgatggttctttgggtttgtcaagtgcatggttctatgagccttatgaggatgctcctggcgattatgggctagtgttagtagatttagatgttctgctcaatgcaacattagaatcaaatgcatccttttttcggctaaagctacatgcatacgcagttttagcctcatacatggaatgtgatacatcatggtactagtttgtattgatctggttatgtataaaggaaaccaatatgattagcccgatcagtctctgtttctgcaagaaactgtaaattgagaaaggttgtgtcagcaagtgcattcaaaattacatcttantacactgatatttcatatctacaccatactttttatggaatagatgcacatcatattgttatctagagggttgatatttaccactaaatcttc

SEQ ID NO: 21033 - DNA, 656 bp, Triticum aestivum
  unsure (1)..(656): unsure at all n locations
  Clone ID: PAT_TA_21033
cttatgctcttcgaggcggccgagagactccctctcctgcaggtagggcaaatataccagaagtttgagtgcaagggtcggtcagatggtggaattgtgcggaatgtcgtgcgttggagcatcgagaacttgctggaggagcaagagggtgcaacactgatggtctctgcaaaatttgatgttctgtctaagcgcaacatatttcttcagttcgaggaggttgctgtagagaatatcaagattagtgagcagctacaagcactgatacctcctgctatactccctcggtcttttttgagccttcagatattgcagttccctaaaactttccgagctcaacctcctagcagcacccccgaaagacgatcacctgggaggactatacttcttccttaccttgaccgtgacatgctccctggggcgttcaattggcggcgtggtgttttatttcacaagagaccaacccctgttataaggttccaattccatgggtgtgttgtanattaaatgatggtataatgggctactcataattagtatgtgaaaccgatacgtcattcactatgcatcactcgctccgtgcanaaatntttgtncagntcggtataaaaaaannaaaaaaaaagggggcgacaattccaanntcatacnccagg

SEQ ID NO: 21034 - DNA, 497 bp, Triticum aestivum
  Clone ID: PAT_TA_21034
cttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaaagtactgcagttggtggttgtttctggtcctgtggtcttgcaggcctgatgcttttgcttgtttgtgcccattgttttttttgcccaaaaaaaaaaaaaaaaaaaaaaaaaaaac

SEQ ID NO: 21035 - DNA, 387 bp, Triticum aestivum
  Clone ID: PAT_TA_21035
ccatcctccaggcaatacgtgatgaatcaatgtatgatccacgggaaagaattgagatggcacagaggcagtctctttaccggccatctcttcttggcctgcctaaagctgatgcgaaggcctaagatatggtgtttcatcctacctgatgagagcttgcaggagccaggaggcgcttactggtcttcaagatccttacgtgcctcagatgtgtgttgtgtcatgcgtgtacactaatacactatagagttgggtgatggcatatttagcatgccaggataaactttattgcccgtgtctgaaatacaagctgttgtgattcaaatttatttgtcacttagactggagtaaagatgtgtatgccttttttttgggataaaaaaaaaa

SEQ ID NO: 21036 - DNA, 531 bp, Triticum aestivum
  unsure (1)..(531): unsure at all n locations
  Clone ID: PAT_TA_21036
ggatctcttatggatattgttaaagtctatccacttgatgctgtctacgattcccctgatgatgttcctgaagatgtcaaatcgaacaaaagatatgcaggggcatcaaactggacagtaaaggaagttgttgaatcagtgaggaatgattttggcagcattgacatactaagtgcattctcttgctaatggcccagaggtaacgaagcctttgttgggaaacctcaagaagaggctatcttgcggcaatttctgcatccagttactcctatgtttcattgcttcagcacttccttcccaataatgatcccggttggtgctagcatctcctctaacatacattgcatcctgaggcgggcctggcccgggtgggtggtggctctagtttgccctgaggcgaccccgggncttcattcgccgggcttgcgttcaaagcttcgcgttaagaggccctggggcacacatatcagctgcctctggggacccgctgctaagnnattggnttatgagaaaatattgannccaaatntt

SEQ ID NO: 21037 - DNA, 624 bp, Triticum aestivum
  unsure (1)..(624): unsure at all n locations
  Clone ID: PAT_TA_21037
cgacgcttcgtcttcgtctgtccaccaaccagaccaacctccggccacgggctcacggcggcgagcggccccagctccgatggcgccaacggttgagatcagccacctcaccttcacctaccccggcatcgacggccgcccgccacccggcgcgccaccgctcatcgaggacgtctgcttctccctcgacgccggccaacgatgccccccccgcggctccggcggcgcaggcgagacgtcgatactgaagatactaagcgggaagcacatggtggtnccgagcatggtgcgggtcctgggaaggtccgccttccacgacacggcactcacctcctccggcgacctctcctatctcggcggtgagtnggagacccacgtggctttgctggctacaagtgaacattcagatggatatatccgcananaagatgattttggtattctggtgttngtncaaagaggagagacagctttcaaattttagacatcgactcactggcgcancacaagnancagatggncaaggaactgtccaatttnaagggantctaagcatnangtctctctganaattaantatctgagtcngaaatnaacgtnccttcctaaaggantngaaaaggg

SEQ ID NO: 21038 - DNA, 670 bp, Triticum aestivum
  unsure (1)..(670): unsure at all n locations
  Clone ID: PAT_TA_21038
gacgagactcgcagctagctgacacggccgagaagcagcttgcattgcaggcgtagtacgtacccagcagcagctagcactagcagtccatcggagcgacgatggtgagaaggacggtgctggcggcgctgctggtggccgccgccctcgccggcggcgcgcgggcgcagctcaaggaggggttctacgactactcctgcccacaggcggagaagatcgtcaaggactacgtgaaggcgcacatcccccacgcgcccgacgtcgcctccaccctgctccgcacccacttccacgactgcttcgtcaaggggctgcgacgcgtcagtgctgctcaaacgccgacgggcggcagcgaggcggagaaggacgccggcgcccaacctgacgctgcgcggttcggttcatcgaccgcatcaaggcgtgctccaagaaggatgccccggcttgttcctgcgccgaatctcgcgctcgccgccggcgatccctccgggtcatccgcgtccttctggacctgcgacgggaagcccacggacgtgccataaacaggagggtggcaattccgcgccacatgatttacaatctcatcctcagaaaaacctaactcccactctcggttaagggcaaatggtttncancaancttacaggccnaantangggcggccaaacgg

SEQ ID NO: 21039 - DNA, 1197 bp, Triticum aestivum
  Clone ID: PAT_TA_21039
cgaaccacaaacaatcatatcctaggcttaaccctgaaggttgatttacacgctagtggctgtgccccgatctgcggggagagacatgtctgtgcagtgcaccgcaaactcactccgggctcttgctgccctcccggcgccatccccctcccgccgcctggcgagaaatgaattccttatgccatgccgcccgagtcgcaccggtgcgctggtccgagctgcggattcttcgcctcctgccgcacccgcgtcatcgtccggagcagccgacgacaaggccgtcatccccgacgatgagttcaccctcgccaaggtgtcttttggcgtgattggactagggataggtggctccctcttgtcgtatggatttggggcgtatttcaatcttctccctggttcgggagtggtctgctctgatgctaacctacggatttcctctcacaatcataggcatggccttaaagtatgctgaactgaaaccagtgccctgcataacctactctgatgctttcgctctaagagagaagtgtgctacccctatcctcaagcaggtcaggagtgatgttacacgttatagatatggtgatgagcagcatctcgatgaagcgctaaagcggatctttcaatatggtttgggtggcggcattccaagacgtagtgcacctatattacaaaagattcaagaagtaactgatgatgggaaatactgtttagtacttggaattcgaagcccaaatcgttggcagctatcagattttgagaagagggcaggcaaaattcacctcctttttcggtcctggaattaaggctgaaattggaaaaggtggtgacgacctatatgaagtgcgtcttatctcggagaccacagaggaagagtgacagcgtttgcaatcctattatctgctaatatacaacaaaatgatatttatttcttttccccactaatttgcatatataacgttattattgtaatatactcagtatataattttgcttttgagctttgtatgtagttccaaatctagcatcgtatgttccatgcaaagcatacaaaaaaggctattgtaataaagatgtaaattgacttgattggcaaacatagggaatagtagtagttgcaacattttctgtagaaaaaaaaatactcatcacacgaaacactcgagcctacctcgctccctcgtgcccctgcacaca

SEQ ID NO: 21040 - DNA, 578 bp, Triticum aestivum
  unsure (1)..(578): unsure at all n locations
  Clone ID: PAT_TA_21040
cccgtaccccgcctcccggttcaaccaaatccctctcgcctcatccccaccagcgcaaaagccgccctatcgtcctgtcgtgagaagcaatggcgggccgtggcaaggcgattggcgctggtgccgcgaagaaggcaacgtcaaggagctccaaggctgggctgcagtttcccgtcggcaggatcgctcggttcctcaaggccggcaagtacgccgagcgcgtgggcgccggcgcccctgtctacctcgcaagctgtcctcgagtacctcgccgctgaggtcctggagcttgctggggaacgcagcgagggataacaagaagacccgcatcgtgccgcgtcacatcaagctcgccgtgccaacgacgaggagctgacaaactgcttggtggtccacatctcnaacggcggcttatcccaacatccacaanactcctcccaanaagntggtcgtcaaagnttcaccgtcatgacgatacactgaactgccanggaaangatccnacgtctgttccaggttaacaccattaccccattcttgaaaattcattnttggaagaaaattcttctgnccaattt

SEQ ID NO: 21041 - DNA, 595 bp, Triticum aestivum
  unsure (1)..(595): unsure at all n locations
  Clone ID: PAT_TA_21041
gccggcgcctccacttcgcgttctcgcctcatctcctcccgctcaggatccggcggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgtaaggccttcaggaagatccatgtcaggatcgtcagggacctggagaagaaattcagcggcaaggatgtggtaattgttgccacaaggagatctgaggccgcccaagaagggttcaactgttcaacgccctcgcacaagaatctgactgctgtcaatgatggcatcctggaggatgttgtctccactctatgtgggaacgttcagtacctcggacgggcaagatgctgctctctggccaaagatgctcgcacccatacactggccctcacacgtcaccgccggcgctaaattccgttgcccagggctgtggtaan

SEQ ID NO: 21042 - DNA, 559 bp, Triticum aestivum
  unsure (1)..(559): unsure at all n locations
  Clone ID: PAT_TA_21042
caccgctcctgagtcctgtccaccctgccaccgccgacgccgcgccgccgcagcaattgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccggcggcgtctgaccaagaacaactctctctgaagaccgagagggaaaagaagcgtgagaagtactccccatgaggaatatctatcaaggctacgcaaaccgtgagtgctccttacatanatcggtgtgtttaattttgggttgtatggaattgcntggtcggaatacaagtatccccattcaaaaatggcaaatggtgacngnaaaaaaaaaaaa

SEQ ID NO: 21043 - DNA, 693 bp, Triticum aestivum
  unsure (1)..(693): unsure at all n locations
  Clone ID: PAT_TA_21043
agtccccgccccgaatcttttccctcctcccgcaccccaggccgcagcagcagcaccggcgcaccgccacccactcgccccgcctccgtgcccgcgcaactcgcgcctgcagcgtgtgggagatgtgatcggagcccggccgtcggttcgagtgttttcttctgcctctgggctgtggcgcggggaggaggcaagctggcggtgagatgggtcggtgcggaggaggaagcggagcagagagcaggagggggagctttgggcggctgtgctctcctcaccgccgccttggttatctcaacgctcgtgatccagggcgctggaggatctaagcaatctcatgcacctgctgttgctcgcaaagttcttctatccataacgaattggcaccacacaattacttggatgatgtactcatccatcacaagttcaagataaaggtccaacttttggcaagatcccatcatttttactggcaatgacttcaaatctcatctccgtaagtaccgcgcttgcatccctcantaacatatcgctcancnaaattgctanatcaacgctgacctcttcaaannacctggtgnatactcacgccttccgaatggcaaaatnaatcacantccaaaaacnttacacnaatgaggtttganccattnancttaatttcnacagaancgaaannatgaancagancat

SEQ ID NO: 21044 - DNA, 476 bp, Triticum aestivum
  unsure (1)..(476): unsure at all n locations
  Clone ID: PAT_TA_21044
acaatatgagacgcaagaggaagctagtgccgctgttaagaacactgacaagagcaccatattggacagggtagtgaccgttgaatatgccttccgggatgatgacggcgatagagatgaccgatacgacatccccaaacaaggtgcttatgacaggcgtggtggtagcccctacatgcgctcacctagcccaaggtacccanagggactacggcccagattatggtccgcgtggaacgttactctgggctatggtccccgtgatgggagcaatgtatgaaaaggcgaagcctgtatatnatcgctaacngcggggcaaaanccccttatnattcgctattacaggggagaagccccgttttatnnatatagtcantcaatntttgggaccnntaaggagtattttccaaggaaaagttgggagcaaaanttantttttcaacccaagttaactttaggagcctggtnttcaaaaa

SEQ ID NO: 21045 - DNA, 637 bp, Triticum aestivum
  unsure (1)..(637): unsure at all n locations
  Clone ID: PAT_TA_21045
cttaacatgtcaactctgacatggtcagtggttagcactgcggaaggacgagttccccttgccagtgagggcatgactctagtgcatagcaattacaatggatacgattatctcatctcatttggaggatacaatggacgatacagcaatgaggtttatacacttagcctcaaatcagattttaagtccaccacaaaagaagaaactgtctcagatctagggtcgtcgaaccagaggttgaaatgggtgattggcgtggacagtgctgatccagacctgaagaacagtagtacagtactgatgaagcaagtgaacagtccttaagcactctccaaagctgagaaagaggaactagaagcgacacttaacagggaacagctgcaaactgtacaactttaaagatacattgctcaagcaagatccaaaatgtgggacccacaaaggacttcaagcgtccgtggccaatttccgctgacatcaagagttcaaacttaagccatgttgcggactacgacagaactcaaagtaggatcaatggaaaggagtcnaactgctcacgacaaaagcccgcagacaacaacgctgaccaaacaacggaagttctgggcattgactgcnctgganccnccgnaaatct

SEQ ID NO: 21046 - DNA, 696 bp, Triticum aestivum
  unsure (1)..(696): unsure at all n locations
  Clone ID: PAT_TA_21046
ctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctgaggaacaagagcgagctgctcctccgcgccaacccggtgcacaagaagatccccgtgctgctgcacgacggccgccccgtctgcgagtccctcgtcatcgtgcagtacctcgacgaggcgttcccggaggcggcgccggcgctgctccccgccgacccctacgcgcgcgcgcaagcccgcttctgggcggactacgtcgacaagaactgtacgactgcggcacccggctgtggaactcaagggggacggcaagcgcaagcgccgccgagatggtcgaaatctccgcacctggagggccgctcggcgacggccttctccgtgggaccctcggttctcacttcccccggcctagatccgggccccccgacacgctggggggtcgcttgaaagccaccggccctgccccccgccccccgcccacnctcgtccatcacccccccctaagtttacggaaaaagggggncntnaacatg

SEQ ID NO: 21047 - DNA, 458 bp, Triticum aestivum
  Clone ID: PAT_TA_21047
cgcggccgcgtcgacccaaagcagacaccacacccaccattctccagcagagcagcgcaggcaccacaccgctcgtcgtcggcgggatggacggtgccgcagccacctggacgccccggaagcaggtggtgctgtacccatcgcccggcatgggccacctggtctccatggttgagctcggcaaggtcctcgcggctcgcggcctcgccatcaccatcgtcatcgtgagcctgccgttcgtcgacaccggggccagggggccgttcctggccggcgtcaccgcggccaatccctccgtctccttccactgcttcccgcaggtcgaggtcccgccgctcgactccgaccaccccgaggcggtcacctacgaggtcgccggcctctccgtcccgcacctccgcggcttcctcgccggcgcctcccccactgtccctcgcgtcgacttcttctgcagcatc

SEQ ID NO: 21048 - DNA, 418 bp, Triticum aestivum
  Clone ID: PAT_TA_21048
cccgtccccggcccccgcccgctcgccgccgcgccccgcaccggcctccgcgccccggccccgcccctggtcccggcggcgcccatcgccgtcctctcggccgcggccccgcccctcgcgcccgccaccctcaacggcctcctctccgcctggcgcctccccaccgcgctcgacaccgtcggcgtgctcctcgtcttctcccactgcccctcggcgcccccgagcctcgcccgggccgcccactgcgccgtctggcccggcgctcccccttcgcaggcccggagcgccctcttggtctgcgagctcgggctggctcgagtcgtctctctcctgttctgcaaatcgtagctgacttcggagtgtgaagttttgttgctgtcacgagtaaaataaaaaacaaattttgcagtgaaaaaaa

SEQ ID NO: 21049 - DNA, 512 bp, Triticum aestivum
  unsure (1)..(512): unsure at all n locations
  Clone ID: PAT_TA_21049
gagacttcctccattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaaggagctcaaggaggccttccgcgtgttcgacaacgacccaggacggcttcatctctgctgctgggcttcgacatgtcatgaccaacctaggtgagaagctgacggacgaggaggtggatgagatgattcgtgaagccgacgtggaccgtgatggcagtnaactacgaggagttctgaaggtatatggcaagtgaga

SEQ ID NO: 21050 - DNA, 528 bp, Triticum aestivum
  unsure (1)..(528): unsure at all n locations
  Clone ID: PAT_TA_21050
ctcgtgccgcgatccttgagttgacgaaaacatacacagctgctagctaatcctgccgtgagtgcaatgcatgcgaagatgacgaagcccgcagccatcgttgttgctgctatcgccgtcctctccgtcagcctgctggctgggtcgtcgtgccttgcccttgcgcggcccagcggcgacttctccatcgtgggggctactcagaaggaagggacctgtcgtcgcacgagagcctggcggagacntgttcgagcgctggctgtcccgccaccgcaggcggtcgcccgcctggacggggagcgcccgcggttccaggtgttcaaggacaacctgcaaccacatcgacgagaccaaccgcaagtgaagcagctggggcgagaangggtacatccgcatgaggaggggcaccggcaagcgcaagggctctgggaatcaacaagatggcttcctanccaacaaaaactgaactcagatcatcattcatcgtaaagaacaactggctattactccattgctggggttcaagct

SEQ ID NO: 21051 - DNA, 521 bp, Triticum aestivum
  unsure (1)..(521): unsure at all n locations
  Clone ID: PAT_TA_21051
gggaggtgaagcacctgtgcctggccaagttcaaggacggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcctccgccgccgacctcgccgcctacatggcccacgacagccacaccgccttcgccgccaccttcatggccgccatcgacaaggtgctcgtcgtccgactccccgtcgtccgtcgccaacctccgccgccggcatgacccgctggcgtctcgcatccgccggcactgtacgctccccttctcaagtcgcgcagcaattccaacgtgtgcctgccgcggcggtgctggtagtactactagtactgtccatgcctgttattaacctcccatctatctatctatctatctatctaagtcaagtaantaactactattattgtttggttatctttcggaaaa

SEQ ID NO: 21052 - DNA, 502 bp, Triticum aestivum
  Clone ID: PAT_TA_21052
ctgtcgtgggatcccagccaccgccgctagaagaagagctcggcgattcccaggtcccgcgagaagatgccgaagcagatctatgagattaaggacttcctcctcaccgcgaggaggaaggatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgggttgaactacccaagcttctttatcagtagcagagcatgctactcatgtactttggaacctaagtattagacctgtcagtgttgggtgtgtggtcttgcattttgtggagaaataccaattactcgttcaaggatcacttcagtaaataaaaaaaactgcacatacttatattaagccgttcataccttccctaaaaaaaaaaaa

SEQ ID NO: 21053 - DNA, 627 bp, Triticum aestivum
  Clone ID: PAT_TA_21053
cggccgcaggcgaggcggagcgcgaccgacggctccgtggggctgccatccacggccgcctctgcgccttcccatcgctcgcgcgcatgtcgccgccgtcggaaaacaggaccgtgcgggtcgcttcctccttttcctcccgccggatctaaggcgtgcgtcgctggacgcgagcctctccggaggcggcggcaaagggtgaccacatggatcggtccctgctggagagagacgatgggagagagggagagcaggaaggagaggagggaggcccggcggcggacgggagagggtcaccgaccgaggccggcgaggtcaggtcccaccctggtggttggtggcggctcgatccactcctggatccttcttcttccacttccccactgcctaacacctgggaagagggctggcgaccgaagctatcgaggacgcagcatcttcattgaggtattcctgccagcctggcctgccccaggcccaccgccgccacgcccggggatgcatccagcccccctctttatcagcttccggtatcctgctggtgccaatggaggctcctcacgcctcctgccgccgccaccctccatcatgttgtagctcagccagaccacgaccatcgataggtga

SEQ ID NO: 21054 - DNA, 462 bp, Triticum aestivum
  Clone ID: PAT_TA_21054
gcttgtcggtgatcttccctgggattattttacctctatctgccggaagctcaaaatcatgaggggctctgatgctgttggaatagctccaagaaccatagagcagacaggtcagaacaaataagcttggtctttgcctgcacccacgcaagaaatctgagctagctggaaggccatgttgaaggcttaaatagttgctcggaattatcaaaagtcctcaaatgttaagtgtagtttccacgtgttcttgagacgtgtgtatttgtatgtccgtgatgtgatccgtcaggtctgttcttgtgcccttcaaagggcaaatcagggagctctcgtgcttcctgtgtatgcttgctttttccagtatccccggttatcctactatgaacctccccccgccccacgtggtctgatggttccgatgtcaagaaagctgtccgaatgtctccttttaaaaaaaaaaaa

SEQ ID NO: 21055 - DNA, 694 bp, Triticum aestivum
  unsure (1)..(694): unsure at all n locations
  Clone ID: PAT_TA_21055
gcaattcacttctaactgcaagcccggtgacaccgggccctgccgatgcccaaggaagattactacgccaatttcaacagctggaaggtaatggaggaccggccaatgctcaaggaggaggatggtggcaaagagggtgggggcggcgaggatcaagctataaccaagtgtgccggttgcgacgagatctacagcgctaacgacgggcacctatggattggctgcgaccactgtcagaggtggttccacggcaagtgtgttggcgtgactactgagatggcgaacggaatcgaggactacatgtgccctggttgcagctacaaagccacgacgaaagcttctgactcgatatagcggtgatgatgaaagcttccgactcgtgatggtggtgactggtgatgcttgaaccatgggaaatctctcatttcccaacgatgctgtttgctccgctgttgcgttatcttggtgacatgttaggattttggctggtgatggggacaggaggtggctttgtacaggccgttggcttgggttcaaacatcccaatgtggtgctcctttttttgaattttgacaccgtttcaaatcaaaatcatctgaggggacatagagcggggcggtctgtgctggcctgctgcttgccttcctagtgttgatggaccattgagcgngaaacccagctctagagnaattaa

SEQ ID NO: 21056 - DNA, 639 bp, Triticum aestivum
  unsure (1)..(639): unsure at all n locations
  Clone ID: PAT_TA_21056
atttctcaccagaagcgaaggcggaggcggaggagcggaggtaggagatctcgagcaagccggaggcagaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactctaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgcttgcactctatgttccatttgtaatgtaataagaggcaaatggattgaaaccaacaacaatcaactcctgattgaaaaatatcgatgtgtggcctgaatgttgtgggatcgcatctaacctgtcgatttggtgaagtgaagatctgccataaaaaaaagggggccggtaccaatcgcctatatgatcgtatacgcgcgctcacgggcgtcgtttaaactcgtgacgggaaaacctgggttccaacttaacgccttgagaaatccccttcgcagctgngtaana

SEQ ID NO: 21057 - DNA, 515 bp, Triticum aestivum
  Clone ID: PAT_TA_21057
aacacatccatccctcgctctctctcgcgcgcgcgctcgtgctccttcgtgctgctcgccccgcccccgccgccctgccctccccaccgtcgtcaccggcgtggggggaacgacatgactacttccaggcgccttgcggacaggaagacagccaagttccagaagaacatcacgaggcggggttccgtgccggaaaccgccgtcaagaaggggaaggggaacggctacgctgccggccccgtagtgctcggcttcttcgtcttcgtcgtcattgggtcatcgttgttccagatcatcaggaccgcgaccagtggcggcatggcttgagaacccgtccccggtgcagagcagagagatctgtttgtcgtttgtacatgcatgcgtccagctagaatcgagtttaatttcgaactgaaccgtaatgcagaaccatgtatgtaaataaagtgctattaaatgggtaactgatatagtgctatatatatacatgttggataccaaaaaaaaaaaaaaaa

SEQ ID NO: 21058 - DNA, 674 bp, Triticum aestivum
  unsure (1)..(674): unsure at all n locations
  Clone ID: PAT_TA_21058
tgctcatataaaaccaaaaannnnnaataatatgaggaaaaatatatgttataaacaaatatcaagctagaatagataaggaactcggctggtaaccgccaagttaccggctagcctgctcccgcccgtcctgcgggttgccttcctgggggtctgtagcgtggtcgcggccgaggtactgctccattggtttgcagatttttgggggcatcgtgtatgctggtaacccaacactagaagaaacggacctcttcaataacgattatcttctttttaacttcaatgactatccaagtggtatggttactctgttcaatttgttagtgatgggcaattggcaagtatggatggagagttattggcaactgactggaaattcttggagcctgatttattttgtcagcttttaccttatttcaatattactactgcttaatctgattgtagcatttgtgttggaggcattttttgctgagatggaactggagaaaggtgaagaggttgatatccagaatcctacgtctggaggaataaagaaacgccggtctatgcgggtgtggtcaaagggttcctgcccgggcggccgctcgaaccttcggtggccggcgttccgggcgggtcccttatctgttgtagtgtgaggtcaaagggtacctgcccgggcggccgctcga

SEQ ID NO: 21059 - DNA, 645 bp, Triticum aestivum
  Clone ID: PAT_TA_21059
cgtccggttccctccctgacgcacctccagtactcctcctcaagatcgcagcatgcaatggcctcccttaccaccatcaccgctccacatctgtccccagccttgacacgacggcgcaacgccgccgtgcctaggcgaagaccctccttccgctgccaaaaccgccccccgaccgagccgccgatcggcggcgacggaggaggaggaggaaagaagagggcgtggtgggtgaccatggccgagagggcgcacagcggcgtggtgaaggcggggatggacgtgcgggagagcctgagcccgaagcagaagggggactggaaggacgtggcgctcatgagcctctccttcgccgtctacgtctacatctcccagaagatcgtgtgcacatactgcgcctgggtctccatgatgaatcactagctcaaattcctagatatatttagcgccaacaaagcatctgctgttatcattgtacttgtagttcatcactctagatgatctaagaaactttttctcgtgcaagacatgattctgagttgagaagttgcatatcgccagatcttggaagaagcaggaaacaaaattgccaattaatctcaggaaaaaaagaggcattcgccttacatacacctctgactgatcgcg

SEQ ID NO: 21060 - DNA, 626 bp, Triticum aestivum
  unsure (1)..(626): unsure at all n locations
  Clone ID: PAT_TA_21060
gcggatcgaattaggctctccgagtctccggttccctcctctcggcggcggctcaggtccctctccatctccggcgtggcgcttggcgtctgacctcaacaagcaagaaagcaaatggcaggcggcagggttgcacatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagttattttcaaagaactctctcgagagcatgacaaagtgattgcttgctgtggagatttgtcctgggaaataagcacaaccatttgagaacaccaagattttgtcgaatttcctttccttttgatgaatatttgagcacgtccatgtcaataccaaacattggcctttccccccccttttttacaatgttaaggggctagcaggcttgtcccacttgcctttggggtcccatgtatggccccgggcccaacgcgcacccactcttggaaaaatgcgggtgccgantaangcctgcngaaatcccttt

SEQ ID NO: 21061 - DNA, 549 bp, Triticum aestivum
  unsure (1)..(549): unsure at all n locations
  Clone ID: PAT_TA_21061
gaaactccccgctccccagccggcaaacgccagccccgcgacggcgccgcgccgtcctctcccgaccgacggcaacggaaaccccggtgacttctgatacaggaagattacttttatctatactccaccttctttcgtggctatggcactagcagctatctataaccttttcatcattaacaaatctggcggccttatatactacaaggactatggttcagcagggaggatggataccaatgacagtttaagattagcaagcctctggcattcgatgcatgctatctcgcagcaactgtcccctaccactggctgtactggcattgatctcttacaagctcataactttgatctccattgctttcaatccctcacagggacgaaatttttcgtcgtatgcgaaactggagctccaaatatggaaatgctgctgaaacgatttacgagctgtcacagacttcgttctgaagatcnttctatgagatgaatgcgattcggtcgaactgttgtcnaactggctaagtatcagangacgtgtgcnnctggtgg

SEQ ID NO: 21062 - DNA, 581 bp, Triticum aestivum
  unsure (1)..(581): unsure at all n locations
  Clone ID: PAT_TA_21062
cctcctattctgaagcaagttaagatatcagacaccattgcacatatgtgctttcgagatgttggcatgaatgatctgttgctgggaccagattgtttttgcttctgccgatgcaggagcagcttcccctgcacctccggtggcagcttcttcttcaactccggcctagtaactctggtgagcctagcagcgcggatggggactaaagtaagatggtgatttatgacagcctaccttcgtcacctgggttcttccttgtctttgacctgatggcgcaccccagcattgttttaaaggcgtccgtatctcgtcgctatagcgacgatatacaggtgtgaagggggtcaatcgccatacagacccaggcttgcaatacctttatggcgtcgctatatcgtcgctataatgctataaagggggtcgctcgccataaaaccaatacgccattaaaacatgcacccaggcattgcgactacatgccactcaactctaagcattatagtgtggaaggaccctggggacattgcatgtaatggggacaaaaattgtggcctncatgcanctnacactgggtctctttn

SEQ ID NO: 21063 - DNA, 641 bp, Triticum aestivum
  unsure (1)..(641): unsure at all n locations
  Clone ID: PAT_TA_21063
tcccaagcaaccgcttctcgccgggcgccggcggcagctgccacgtgccgccaccgtctcatcgcctcgccgtactagccccgcggcttcgtcagccgatgagccgctgccctgtttcctctcatacaatataatggtgtcaaagcctgtagtgcttgtcttcctgttggtggtactcataatcacatcccagtttgaatggaagcaacagcttgtaaacgagttggaatctacggctcgcaaccagaaacatgtttcaagtagagaagagcttgtcaaggatcaagataatcttcactcaagaaaagatgattcaaagattgaataattttgtccgaaaccttcagcaacagttggtgcagtgtcgtggcaacaacaggacattaatcgttctggaactccttgacatcttatatagtgagatcagatgccgcaatgatggatactgacatgtcccgcgcatgactatacggtaaaagataggtatccacagcccgtggcaacacgattccccaaataacatatcaggtgtatatctccggacanatatcccttttccaaaaaagggcccgtccttaaaccgtgttatccctcctctccccccccccaatgaatctgttcggttgtcaggnacaanaatg

SEQ ID NO: 21064 - DNA, 473 bp, Triticum aestivum
  Clone ID: PAT_TA_21064
ccaaggccgccacccaccacttcttcaacccctttacccactccgccgcctgctgatctgcgcgccgcccgcccgcgcgtacatacacgacgctcatcaacatcgaccagcaccaccgccatagctagctagctacgagtaagtagcagtggccgccatagctaagctaatacctcacgtcgcaagtaacatatgatccttgcagccagctgcaggacatggacatggacacgatcctcctacacttttgccatttcttggtctgggggtttcgtcccgaatcttgttcagtttagctaatccatccatcaatcataggcgctagccagtcgcgctgccgtggcagccagccagccggggtagcgccggcccttgtactccctgcgccccgccatgggttacccgggtccccccctgtggccgtggcccccgccttttgggtggcttctcggcctccgggggttcaaaaaaaa

SEQ ID NO: 21065 - DNA, 650 bp, Triticum aestivum
  unsure (1)..(650): unsure at all n locations
  Clone ID: PAT_TA_21065
tcgagtttttttttttttttttttagcaagatacaccacgaaactacaatacatgagagcaacagaaaagtacaatagcaattcactggtccaacattctctatatacataaacacatttgcacaccatccatatcttttagaacaaatccagactgggactatgcagtaggaataaataaaccacaggcacaagaaaaatagactgatcaatatgtggccaagaaggaagctttcaggtttcacagtttattattggcacgatggctgcataactgatctttctaatcggttagattggatcgaatagcactgaagaaataagaggaagcaaacagcaccagtcactaatccttgatatcgtaacgataggaaactgacactctaagagctcaaaatccccagtggacgacagtaccttttcaaccttcaaaacaggttctttggggtgcctggcaagttgtcccccacactgtttttactatgaaacatcggaaccttaactggctccttgagtcaaatcagacagtttctacccaaantctcattacgacctgacactcacaggaacttcacacccaagattgcatgatgtatcaaagcaatcaacngggctgcagaattcagactcaggtcaacactantcgcana

SEQ ID NO: 21066 - DNA, 612 bp, Triticum aestivum
  unsure (1)..(612): unsure at all n locations
  Clone ID: PAT_TA_21066
agtttcgagttcctggctggtggcgtggcacctcgttccccccgaccctgtccccgacttacatacaccccgactcgctagcgagcaggcaggcagaatggagcgccacgccgagaagccgctcctcgtgctgccctcctgcctcctcctcctccttgtcctcctcctcgccccgctcgtctccgccgtccccacgccaagaagcctgcgcctggggagccaccagcagcacccgccgccggctctgaagctcagttcctctcaggacacgacggcgatcgcggcggcgatgatgaaaaacacgggcaaggccgacggcgaagggtggacgtggaggtgaacgactaccagccgtccggccccaacaaccgccacgacccacccaagggtcccgggaagaactggaacggggggccggtcagcttggaacgacgtacccgcgcccccaataatccttctccgtcgtcgtcctcgtctcacggtagtacagaggcgctcttgtctactcctctgtccagttctacggccgcgcgtgtgtatggcgttgaaganatggtgggtgtaagttgtgttgttntgttgtanaaaaaattcactgatnagattgnttnn

SEQ ID NO: 21067 - DNA, 1172 bp, Triticum aestivum
  unsure (1)..(1172): unsure at all n locations
  Clone ID: PAT_TA_21067
aatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaacccctcaaggggtttgaggtgatcgaccagattaaggctgctcctgaggctgcctgcccaagcacatctcctgtgccgacattgttgcccttgcggctcctgattccaccgcctgggttggtggacaatactgggacgtgccacttggccggagagaccccctcggtgcaaccatcaagggctccaacaatgacatcccagcccacaacaacaccctccccactatcatcaccacgtgccagcgccagggcctcaatgttgttgatgttgtcgccctctcaggtgggtcacaccattggtatgtctcggtgcactagtttccggcagaggctatacaaccagacaggcaatggcatggctgacagcacactggatgtatcctacgccgcaaagctgaggcagggatgcccccgctctgggtggtgacaacaacctcctccccttgggacttcatcacccctgccaagttgacaattttactacaagaacctcctgggccggcaagggcttctaccccctgatgtcgttcccttagcctagacgcgggcccctgggcctctgcgcagggtatgccgctcattcttctcttcttcgacacgttcacctcttaggggcatgggggtagcatctcgccactgacanggtcacaaggtgagatcaggaagaatgcaggaggccaacaatgacactgaggnactgaatccctgattctgaantgtctgatgttgtgcgtatttgttaatagtagnaggtgtattacaangtcatcttgggttattaaaatgaaanttncatanaccagttaaattntaaaaaaaaa

SEQ ID NO: 21068 - DNA, 548 bp, Triticum aestivum
  unsure (1)..(548): unsure at all n locations
  Clone ID: PAT_TA_21068
gcgcgcggtccccggccgcgcgctgctgcccgacggcggcgccgcgcctcccccgtgggggctcgccgccctgcgcgccctcgtcggggccctcctcccccgggggcggcgcctccccgtgccgccgccgcccctggccgcccccgcccgcgcgctcccccgtcccctcgggccggcgggccccggcgcgggcggccacctccgcggcctcccgcggccgcgccgggacgccgccgcgcctccggccccctcgccgctgcccccctcgcccgtggcctcgctcctgctggctgccgcgctgctcctcgcgcgggtgctcctctgcttgctagtgcctcatctcgttcgtctggcctggtccgtcttctcgcttggtcttgccaccggacctgtttctgcgttggggggacccaagatgtcaggtggctgtatttcttgttcccccttttgatgcgggggggttatctccttaactcnaaatgtcgcaaacgacaatgtccagaattaaaatgtcgacttaanaatgtcggnattataaaaaaaaaaaa

SEQ ID NO: 21069 - DNA, 606 bp, Triticum aestivum
  unsure (1)..(606): unsure at all n locations
  Clone ID: PAT_TA_21069
gcgcctcgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagattcttcaatttgctatctctctctgcatgtttggcgtcatcttgtgccaagtacgtactgtgtcaactcatgttggttgatcgaatgcatcgcgtacatatataattggcacatgatataatttgtacatatatatcaaaaaaaaaaaaaaacatcaccangtagngtataccnccnatncg

SEQ ID NO: 21070 - DNA, 524 bp, Triticum aestivum
  unsure (1)..(524): unsure at all n locations
  Clone ID: PAT_TA_21070
gattcattagctagtcttcgatctgtaatttgattttgcaggagaaagagagttgccagatgaaaaggatcacaaggtatacatgcatgtagtgtgactagagaataccaaagttctatcacggaactatatatcgatctacgaatccatatttgtcacggaatttcgttttgcttacttcagggccattccactgttgcttctggaaaggggggaacggcttcaggagatatggtgaagacgaatgactatgggcgctacgatccaactccggcgttctccaagcctcgctccaagcttatacccaactaattacactcacacttgctgcatctacatgcttactatatggatggcatgcatagaaatatagtcctgtacangactataatgctcacttcgtttttttttgtcgcgtctagttcaaaaataaactaatcggcgataaatattaagacggggtagtactagatctagccttgacgcctctactgaatgacctctactgatgactcggctcagtn

SEQ ID NO: 21071 - DNA, 340 bp, Triticum aestivum
  unsure (1)..(340): unsure at all n locations
  Clone ID: PAT_TA_21071
accacaaggaggccgaggaggccggncggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaaggacccgaaaaaatgtatgcaactctgatttacttacatgtttagttgtttacgtttctcccaaagtattaaaaaaactcccnaaggggggggg

SEQ ID NO: 21072 - DNA, 618 bp, Triticum aestivum
  unsure (1)..(618): unsure at all n locations
  Clone ID: PAT_TA_21072
cagcaaccggcgacatcactctcactactgcagctcagctcagctcagctcagcaagcaaattgttcgatcgatcgtcgtcgactatggccgccgcctcctcctcgcagcaaccaccgcgcctgctagtactcgtggcggtctcgtgtctcctcctgcagagtgccatcaccagcagctcggcggagtccgtcgatgcaagtgccacgaaggaaggaccaaggaggcgctgctggccgtgaactccgcgctgggcagcccctaccacttcgcgtcgttggacgcccgacaccttttgctgcgactggtacgacgtggactgcgacaacgtcacgggccgcgtcctccgcctcaccgtgttcggcgacggcaacctgacgggcgccatcccggacgccatcccaacctgaccaactccgcacgttggcctgcgcaactcccgggnatctccgggggatcccgcttggtngcgcagtcgccaacctaaccagctacatttctcaacggggttcggccggtgcgtcgttctgtccagctaaggagtaactctagactctctnantcctcacgggcatcccgaangtcgcactccgcttcagatgactacgacgctntngcc

SEQ ID NO: 21073 - DNA, 534 bp, Triticum aestivum
  unsure (1)..(534): unsure at all n locations
  Clone ID: PAT_TA_21073
ttttttttttttttttttttttttttttttaaagaaatgggtctgttccattccatgactgaatattacatgtccatcacacccgatggccatacggtaacaaaagaaagcaatctgatgcagtcatcttttattcgatgatgctcttaaagaaatgcatgggtcaaatctcaataagcttttgtctggacaaaatccctaggtgattaactaccacccgcttgatggccaaatgtctgttcataaacaaggatgccgtgcagtctggttcaagaaaaaagaagtgtgatggactcatctgcctcatcagattcttattttcangaaccacaaggcatccttagtgatgtccatcatcttcatcgtcatgggccatcctggatctccaccatcaccaattaccttaagcacaaagtattgcgaagcagactggacactcatgcgggtcgtcntttttcaaccaggaaccatacaacatcatgttcggcctcacccccgccccaggnaaccgcnancgatgtaaagatgancatn

SEQ ID NO: 21074 - DNA, 541 bp, Triticum aestivum
  unsure (1)..(541): unsure at all n locations
  Clone ID: PAT_TA_21074
gcccgtcagcccctctcgtttttcatccgccttcgcctccaaccgcgtgcgctccacgcctcctccaggaaagcgagagcttctgcataagaacaacaaatcaaaagcttgatcagctcggtgcctacaaaacctcaacaaccaagtttcatgtctgatctcgacgtccagcttccatctgcctttgatccgtttgctgaggcaaatgctgaggactctggtgctggtcctgggaacgaaggattatgtgcatgtgcgcatccagcagcgcaacggcagaaagagtctgactacagtccagggtctgaagaaagagttcaagctataacaagatcctcaaggatctgaagaaggaattctgctgcaatggtactgtagttcaggacccagagctaggccaggtcattcagctccaaggtgaccagcgcaagaatgttgctactttcctagttcaagcggggattgcgaagaaagagacatcaagatcacgggttctaagggacctgtaatgcttgtgcccttattgtgtgccncacaaatt

SEQ ID NO: 21075 - DNA, 608 bp, Triticum aestivum
  unsure (1)..(608): unsure at all n locations
  Clone ID: PAT_TA_21075
gggtgttgcttatggagtacaatacaggaatggatcttgcttaaacaactcatcagcaatagataaaaccacccagcatgcatttgggccagctactgctacaactctctgggattccagcatcaggatcaaaccgtgtaacggttcttcaggcctttgtccatcttctttgcatcgtcatgaacaatgaatccaatggagtccttgtagtccagaagttccttccactgcttcccgatgccaacctgggcagcttcattgggcagcattttttgtccaaatagcaattctttcctgcttcccacgcacactgacaactgcgccacaaatttcatcaccatagtcgaattgttcaccaatcatagccagcagagtgtgcagccaaaacgtatcagattttcctcntcaacagctgatggtcaattacacattcgcacaaataaggcctccaatttggccgatctgttcctgaagcatggaancactccacgataattgctaggtgataagtatgtaancccaaatcccnacggggaaanggttatgggggtgggcccccagcgctgctggctgncgcggttcaacaaagcagatgtcanggggccgtn

SEQ ID NO: 21076 - DNA, 349 bp, Triticum aestivum
  Clone ID: PAT_TA_21076
gcaggaggggggtcaatgctggttcttgtttcgctgacctgttactaccgctgccactgttattaccactactgtcaccgtcggcgccactgttccaagtacgtactaggcctgctccactgatgccactttggaccccactagctgcgtctgatccgctgcacacctttgctacctactttaccattttttgcttataccctgtgaactgcatctgatccgctgcacaccgttgctacttccttcccacgattattattatcttgtcaccatgctctctaaatcgtcattatgagtctactgttgctttgcaatggatacttttgatgtgtgttaaaaaaaaatgcgc

SEQ ID NO: 21077 - DNA, 633 bp, Triticum aestivum
  unsure (1)..(633): unsure at all n locations
  Clone ID: PAT_TA_21077
tgcacacttgcacttggttggagctcctctaccttttccatcgctctgctctgctccgcgtctccgtccgccccggcaaaagcaaaacacagccatggaggggtacgaccgcgagttctggcagttcagcgaccagctgcgcctgcagacgaccgccttctccggcctctccctcggcgactccatctggtctccggccaccggcgccggcgggcggcgcaacaacaacaccgacctactcgcggcctccgcgtcggcagccgacgccggcaagcacaacggcgtgggcctcagcctgaatgatggagggcccggactcattggctccgggaagctcgccttcggcggcagcaaggccggccgctacaacaacctcccatccgagaagggcgcgcccgtctacaacacagcggcgccacgattaacggcggctacgccaagagcgacaacgccggctggcggcgttaacaagatggggagtactccacaacagtaacggaacgcggcggcgcgggaagtgaagactactcaacaatcccccgacggccggacacaaacccgcggggcccgcggccggcaggcgcgcggggcggcgggacacgcaacggccgggcgcccgcggccgtganctcc

SEQ ID NO: 21078 - DNA, 583 bp, Triticum aestivum
  unsure (1)..(583): unsure at all n locations
  Clone ID: PAT_TA_21078
cgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctccgtggactacatcatctctggccctgtggtggccatggtctgggagggcaagagcgtcgtcacaactgggccgcaagatcattgggcgccaccaacccctggcttctgacccggcaccatccgtggcgacttgctgtcgacattggcaggaatgcatcctgggagtgacacattgagatgctaataaggaatgcctgtggtcccganggcctgctgattggcagacagcacaccctggattacaaaagtaacatggaaagttaatcaaacttgagagcagagaacattacantttgcttacaatgtttcaaagatanatcgtnctgacttattatgncaaatttt

SEQ ID NO: 21079 - DNA, 597 bp, Triticum aestivum
  unsure (1)..(597): unsure at all n locations
  Clone ID: PAT_TA_21079
gttggggccgccgctcttgagggatagaagaagaggatacagcaagcgggggttgcgaggaggcggcggacgctatgggcaacgccgggagtgcgccggaccagcccaagaactcggcggatggggccggcgctgccgacgcggagtctcgccgcgggccgccgtctacggtgcgtttcttccccgatggggagcgccacaaggcacggcagccgccgccaataaagctcgaggaggaggagggcgtcccgccgccgcccgccaccgaggaggagatggccccgcgcaacctctgggcaggtgtatgcgcttggggcgttcaattgtgttgagatgggcctgggctaaagaggaaggagaaccaggacagaaaggactcacctgatgctggggatgggaatgcaccggacagatcgacttaatctccggttccggccgcgtcgacgtgcctccccgcgaaggcgttccccgttccgcgatatgctaccatcttggatcaatctagcgcaccagctctttgtggcgccttccgnccnaagnttatggatttctgacaattgcaagtacatctncccttttcactctaaaaaaaaaaaa

SEQ ID NO: 21080 - DNA, 809 bp, Triticum aestivum
  unsure (1)..(809): unsure at all n locations
  Clone ID: PAT_TA_21080
gagtttttttttttttttttttttgcagcaccaagaagcaccattttttccttaagattaacttgagagaacgcccgaaaccccccaaagcaaccacactagcaacaacctaacaacaatggctaccaagatattatccctccttgcgcttcttgccctttttgcgagcgcaacaaatgcgttcattattccacaatgctcacttgctcctagtgccattattccacagttcctcccaccagttacttcaatgggcttcgaacacccagctgtgcaagcctacaggctacaacaagcgcttgcggcgagcgtcttacaacaaccaattgcccagttgcaacaacaatccttggcacatctaacaatacaaaccatcgcaacgcaacagcaacaacaattcctaccagcactgagccacctagccatggtgaaccctgccgcctacttgcaacagcagttgcttgcatccaacccacttgctctggcgaacgtagttgcaaaccagcaacaacaacagctgcaacagtttctgccaacgctcagtcaactagcatggtgaacctgcggccccctaaacatctcaactgcccgctcgcggtgggaatgactacgtcaaaaattgatagggtgtggttncgnggggccatgcctgannacggtttcgccttnacgtggngtcagttcttaatagngatcttgttccaactggaaaaaactaacctattcggncnatctttgatttnagggtttgcgattcggctattggtaaaaatgnntgattacnaaatttacnngattttaaaaatntt

SEQ ID NO: 21081 - DNA, 648 bp, Triticum aestivum
  unsure (1)..(648): unsure at all n locations
  Clone ID: PAT_TA_21081
ggcctaccgtcccccgctcgcgctcagccctgctctccacccggcgcgcagcagggccccggcaccgccttctcgagggcccgcgggggcagcgtccacctccgcaagccatcccggggccgccccgccgcccccctgacgactccgcccccatcccaggccgcgcccacggggtctccggcacgggcggcttgtgcgccggcgctcgccaggctgttctgcgccagcatgccaacttcccccgccgtcggctacaacacgccagtccctcctatccgaggaggccccctccgaggtccctccgatgggagccagcgctcgtctccgcgccgtcccgtgatattgcccaacatgataaggttccggggtggatagctacaacaacccttccctgctatcctggaattccatcccaaggacatccatatgttcaacgcacaatctgtgctctctcgaatgaaatacgctctccgcaaaaccgtgcgtcggatagccatgaaggcccttcgtacaatacctcgatcatcaattgttacggattgaaaagaaatgaacttcattggtcaacaaccacataataaaatggctgaacaatgattgttacnacacaaattttttaaaggccaaaaattggctntttaaaaaaaa

SEQ ID NO: 21082 - DNA, 689 bp, Triticum aestivum
  unsure (1)..(689): unsure at all n locations
  Clone ID: PAT_TA_21082
ccacggcgacgaggcgcggcaatgtccagcaggagcacctccaccagcagcaccacctcggaggcgacgggtcggtggacagctgcctgaccgcgtgcgaggggtctcggtgccagagggagagggaccaggacctgctgtccatcggcctctcgtccgctccgcctcccactcccactcccagcagaggctacaacgacagaggaggcggcggcagcgccagctgcgagggagttcctgcagtttcttgacgagcccagcagaagaggagcaggaggaggagggtcctcggatgagcagcaggagcttgacctcagcatcagcggcggcaggagcaatccaaggcctcgcggcaaccaaagccaaaggatcgacctcaacggttccagctggaactgaatggtcctccttttagcaatggtctccttcctcgtactttagctgcagtagggaaaatggccaggtcacagcaggtgcctgtgtgtgggtgcacttcatccctgcagcatttgcagcaatacctacgcggcggtgtgatgtggtgggttgcatcgaggaaccagcccacgcacgtctctttaantctgattagttactcnataatngtattcagacatgnaagncntgctgaatcttcatcngttcggatgncaaactccagnggttccccganaaanaaaaaaaaaaaa

SEQ ID NO: 21083 - DNA, 1449 bp, Triticum aestivum
  Clone ID: PAT_TA_21083
gcccgcattagcccccgggtcccctcctgtcaccagcgaatccacacccctcgcgcgggtcgaatcgagctccctgctgccggcgatggccgtcgacaagcagcggcttcttacgctcttcttggttggtgtagggacggcggccttggcggtgaggggcggagaagatgcggggacgttcgagctgcccgaagacaggttcgtggcggcggtggacgcaggccatttcctggcggcggtgtccgccgtcgatttcctctgcgaggacttccacgccccgtggcacgacgactacaaccccctgttgccgaagttggttgactcggctacggttgttgcgtgggtaatggcggagagtttaggagagattggaaataaagagatcttggatcccaatttggccgtttctgcaatggatgtcgtgcttgctcaaaagtaaagtggccattgggcagccgttgagcaccgttgctcggtgaggatgcgttgtacatccgcctcttattggtggctgtgcttgttgttcttatgtttttctctgggcgaggcggggatagatcgccagctaacacgagctcatgaggaatttatgtgttttatttgcctgctccaggctaaactcaagaatttcctgtagcagaagaatagcatggatgttgtagagaggtgaacctggaaatgaggatattctgattttgggatttcacatgccttagttttgacctccccttgtctgacctggcagttactagatcctctgtttagcgatttcatgtcaccctttgaaggaacctttttggaggattttatacggcaatccctgcttccgataactgtgcccatcaatgaagagactgttaagatgctaaaagatgatgataggaaagttgtccttgcaattctgcaggatgaatctgatgaaacttccatgcagttgataaaagttttaaggtctgcagccaatgcaaaccatgacctggtgtttggatatgtgggagtcaaccaatgggaggaattcactgagcctttccatgattctaagagctcacagctgccaaagttggtagtctgggacaaagatgaggagtatgaagtggttgagggtttagagagtttggaagaaggtgaccacggatcccaaattagtcgtttcctcgaggcatatagagctggaagaacaataaagaagacattgggcagacgctccccaacgctgctcggtgtgaatgcgtcgtacatcctcctcttcttggtggctgtgcttgttgttctgatgtttttctctgggcaaggcgaggaagatcgccagccaacacgagcccatcaagaatgaatgtgtagtagtttccggctccagactaaacttaaggatttcctacagcagaagaatagaatggatgttgtagaaagagggacctggaatgagaatattctgattttgaatttcac

SEQ ID NO: 21084 - DNA, 449 bp, Triticum aestivum
  Clone ID: PAT_TA_21084
gcccagtcgtgttgtcgtgaggagaggcaaaaggaagatcatcggaatggatggagtagccaatgagcaagacttcgacaagtacggcgacccgagaatcgaacatgacgacgatgatgaagtagcagcatacaccacaagaagaagcaggaccaccctacctaaaggacgtccgttccacagaagaactccatttgcgaaaaagaagggcaaaaaaaattatgattggcttataaaaaaattgttactgtcttataaaaaaattattactttcttataaaaaattattactgtcttataaaaaatattactgtccttataaaaaaattgtgggacctggggaatccgaacctaggactcctgggtgttgagaactgggctactgaccagtccagctaagtaaaggggacttggtgtggttaaggtaggtggaaagacaactgttggtc

SEQ ID NO: 21085 - DNA, 525 bp, Triticum aestivum
  unsure (1)..(525): unsure at all n locations
  Clone ID: PAT_TA_21085
acttaacgagcaccaccagttccttgttcggtcggaacgcagcgcagccgcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagattcccgaagtacgttcgacacagttactccccagtacaagccaaagtttgatgctgtgattgctgaattaaaggagctgagaaaacatccagaagagccagaaaggtagagaaggatctgactnaaattg

SEQ ID NO: 21086 - DNA, 423 bp, Triticum aestivum
  unsure (1)..(423): unsure at all n locations
  Clone ID: PAT_TA_21086
gccgaatgcagggcggcgtccaggtgcagcacggctacggagctgacaacctcgggcggtgtgcgccgctacgagtcgtacgagagccgcgaggagcacggcgacggccgccgctatgagtcgtacaagagcaccgtccagtacaacggtggcgggcacgccacgtgctccccgattcaagaaccgccacctccttggctacggcgcgtaggcataatacgcgctggctgatccaagtgcacctacgtactgtatattcgtatgctccgtcctatatagacagacaggcctatatgcccgctaccgcttacggctacttnggtccatgggttctgcttgtggttncctgatgcagctaaaccatcgaaatatctaaaaaaaataagatgttacataatgccaaccnttgggataataatgtgt

SEQ ID NO: 21087 - DNA, 710 bp, Triticum aestivum
  unsure (1)..(710): unsure at all n locations
  Clone ID: PAT_TA_21087
aaattcctcatattttctctcctcccctggtcccttctcgttctcgcccgcgtaattcctctctggcgtctaccaaaagcggagcaaccgaggcaagaaaaaggggtgggcgaggaaaagcgattaggcttctcttccagttcctgattcagtctgagaaacaatggatatctgaagcatgaaaagtcaacccacctcactcttttaaacagttcggttaacacacttaatggctgcggtgtttgcatgacattctctttgagcttatatgggagcagtggctgtattgngtaatttaagcagatctcagtcacttccagattctaaaccgaagcgatctttgtagaaagaaatatcaggattcatcgactgngaaacagaagacgatggcaatccgggtcctaagaagcaatgggagaagaatgttagcatatctgtttctcttgaggggaatatctcttctatccccaattcataggccaacgactctaaaaacgtcaatgggaaaccggggtatacatcattacaacatgcgctgaacatgggctgagatanaaaacaagggtgggcccaagcaaaatntnagaaaaacccganagcaanataantggccaaacatatgagactctgtcanaatgacgtttcaaaagaaccatnacgaatgtgattttgtaanangacaaaagggcatatantgccncncttctacc

SEQ ID NO: 21088 - DNA, 780 bp, Triticum aestivum
  unsure (1)..(780): unsure at all n locations
  Clone ID: PAT_TA_21088
ngnttttattnnttnttttttgcagatcgttncatttatgaggctacgncggccatgacatgtttttnaaactggtagagggtgtcaatgtntgcgnactcattgtccaaccgtttacacgttgnacgaggnttagcaacaatcanaagcggggtttcgagttttttttttttttgttgtaaaactaacattgacagacgtggagttctttacttgcgtagcagcaaaaacatgtggtacagaccataaggcagaattcttcttgaaactgttagacgttttccggcttccacaaagatccctacagtcactggatatctccctcttgctctggactgtaagaagcaaccattctagttgcgattcttggacttatcagctgcccttggagcaagtccaattgcatctgatcctttcatgatcctgagcctgcggcaagagtcagcgaacatctcccatggtacatcgccaacaagcatccaatctccatccttgtcctccgtaagtcagaacatattcaccatccttgcggtactcagataagcacccttgccagtactgaagccactgaacaccttctcaagcgcactcgacagccccctgtagtcctggtagccttgaggcaatctccctgaggtacgggcgccaccatgctgacctgacgtaaagaacccggtcctgctggctcaaacctcctgcgccctcaactgggtgggaaatactgtctccgtaactcggatggggcaccacaccnacttgcacggcgcggtccgaantttt

SEQ ID NO: 21089 - DNA, 665 bp, Triticum aestivum
  unsure (1)..(665): unsure at all n locations
  Clone ID: PAT_TA_21089
gttgccggctgcccccgcggccccggccagtccatcccctcgctcgctccccaactccagcaggcagatcagatacatccatccattcgcggaccggaagtaatcagcaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgaccaaggacctcttctacgacgaccagctcgagcagggccccgtcgccgccgcccttaagacagattcggtgtcaaggcgctgaacatgactccccgaagggcggcggcgacgcccgccggggttccggagaaacccgaacgccgagaagcgacaagtacccgcaccccaagacaccctcccgcgcgctaccaacctctaggtcgctggggaaccatacgggggggctcccctgggagccccctcccccgcgcccctggcccccgccccggccccgtcacggccgccccatggcgattggcggggtcttccnttnaanaaattaaaaaattg

SEQ ID NO: 21090 - DNA, 627 bp, Triticum aestivum
  unsure (1)..(627): unsure at all n locations
  Clone ID: PAT_TA_21090
aggaacttgtgctgtcggtgtcaagggtgccgatgttgtggtgctaggatgtgagaagcgctccgccatgaagctgcaagatactcgcatcacaccttccaagatccagctcctcgatcaccacgtcgccctcgccttcgctggcctaaatgcggatgctcgtatcctcgttgacaaagctcgattagaggcacagtcccatcggttgtcagttgaagaccctgttactatcgactacattaccaaatatgtcgctggcgtccagcaacggtacacacaggctgggtggcgtccgaccatttggcattagcactctgattgttgggttcgacaacggcagcgatgtccctccggtgtaccagacggagccctctggcatctactctgcctggaaggaaaaccgctatccggccgttcaagcaagacctgttcgtgacttccctcgagcggaaactacaaggangacatggaccgagaggccacccgccggcctcgcccccgccccgctgcttccgggncaanacatgagattcctaagnactgcgcacatcaaaatacantcanatgagntctaagaantacagaaacagagactcnaaaaaaggangcctgacgatngcacnanca

SEQ ID NO: 21091 - DNA, 361 bp, Triticum aestivum
  unsure (1)..(361): unsure at all n locations
  Clone ID: PAT_TA_21091
tgcggatcttgaccggtcgctgccgttcaagaagaggtgcaagatggttgatcatcctaccgttaccaccaccaaggccgtggctgtcgatgccactctgaaggatcaagatcacgttgtcgccgaggacggcgccatggtggagagactgagcaaagccgatccgccagcagcattcactcacgccttcatgcgcgacgagatcaccaatgccgccatgctgctcatgaccctatcgtgcggtcttgttcgcagctagtactagctanctagctagctagttacactagacactgatgaatgcaacttgatttgcatatcatgagttataatcctgtaaatttccggtaaaaaaaaaaaa

SEQ ID NO: 21092 - DNA, 722 bp, Triticum aestivum
  unsure (1)..(722): unsure at all n locations
  Clone ID: PAT_TA_21092
aacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaaggaggccgaggccgttgctgagccgaccgaggcagagcccaaggaagcagacccggaggcccccgcgccggaacagagacggaggtcaaggaagcagagacggagccgccgcgcccggaacaaagacggagctgctgctgcccggtcccgatgctgaccagagatagccgccgagacaaaaagggcgcggctgagcgaccgagaggagaggagnaacctgctttctgcantctangtccacgacgaggaagaacgngncctgtccaggcnctcaaaaatctcagtantaaccacccgaggggcnnttacnccgctancntacngaanggtcccccnncatgcagaaaangatgccgangtcnnaactnttttcgtatttnatgcgggcccaaagactttntgcaaaatttntttnt

SEQ ID NO: 21093 - DNA, 606 bp, Triticum aestivum
  unsure (1)..(606): unsure at all n locations
  Clone ID: PAT_TA_21093
ccgatggcgagcatggcagccgtcttcggcgaggccaagccggacaaatccaacaaagatgccgatgctctcctgcgccgacccgtgctcttccacgcccactcccagggcggcctccgcgtcgtcgccaccgacctccactccttcgcttggcatcgctccctcgacctcgacggcctccgcgacctccaagatgacgttggcatcgctggctcctgctccgacttcctcgactacctctattcttccttgtcttccgaccaagtcaggctcttcttccctgccgcggccctaggtcctgatactgctgagcttgtggctaccaaggcaaagggactacctcgcatcactctctctctcgatagagttgccgcatccgcgctcaaagatgtcattgctgattctccccttgcgctcctatgaatcttacaagaccagccagaacatgcatcaagagaacaagaacgagtgtccagctcatgggaaatctagactctgaaagagaaaaaaaacgantaatgcaaaacaactgaagccttcatcctcgacaaaagaaggtacaagcaaactntgccgtatttctcaaatgntcggngacncaaaccn

SEQ ID NO: 21094 - DNA, 639 bp, Triticum aestivum
  unsure (1)..(639): unsure at all n locations
  Clone ID: PAT_TA_21094
atgatctgctgctgcaacaagatggatgccactacccccaagtactccaaggctcggtacgacgagatcgtcaaggaagtgggttcctacctgaagaaggtggggtacaacccggacaagatccccttcgtgcccatctctgggttcgagggtgacaacatgatcgagaggtcgacgaacctggactggtacaagggccccaccctccttgaggcgctggaccagatcaacgagcccaagcggccctcggacaagcccctgcggcttcctctgcaggacgtgtacaagatcggcggcatcggcaccgtcccggtcggccgcgtggaaactgggctcctgaacccggcatggtggtcactttgcgcccacgggcctgacgacggagtcaattccgtggagatcaccacgagacgatcaggaggcgctgcccggcgaaactcgctcaactcaaaacttggggtcaaggactgaacgcgctactggctcaactcaaggagacccgcaaggagttcaactcacgccaggggttacataacacccgggatagggaccgtaccccggcggttcaagtccaacccgattccgactgccccaattacgngtcgcggactgaaacccagtccaaaagnaaccgtntaa

SEQ ID NO: 21095 - DNA, 597 bp, Triticum aestivum
  unsure (1)..(597): unsure at all n locations
  Clone ID: PAT_TA_21095
gcgacacgggctatccaagattggtgaggaggccaggtgacatagctctgaccggacaagttagccaaaggtgcgcttgcttccaggaaaacgagctggacaaagccgggctagtggtgtacgaagggtgtgattacctgtcccagtcttgcaaagtaaactaggccgtgcgtctcccttccacggacttgttgctttggggggtactcaaacgcaaggttcatcaagttacgggggcgctgcgacattccacgagcacccaccaagccacgcatgcatcatgaaggcgggcctttctgctctgtccccgccgtgaaacacctgggtgcaacgtccgtgggtcagttcaagatgccttagattcgcaattgaattggaagatacccgcgatcgaaccaaatgatggtaacctgcgccgccacggcaagattccattctaaaggctgccgttgttaatagcatggggcttgggctgccattgatccaaggtgcttgcagttccccgtcgcacatagntactcatcattaaatcattttttgagatcatttancatttcanangacatgtgtcntnttggaccaaatttntttcccaat

SEQ ID NO: 21096 - DNA, 1408 bp, Triticum aestivum
  unsure (1)..(1408): unsure at all n locations
  Clone ID: PAT_TA_21096
caaaggataattccgcggcagcgggacctaccgtgtactgtgaaaggtggtggtgtttcaggtcaagttggagctgtgctcctagggatcagcagagccttacagaactgggaaccaggactacgcccatgtctcaaagcagctggatatttaaccagagattcgcgtgtggtcgaaaggaagaagcctggaaaggcaaaggcaaggaagagcttccaatgggtcaagcgttaacaggtctacttgcaaaattaccgtgccactggtggcaggtcctctgctcgttgttgtggattttctagtgagcagagatctgtattcgcattggatgtgctgtcacttcggcggaaggcccgtccaagcgttgtatacaagatagagctattgcatcgatgaatgcgacatcgtgacaccagatgttctattttttgtatgctgatacagcaaattgatccggggaaaatctcattttgaccaaaacaagatgcagaagatacttagccatgagctgttgcctctgaataaaaccgggccgccaaaaatgttcagttcacaatgtaaatgacaaccaatctgttgcttacgtccctggcctggaccttcccgcgcctcttcttcgcccccgttctgtggccagctcgttccggcctggggtcctccctggggctgtgccgggtgggcggctctccggtcaagttggagctgtgcgcctaggaatcagcagagccttgcagaactgggaaccaggactacgcccatatctcaaagcagctggatacttgaccagagattcgcgtgtggtcgaaaggaagaagcctggaaaggcaaaggcaaggaagagcttccaatgggtcaagcgttaacaggtcaaaattaccgtgcctctggtggcaggtcctctgctctttgttgtggattttctagtgagcagagatctgcattcgcattggatgtgctgtcacttcgacggaaggcccttccaagctttgtactcggatattccagtttgcatcggtcatggagttcctgagacaccaaatattctgtgttttttatgctgatacagcaaattgatcaggaaaaatgtcattttgacccaagatgcagaagatacttagccatgagctgttgcctccgaataaaaccgggccgccaacaatgttccttttctctattcagtttcttacagggggatgacatggctgtatgtcaaattaacgcagccgttttattgttagctagttccatactgtatttctccttcatgtttgtccatgcgtgctgcacatggatgatttttttttatgtttacttnatcttctcaatgtcacggaccactataaactcttaagttcaaatttaactnaaaccccgacacttattttggggcggggggagtagcataaag

SEQ ID NO: 21097 - DNA, 688 bp, Triticum aestivum
  unsure (1)..(688): unsure at all n locations
  Clone ID: PAT_TA_21097
cctcaatcccctctaattcccttgctttcaaactagcccaaagagtgtcactgcatcctctgaattatgatatattgaacatggtgttataattgtgaaccgatgagtataacttattttctccatattctgaacaacccattacttaaacagatttgcatcctactggagacattgctggcagaggaattgagactggcataggagaactcaatatatgcttgtgaataacgcatccagtgaaagatagtagattttcatcaattcactacccaggatgttgtcgcattggatgagaatgacatgggaagacggcgaactagaggaagacaacaacctcatctaagctgaaaatgtgttgcctgtggttgaagaaaatctagcagatgaacaacactgccttccctgtcctctctagacctgaatctctctgatggtttggatccgtccatgattgtcctgtacgatgaaggttcactcgtccaacgtttttcaagggacgaacccaccctggggactttcttggcctccggcgccgcggactgcgccgttgccttcgcgggagccgcctcccttggacccaacctgcgcatgtcccccggctgtcgacagctgtgcccgcgttgcgtacgatccggcgcgtcctagcccgtgtgatcgatgattcngggctcgtacgnaacaaaag

SEQ ID NO: 21098 - DNA, 564 bp, Triticum aestivum
  unsure (1)..(564): unsure at all n locations
  Clone ID: PAT_TA_21098
taanagatcattttgggngaatttggtaccgggccccccttgtgtttttttttttgttcgattcaagtgccaatctctggcggagtcctttatttatcgaaattattcaggacacaacaagtagcagtaggaaataaaacggagggtgactggagcagagcaggtagctgcctctgtcgtcagagtcatcatcacagggatcgcacgtaaacgccaagggcgtcgaggtagatcccagctcgtgcgaagaagccgacgatggcactcccttgctgcacggggatcgcgaatggagtgtcactcccgtccccccatgctccgaaaggcccgtaggtcttgaggcttgtgacgaacttgatggaggttatgacggtgaggccgtcgacgttgccgatcgtcccggacagctccgtgagcacctcggagtcgccgagctggatcaccgggctcagtttctccaaccggaaccgccccagcgacccagcagattgggtttggccggcggagttcgacgtaggagaaggcaatcgaggtcacggcgatgcagtagcaacggtgatgctc

SEQ ID NO: 21099 - DNA, 502 bp, Triticum aestivum
  unsure (1)..(502): unsure at all n locations
  Clone ID: PAT_TA_21099
caacacacaagcacaaattgtgaactgcgtgacgccgcgaggggttaagtcagcaagcaagcaggcagacagccatggcagtcgcaagcgccgagaacacgtcgtcgctgctcccgctcgacggccgcgtagcgctgatcactggcggctcccgcggcatcggccgcgaggtgtcctcccaactcgccaccctgggcgcgcgcgtcgtggtcaactacgcgtccaattccgccagggcagacgagctcgtcgcggagctcgcctcccgcggccaacaggccgtggccgtcncgcgccgacgtgtcggacccggacgccgtgcacgcgctcttcgaccgcgccgaggatgcgttcgggtccccgccgcacatcgttgtctgctgcgcgggctccccctccatttaacccccccgccccgcgggcccccccgtcgccaacgtattngacgcatgttcgccggttaatngtgctngggaagtttccctcgtnttgccncnatggg

SEQ ID NO: 21100 - DNA, 675 bp, Triticum aestivum
  unsure (1)..(675): unsure at all n locations
  Clone ID: PAT_TA_21100
ctacaatcctaaaaccatctgcttcagccttcagctagccccaagtttagtcggccgatcgatcactgaagtagtaatggcctccgccaacagctggaccctcgagatcgcgtcgccggtggccccacagcgcctgttccgcgccgccgtgatggactggcacaccctggcgcccaaggtcgcctcccacgtcgtcgccagcgcgcagcccgtggagggcgacggcggcgttggcagcgtcaggcagttcaacttcacctcagtcatgccgttcagcttcatgaaggagcgtctcgagttcctggacgcggacaagtgcgagtgcaagaacacgctcatcgagggcggcggcatcggcgtcgccatcgaaacggcgacgtcgcacatcaaggtggagcccgcggccggcggcgggagtgtggtgaaagtcgaatccacttacaagctgctgccgggcgtggaggtgaaggaacgagattcgccaaggcaaggatccgtcaccgcatcttcaaggtgccaggctactcgttgcaaacccaagcctaaactaaacattgactgggataactcattccttcgtctgttgggaaaaggatgtgtggatcgttcccccttcttccctcttttgtttatacgacaaatctcggcctggccacggcggtttgncgcagctaa

SEQ ID NO: 21101 - DNA, 533 bp, Triticum aestivum
  unsure (1)..(533): unsure at all n locations
  Clone ID: PAT_TA_21101
aacctcgacctgatggagctggacctccctggactccacctccctggcctccgtccgcaacttcgccgcgcccacaggggcctcccactcaacatcctcatgatgttgcgcttgctactcacatgttttctgatgccgcaacaaaggactatatgtggtttcttcagtggggctgtctttgtcgctcctcatgttcaataacgtttcagcattggacctgctagtcacccaagccaagcctcgcatcgcttcaacaaagcgatacttcttccaatccacccctgcttcgactatgctttgtttttcatcttcttttatttaagctaaagaaagattttgagtttgcatccatctccattacactagcataatatattagtttaggaatctctanctacatacctacaaattacatgatgaaggggaacccaccattaaagccaagattaaaaattatgagtggnttgccttatgtgacttgggngctagcgnttctaccaattccgnaatctttacgtgaaaaaaaaaaaaaa

SEQ ID NO: 21102 - DNA, 681 bp, Triticum aestivum
  unsure (1)..(681): unsure at all n locations
  Clone ID: PAT_TA_21102
cgcagttgtcttcggtcttccgtgctcgcctgcggcagaccaagctgccgctgcggtcggcccctaccatcttcctcctgcgcgaggtcccccagccggcgccccgctgcgcccccagggtgtgcccggccacctctaggtcccccgctgccgcgcggcctccctctggcccgtccctccctggccccttgcctccgtccggcctcaacattggccacttcggctgcgaatcgccttgtggggttggccattttcacaacgttggttctctcttgggggttgtcctgtgctcgaagggggacgctggacacatccattggacctgttctcggactgacaaggaagaaggtgattccaaagcgatgttgcattttacatctagtttcccaagaattggacactgccttagctatgttttgaattcatgtcactatatgcaatgttgtgatttcagctggtaccttaaatctgaagatttagtatccttgttgggttccctccgattttgatgtgtggtgttcaattcaaccgtcaactctccagtggcaccgaaatatgctgttggcgtgttttcattcaaaaactgcaccaattaactgaaatgcccttccccagttaaagaatgactacgttccgaaaattccactaagaatggaccccttggnaaaccggggtngtccn

SEQ ID NO: 21103 - DNA, 549 bp, Triticum aestivum
  unsure (1)..(549): unsure at all n locations
  Clone ID: PAT_TA_21103
cggcagcatcccggagtccctgtacaccaacggcggcctcaagctgcgcgtcgtctggaccatcagctccctcatcgccgcggccacccggcactacctcctccgcgagatcgtcaaggagcaccccaccctggagcgggtggcgctgacggacgccggcgggcagggcacgctcagcatggggcgcgaccagctcagggagttcagggacaggccgctcgccgccgcgcccgccgccgccgccaaccgcacgcaggtgcccgcctgcaacatgaagctgcgctacgcgccgctgctggagctctcggacggcaccaggatccacggcgccacgctcgtggtcatcaaagcccgtcggcgacgccggcgggaaaggactcgaacgagctcnggcgccggcgccttcgacgggccctgagggaggcgtngccgcgctcggcaagcgccgcgcctaactgctcgagatgaacggttctaatctgtgcgcctctctggtgttcatggcaatgggatggtaatgggcaatgggaacggaactactagattctc

SEQ ID NO: 21104 - DNA, 370 bp, Triticum aestivum
  unsure (1)..(370): unsure at all n locations
  Clone ID: PAT_TA_21104
ctcgtgccgaattcggcacgagcggacattgatatggtggttaatctgaaactaagagaagatgttatagtagagaagtgccttggcagaaagggattttgcgggccaaatgttggaaagaacttcaattttggcctgcattgatgttaagggtgaaaatggactcccaccaatctacatggcaccactgttgcccccaaacaactgcatgtcgaagcttattacccgagctgatgataccgaagaggtggccagaaatcggcttcagatatataatgacatgagtcaacctgtggaaggtttctaccgagagcaggggaagctcctggaattggcttgcctggtgggatcctgaatcttggcaaanctg

SEQ ID NO: 21105 - DNA, 583 bp, Triticum aestivum
  unsure (1)..(583): unsure at all n locations
  Clone ID: PAT_TA_21105
gccaaatttacagctagttagctgaattcgatcgatatccaggaactaataatccaccgacccccctcatggcggcttcgtcgcgaatgggcttatccgtctacctcgccatcatggcggcggtgctcgcctcggcgctcggagcggagctcanccgcggactactatagcgagacgtgcccgcaagcgctgaccaccatcaagctcctcgtcggcgccgccatcctgagggagcccaggatgggggcgtcgctggtccgcctccacttccacgattgcttcgtcaatggctgcgacggctccatcctgctggacgacaccgacgacatggtcggcgagaagacggcgaagcctaacaacaactccgtgagaggctacgatgtcatagacaccatcaagtcggcggtgaacacgatatgcttgggcaacgtcgtctcctgcgcccgatatcttggccgtgggcgctcgcgattcattgtcgctctgggangaactcgtacgacgtgctctggggcggcgcaacgcaanaacggcaagcatggacgacgcgaacaacgacatcccgangncgttcatggaactt

SEQ ID NO: 21106 - DNA, 610 bp, Triticum aestivum
  unsure (1)..(610): unsure at all n locations
  Clone ID: PAT_TA_21106
tggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctgggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgtaaaaaagaaaaaaagatgtgacatccaaaggaggaggcttgcaagatnggtcgccgcatgcaggcaagcataataaaganatatgctgcggggagagatncacggggtnatttttgcccggtcccccc

SEQ ID NO: 21107 - DNA, 1102 bp, Triticum aestivum
  Clone ID: PAT_TA_21107
cccacctcgccgctgccccgaaactccgcagattctcctcgccgctctccaatccggccgtccctgggcggtcaccatcgccgcccgccctcacgacgaagcatcgaccccttcccgccgccgcctgcctcgtcgccggcgcatgagaggcggcggacgtcccggcgaatcatgggaggattttgctgctgcctttccactgacgacttagaggtatatgttcatccaaataatcctgtctatagacaatgcatatccctaaggcagttgtttcacaacatgtttggggggtatactgcagcattccagaggctcgactctaggccaagcaacccagctcaaggagctgcgccattggcatccactaatccaagtactaatataactgagagttcgctgtctgaaacttttcaccttgtttctagaccacccccatatgacattgaccctagatatgcccgagttcaaagagagggactggtatcaaggcgtgaaaagtctataaacctcacgcatgaagagtccccagctcttagacgaaatggcagcagctctggtgtcgagcatttagctgctcaaaagaaaaggagcagcactgatcctgagggtgaacataaggtgcgtcgttctgagtcgactaagagtctttctggaagagcatataacagcagttatgccgtcatcacttcagacgacgaagatgtctgccctacttgtctggaagagtacaccccggagaatccacagatcataactaaatgctcccaccatttccatctaagttgtatttatgagtggatggagaggagcgacacctgcccaatttgtgggaaggaaatggagttctgcgagagcccctgagagatacttccatgctggtcgcatcgggaagagcgggaaaaagtatctgacagcatgggatgctggagagtctgtaaagggaagaagtatctacagcatgggatgctggagcctgtaagccgtatcggcgtcttgtgttcactcaagcctgtcctccttactcccgtccggcttgtgtcctctatatcgtgctaccactatgtcagcggtggaatttgatagtactactcgctcaaaaaaa

SEQ ID NO: 21108 - DNA, 587 bp, Triticum aestivum
  unsure (1)..(587): unsure at all n locations
  Clone ID: PAT_TA_21108
cacaggcgtagtccggaagaaggttcttccccttcttggaccctccggcctcaccagttggggcggccttccttttctttcctccccctgttacagggggagaaggcttcttcttcctcctcctcgtcttcggaggaggagtgcgcttccggggtcctcgggcgatgaatctgacaccaccgggcaccggggaactccttccagttccccttggccttcctccttggccttcctctcccggcaccacgtgtaggtgcccgggaccagcacctttgtcaaagagtgcatcagctgggccttccgggcaaaggacccggacagttaaactgtccagacgtctcctcccagtgctgtcaaaccagcggacgttagtccccgcatacagccaagctatggtacctgagtggcctgcactgccgccggcgggctttccgccccggcctggcgctgggccacccgccccgatcccccatgacgcggcggggcactccgagctctggtaccgccccccccatttaaccacttaangagtacgaaaatnctaagnttaaactacttncacatttgncagttggccgcccctcgnn

SEQ ID NO: 21109 - DNA, 561 bp, Triticum aestivum
  unsure (1)..(561): unsure at all n locations
  Clone ID: PAT_TA_21109
gccacctggccgtccgcttcggcaaggcgttcgggatgaaggtcaccgtcatcagcacgtcgctgggcaagcgggacgaggccctcggccgcctcggtgccgacgcgttcctggtcagccgcgaccccgagcagatgagggcggcggcgggcaccttggacggcgtcatcgacacggtgtcggccgaccaccctgtcgtgccgctgctggacctgctcaagccgatgggccagatggtcgtcgtcggcctgcccaccaagccgctccaggtgcctgccttcagcctcgtcgccggcgggaagcgcgtggccgggagtgccggcggcggcgtcggggagtgccaggccatgctcgactttgccggcgaacacgggatcaccgcggatgtggaggtcgtcgggatggactacgtcaataccgccatcaacgcctagagaggaacgatgtcaggtaccgcttcgttgtcgacgtcccgagcagcaagattgggaggctaggcatcaccatgccctgcgttcccggcgatngacgtgtgatttgctctcctccnnaagggggggg

SEQ ID NO: 21110 - DNA, 675 bp, Triticum aestivum
  unsure (1)..(675): unsure at all n locations
  Clone ID: PAT_TA_21110
cagacccctccccttcgcttccttccctagcgccgacgcccaccagacgagatggccccgaagaaggacaaggccccgccgccgtcgtcgaagccggccaagtccggtggtggcaagcaaaagaagaagaagtggagcaagggaaagctaaaggagaaggtaaacaacgcggtgctgttcgaccaggctacctacgacaagctgctctcggaggtgcccaagtacaagcaaatcaccccttccatcctctccgagcgtctgaggatcaacggctcccttgctccggagggccatcaaaggacttngatggcgccgtggccccattccggatggtctccggtccactccaacccagcagattctacaccaagggcaaccaatacataaggatggggaaaagaggtcctaaaatgcattgtctgccctctcctgcaggaggagctcctccttttgaacagttgccaccttttgtcaagagttgccaatgttaggttacgggggatgagttccaggtgacggccactttttagttttganantcccataattgggacnaaggttgcccattatattacttggccnaaaananaaggggggcccgtaccattcccccaaatgancctattancncccaaangctcctttaaactccnnaacgggaaacctggnttccaa

SEQ ID NO: 21111 - DNA, 163 bp, Triticum aestivum
  Clone ID: PAT_TA_21111
ggttattggagcgtatttcagatcggccgctagagattgtgttgtagtggagtctggtgattgcgtgaacattgtgttcgcaggtcgctgcgactcagatgagttgtttatagaaatatataggtaaccatggtctctatctttactgtttaaaaaaaaaaaa

SEQ ID NO: 21112 - DNA, 1508 bp, Triticum aestivum
  unsure (1)..(1508): unsure at all n locations
  Clone ID: PAT_TA_21112
ctgcgcctgccgcgcgccctcccccccctctgcgtccccgcccccgacctgcgccgccgccccgcccgccagccccccaggcttgtccctgcgtgcgtttgccccgggcgcaggttctacctctacttccacgcgtggatcctcggcaagctcatcggcgacgacaccttcgcgctgcccttctggaactgggacgcgccggccggcatgacgctgccggcgatctacgccaacaggtcgtcgccgctctacgacgatgaggcgcgaccccgcccaccagccgccggtgctgaccgaccttgactccagtgggaccgacgccaatatcccaagagaccagcagatcgatcagaacctcaagatcatgtaccgccagatgatttcggacgcgaagaagacgctgctgttcctgggacagccgtaccgcgccggcgaccagccggacccgggcgcgggctccctggagaacgtgccgcacggcacggtccacgtctggactggcgacccggcgcagccgaacttggaggacatgggcaacttcttctcggcggcgcgcgaccccatcttcttcgcgcaccacggcaacatcgaccgcctgtggcacgtctggcgccgcctccgcccgagcaacaccgacttcaccgaccccgactggctcgacgccgccttcctcttctacgacgaggaggcccgccccgtgcgcgtgctgcgtccgggactgcctcgacccggcctgcgctgcggtacacgtaccaagacagtcgagcctgccgtggctcaacgccaggccggccaaggcgtccggcgggacgccggcgcccgccaccaccggtaccctccctgccacccctggacagcaccatacgggtgaccgtgacgaggcccagggtgtcgaggagccgccgggaaaaggacgaggaggaggaggtgctggtcgtggagngggatcgagatcgccgaccatttcaacaagttcatcaagttcgacgtgctggtgaacgagcccgagggaggggtggacggcacgccggcgacggcgacggggtactgcgccgggagcttcgcgcacacgccgcacatggtccggcccgaggagacgaggaaggggtcggtcaagacggtggcgaggttcggcgtgtgcgacctgatggacgacatcggagcggacggcgaccagacggtggtcgtgtcgctcgtacccaggtgcggcggtgagctggtcaccgtaggcggcgtcagcatcagctacctcaagtgaagttacgtaatgtggtccgctctcgcgtcggtggctcgccgtggtatagaatctatgtaatggtgatggtgatgaattataaataagctaccgcaagtgactgccgatgaatctctggtcggcgttcactgtggtatggaatctatggtgcgtctcctcgtattgtattgcagcacgtacgtacgtgcatgcgtatgtcctatgtgtaatggtaattccaaataagaagagctggagttaatgggaaaaa

SEQ ID NO: 21113 - DNA, 654 bp, Triticum aestivum
  unsure (1)..(654): unsure at all n locations
  Clone ID: PAT_TA_21113
aaatcgctccctgcctctggtcacctcgcttccgctcccggctcccctccggccacccacacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcaagaacccaaccgaggctgagctccaaggacatgatcaacgaggtccgatgcggacggcaacggcaccatcgacttcccggagttcctcaacctcatgggcccgcaagatgaaggacaccgactccgaggaggactcaaggagcttcaaggtgttcgacaaggacaagaacggttcatctctgccggcggagctccgccacgtgatgacaactcggcgagaactgacgacaagagtccataaatatcgcgaggcgactcatgggatggcaagtaaacacaagatctcaaggcatatgcaaattagtaaacctgcgtaacgtcacaccccgggattaagggagcacacgtaacattcaaattgtctcatgcctctctctccgccccaatcataccgagcctaccggtttctgccccccccggntacgngtt

SEQ ID NO: 21114 - DNA, 610 bp, Triticum aestivum
  unsure (1)..(610): unsure at all n locations
  Clone ID: PAT_TA_21114
ccacactctccctgcgccgttcccccatagctccgccatcccttccatccacagctgtttccccgctgctcagggcgcccacggcgagaatggacggcgagcacgtcagcgactacaccccggcatgagcggcgagctactatctcaaccggcgggcctgacgatgaagcacgcagatgctacaaccggttggggagggagctgcaaccgcatactggttttgctggaaccagtgatggcggcaagctgtggggttcacctcggcaagccgcggaggtcaccatgacaagttggactagagcttggcggggtgctgctgcaaccatggatcaggtttgctggaactggcggagtgttttgctggaagtagccccaaaaattgcttcatcagagttgttcttgctggaccagcaaatttttgctacaattatatctttaatttgctgggagttaccccaaaaaaaagggggggcccggtaccaattcgcctttgtatgtttagcggtactgcgtgtttcaactntactggaacctgngtnccaantaangcttnagaatccctttccagtggtatacgagagccnancgatgccttcanatggcctnatgg

SEQ ID NO: 21115 - DNA, 1141 bp, Triticum aestivum
  unsure (1)..(1141): unsure at all n locations
  Clone ID: PAT_TA_21115
ggaaggtctcgatgccatctaggttccaagttggtgagggctcaaggaagctcaccacaccattcgaatcacaaagggaggactcaaggaaggccaccgcatcatatggaatccaagatgatgaggacacaaggaaggccactacatcatatggaatccatggggaggacccaagaaaggccaccacgtcatatggttcccaggatgagaagggatcaaggaaggtcataatgtcatatgggtctaatggtgaggatgatccaagaaaggccaccacatcatatggaatacaagataaagagtatcccaggaaggccaccacatcttatggagttcaaggggacatccatcaccatgaccatgctgccgttcacatccacagcagcggcaacaagctagtagcagatgttttcttcttccacgacgtcctacgcccagggtccgtaatcacgccgatcatcccaccgaccatcaccctaccacctctgctgcctctccgcgaggccgacgcgctcccgttctccaccgggcgcttcgccgacatcctcgccatgttcgcgccgacgacatccgacgccatgggcgaagagatacggtcgacgctcgacacctgcgagaacacgcgcccgctccctggcgagaaggccgcctgcgccacctccctcgagtctctcgccaggatacccgccgtcctcctcgggacacgcaacgtccgcgctttctccggcgacatgcccaccgattctgccggaacgtcggcgaagcgggggcggctataacctaacggccgtgcagaactctccgagtcatgacggggcgggtgcatgactgactaccctacgtgtgtccactcctgccacaccacgccccccgccgtgaacgctcccggctggaggcggacccgaagttggcgggcccccgcactcggaggcttggccgtctgcacctctgacaggagcagcggaccccccccaccatcctggcccggagaggtctcatgctagcgacagcatcgtgtcattcttccaaatcaanangtcnggtcccgctggnaaaaggtggctgctgaatgaancnatacgtaataccgtgtangcttantgaactgntggccnaggggcctnaggnaanaaccggnatc

SEQ ID NO: 21116 - DNA, 1797 bp, Triticum aestivum
  unsure (1)..(1797): unsure at all n locations
  Clone ID: PAT_TA_21116
ggatggctaaaaatttgctataagataccatgcataaattaggagcatgtatacatgagtacattgaataactggattccctgatgtcctctcctcaggcaaccagcgtaggtctcgaggatcaggaagctaccgagtttctcgaggaagcaatggcgggcaattcctctttgtcattccaggaaaccatggaggtgagcataagtgcacaacattatttttttttttttttttggactcaatgagcaacttgcttatccgccgatcgtctgaggctttcacaacatactgaactctgaagccacaatggatggtactacctgactgcttattctgatgacacaatgctgaattctgaaaccatgactgatactactatctgactgcttacggcggagccgtgcatgttacagtgctgaatctgtcacccacagtgagattcccgatgcctttattactagtccgatggcgatggatgatgaagctaactgtctaggaactaggaagaagccgccgcctggccctgtgcctgtgccaccttggccagagatagcttgcccacgaagttggtcgcgaggctcccgaagaagaggtctccgttgaactccgtcactgaggtgatgaagttgatcaccttcccttcggagtcgtcgagcacgcggaggacctcgccgttctccgacacctgcgccaccatcgcccccttccccgcggcgtggaccgcgtcgagcagcgccgggaacgaggcgactaccctcttcgtgaacgtccagcgcatgaccaggtccagccacggcgacctctggataagggcgacccagaaggagccgtctggcgctagctggatgttatccggagaccccggaaggtcgtcgacgaacgtctccgcctgcccggccttgtcccctttcagccacagcctcgtgcatttgaacctccctgtctcgcagacgatgacgaaggcctcgtcccgcgacagggcgacgccgttggcgaaggcgaggttgtctagcgcgacggacgccttgccggtgcgcgggtcgtacttgaggaggcggccggtgggttgggactcgacgtaggcatggaaccaccggtcgaagccgaacctggtgctggcgtcgctgaagtacaccgtgccgtccgatgcctcgatcgcctcgtcggcgaacctgatcgtggagccttcgaccgttgaggcgaggatggtcacacggccctcctcaactcgcagcagccccttgtcggcgtcgcagacgagcacgctgccgtcggcggagggcgcgatgccgagcaggcccgtgccgccgacgaaccgccactgctcccacgacccgttggggtgcatcctctgcagccacccgtccctcgtcgccgtgtacagcgtccctcccgccgccgcgtccacgtacacgtcctccggcgcgctcagctgcccttcccccagcttctccagcccctggaggaggttattaggcgggtagcgcgcggcgggcggcggcggcgacgggagcggctggatggggcagttgagcgcgacgtggaccgccagcgacacgaccacggccaccgccgccgtgccgaacagaccaccgagcgccatgacgagacagcactgaagtgaataacgaagctgtggcgatcgagtggtactggctggcagcacgggccgaggctggatggagtgctggactaacgcggtgccgtcccgccactaccggcagagcggccgccaccgcggtggagctccagcttttgttccctttagtagggttaatttcgagctaacggnntatc

SEQ ID NO: 21117 - DNA, 576 bp, Triticum aestivum
  unsure (1)..(576): unsure at all n locations
  Clone ID: PAT_TA_21117
cgttgtcccgcaccgctgctgccgctgtcgtggccctgaggtcggcggtccgctccgcgccccttaccggccgcgtcctcggagcgccactaccttcctttgcctcgccttccgctgcccgctccgcccggatcctccgcaggtcggcggccgcggcgtcggcggggctggaaacgctaatgccgctgcacagcgcggtggctgccgcgcggcttaggtcctgcatcgccgtcgactcctcctgctggtgctcgctctcacaaggtttaaacaagcgcatctgaccatggctaggagctgagcagaagagaagtgaggcctcgccgttatgacggcgcagcgtgctgctcccggagattcgtaacatgctctactttgaccgtcgcgcgctgcactggcccatggcggccttgcggagcatgccgccttgttccctgtaacttgcatcggcccctgttgtccgtcggctctggttcgtggtcctggcattgctgccactcccggttgtacattaaaacgcgcccgttcccattccccaaagtgagtctataccgcgctantggcgtcnttaaantc

SEQ ID NO: 21118 - DNA, 672 bp, Triticum aestivum
  unsure (1)..(672): unsure at all n locations
  Clone ID: PAT_TA_21118
ctcgtgccgtgcatgcatacaagagcaacaagatactggcgcagaggagcaatgcccggcatggatgccttcgctgctgtgtcactactcgccacactctttctggttcgtgcggcagctgcccatcctccggcggcggctgcggacgccatgacgccgacggactattggcgagcggtgcttcctgagaccccgatgccccgagccatactcgacctattgaccacatctacagttggtgagggctcaaggaaggtcaccacgtcaaatgggtaccaaggccatgacttaagaacggtcagcacatcatatgcatctcaagatggggacaactcatggaaggccaccatgtcatatgggttccaaagtggtgagggctcgaggaagtcaccacatcatatccgtaccgagggcaagacttaaggatggtcagcacatcatatgtatctcaagatgaggacaactcatggaagtctcaatgcatctaggtccaattgtganggtcaaggaaggcacactcaaatggtacaaggcatgactaagacgtcacactatatcatcaaagatggaagcatcaggaaccgtcatgggtagcccagaggccatcaggccgccattcttcccctccaggcgtgctnagganntccaatngnanatgagccatcanngtcn

SEQ ID NO: 21119 - DNA, 430 bp, Triticum aestivum
  unsure (1)..(430): unsure at all n locations
  Clone ID: PAT_TA_21119
ctaagctccaggcagcgtcgcgacagagtgagctagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctatccttcctttcttgtatcttccatgtgacgccgcgtgtgcgtcccctcatgtgtgatgatgccagatgaatactacaaataagacttgttgtggaaaaaaaaaaanaaacactc

SEQ ID NO: 21120 - DNA, 657 bp, Triticum aestivum
  unsure (1)..(657): unsure at all n locations
  Clone ID: PAT_TA_21120
cagaaagtcaactcctccccaattccacgctgccaccaactcgccgtcctccgcgccaagcaccaaagctccgatggcccgcacgaagcagacggcgcgcaagtcaacgggcggcaaggcgccccgcaagcagctggcgaccaaggcggcgcgcaagtctgcgccggccaccggcggcgtgaagaagccccaccgcttccgccccggcaccgtcgcgctccgggagattcgtaagtaccaagaagagcacggagctgctcatccgcaagttgcccttccagcgcctcgtccgtgagatcgcgcaggacttcaagaccgatctccgcttccagtcctccgccgtctctgcgctgcaggaggccgccgaggcctaccccgtggggctctttgaggacactaactgtgcgccatcaacgccaaagcgcgtcaccatcatgcccaaggacatccagctcgcgcgccgatcaggggagaaaagggctgagcgaagcgagctctctcaacgcaggcgggtcggtgctcggcccggctntaagantggctcctgggtccttcgggggaaggatctcnacaatggctgtctaaancaggaaaaatttnattcgggaacgatttctgctccgcccgaagtncgcgctaagaanaatnttttaaaaa

SEQ ID NO: 21121 - DNA, 723 bp, Triticum aestivum
  unsure (1)..(723): unsure at all n locations
  Clone ID: PAT_TA_21121
tcggcaacaactgacggccggaggaagaaggcgcagacgacaagcagaagcttgtgccatcgatcaatggcggcggtgacaaagatctacgtcgtgtactactcgacgtacggccacgtggcgaggctggcggaggagatcaagaagggcgccgactccgtggacggcgtcgaggcaaccatctggcaggtggcggagacgctgccggaggaggcgctggcgaagatgcgcgcgccggcgaggagcgaggagcacccggtgatctcgggcaagcagctggtggacgcggacggcatcctgttcggcttcccggcgcggttcggcatgatggcggcgcagatgaagggcgctgttcgactccacgggcggctctggcagcggcaagcgctggcgggcaagccgcgggttcttcttccgcgctgggcaccaacggcggcggcaagaggagacgcgctcacggcgtggccaactcaccacacgcatggtgtcctcccctcggctaacttcgccccggatgttcacatggacaagtaagtctgaaccctangggccgaaatccccggccacggaagnacagttccacaacccactcaatgcnccacaggaattttcccctccaaactaaggngacgctctgctaccnnatagcccccctcacancannctcggaaaaaccctttnantttcaccaggtntaaaaagtcctctnaantggccntcncn

SEQ ID NO: 21122 - DNA, 537 bp, Triticum aestivum
  unsure (1)..(537): unsure at all n locations
  Clone ID: PAT_TA_21122
gccatgtgaaatgaagaactgcaccttcaatggcatatggaatggcggcggcggagcaggccaaggcagcatctatgttgcatccagcttctacttcgtggcctcagaggtcggcatcgtagatggcaacgcaccaagcgggaacactacccctggcgcattcggagcttccgcggagaaggcttgccagatgagtgttgaagaagccaagatcgaatacccaaacgtcaacgatgtcgatgtgccctacctgtgcatggaccttgcctaccagtatactttgctagtagatggctttggtgtggagaggaccaaggagatcacagtggtgggacaaggtgaagcacggagagtactacgtcgaagctgcatggcctctaggctctgctattgaggctgtgtcgtcaaccaaagaatggcgtcaagataattgatctgttggtccaatctcatatgctagtattggacctgacatgtacagtactggcacaacttatgaaataaacgaaaactcggggctcacctaaaaaaaaannn

SEQ ID NO: 21123 - DNA, 415 bp, Triticum aestivum
  unsure (1)..(415): unsure at all n locations
  Clone ID: PAT_TA_21123
ctagcacagcactcataagttaagttgtatagctagagatagatcgagcgagcagctatctatctatctatcttagcggcatatatcgcgaaacatagctagctggagtgagttttgtaatcatggacgtcgccaacaaagtaggcaagcagcttaagttcgacgtctcgtcgaaggcggaccggcaacgcttcaatacgactttcatccaggagattcgccgtgagctcggtgacacaagcgtgatgcaggaggcgttccagctcccgcctcagacggacaccccgagcttccaggacctcgtgctgatcgccggcgagagcaccgccaccctgcggctgcgtaccgacaacctctacgtcgtcggttccgaaccaagccggccggtggttcgagttccggnacgaggntgggg

SEQ ID NO: 21124 - DNA, 750 bp, Triticum aestivum
  unsure (1)..(750): unsure at all n locations
  Clone ID: PAT_TA_21124
cgcctttgtttacccgctggaaggggttnttcagngtaagttggaacccaggtttcccngtcagagtttaaagacgccngtagncgcgtataggatcatataggcgaattggtaccggccccccttgagantacacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatctgggactagcgctatttgtaatttgtgttgggagaaacacaaggacggtacgtggtgttcaacttattgcatgtgtatggtgattctaataagtaaagtataataaaaagggatatgttggatgtgttaaaaaaaaaaaaaanaaaaaaaaacccagggggggccgtaccaattnnccaaaatgatcnatacctcccatgnccntctttnactctgacgggaaanctgggtaccaattaagcctctaaatcccttnncattgggantcaacaagcnctnttgcttcgtnattcggcaccccganaagttn

SEQ ID NO: 21125 - DNA, 645 bp, Triticum aestivum
  unsure (1)..(645): unsure at all n locations
  Clone ID: PAT_TA_21125
cagtgctcgtcgttgagcgagaggaggacggacacaagttcccactccagaaactggtatactatgtatccactgtccttacaccatacaaatcctggtaccctcattaccaaaagatagcatatgcggtattcatggcatcccggaagctacgacactacttccaagagtgcttggattacagtggcttccaaagtaccacttaacgaatgggacaagaggccaaactccctaagagagtacgccacatattccaactgggccatgtacttttggatggccctaaaatgctggccggttcaaggagctggcgttcgttttaacatcccccaactgggggacacagtccagttcatgctcccaaatattatacattggctcccaacaatgcagcccaatacgagccttattgcacggtcttccggtactactccaatgggatacacgctggaggtccccggtttcaaactngcatatcccagataatgggattccatccaaggnccnatatggggctacctaaccctncncaaattcacacggntagggatcaagggggccgtacaatcnctaaanggtctntanccnccaaggcgtcntttaagtctncgggaaacctgntnccanttatccctnanaaacccc

SEQ ID NO: 21126 - DNA, 607 bp, Triticum aestivum
  unsure (1)..(607): unsure at all n locations
  Clone ID: PAT_TA_21126
aagaaaaggggcaggaagaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccaagggccagcatgggcggttatatatcctcacaaaccgtngaggaaaattattgaaataatccttacatgctggggacaatggtggaggtgctgctgattccaatttttggcataaggacctaggatcaaggtctctccacgagctttcaaacaagcaaggttcgatcccggggcttcaaaccttggttacaccgtggcatggatgggatggtcctcttgcctcaggtccggggggctgcttgtctgctgtcaagttaaataggtccggtctggaaagtccgttgnncgttagt

SEQ ID NO: 21127 - DNA, 1293 bp, Triticum aestivum
  Clone ID: PAT_TA_21127
atctcgccgccgactacccccaccgcggcggtggccgcctcggcctagggccattcgcggcagccgtgttccgcaccgacaaccgtcgccgtgcgattgcaggcggcgccgtcctcgcctcggcgctgcttctcgtggccacaccacgactccgccactcgccggcgctccacctcttcgccgacatgcgcaacctactcggcgtgcccaacaccctcaacgtgctcaccgcctacccgcttctccttgctggagtaccaggacttatcctgtgcctcttcggcggtggatgcttcggcataagcttaaggtgggaagccttgggatggttcctcttctatgtggggaatgtaggggcagcatttggctcagcttactatcacctcaagccagatgatgaccggttaatttgggacaggttgccgatgatgatgtcggcctcctcgcttttgtcgatattggtaattgaaagagttgatgagagggccgggttatcttgtttgatctcgctcttgtctcttttactggtgagcagtgcgtgtgaaaggattcttgatgatatgcgcctgtgggtagttttaaacctggttccttgtgttgccattcctgcaatgctattcttgttcgcgccaaagtatacacactcaagattttggtttcttgctacaggcttttaccttctggcaagattcgaaggccttgccgacagaaaggtttacagtgtgaatagatatttcattagcggtcattccttggagcacctttgcttcgccatggttacattgatacttactgtgatgctatccttcagaaatattaagatcaccagggactcgtgactacaactccaccattgcttgtttgtaacaaatggcaaatttcctgtcagaatttctatgttcggaagggcccctccagagtccggaagcacctgaagaaacataaataggtgatctatgtatcctatctttccactacctgggtgactgacgccctccatccctggggcggcatagacattatttcaatgtatgttcatgtcgtgagttgtttgtgtttggagcttgttaacttgaccagcagaaacattggaggactatattgcaatttatacagatttcagctgtcacaaaaccatagatttgttgctcatcatagtttgcgtcccctgattgttcgaggtttgctcagttcctcgaaaaagggattgttcagtagggttgtacatctgtactttgctactggctaacaacaagaaatgttgctcccccagctggagcattattgagggat

SEQ ID NO: 21128 - DNA, 651 bp, Triticum aestivum
  unsure (1)..(651): unsure at all n locations
  Clone ID: PAT_TA_21128
ccccaaatcggatctccaggccggcagaagttgagcggactgactggtcactgtagttcgatcgaatccgagtagggctgatacagttcgattcggcgggaggcatggcgtccgaaaagcacttcaagtacgtcatcctcggcggcggcgtcgcggcggggtacgcggcgcgggagttcgccaagcagggagttaagcctggggagcttgcaatcatctccaaggaggctgtggctccttacgagcgtcctgccctaagcaaaggttacctctttcctacgaatgctgcaagactcccaggattttatgtatgtgtgggaagtggtggagagaagctattgcctgagtggtactcagagaaaggcattgagctgatccttagtacagaaattgtcaaagctgatcttccaccaaagactctgactagtgcagctgggagcaaactttacatatgagatcttgctcattgctacgggctcctcggtaataagctaccgattttggaacaaaggactgatctacaacattctattctagggaaatnatatctgacaactggtgcagtatcagcaaaaaggtgcgggggtagggttggggggtgtaccgccccaatgtgtacccctgtgagatggctncgtccaagggttccgg

SEQ ID NO: 21129 - DNA, 351 bp, Triticum aestivum
  Clone ID: PAT_TA_21129
cttacatctacaacccaaatcaatacactcaaactcacaatggattttatcaagaacgctgtgtctggtggctccaagtctgatgatgcctccaagaccgactccaagaaccaggaggactatgtcgataagggtgttgaattcctcaacaagcagggtggcttcaacatctcccgcgacaaccaggagaaggctaccgactttgcccgcagccagtacgagaagcagactggcaacaaggtcgaccctaagatctctaactagagagaggaataatgtttaatgacggaagctcaaatagtgtgagcatgaattaatatgacataattacttcaaaaaaaaaaaaaaaaa

SEQ ID NO: 21130 - DNA, 679 bp, Triticum aestivum
  unsure (1)..(679): unsure at all n locations
  Clone ID: PAT_TA_21130
accaaacctagctaccaactcgatcgtcgtcatcacgctcgaccgcacaactccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgttttgctggactacgacgccatctgccgcgccgttgcaaggctgccaaggcgtcttccacaccgcctcccccgtcaccgacgacccggagcaaatggtggacccggcggtgcgcggcaccgagtacgtgattaacgcggcggcggaggccggcacgtgcggcgggtggtgttcacgtcctccatcggcgccctgaccatggaccccaagcgcgggccccaccttggcctggaccactcgggctgaaccaatctcgcgtctgcacagaaccgggcgccggacgcttgcgacgccggcgcgcacccccggggtgggccctccggggggccccctgctgggggcccctcnaatctattctaggttgccaanttcaacttaggttttatttcaatgaccnccc

SEQ ID NO: 21131 - DNA, 718 bp, Triticum aestivum
  unsure (1)..(718): unsure at all n locations
  Clone ID: PAT_TA_21131
cccgccgcgaatcccgcacgaccccaaccatgaccgtgctgagccgccctaccccgggcacggcccagtgcttcgggcggaagaagaccgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccggcggcggcgggaagacgtcgcagatctacgccatccgccaggccgtcgccaaggggctcgtcgcctactaccaagaagtacgtcgacgaggccgccaaggaaggagatcaaggacatctttacccgctacgatcgcaccctcctcgtcgctgacccccggcgctgccacccgaagaagttcggcggacgtggtgcccgcgccaagttcagaagtctaccgttgaccggtgcctgctcatctcgatttttaaatcgttgtggctgttctgcgcttatttccaacaatggcttgctacctggtctaatcagctgccgcttacaaaatgttaacttaagccccccgacacttgctacaaccaagtaataaagggttcgaaccacaacgtttacttcacttgtgccgttggtcctcaaattggctttaaacctgtgtcngncctttggatgaatagnaattgangctan

SEQ ID NO: 21132 - DNA, 773 bp, Triticum aestivum
  unsure (1)..(773): unsure at all n locations
  Clone ID: PAT_TA_21132
ctagtctcgagttttttttttttttttttttttttttttttgaatatacatgagcccgtggttcgataagacgataagaatggtgccgtgtaatctttcctcgctacgaaatcgactccccagatatatagcaaacatgttaccagcgttctcttcaacaagcctagtcaaggttcaacttggacaccataataatacagatataagacaaaacaaatggcttggtgcacacaaatcgctcaaagaactgggtagaaccatggtgacaaagggaccacgacatgagcggttccaaggcaagaagactccacctcacttttttagaacattgtaaaggtaggccgcaataccaagaatgacacacagaaggatgatgtcgatgcaaaagttgcgacttgatctaagttgaagaacagtctccttcagtctcacgttggtatccttcaaatctgcattggctctatccaccttatcatccatttcgtccatcagagggacttgtcgtccaattcccatcatatcagatgcatgttttcaaagtttcaatcctcacaataacgtcaaacctcatccgttcaatctgcgcatctcatatccgacggacgattaatctcggccctaagtaccacacaagttcacacagtaatcacttaggncccatgcaatcgagcccaatcatttcttgnggataaacacacggatgtgatcgcagaaccgacaatnaggccatntccnnaccttatntagnaggctcatgaagcccngggcgtcnn

SEQ ID NO: 21133 - DNA, 645 bp, Triticum aestivum
  unsure (1)..(645): unsure at all n locations
  Clone ID: PAT_TA_21133
gcggattacaacattcagaaggagagcaccctccacctggtgctgcgcctcaggggaggaatgcagatcttcgtgaagacattgactggcaagaccatcaccttggaggttgagagctccgacaccattgataatgtgaaggccaagatccaggacaaggagggtatccccccggaccagcagcggctgatcttcgccggcaagcagctggaggatggtcgcaccttggctgactacaacatccagaaggagagcaccctccatctggtgctccgcctgaggggcggtatgcagatctttgtgaagaccttgactggcaagaccataaccctggaggttgagagctctgacaccatcgacaacgtgaaggctaagatccaaggacaaggaggggattcccccaagaccagcagcgtctgatcttcgccggcaagcgtctgggtggcggcccgcaccctccatgtctgcagtgtccacctcgcggctccccctccgggtgctcctcctcacgcggttctctgccatcggcgttgtgctcgcctgtctcggggtgtcttcgtcctgcatggccatcgatgggcgtctgttatgtcaanggttggtctanctaacgancggntcatgacanttgttccttccaaatat

SEQ ID NO: 21134 - DNA, 604 bp, Triticum aestivum
  unsure (1)..(604): unsure at all n locations
  Clone ID: PAT_TA_21134
gcaccatccaactggctcatccgcaagcgaacccgatggatccaatcacaaggccggcagctccatcgttccatcggccagcagtcgcgaccgcgaagcatctccatcaggccgccgccaccttggctcggaggaatggagtcagcaggaggtgccttctgacgctgctgatgtccactgcggccatacctggcggcagcgaatcgaggaaggctctactgcaagagtatctgaagaaatcgaaggagaacaaggaaaagaacgacaaggagaggctggatgactacaacaagaggaactacagggactacttcgggctcatccgagggccaggtcaagagagaagacggaagaggagcgcacggagtcggagaaacggatcctcgagtggctcgacaagaacaggttatctaatgagcaggatcgaatggtcnatcatggagggccggccggtcccacgggtgaaattctcgcaggatcttcgtgttcccctctaactatggcacccttgtgtaacaggttcccgttgttgctgacgtatngtcgngttnttcttnnacnaacgagcaggaaattntctgttcgactaacagttanaattcaa

SEQ ID NO: 21135 - DNA, 546 bp, Triticum aestivum
  Clone ID: PAT_TA_21135
tgcatcgcatctaaaacgtttcctgaagattcatgatactttggctgcacttcactacatgtctctctctgtgtgaaggttccgatgatgacatgggcgatggctacactaactatatgtgattgccagagccagtaaattaatgttaagacactctgttatgctctagcccagtatattgtgaacactatggggttgtttgggttctaaggcctaggaatgccacactttgccatacaatgttgtcaaacttgactaaggttagttcctgcaaaatgagagccacaagttggcaagcctaaaggaaccttgccacacttggtgtgtgtatgtgatgttgggaccatagtgtggcttgcctaagatgtggctttaaaccaaacacacacctaagtgggtcaaatttgcctaaccttaggtgtggcagctttggcaaatttagtcctcaaaccaaaacaactctatgatttgcccgctctaaaaacctcacgcctccggggtagttggtgcttagtaactccccctccctcggttaaaaaaaaaaaa

SEQ ID NO: 21136 - DNA, 762 bp, Triticum aestivum
  Clone ID: PAT_TA_21136
gagcagaacttgaagcagaacagagccaaaaccaacccaaaaagcatttcgtgctaggacagtgaagccatggagaagaccgttgtcctgtaccctggcgtcggcgtcggccacctggtgccgatggtggaggtcgccaagctgttcctcaagcacggcctggccgtcaccgtggtgctcatcgatccgcaggtcgagtccacggacttctccgccgccgtcgcccgcgctagggcctccaacccctccgtcgccttccacgtcctgccaacgccgcccgccgattccaactccgacaccgcgcccaccaaccccgtcgtccagattttccggctcctgaaatccatgaacgcccccctcctcgacttcctccgctcgctgccctccgtcgacgcactcgtcctcgacatgttctgcgtcgacgcccaagatgtcgccgccgagctcaagctgccggtctactacttctacgcgtcggccgccgccgacctcgcgctcttcctcaacctgccgactatgctcgccggcagtaaggtaaaggagctcggcgactctatcatcacttccccgggtgttcctccgttgaaagcttcggacttacccgaggttacacacaacgatgaagtactcaagaccatcttaggcatgttcgaccgaatgccagattccaatggaattctcattaattccttcgagtcgctggagacgcgcgcggtgcgcgctcttaaggacgggctctgcgtccctggtcgtgccacgccg

SEQ ID NO: 21137 - DNA, 1325 bp, Triticum aestivum
  unsure (1)..(1325): unsure at all n locations
  Clone ID: PAT_TA_21137
ggctctgcgtccctggtcgtgccatgccaccggtctactgcatcgggcctttggtgttgggaggcggtgaccaggagcacgagtgcctncggtggctggacgcgcagccggaccagagcgtagtgttcctctccttcggcagcatgggcacgttctccggtcagcagctccaggagattgcaagtggattggataagtcaggggagagattcctgtgggtcgtgcggagcccgcgcaatcccgactacaagtacggcgattcgctgccggagcccgatctcgacgcgctcatgccggaagggttcttggagaggaccaaggacagaggactcgtgatcaagtcttgggcgccgcaggtggaggtcctgcgccacagggcgaccggcgcgttcatgacgcactgcggctggaactcgacgctggagggcatcacggcagggtctgccgctgctgtgctggccgctgtacgcggagcagaaggtgaacaaggtgcacatagtggagggaatgaagctcggggtggagatgagaggctacaacgaagaggtggttaaggccgaggaggtggaggagaaggtcaggtgggttatggcgtccgagggcggcaaggcgctcagggagcgggtggcggcggcgaaggatgcagctgccgaggcgctcaaggaagggggctcgtctcacttggcgtttgtccaattcctcaacgacctggacacttccacagcccctactgtgtagcattgatgtgaaacttgtaaactttatttaatgttcgatttgttgtagcgggctatcttcctttgtcaacttagctagggcatgtatcttttccgacgcctaccacatcctaccactggagcccgccgattccaactccgacaccgcgcccaccaaccccgtcgtccagattttccggctcctgaaatccatgaacgcccccctcctcgacttcctccgctcgctgccctccgtcgacgcactcgtcctcgacatgttctgcgtcgacccccaaggtctcgccgccgagcccgcgctgccggtctacccctgcgccccgccgcccgccgccgccctcgccctcttccgcggcctgccgtctaggcccgccggcagtatggtattccggcgcggcctccctgtcgtcactccccccggggtccccccgttgaatccctcgcacttacccgtgggtccacaccacgtcgaggtactcatgaccttctttggcgggtccccccggggccctgatgccggcggggttcccgtgtgcacccccgttatgatnggccttggggggggggggaaaaaaaacaanctcgngttga

SEQ ID NO: 21138 - DNA, 703 bp, Triticum aestivum
  unsure (1)..(703): unsure at all n locations
  Clone ID: PAT_TA_21138
gtgatataggggtcattgcaaagattgagagcatcgatgctttgaagaacctggaggagattatccgtgcatcagatggagtaatggtagccagaggggacttgggggcacaaatccccctggaacaggtcccttccatacagcaaagaatagttagaatgtgcagacagctcaacaagccagtcattgttgcttctcagcttctgggaatcaatgatcgagtatcctacacctactagggctgaggttgctgatgtttctgaggcagcccgccagcgtgcagatgctctcatgctttccgggtgagtccgccatggggaggtacccagagaaggtctcagcgtccttaggagtgttagcctgaggatcgaaaggtggtggagagaggagaaacgccaagagcactgggacttcaagtgtcccgtcttccttttctgacaagatatcagaggaattgcattcagcagctaaatggcaacaacttaggatcgacccgtttcgttacacgaaggtgctcatggccccgccccacatgcccccccagccccgtccccgcctccccctcggtcggngggaacccatgggcccancnttcggtacatccacaatggacacnaacgncttccgnaaganggaggaattggancngttcccccaaagnncccaagggtnccaaaatcnctacgnctctagaaaaaaaggg

SEQ ID NO: 21139 - DNA, 525 bp, Triticum aestivum
  unsure (1)..(525): unsure at all n locations
  Clone ID: PAT_TA_21139
gcctcccctccccccatcccttccctctcccacgcgtccgttcaccaccacgccgacgcggcacccggccggaggagttcaagaaagtccaagaccactcatcaagggcgatgccgccgcggcggcccaacaccggcgggggcgggggcacctcctcggccgcgccgccgcctcccccgcgcaaggtcccgctccgctccctgctccgggcggcctccgtcgcctgcggggtccaattcgggtgggcgctgcagctctcgctgctcaccccctacgtccaagaactcggcatcccgcacgccttcgccagcctggtctggctctgcggcccgctgtcgggcctcctggtgcaaccgctggtgggccacctctcggaccgcatcgcgccggccaactccccgctgggcctcgccggcccttcatcgccgcgggcgccgcctcatcgctctcgtgctcacgtcggtctccgccgactggggcgtcttcggggacaactctgccggtcaatcggtcggngcatatgtc

SEQ ID NO: 21140 - DNA, 600 bp, Triticum aestivum
  unsure (1)..(600): unsure at all n locations
  Clone ID: PAT_TA_21140
gctctccggcgcaacgccggatccctcgcgctccgcgccgccgcctacctccgccgccaccgtccccatcctcctcccccactggccctcgccgcccccgctcccactcccatacgctccccgctggccccgcctttccggcacttcgctgctccgcctggtactcagaccaataggaagcgaggcaaggaggaggacgatgccagcgcgggcccgcgcatgaacaacgccatcgccgctcccttcgtcaggctccgtcatggatgaaaggccacaacattctccccccggcatgaagcttggcagttgcgatcaggatggacatggattgggttgaggtcaataggaatcaaaccacctgtatgcaaaatcatggttttcaacagagagaaggataagaaagaaaccaaggagaaagaagcttggaaaacaagcctgctattgtcctacctggtggggaagaacaagaatgcgattaaggggaagntgaactaaaaattgatggtgaaggaaatggatacanattatggacgggtanaggtgaatgatgcatgcctcagtaanaagggannttaganacaancnccgttgaggattaaa

SEQ ID NO: 21141 - DNA, 510 bp, Triticum aestivum
  unsure (1)..(510): unsure at all n locations
  Clone ID: PAT_TA_21141
tttttttttagcccgataatgcaccaataccagcaacttgcatcactaataaaatctcgacttgcaccctacagtttggtggactcgaattgcaggacttaagcacagccttttaaagcacacaacctgtgaaccgaaccaacggtgtcctgttaaaagtgacaagaacatgctgcagccacaagatcatagatctactagtttcagctggatacagcaccagaaattaagaatctaggcaaacggaaaatgggttccgattcaaccatagacaaagtaccaagaacagataaatttattacaaagaagacactagacaatctgatggttcaccctgaatcgcacgagtccatacaggcagcagtttgtgtcccgctccaggatatggccnttnaggcatcgntaccccagtcggaggcttgagggggccttttgtagantcaangatgccttccatggnggattttccccaaangggggggaaaagggnccnccaggggggtttnccct

SEQ ID NO: 21142 - DNA, 377 bp, Triticum aestivum
  Clone ID: PAT_TA_21142
gtttcgtcccctaaattctggacttctctaagcgtcgtcgttacaattccttgcacaagtttctcgagtgtggatgcttggagcagtaaatatatctgttggattatcatatggcttagtatgttgtatctttaccttgttcatctttgcaattcatgagcacaagaacgtgtatgcctcatgagtgtagtattcacatagctagtttgaagttgtataacacaagctgcattatcttcatagatagtgggtcggtgctttggcaacaatatgttcacatggtgtttttattcggcgtgtcattatccaaagccatatacattcttgtgatgatgatataatacagttatttttgaagttttaaaaaaaaggggggg

SEQ ID NO: 21143 - DNA, 850 bp, Triticum aestivum
  unsure (1)..(850): unsure at all n locations
  Clone ID: PAT_TA_21143
acccgccaccccaccgcacccctcacacacgcccgcagctccacaaatcgccacggctttcttggttcctccgtccacagcgagccagctccgctccaccacccgcagccaaatggcgaagctgctgccggccggcctcgcgttcctcctggccctcaccgcggcggcggcgctggccccgtccccggcctcggccttgaagggcgccggcgggctgggactcggaggcgcggcggccgtggtgatgcgccggggcgggcggacgtgccggggcacggttggcgagtgcatggagtacttcggcgtggacggcgagggcgagggcgaggtggcggcgatggctggcaagcggcgggtgctgcaggacgggtccgggtacatcggctacgacgcgctgcggcgggacaacgtgccgtgctcgcagcgcggcgcctcctactacaactgccagcccggcgccgaggccaacccctactcccgcggatgcagcgccatcacccagtgcaggggctgattctcttcattaaaccctgcttcattccttcttactacctgcatgcctcatcaattagtactgctatctatctgtaatgtaacgtaatgtaattacaagaagaagatcaaacacttcttgacgatgcttgatcaatcatcaccgggtggtgtggtgtgatcaatcgtgccgtacgtgtatcactggaggaggcatggttaattattgtgtgatttgtgcctatttgggtgaaagtaattaagcttacgcattcatctggtttcggttatgcccaataaatttgtagagtcctttgnnnnnnnnaaannnnnnnnnnnnnnnnnnnnnnnnnnnnnn

SEQ ID NO: 21144 - DNA, 589 bp, Triticum aestivum
  unsure (1)..(589): unsure at all n locations
  Clone ID: PAT_TA_21144
ggcaggctgtttctcacaaagaatgggcagcctgcaaattcgaagccaaaaccaagggagtctgccctgaaaccgtcaggtacattggaaacgtgaaccactttgcatgctacatggtagtaggcattgctgcccggtatcacttcactggtattaaatcaaatcgtgcagtagctggtcgatgctttcgcaatttgcgagcatcgctaggcatgatgcgatcccatgacatcgatcaacgctccgtatcctttacaggtcgcacgacatctacaggaagccaggcgacaggaggaggttcttcaatggaacccccgaagaggcggtagagaaataaagacatcccgggttttcacgttgattgctgatgcatgcgtgggcgttttaaccgccccggagncccgctgggaactacgcggcngttgggcgtcccggattccgtacgttactttnacgccgttatatatgggacaccnttttgnggaantttcanacccttctttancaccggctccagcgatccagccatctggccgtcgcgaacgctgcncagccacataggaaacaancncgaactcattaaagagtt

SEQ ID NO: 21145 - DNA, 577 bp, Triticum aestivum
  unsure (1)..(577): unsure at all n locations
  Clone ID: PAT_TA_21145
cacgcgcctcgatcctcctcgcccctccggcctctcctcccctccctgcacccgcacctgcggagagcgccgcaagctagctgcagaggagcgagacagtagcaggaggaggacgagaggaagaagagatggcgggctgtgatggagccaagtcgtcggcgtccatggaggaagaggcatgcgcggagaagaagtacggagggatggcacccaagaagcccttgatatccaaggaccacgagcgcgcctacttcgattctgcggactgggtgctgggcaagcaagccgcgaacagcagcagcagcagcacgaggaccgcagccgcggttgagtctctgaagcccaagctgaagagaacgccgcaccaccagtggcgctcgtaagcccacctgcgcttcagttgagaaacgcacggccacgcgtcgggtcgcagtgctggagcggagctcgtccgggaaggactgagggttccgacgagtcggctggaaatgtttagtcgtcggcatgtgggagacacccccacatacattcgaatcgtctgggtctgcggcattcngtattttnaaaacgntattat

SEQ ID NO: 21146 - DNA, 621 bp, Triticum aestivum
  unsure (1)..(621): unsure at all n locations
  Clone ID: PAT_TA_21146
gcgacctcctccaacctcgcccggaactccgccagcgcctcggccgccctccgctcgcgcgtccactgctccgtgtccgggcgctgccccaggtacacctccgtgcccttgagccccatcggccccgaggcgatggacatgaagccgagcgcctcggtgaccggcgtgacgctcgccaggaagtccgactccgtgacctccgccccggcgtccgggcccggcaccggccgcgtggtgatggagggcccgttcgggacgaagcccaggtagtcgtactgcccgaagctgatggacgcgtggtacgccgagctcagccagacgacggtggcgcaggtctccacgaggtcggcgacccatccatcgccggccaacacggcgcgtcgcgcagtcgccgtgccccacgttcctgacctcgctcaccaaccctgaactcgctgtcctcgcaacgcccctctgcgggggttgatggccattgtcgccaccacttctgttgccccccatgggggcccctcgcgctgcgggatccttacgcaantcactcccggttcntgggttcctttcaaactcgttccaagtaanagcgttcaaggantaaaanaagtattntntaaaaaaaaaaaa

SEQ ID NO: 21147 - DNA, 526 bp, Triticum aestivum
  unsure (1)..(526): unsure at all n locations
  Clone ID: PAT_TA_21147
cagaagcaggcctcgacgggctcagaaggagtaagagagcgatatggcccgagctgtgagtggctgagtttattttggcccaagtggccttgtaacagactgtaataagaagtattggtttacactaggagaaggcggcggcgaactgagaggaatagacagaacacgagtctgaactgtaaggttgttggcggccggtgatctgtggtgatcgttccggagtaaaattgagtcgagggtgccgggatcctaacactctccgagtggagccggaagcacctgacgtggcggagtggtggagcgttgcttctgtctggggttttgggggaggccgctggacggtggacacacatcggatcgggcggaccaaggggcgtagcgatgctggatttttttatttttttttgctcgtggtggagctttgcttctgtctgtttatgaatttgtaatttatattatgaattttttggtactagacctgaaaaatctttcaggtcnagnactaggaanacacataatcaaaaaa

SEQ ID NO: 21148 - DNA, 619 bp, Triticum aestivum
  unsure (1)..(619): unsure at all n locations
  Clone ID: PAT_TA_21148
tattattacacatgaagatgatttggtaatatacactgagaacatagggagggaaagggggagggcccgcatacaaagggagtcacagcacccaagtgcaaatcatatacagcgcttacacaattagaacaagcagctaaacagcggatgactgcagctccgcgtggaatggtgtcctcgtcaaactgatgttagtgccagccccctgtgctgcttgaatcggtcagtcaatgtctgggaaatcatcaccgacgatgaggggcactgcatgcatcctctcaagctattgcttccggatgggccagggacccctttgggggcggcttggccctgttgagaatctcaaagaccgttacttgggcggcggaagactgatcgtgtttgatnaaagggtgatctgcacnccgttgctgtcgtcatcctcaacgtgatcctgatggcanatcacaatagatcctcacactagagttgtgccatcatcccaaaaagttctccacgtncatgcgaacaccgcgtaatntgtanatcggtactcncaactttctgcggnccgttcccaaggttttccctccnagaaacccaatcntgngttgcccngggncacacaaaaatgggcaaa

SEQ ID NO: 21149 - DNA, 290 bp, Triticum aestivum
  Clone ID: PAT_TA_21149
cgagtttttttttttttttttttaaacgcaaggaatttctgatccataacagactgtcttagtaaaaaaaactaaaattactcagtaaacaacaaccgaacgcagagactccaggcggggacactccatgaatctgcctacttggacctctgcctcatctttcggcgcttcctcttaagccgcctcatccgcttcttcttccacttggccctcatcgcggcgggatgactgcctctcggacgggtttggggggaaaccggaagagaggcctgtgatgtccgagggggggg

SEQ ID NO: 21150 - DNA, 540 bp, Triticum aestivum
  unsure (1)..(540): unsure at all n locations
  Clone ID: PAT_TA_21150
ctcaaatcttttctgagcatttacagccgttatgttgtccaagtcatcctaggtttctaaacagtctgatgcatttgcaaatcccttcttcccgttcccgatgtccttttggtcagattaatcacacaaattagtgagttgaggtactttattgcctcgacatatatgttggagttaataattatgaccctaagtgcttaggtgatcatctagtgggtctagccatgatttgtgtcccagtgtgatgattctgggcctttattcttgtaagcatccccgtggatgccacttaagttagtaggcatttcactcctgggtttggaaccccgagattcaccctacttaacttcatgtgggatagtaattggctagctccccttaggttaattaagtaaccttgcgatagtccttgaagcccgtggatctcctcctccnaaataccatgagctacttatggcagaagtcctcngttgaacggaacgataacaaccagaggccctgatgagtctccatatnaatgtggcctgcagtccacttctg

SEQ ID NO: 21151 - DNA, 527 bp, Triticum aestivum
  unsure (1)..(527): unsure at all n locations
  Clone ID: PAT_TA_21151
agaccgcccaacaccagctccaccctcgccaccaaccgcccccgcaccacggccagaaccctagtcacttccccgccgcccactccatggaggacgacgccatctcgacgctcatggacatcgacgactcgccgctcagcgctgcgggggccgggttcctcgacgaggaggacggggaaagcgagatgttcttcgccccgcaccgcgcgtgcccgcggcggcgctggcgatgcccgcgggcccctccccttttccgggttcttcaacagcttcgacggcgccgatttcgccgacgangacccgcctgagggaactgccgcccggttcggtacgggatgttgttccgtgggttcgcaaaccgtgttatgtccatcccgtgatggggtctctaaattagggatcgattcagcccctttggggcttctggatgtttagggataacattcccttggggccctgggcgcggatgacatgacanggntnaatataagacctttgtgccaaggttcgggatactgtgatgtttt

SEQ ID NO: 21152 - DNA, 609 bp, Triticum aestivum
  unsure (1)..(609): unsure at all n locations
  Clone ID: PAT_TA_21152
gctgagcctactgagaacacacaaattaaagccttctcctactcctacatacgttgatcaatggctctcctgcgtgtcgtcagcacggctgtactgcctgccgcctgctgcgtcgtcctcctcctcctgtccaccaccacggctccggtggccatggccggttcgttgcgggatgactgccgcgcgttctgccgcccaaggtgcgagggctacggtgcggatttgtgccatgccctcgtcaacggtttcccgctactgcagaacgtcctcgaggcgacgtgcgcagagcgcttctacgaagtgtgtcaacccatctgcatgaacatctgcacggccaacacctcactccggcagcggggccgggaactgccccgccgccgccgccacatgcggcaagcaatactaactggctagctagttgatcctccgtacgtacgtgttgtttaattgctgttaacctaagtgtgtagtttccgtacgttaatattaagttttaattgtgtcctcggtacgtcgttcncaatgtagtgtcgtcatgtgtcaccaaacagctatcctgtttctccccccggggtccccgggggttcgcgttggttatnacggtatata

SEQ ID NO: 21153 - DNA, 536 bp, Triticum aestivum
  unsure (1)..(536): unsure at all n locations
  Clone ID: PAT_TA_21153
cgtgcgagtgtgagcaagctactgacagaactcggaacgttgcttgacagcttgagtaggtaaatcatctatggcgcgccaacagtggagcagcggcggcctcgcggtcgccgtgctggccgtgctgtcgtccgtgctcatctgctcgggccacccggtgccgggcgggctccccctgctgccgcacttctacggccacgcgtgcccgcagatggaggccatcgtggggtccctccgtggcgaaaggcgcacgcggaggacccgcgcatggcggcgtccctgctgcggatgcacttccacgactgcttcctgcagggctgcgacgcctccgtgctgctggacgcccgacggcagcggcaggttcgtcacccgagaaacggtccaaccccaacaaggactcgtcccgggggttccaggtcgtccacattttgaagggcgcgctcggccgccctgcccgtaaactctcctgcgccgaatctcgcctngccgcaagganccttctcctnaacggcggactggctggaagttnccccngg

SEQ ID NO: 21154 - DNA, 794 bp, Triticum aestivum
  Clone ID: PAT_TA_21154
gaattcggcacgagctcaactcttctcccagacttgtccccgtagccagtcgccaccgctccccgcccgcctcgaaatggatcccgcgccggcgacccctcgctggaacctggagcgcccctacctcaccggacgcttccaccaggaggcgaaggtgtccgcggcgtcgcaggcgcccggatccaagcctttctctctcgactccttcagccgcggagctggcggcggcgctgggagtgtcctcggatcgtacgctgtttctgtgcaggagcttttagttattgatgatttgctatcagctctggtgggtattgagggaagatacatttcaattaagagagtacgcggaaaggagggatatgttgtcttccagattgattcttcaatggaccttgcactccaggagttgactcgccgaattttccccttatgtgaagatttcgtgctagcaagccagtttgtggagtccaggtcacatttcaaaaatggtttggtcaaccatgctctagcggcagctctaagggcattcctcctggattatcaggcaatggttgctcaactggagcatcaattccgtcttggaaggctctctgttcaaggattatggttcttttgtcagcggatgatgagttcattgaatgcactggctgttctaatagagaaggcaatgtccaataataccagtggttcggcgacacttaatctacttcatagtcaggcaaaggcgatggctggcgatagtgctgttcggtcattactggagaagatgaccgattgtgcaagtgcagcatacc

SEQ ID NO: 21155 - DNA, 457 bp, Triticum aestivum
  unsure (1)..(457): unsure at all n locations
  Clone ID: PAT_TA_21155
ctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcaggtgcggcggcgcccgcgcggcgtcgcctcgccggccgctggcgccgcgtgcagggccgcgggcagggggaaaaggaggtgctcagcggggtcgtgttccaacccttcgaggagatcaaagggggagttcgcctcgtgcccaagtcccaaacaatcgcgcgcgcgcgccagttcgtcgattacgcgangccgccctcaacgagaaattaagtggagtacaacgcctcctagcatacatccctctncgccactttaacgcanaactggcttnaaagatttcaagttttcaaggat

SEQ ID NO: 21156 - DNA, 443 bp, Triticum aestivum
  Clone ID: PAT_TA_21156
gctacagtgggggcaaactggatgacatagccgtcgttgtatcaattgtccggactgaaattcaagaggataggctaagatgactatgcagaaaagaagctcatgttttgtggaagctcaacaccaagcgaccacgcgggttgccctatcagtattctgtactgctagaactgcagctatgtggcgatttctggaaagttaagggcgtatgcatcagcatcatacaccgtgctcgatcatcaataggcgggccaataaccattggacatcagcattgtagcgaagccccttcctgttgcccttgccagtgcaccggcgccacattttgatttttgggtttcgctataaaaatataaggcatttagatgttgcccttgccattaaaccaatgtcatgtactccttctgtcataaattaaaattcgttttggtttccaatggatc

SEQ ID NO: 21157 - DNA, 783 bp, Triticum aestivum
  unsure (1)..(783): unsure at all n locations
  Clone ID: PAT_TA_21157
tagcactcaaaaaaaataccactgttctaatattgatatgttaaaataatattatttttcacaaaacgaagtaatgttacttaaatatttcatgaaaaattgacgtcatcataactttcatatttaaagcaatctacaatatcccaaactaaaatactctaattgtgattagcattaaaaatattatctccactttaaaatatgaattatcacaataatgtaaatctagatatgtctagataaatattttgatataattatatctttagtatttaaaggactataaaaaatagttaaatgaactagaccaatgtgtcttaattaagagtaataggaggtgtatatgtttatccgttcatcttcaatctttcgagtttaaacttaagttaatctgagtatatagtatataagggccaatgtactcgtctcacacatatcttgccttatgtgtcaatcctatgttacacttagccctggtatcaatcctatgtatgtactgctatccaccaaccattgaggcagaatattataatatcccttcccatatttaatgatacactgtggcttgtaagatcattgaccattggctatcaaaattatgaatatattatttatgtgttgtttatagaccgtctgagcttgcataaatacntttgncaaaaanttgataganatancacgtngccaagtcacgtgcaaataaattggggggtcaaggcatgcataaatccacagcncntgttacacacacacacacacacacacacactaacaagcatactn

SEQ ID NO: 21158 - DNA, 693 bp, Triticum aestivum
  unsure (1)..(693): unsure at all n locations
  Clone ID: PAT_TA_21158
tcaagatcgatcgagaatggcgtttccgaagcctactagtcgtctagccgcgctagctgccctcgctgcggccatggcggcggcgatgatggccgcgaccgcctcggcgcagaacacgccgcaggacttcgtgaatctgcacaaccgcgcgcgcgcggcggacggcgtgggcccggtggcgtgggacgccagggtggccaggtacgcgcaggactacgcggcgaagcgcgccggggactgccggctggtgcactcgggcgggccgttcggcgagaacatcttctggggctcggcggggcgggcgtggagcgccgccgacgcgctgcggtcgtgggtggacgagaagaggaactacacctgagcaacaacacctgcgacccggcaagtgtgcggcactacaccaagtggtgtggcgcaagtcaaccgcatcggctgcgcgcgcgtctctcgccgacaaccgcgcgtctcatcgtctgaactacaaccccgggcaactcaacggcaacgccgttctaatctgaccggtgcaattaagcaaaaacccgctcatcatgtctaccaccatctcttgatggtggaaccattatagtagctggccccacaaaaatatgttctaaaccatcgatgttgtgaaaaaaacccgtgcaaaaacataattataaaaaaaaancagggcggcattccaatttttcn

SEQ ID NO: 21159 - DNA, 522 bp, Triticum aestivum
  unsure (1)..(522): unsure at all n locations
  Clone ID: PAT_TA_21159
gccgccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggggtcgtggacgccattatcaacagtggaccactggggatcccacccgtattggttcactgggtgttttgagaaggaagctgtggntatctcacccctganaaggtgaacaaggcatctactcctcacactggtgccaagganacgctttaaggaaataaa

SEQ ID NO: 21160 - DNA, 630 bp, Triticum aestivum
  Clone ID: PAT_TA_21160
gatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgtttttttccttcctccttctacttgatttcatttaacgaattggtatcgctgatcacatttaatttggtgcctgtaattgtcttcctcaagtgaggatcaaactgtacattgctgcaattgtcggacaattaaaattcattaacaacactaaagttgcttggaaaattataatacccaggggggggtccgtgaaaaaaaaaaaaaaaaaaaaaa

SEQ ID NO: 21161 - DNA, 2461 bp, Triticum aestivum
  Clone ID: PAT_TA_21161
gtgtttgttcccgtctttccgcctttttttggtttcgtgccttagaattaacttgttccgtagctccatggagctctttattttgaaaattttaaaattacatttgtacatccaagaaaataaaagaagattctagcttgtacatcaaaatacaaccattatagatcatggcatttgttttctatgcatttcccaaatacaacatttcctcatcaattttgctcatcaacggtctgtttgcttgccctggggcctaggtggctgggccatcgtccttctcgccctgcgcatcggaaaccacagaagcagataaccgatggtcgtagcacaatggttttagcccagaagcacctaccaggcaaaatagttgtgtgcccctctctcaggtggaaagcagagttctatactcgcccagcaagatggggatgtcatccatgcgcaactgcgaggcatttttcaaatggaagaggcggcgatcttccctttcaaggaatgtcggggatgggctttccacaaagcggcgaataatgagacgttgatagtccctcagcagagggcctagctcctggagctgtattgagctggatggagaacttctccaatgatcacgaagtgcctgaatacatgcaagctggtcggtggtaggaagtgattcaccaatgagcctagatgataattccattagttctttatcgttgatttcgtcaacaaaacttgctgaaggttctacataaagtggaatccccaatcgtttggccaactccaacatcggagattcatcagattgtgattctgattccttcaatgcagactgttgggcatcaccagtcacagtgctatggttgctgtctgaaccaacactaggaaccaagtcccgcttggcaataggatcatcttcaggaacaagccaccacaaatcgccaaaggtattctttccatcaaagccgccaaataaaagaaaccgaggcccctatggcaagtcatagaatgatatgcccgaggagggggtggctcattacttgttggtaagcgcttccattgaacagagaccctgtctaaaataacacattcgttgtagtacacatcatatctacttagccaaccgccagttccatgtccaccaaatagcaagagataaggtccaccagaagtcactgaatggcccctgccggcagagggagattgtcctggcagctttaattgcgtccatcctggtgtctcattatcttcttcagtaataccctttaaagcccagagatcacccattatcggcccagttccacctctgcctccaaatataagcagcctcttctcaatcatagtggcagaatgtccgcatcttggaggtggcgctgatccagtaactgctagttctgtccactcaagtgacattgtgtccatgacatatacatcagacagccactttttgccttcccaaccaccttgcctgagaaatttacggtgtccttccttgcactgtacaaggagatcactgacatacatgcccatgattccggtgtcctgtacagattcatgtatcctgtataaactcgagggcgcaggtacacacaccaaaaaaagccctccctcctaatttcaacttgacattctggctgatctggggtatcctaaggctaatgggaaagaacaaaaggggggccatggcctccacaggaaggaatgttaccaaaaaaacatgtgcagagtctacagaggtgagcatgtacacaaaatggcacgacccaagcatgttagtcgtcggggcggtggatctcgcccatcaagatgcggttgctgtggaccttgaagcccccccgccggcggtcgagcggcgttccctgcttggcgggcttctttgtgctcttgagcatttcactgaacgaaggaccagaggcgtcctgattgctgctcggtgggatgccgaacgaccctgcctctttgttggctgaagcagtggcttcaacggcgtgggctgctgaggtgactccagattccatcttatgctcatcagaagatgcagaagaagcatggcctgccttcttggacctaatggctgaagacagatccgttgacgttgcctgcgaggtagcagcgtgtgggtttgctgtgcgctttaacagggaatgggagcttccctttgggatgccagtatcaacccagttgctgaccgcttcagaaaaatcagtgtcctccactgccaagtttgcactagaaccctgccttttcctcctggctacatcattggcattcccaaccaattgattagttgatgcactgccacccatcacatctgggaattctcccctttgcatatcaagcattgtcgcagagcttgatctaaggccgagtttccggttcatctcaatattgttcggtaaaatatctagagtagttggtccatcctgtcccaagtgccccatttttgagaaatgtgacctttctgcaagtggatcatcaaaag

SEQ ID NO: 21162 - DNA, 530 bp, Triticum aestivum
  unsure (1)..(530): unsure at all n locations
  Clone ID: PAT_TA_21162
ctcgtgccgaatccggcacgagtgtgcctagctaactagcaatggcgcgccagttgttcctccatccggtcctgctggccaccgcctgcttgttggtctcggtcgtcctctgcaacgctggcgtggcggatgcggcgtggcggtggccgaggtgggacagcctgttcccgagccgcggccagcagcagcaccacggcggctacggctaccacgacaacggcgacggcagcagcaagagccgcgtggcgtcgatcgtgacgcaggagctgtacggggagatgttcaagcacaaggacgacgcggcgtgccccgcgcacggattctacacctacgcctcgttcctcgcccgcggccgcgcggttcccggagttcggcggcgacgcgactggccacccggaacgcgaggtgccgcgttcctggcgcagtctcnacgaacgaccggaggtgggcgacggcgccgacggaccttgcgtggggcttgtttaaggaggaatacncgccatcnanatgcaagcanagacgaatgccgt

SEQ ID NO: 21163 - DNA, 640 bp, Triticum aestivum
  unsure (1)..(640): unsure at all n locations
  Clone ID: PAT_TA_21163
cccacccgcttctaggacgcagcagcgcacccccgatcctcgcctgtcgcctccatctccattcgcaggcctgagaccctcgcctgcaccgcgctgccgccagccatgggaatggggcctctcgagaacgccgcgtcggccgccgctgagtccgcggccttgccggaggccggcgccgcctcggcagcgggctcgtacgcggtgctgcagtgcggcgaggactcggaagtacgtgcggcagaagtacggcgggctacttcgccgtcttccgcgcgctgctggaaggaggacggcgagagcttggcgcgtgtacggccccgtccgcggggggctccccaccgacgccgaagcggccggcttcgacgggttcgcatctccgggaactgctccgacgcgcacggggacagccctggattctggactcgtcggctatcgccgctcaagccgccggaaacgatctcgggtcgcttggcaaaaatctgtccggggctggcggcgcacgggggtcacaanggtgggnatcgggtaactgatcacccangggggggggccgtntnncccctaacnccgtgaatccggataatcccacncaagtttgaactccccggccaagtttggcgncgaaaacnttaatttccng

SEQ ID NO: 21164 - DNA, 622 bp, Triticum aestivum
  unsure (1)..(622): unsure at all n locations
  Clone ID: PAT_TA_21164
tttcctcctcctttttccccgttcgtcccctggattggcgtctacccggcgcgacccggaccgaatcctaagtccgcctgccgccgccgccgccggctcccgttggaaacgagtttggagtaaagaaaccaaccttgcatctgtgttctgtctgtctatgctgctttgctttggattcacaaaaaaataagccttgcatctcactgacttgagataactatgcctaaggacaggagctcccgcgtttcctctcaacgagagccgccgggctcgtgcctccccatacttgtcagcgtctcaatggacagagcagttcttcacgccggtcanaagagtctcctgcggccgcggaaccaaacaaagctgaaaattggaaggattttcggggcccgtccggaatggacaaccgcacaaggtgtcctgctggccggtcgtcgcacaaaaagggtgccgcccttatgggttnanacaatcncgggatcaatnctaanacattacggnaaggctcaaagggcnctcaagggtcaggaaaanttaacaatncaanaaaagncaaatcctgcccctttccttggaattacaagtntaagggnanancccggggtatnaanaaagcggcctc

SEQ ID NO: 21165 - DNA, 538 bp, Triticum aestivum
  unsure (1)..(538): unsure at all n locations
  Clone ID: PAT_TA_21165
ggacgcgcaagctccttcacccaccctcccccacgccacacgctcctcctacataaccacgctgcttcgattcactcctcatcggtggctcacgaccgagctgctgaggcaaagcttgtcccgcagtccttcccttagccttaacactcggagttgatcccgtctccgggggaagcagctggtaataatggcgcggtgccaggggaccgttgagagcctctgccaggggctgctcgacctcgacgacgacaattcggtgcaatgtgcagcgccttcggctacctccaagagtggccggacctgggtgccgccatgtgcggcgccaatctcgccgtgccgcctgccgttgcgacgccgaccgccggcgacggaacatcctcctcttgcacgtcagacgggtttaggaagagaggcggacgcgtacctgatgcaagggtggttnaaaggatgaaaagagacccagaggaagancagccgtntgcctcttgaaatgggngggcccggnaagggacagngaggaaangtggaanaaaaagan

SEQ ID NO: 21166 - DNA, 539 bp, Triticum aestivum
  Clone ID: PAT_TA_21166
ccgacgccaaccaccaccacggcaacggcaaggcggaggcggaggcggaggcggtgctctgccagccggcgagcgagttcctgccggtgatgcaggaggtgtacgcggcgctggtggccaaggtggagcgcgccatcccgggcgccaaggtggaggacaacaagttctgcctgtcggtccacttccgttgcgtggaggaggcgtgctgggccgcgctcttcgagcaggtccgcgccgtgctgagggaccacccgggcctgcgcctcacccagggccgcaaggtgctggaggtccgccccatgatccgctgggacaagggcaaggcgctggagttcctgctccacgccctcggcttcgccgccgacgccgaccgcgacgacgtcttccccatctacgtcggcgacgaccgcaccgacgaggacgccttaaggtgctgcgcgcgcgcgggcacggcgccgggatctcgtgtcaggttcccaaggacacaacgctcctcaagctgcccccccgccgtaagggttctggaagtcgtggggcaa

SEQ ID NO: 21167 - DNA, 404 bp, Triticum aestivum
  Clone ID: PAT_TA_21167
ccacgcccggcgccgccgccagctgggccgccgccgcgctctcggcgctcgccgctgctgccctcggcgccggcctcttctgatggggagagggaggatagagtcagtcaccatcgttcagatttgagatcacacggcgcggcgctactgcggtggcgatcgatcgctcctgcgccgcgcgccgtgcattgccatacaatgtcgcacggtcgatacgatcatagagttggtgtgccccatccatccatgtacccatccatgcatttgtggctttattaattctttcttccccttcctttctctccccttttcctttcggcggatttctattggtgatttgtatttgtaacctaatgtgatgtacacaagtagtgcttcctctttcactggaaaaaaaggggggg

SEQ ID NO: 21168 - DNA, 1190 bp, Triticum aestivum
  Clone ID: PAT_TA_21168
cccccccccctcgagcataccccattacatcttttggttttgacccattgctatcactgtgttcacatgatggtggaagtccagtaatatggaaaatagtgataagttgttgttgagcccatcagcaacatttttgtctcccccatgattcatgttgaacatcaacctagtgttgaaaaccttgtaagcaatgccttcgtgttccgttcatgaagcttatgcttggatgaaagaagtgactttctccaagttcacgtgcattaggtgtaagttcccgccatgaatttgagaaaggtttgttttgtttcccttgggaatcatcccaaatcggatcatgcatacgtacgaagtatcccaaacctttttttttgaatttttttgcctctagatcttgaaagccccgtaactttttgggtgttaggttttgggggattttgaaaatgtttaacgtgcttccccgaattaaattcgggtgtaacttttctagtagatgattttacacatataaatcgttttaagccgagttcgtacgcgactgtcttagctcttgttcaggtttatcataggtgtttgggtatgtaagttgaagatagatgatatatccattgacaggtcctcgacatcagttgttggatctattttcttgtctagactttttcttgagtatgggctatcgttaagtcaaatcatgaaccaacgattggcggtaaagtggtcggagggggtggtcttgtaagccaccctttctccatgaatctgtgtcggattccctgagctagttggttaagctaaacaacaacttggagagttggaagataaaagcttgtcttgacttagttcatgttaagggatatcttttgtgcgtgtgtgtgtgttgaagaaagatgatatctcccattgattggtcttcgtgatcagttgttggatctattgccttgtcaagactttgaattgagtatgggctatcatcaagtcaaatcagaaccaacgattttcgtaatgttgtcttactcgtggttgatccctcgagcatacaccattacatcttttggtctgaccattgctatcaccgtgttctcatgatggtggaagtccagtaatatggaaaattctgatgagttgttgttgagcccgtcagcagcatttttgtctcccccatgattcatgttgaacatcaacctagtgttgag

SEQ ID NO: 21169 - DNA, 1171 bp, Triticum aestivum
  unsure (1)..(1171): unsure at all n locations
  Clone ID: PAT_TA_21169
cccacctccgcagtacaaccccctcctcacacacgccgccggtcatggcggtatccacgtcagcgacggccgccgtgtccttctctcttccgtcgtacccgcgccgcctccgccgccgcccgtccctcctccgcgctgcatccactgcggcgctcccgtcccccgacctctccatccagctctctccccgcccttccccgcgcgcctcgcctcccgtagtaccatccctcgcccgcgaccgcgcagaggacctgcaggccgagtcccgcgccatgacccgagccgctgccgccaccgtctacaccctcgagctactcgcctcccgctacggctcccaacctttccaggtggcaatgagagcggcggaggtgctctcgaagctgggggcattcgggctaaagctgctgctcgaccagcagaggggggagtcgtcctcgtcagcgaagaggcgtgccagggcggtcgagctgcgaactgtactgacaagggcttggcccgacgttcgtcaagattgggcagggtttgtccacgcggcctgacctctgcccgactgagtatctcgaggagctctccgagctgcaggattctctccccacatttccagatgaagaggcatttgcctgtatcgagagggagcttggctttcctcttgattcaatgtactcagcaatgtcaccttcaccgatagctgcagcaagtttaggtcaagtttacaaggcacggttgaaatactctgagcagttggtagctgtcaaggtgcaaagacctggcatcgaggatgccataggccgtgatttttacctactgaggggacttggttttctaataaataagtatgttgacattataactactgatgcagttgctctgatagatgaatttgcccgaagagttttccaagagcttaattatgtccaggaaggccaaaacgcacgaaggtttaaaaaattatatgctgacaagcaagacatattggtccctgatatattttgggattacacaaggccaagnactgacaatggaatggntnaggtgtaagctaacaacagctgcattgaaggcaagcttaagncctgacttggaaacatggnaaagntaccaaggacncnaataggtattntcgacccaccggatttggacccnaggactgttctattgatatatancaagg

SEQ ID NO: 21170 - DNA, 1863 bp, Triticum aestivum
  unsure (1)..(1863): unsure at all n locations
  Clone ID: PAT_TA_21170
tcgcagccacgcatacggaagggaacgtgaaagttaactggaagtctgactcttcaagtgacaccatggctacttacacaaacctcggccgtagtgagttggcctttggcttacccagccacattcattcgtgttcctgttagacctctccaggcctatttcaagccttcctgggtaccagctagccgagacgaggaggacggcagccaggccgaaacaggatgcaaatgtccgcatataggtacactggcgcccagggatgagcaggaccgcacacctttccacctctcccggtggagaggtgcggctggtcacagctactaaaaggggatccaccaaactagtagcgtcccagggaggaacacgacaagcacaccggctgatttcagtcctgctggtaatggggcgcaagccgtgatgcaagttagtggaaatgcaaatcccaccggcggccgacaagccggcccatccccgcccaattgtctccattgtgcaccctcctccatggccaaccgtgaaaaagcgtgggccatgttgtttctggatcacgaggacgcacacctgaggcttatgaattgcatcaggcccctcacggtcttttaatagggctgtcagtgcatgatcaagctccagattgagccgtcctttgctgacaacatccctgtaaaatatgatcctccggggtatatgtccagtcgacctcatgaaagaaatgaggtgctctttgatcattccaccagatatacgtccacttccacaatcattttcgttaaataggccttgtataatctcttcatgacgggccttgccgccggactaatccagcatagttggtaacctccggccagtcttgagaagctacaacagctgcaatagaaccaccagcacgcccccttatgaagagacagcctgttggtcgaagggagccacttgtgaccaatattatgtggagaaacttgtttgtccaggccatttaccaaatagcaatccttcttatctttaatttctctggaaaaaagattctacggctgcagaatgaaagttcagataacgccgggaaaatgaagaacacatttatcttcaatacatttgtattttgccagatcttcaatgagttcaatgcgcgtaagcctgaggaaaggaatgtcttcaaaggagtaacaaagaaccacctcttcatgggaatagtttgtgtaactaccgtgtttcagatactaatagttgaattcctgggaaagttctttaaaattgtgagacttaactggagtctatggttagtttcagttgccattggcgtcgtaagctggcctttggcttatctagggaaattcattcctgttcctgtaagacctctccaggcctatttcaagccttgttggaaatcatcacgccgagacgaagaggaaggcaggcagggctaaaaaggctgcagatcacctagtgtaaatagacatgggtcagccgaagaacaggaacccgtaccgcctctcccagtggaacagagctgcggattatctctactacaaggagatgcagtgaactagaagctttccatgcagggacaggtcaagtgcaaccgttgctgttaaccattatggtcatggggcttcatcgtgatgcaggttaatgtaaatgaaaatcctacctgggaagacaatcagtagcattgccacggaagtgactgttttgtgaatgttcgttgactacgggaaggtgacattttttatgcaaataagttgtggtagctaggacacacatcgtaggcttagtacagtcctaggtgccttgggggtgtcagaccttcattttgttcaggttgagtaaactagcaagcaataagaaagaattanctggtaaaaaaaa

SEQ ID NO: 21171 - DNA, 674 bp, Triticum aestivum
  Clone ID: PAT_TA_21171
cgccaacgtgcagactaacgccgccctgcccggcccggcgtggcggcgctccaccccctcgccgtccccgcggcccgcgccgccgcccccgcgcccccccgccccccgccctcgcccccgcgcgccccccccccgccctcgccggccccccccacgcgctgcggggacccctgcccgggcggacttcgcggcccccgtgttcctcttcggctgcccgtgcgagcccggggcttccccgacgaccacttcggctccgccgggctcgggagcccgcgtcggaccaatccccccggcggaatccgttgggtgacggcggcgaacgtggcgaatttcccccggcgtgaaaaacgctggccctcccccatcggcgcggcatcgaaatacgcgccggctcggcgagaaccccgaggtcacttactcacgacgcccagagatcatctccgtcctccacgggacatccaggtcccctcggatcaacaacgcaaacgcgctcttcacaaccgcgtcacaatggcacatttcggctcccgccggctcgctatgcaacacaccgggggcggcctccgcgttgcgccccttaatccattcacggaaaagcatgcataacttccggcttccccctcctcgaatctccaagcctcgatagaaggagggggcaataagcaattcccatt

SEQ ID NO: 21172 - DNA, 640 bp, Triticum aestivum
  Clone ID: PAT_TA_21172
cttcctcctccgatcgatagaattaaaaccaccgtatagctagctagagctaggcacctgccgaggcacagacatcatatcatatatcatatatcatatatagacgcattgcaggcaggcacggcggcgcagcctcgccaacgtgcaccgcctgccatgagaaaagccaccatctttctcatggcgctcgccctcacgctcatcccccatgagcaaacggtggcgacgccgccgcagcctcttcccctgcagctgaggagaagtcgcttccttgctgccaacaacgtcaacttctcgccgccgccgccgccgtcgttctacgactgcagcaagaagcctccatccatctgcctctcgcccgggagccccggcgcgacgtgctgcaagggcacatgcgtcgacaccgagtacagtcgcagcactgcggcaactgcaacaaagattgcaagctcgcgcaggctgctgccagggaattggtaacacctcacgacaaaagaatgcgcggatgggcgtaaatgagaacaatgaacaaggtacggcacaccgggtttcgggaaaaccacgcgactttcctttttatcctgccaacctttcgaccccagaccagataaaaggtttatcccttaatcattttcaaaaa

SEQ ID NO: 21173 - DNA, 522 bp, Triticum aestivum
  unsure (1)..(522): unsure at all n locations
  Clone ID: PAT_TA_21173
tggatccagtctttgttcgtctttgcttgtgtgtctacaagtttgtcccttctgatctatgtgtctcttcatcggctgcggttgctgtctggtgcgctggtctaatggggccttagcaccacgactttctgactgtctactacaacaaggtttgtccggctccaatgagggagaggcgaagacggcggcacgcttttggctcgctccagtgcgtatagtcactactagggaaaccttatacacataatcttagcagcagcacgtttcaggtggaagaaaacaggcgttactgctactaacttagcagtagcgcggctgggccgaaccacgttgctactaaaatcgaccggtagttcccgccaacctaggtttagcagtagcgcggtctttataagcgcgttgctgataaagtcatagtaatactgtgcttttccttggacgcgctactgctaattgtcgcaatttttaaactgtccacatggcggganccacttagcagtagcgtgtgangnataancgcgc

SEQ ID NO: 21174 - DNA, 365 bp, Triticum aestivum
  Clone ID: PAT_TA_21174
tggcgtctctctctctctgtgtgtgtgtgtgtgtcgtacgtagcccggtacgtagctagcagtgactgtcgcgtggacgtgtccggtgcgggctgcgagtgacgtgggctaaataaagtgtgcgtcgggtggtaatggtggtggggcccggtgtcagtgcgcgcggtgccccatgcctgccgcggctgcagcttgttgtgtcttgtgttggttgagttcctgttctttctgtctatctatctcacgcatggcatttgggtatgggtatgggcctcctcctttggtacttctgtttgtgtcattgtgtgatgatatgatctcctttaatataataatagaccatccgtcaccccaaaaaaaaaaaa

SEQ ID NO: 21175 - DNA, 577 bp, Triticum aestivum
  unsure (1)..(577): unsure at all n locations
  Clone ID: PAT_TA_21175
gtcgcagtcgcagcacacactgaattctctttagctagctaagagagggtagccacaccaagacaggatgcagacagcgaaggtgaaggcgaaggacatggtgagctcggcgaaggagaaggtgaaggaggggtcggcaaagatgcagggcaagacgggcgaggcgacggcggccacgcacggcgagaaggagatggccaaggaggcggcccgcgccaagaaggaccaggccaacgccgacaagcaccaggagaaggccgaccaccgagcggacgccgccactggccaccacggcacgcgcgtgcccctcaccggcccgcacggccaccacggcgctggcgcggccgtcgaccccgcgtacccgtcctccggcaacacgtacccggcgtcgggcaagtacatctaggtgactgcgtcggatgancgaagccagggtcgtggcccactgcctttttggtacgtacgaccgggaagcggtccgggctgcccctgagtacggtccgctggtgtgtgaggggttcggncgcactgcactnccnagtctctganaaaatggccaatgcgtaagtgctaatta

SEQ ID NO: 21176 - DNA, 573 bp, Triticum aestivum
  unsure (1)..(573): unsure at all n locations
  Clone ID: PAT_TA_21176
gtggcctgaccctgtccgtcctctccggtcggcgagagcaagaagagatcccgcgccgtcctcttctccacctccacctccacccatggcggcctccaccttcagcggcgacgagacggcgcccttcttcggcttcctcggcgccgccgccgcgctcgtcttctcctgcatgggcgccgcctacgggacggccaagagcggcgtcggcgtcgcctccatgggcgtcatgcgccccgagctcgtcatgaagtccatcgtccccgtcgtcatggcgggagtactcggcatctacggcctcatcatcgccgtcatcatctccaccgggatcaaacccaaggccaagccctactcctcttcgacggctacgcgcanctctcctccggatcgccggcggctcgctggcccgctgccggcatggcatcggcatcgtcggagacccggattagggcaatgcaaacagccaaattgttgtgggttgttctgatcctactccanaactcttgctcntangttatntcgtanatctctatccgtgaagcatctccgccgatanaaggtnatatcccaactgag

SEQ ID NO: 21177 - DNA, 637 bp, Triticum aestivum
  unsure (1)..(637): unsure at all n locations
  Clone ID: PAT_TA_21177
ccattcctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggttccgcggcgaagggctaatcccactcaacatcgtgacaaaacatgagtcctgggttattgtaaccggtgcattgtaagacatatagaaggttgtttggggtncaanttcctcgcacgtgcgcacttgcggggtatgcaaggcaaactantacagncnaatcggcacattantncgcngctccaa

SEQ ID NO: 21178 - DNA, 563 bp, Triticum aestivum
  unsure (1)..(563): unsure at all n locations
  Clone ID: PAT_TA_21178
cacccctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctccgccgcgccgaccaccaaggccagcgccggcggcttctgaggcggccaccgcagggcggcggctgcgactgcaacacctgcaactgcggcaccagctgcggctgctcctgctgcagctgcaactgagccggtcaaggcgatggcgcacgagacccgagaggacgacgacgattccgtataaatataatatcggcgtctaaataaatactgtcaacctgcaccccgccattatcgattcatgggcgctccttggggtccatattcatctgtaacatgctcgccgccatttcgtctccttgccggtttaatatttatatcatgtattgtgtttttaaaaaaaaaaaaaaaaaactncttgcgtcccaaaaaaaaaaaa

SEQ ID NO: 21179 - DNA, 364 bp, Triticum aestivum
  Clone ID: PAT_TA_21179
gggatggcggcggccgtgatcgtggcggcgctcggcgcggcggcgatgctcgcctaggccgacgatccccgtcgatcgggccgtgataatgcgccggccatgtcaccctttttttctcttttcgttttgtgtatgtaattatttacgaggggtgatggactttgggtccttttctttcctgtgtggagtagagctcacattgtcgggattcttcgtgccttgctttgctttgtgttgagagggaggggagaggagtcacggtgtcacagatgatacgtacgagagacagatgagagggagaggggacgctgcctgtgtattattggggggggtattcatatttataacaatatttatatcacag

SEQ ID NO: 21180 - DNA, 636 bp, Triticum aestivum
  unsure (1)..(636): unsure at all n locations
  Clone ID: PAT_TA_21180
ccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgcccaggtggagttccacgtcggcgtcgacggcggctccttctacctggcccccaacgcgcaccgggccagcgcgtcccggtctccgtcacccgcacggtcgccgctgcaagggcgctgcccgccgtcggctgcgcatcaagggcgctgccccgtgcacaagtgccaacgggctgcgcccgactcgagtaattagttctgacccgacccgcttgttggcaatcgggtggctctccgccttccaacgtgtgggcttcttaagtccgtccctccgngcaacncatgcctaagtgtgtnataccttct

SEQ ID NO: 21181 - DNA, 657 bp, Triticum aestivum
  unsure (1)..(657): unsure at all n locations
  Clone ID: PAT_TA_21181
ctccaccattcggttgaattgaattggtgctgtatgtactgtgctgtgttagttgcatcggttttgcccgccgccgggcctccatggggaggtctccttgctgcgacgagaatggcctgaagaagggcccctggactcaggaggaagacgagaagctgctgcactacatccagaagaacgggcatggcagctggcggaccctgcccaggctggccgggctgaaccggtgcggcaagagctgccggctgcgctggaccaactacctgcggcccgacatcaagcggggcaagttctcgcgggaggaggagcagaccatcctccacctccactccgtcctcggcaacaagtggtccgccatcgccacgcacctccccggccgcaccgacaacgagatcaagaacttctggaacacgcacctcaaggaagcgccccatccagatgggcttcaccccatgacgcaacgccccccgcgacggtgcccgttgcgcantcatcggcngagcctccgnganagtgtcgcctctgtgcgaactaatgtgaagatgccgtcgggagagggacgagtgngacaacgtgaagttccgtagagtaggtaanaantncaacaganagaaaaggctatagntaagggcgncgggtatatctanttngttaagn

SEQ ID NO: 21182 - DNA, 597 bp, Triticum aestivum
  unsure (1)..(597): unsure at all n locations
  Clone ID: PAT_TA_21182
caaaaacttaatcatcctccaccacattctcgcttgcctccaatccagcagccagggcaagcacatcctcaaatcaggcctggccagggtatgcacaatgtgcctcctgtggcagctgggccaggccatcactatacaaagccccgaggaccaggaggccctaaccggtatcctccgggtgggatccagggngggaanggctacaatccgaaccgtggaggtcagggtggtggctatggcagtggcccatatccccagcaagggcgagggcctccttatcctgggaggtggaatgggtggaacagctggtccacggggcagcggtggcagtggctatggagctggaggtccaaactaccaacagggtggtccatatggcgcgtccggtccaggccgaggatcaaactaccccaggtgggggccccgcagcccacagcggctgcggaactgcctgaacgtggatttaggtgtatgtatatgctgtatgcattcacgtcttgcggctgatcctgtctgtttgtactggtgttcgtcaccctcgttcaaggcccttgtggcaatccgccgttgcaccgctcctccatatcgatctcacta

SEQ ID NO: 21183 - DNA, 695 bp, Triticum aestivum
  unsure (1)..(695): unsure at all n locations
  Clone ID: PAT_TA_21183
tgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactacaagaaacgtaggtgggagaagaagatgaaagcggaggagagcggcaagatttgataccacgcggctcgtccagggtgcttctcttcctaaataaggtccaaactttatccaggaggtttgcaggacggctagattctgacgcgtcattcccttgtggtctccttctcccctgtgatgcgatttggacgcactacccgcttggcgctgctttcctaccctcgggcctctggatcgtgatttcagtgagccccaacttctgcagcactagtattttgttgagacaaatcagctataagcatgccatctgccaataacttgtcatcatgaagnaatntgtagttttgcaaaaaaaaaaaa

SEQ ID NO: 21184 - DNA, 598 bp, Triticum aestivum
  unsure (1)..(598): unsure at all n locations
  Clone ID: PAT_TA_21184
gaaaaatacacagggcacaatgtgcggaggcgccatcctcgcggagctgatcccgccgacgcggcgcgtggcgtcgaagccggtgacagaaggccacctctggtcggcgagctccaagaaagccggcagcggcagggacaagaggcaccagcacgaatacgccgacgatgacttcgaggccgccttcgaggacttcgacgacgactttgacgtgcatgaagacgacgaggacggccacttcgtattctccgtccaaatccgccttgtccccagccctgcacgacgggcgcgcggcgagccagaagaagcagcgcgggcgccagttccgccgcatccggcagcggccctggggcaagtgtggcggcggagattccgcgacccgcacaagggcacccgcgtctggctcggaacttnagcaccgccgaggacgccgcccggcctacgacgtgagnccccgctccgcggcacaaggcaangtcaattcccgagcagcgtccctcgcggcgccgcccgcgccgcngaggaaccaaccacggccccggacaccccacaccccgcctctgcgcagggggccgtgcgatccctcccgtctctaaat

SEQ ID NO: 21185 - DNA, 694 bp, Triticum aestivum
  unsure (1)..(694): unsure at all n locations
  Clone ID: PAT_TA_21185
ccaacgtcgaatacatcatagatgatgcaagtgaactccgttttcgatgaacttgagcttgtccccaagatgaccataagctccaaaactcacaaagagaagaaccaaacaagaaccgataatatagtaagaagaggcaggggaggtatgccaacaaatagaggagtgaaacctccaactgagaagaaccggcataacctccaacatcgaaaacatcatagaagatgcgagtgaactccgttttcgatgaactcgagcttgtcaccaagatgaccataagctccaaaactcacaaagagaagaaccaaacaagaaccaataatatagtaagaagaggcaggggaggtatgccaacaaatagagggagtgaaacctccaactgagaagaaccggcataacctccaacatcgaaaacatcatagaagatgcgagtgaactccgttttcgatgaactggggcgtcccgccaccatgccccttaacgccagacctccccccacggcgtcgctccaacccaggccccgacgcctggcttgccattacccctgagcgcgcccgccagcgcctttccccagcccgcgttgcctctaagccccccatggcccgtccccctcggcccaccgggtggcgttccaccgcctgttccgccttgccgccgccgtgcgcggcccnccangtnccgtaactncaactcc

SEQ ID NO: 21186 - DNA, 670 bp, Triticum aestivum
  unsure (1)..(670): unsure at all n locations
  Clone ID: PAT_TA_21186
ggacctcgagcctggcaccatggacagcgtccgcaccgggccgtacggccagatcttccgccccgacaactttgtcttcggacagtctggcgcggggaacaactgggccaagggccactacacagagggcgcagagctcattgactccgtgcttgacgttgtcagaaaggaggctgagaactgcgactgcctccaaggcttccaagtctgccattcccttggaggaggcactggatctggaatgggcacgcttctcatttcaaagatcagagaggagtaccctgatcggatgatgctgacattttctgtgtttccctcgcccaaggtgtcagacactgttgttgagccatacaatgcaaccctgtctgtccatcagttggttgagaacgctgatgaatgcatggttcttgacaacgaagcactttatgacatttgcttcccgaactctgaagctgacgacccctagtttgggcgactcgctcatcttgatcaatgcgaccattgtgctcgctcctgcggactccccttccaaggcaacttaaccccgaccggcccaacttccgctaactggtcccctccctccggcaacccgcacggccgcctcgaccantcactcgcctggtcccaagaataccgtgcgccacgtccctgaactaaccaacaattggga

SEQ ID NO: 21187 - DNA, 598 bp, Triticum aestivum
  unsure (1)..(598): unsure at all n locations
  Clone ID: PAT_TA_21187
ctctcgcttgtttttttttggcaggggattttagttgcattatttcttcacctcgcttcccgcgagatcaccggctagttagaggaaaacgcaggtaaaaacgattacaacacgcgcacactccactattgaaaaacataacaataagaaaagagagagagaaaagaaactccctagaaagacgggtacccaaccataccatcatatggcagtatctggtggtatagagagctttacagctaggaaaatttttatctgtaatcagatggctcccgtcgggcagcaaaggtgttgtcgtcgacatcgcagcagaggggctctcacaccgtgtagttctgctggatggtgtcgatgtccaggcccttgagcttgaccaccgactccacgtggcccttgagggtgttgagctccctcagcctcgcgatctcagctcgtctcttggcctgctcggcgatctcggacagtcgcggtagctgctcttgtcgttgaacagcgtgttggaggaagcccccggcgcggcagccctgcacccaatngctccnngttcgccgagnntcttgngggaagggctgtnngagggggcggaccaatngccaag

SEQ ID NO: 21188 - DNA, 574 bp, Triticum aestivum
  Clone ID: PAT_TA_21188
cggacgcggagccggcggcggagcggagatggcggagaagaagcgaggcgccggcactcgcaaggatgaggtggtgacacgcgagtacactatcaacctccacaaacgcctccacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactctctggtcacagttgctgagattccaccggagggtctcaaaggtttgggaactaaggttgttgaggatgaggattaagccctgtataccatgagataaatttgagaatgttgcttgagcttaatgttatctactgccaatgactcatgttatagaagcttcgagacttgtctcctttctagtaatccaaattccacatggtattcatggcccaaaattccaaaaacgtgtttaagccgcaaaaaaaaaaaa

SEQ ID NO: 21189 - DNA, 597 bp, Triticum aestivum
  Clone ID: PAT_TA_21189
ggtacccaatcaaccagtcagtcaggcagagtggcaaaagctggggagcgatgcaggcgtcagagcagcaacaacggaggatgtagatgagaaggaaacacgcaaagagcatcaaaagcaagttcaacgatcttatgtcaacccatccacctctgaatgaggcatattcagatgtgtgtgtattcagtttacagagctcaatatgttacatcgaccttcccaacccgccggcagagcttaagaagctcaagcacaagaagtgcctcgtccagtccccccaactccttcatggatgtcaagtgccaacgatgcttcagcatgtccaattcgcttgtggcataggaatctcatcctagatccaatagaggggtgcaatgccggcatcgccatactggaaacgagcactgacggacaccgggcgccgagatgggctcttgtcaacgccgcaagaacgcatgcgttggaccatccttacactgctcctactcgcgcaacaaccaacagccgacgacacgactctcctataaatggcatcttatgtaagaccaagggtaagtattatcctgttcagtgattgatttttacttggtagaaaaa

SEQ ID NO: 21190 - DNA, 647 bp, Triticum aestivum
  unsure (1)..(647): unsure at all n locations
  Clone ID: PAT_TA_21190
gagcggggggggccctcctnttcccagatccccagttcgaggagagntccgcgcgtntgccccaggagttgtgccccccccgctggccgcccggggccgccccccgggcgacccgatcgccgcacccggtcgttcccgcttgtaccgcttcgtgcgcgaggagctcggctgcgtgttcctgaccggcgagaggctcaagtcccccggcgaggagtgcaacaaggtgttcgtcggcatcagccagggcaagctcgtggaccccatgctcgagtgcctcaaggagtgggacggcaagccgctgcccatcaacgtcaagtaaagaacgccaaggagaagaggagggaggggaggaaatacgtggaaaaaaaaataaaacctgtacacgtgtatgtccagatcgcgtgccgtcgatcgttcttcgttgttgatttttggttgtattgatcgatccgtatgtgtgcgtgcgtgtgtggcgttgctctttcttcttttgtgtagctgccctgccaccggccgacgtgcatgccatggtggcggacagcgttttctaaggtcatatactgttgttgtgtttaagtacatcttgcgtactcaattccttctaagtaagtatcctaatactagaatgttcctctaaaaaaaaaaaa

SEQ ID NO: 21191 - DNA, 628 bp, Triticum aestivum
  unsure (1)..(628): unsure at all n locations
  Clone ID: PAT_TA_21191
cgccactgccatctccctcctctgtcctccgtaccactcgtcttcgtctagccgccgaccgccaccaccatggcacccggcctctacaccgacatcggcaagaagaccagagatctgctgtacaaggactacaacacgcaccagaagttctccctcaccacctgctcccccaatggcgtcgcaatcacagccgcaggaacaaggaaaaatgagtccatctttggtgagcttcacacccagattaagaacaagaaattgacagttgatgtcaaagcaaactcagaatcaggtcttttgacaacaatcactgtcgatgatttgggtactccagggctaaaatcaattatcaatttggttgttccaagaccaagaggtcagggaagcttgaattccagtacctacatgaatatgctggtgtgaatgcaagcgtcgggcttaattccaaccctatgggtaaccttctggtgccttggaacaaacatacatccgcgttgattccattgttacgcgacagcgattcactttacacgctccctgtcccacattccctgcgcctcaccgcaacgagcaacccggcgccccgagaccgcgacactcctggggctccacgacgcgttgacnatttcnn

SEQ ID NO: 21192 - DNA, 545 bp, Triticum aestivum
  unsure (1)..(545): unsure at all n locations
  Clone ID: PAT_TA_21192
gccaatggatctctccgctgtccaggctgccctctccgacaagtcctactccaccctcgcctccctctgcgacgaacttctcctccaggccgcgtcccagggattcaccaccgacgaatggccctactctgtccacctgcttgcccacctctacatcaatgacctgaacagcgcgcggttcttctggaagtcgttgccgcaggaggtcaaggacacgcggccggagctcgccgctgtctggaggattggtcagtgcctctggaaaagagattatgctggcgtcaacacggctgcacaggggttccaagtggggtcctgacctcgctgacttcatcactgccttcctaggtataggtcttgcttggattggtatgaatgacatagaatttcctaatggtatgtgggaatgaagccaaacttgaattgttcgctttcatagagatttgggaataacatgggttggtaaaggtggtgacatattgtcacattgattgtatggaaaatcaatanaatgagctcacgggaatagatancangtaatatan

SEQ ID NO: 21193 - DNA, 967 bp, Triticum aestivum
  unsure (1)..(967): unsure at all n locations
  Clone ID: PAT_TA_21193
tgcaggnaattcggcacgagggaacatttgaatactggatggccagtattggcttgtgactgtggcacctgaggcagtgcaaggctgggccccactgcaagctgattcgtttgagagattaagtaagattggacaagggacttatagtagtgtttacaaagctcgggatccggcaccagccaaaattgttgcgctcaagaaggttcggtttgtcaatacagatcctgaaagtgtgcgctttatggctagagaaatatgtgttcttcggaaactcaatcatcccaatgttataaagttggaagggatagtaacatctcctgtttcacaaaacctatatctcgtctttgaatacatggaacatgaccttgttggccttgctgcaactccagaactcaagttcaccgagtcacaggtcaagtgcttgatgcaacagatacttagtggccttgatcattgccacagcaaaggaattcttcatcgtgacataaagggctccaatctcttgattgatggccatggtgttttgaagattgctgactttggcttagcaacattttatgatcctgagagtcagcaaccactgacaagccgtgttgcaacattgtggtacagaccaccggaacttctgcttggtgccaccaggtacagtgctgctgtggatatgtggagtacaggttgcatttttggggaattgctgactgccaagccagtcatgccaggcagaactgaggtggagcaaattcacaagattttcaagctctgtggatcaccttctgacgagtactggcagaaattgggaagtgcccccaacagggatgttcaagcccctgtgccagtataagcggtgcattgccgagaatttcaaagatttacctccatcagctctagttcttctagataacttgcttgcattagaaccagaagctcgtggaacagctgcctcgagtcttcagagtgactttttcag

SEQ ID NO: 21194 - DNA, 669 bp, Triticum aestivum
  unsure (1)..(669): unsure at all n locations
  Clone ID: PAT_TA_21194
ctagtctcgagttttttttttttttttttcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcaagaatgactacaatcaaacaggattagtgcctttggagggatgttctgccagtgaggcttcacagcttctcagtgatccctggactgcggcaatcaacatgtacaatgaccaaacaattgaccctcaactcaaccgggggcgctgccccgcccacaatctcctcctcggggcgccccggctccccttcgcctaaatgccccatggcgcgccccggcctctggcgcctcatactggtggtcccggccccacctggcgctagcgaatcccctcccacattagctatgacaatttcaatcanaacggacattagctntgcaatttgaagnaagggttccaagtcaanttganttccaaacgggnattcaaaggtttn

SEQ ID NO: 21195 - DNA, 448 bp, Triticum aestivum
  Clone ID: PAT_TA_21195
aactcggacaaggataggcacacctggatacatggctccagagtacgttcagagcgacggtggcgagacgacgctcaagtgcgacgtgtatagcttcggagtcactttaatggagacactgagcggacgaaagaactgtgacacgccaagcctcgtctcagaagtaaagaccatactgaactgcctcggccgttcgagatgctaggcagcccctgctcggagcttgccgagcccatggtgccgacggtcgtcggcaatgcagccttggctacgctcctggaggccgatctctccagaccgacggtgtacgagacaatcgattttagataagagatgacgcgctcgcactgcgttgctgctaagcttataacacttgttttatacgtcgtactgttgttttacactgattataattgttattaataacatttttggttgtttggccaaa

SEQ ID NO: 21196 - DNA, 762 bp, Triticum aestivum
  unsure (1)..(762): unsure at all n locations
  Clone ID: PAT_TA_21196
ggccggccgccacagcaccgcggatagcagagcagagcggtgagctgcagagcagggtagccgaggtcgtcgtcgtcgtcgtcactcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaagtgacgctggcctcccgcaaccccaacgaccgcgtgggcatcttctacaagcgcctggacgtgttcgtcacctaccgcgacgaggccgtgacggtgcccgtgtctctgccgccgcagtacaaggccaccgcgacttcacgtctggtcccccgtgctgtcggcgagtccgtgcccgttgccgcctacgtcgccaacgccatgaagcaagacctcgccgccggcttctcgcgctccacgtcaagtggacgccccctgtttgaagtcggaactgggttccggaantacactcttntngatcccccgncttcccggnaaccgggtaanacacgtncattcnaattncngcaaagatncntncggggnttttccaaaanncccccgtctgcccanttttgngacaatttaccgggccgccctaagggtttnattncaccggaancnaccngggggga

SEQ ID NO: 21197 - DNA, 567 bp, Triticum aestivum
  unsure (1)..(567): unsure at all n locations
  Clone ID: PAT_TA_21197
ctcccacaacacggtccactaaccctagcgacagcctcggctcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccgccgggcggtttcgcgcccgtgcgcttcgcccgccggatccccacctcggggcccagcgccaccgccatcttcctcaccaccttcggtgctttcgcatatggcatgtaccaggtcggccaggggaacaagtccgccgggcgctcaaagaagagaaaattgctgctcgcagtgctgtactgccgatgctccaagcagaagaaggatgaacgatttctcagagtggaagantgtctnaagangagcangtnatgaagacttcaaggtggaaggccgcaaagntgtcaacctggaaatgatccccggtatgnnaatcccctaagntggaaggctttcancacgaatcatatttacggggcacggaaaactcattttataagt

SEQ ID NO: 21198 - DNA, 583 bp, Triticum aestivum
  Clone ID: PAT_TA_21198
cgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctggggagcgcgcccacctcgcccacctcgaggagatggagaggaccggtgggaagcactagatccgctgccccgtccctcgccggcagcgcgggaggacgggtgactttcatggggtccattcaggctgatggttctgttttcttctgctgttgagctactggagtcatgttactttggccttggtttgtcccagacaacaagaaatgtcaactaatgtctgttctccctctgtcaaagtactcaaacaaaggagtgatcatttataaaactttcacaatgagtacaatatcccttttttgaaaaaaaaaaaa

SEQ ID NO: 21199 - DNA, 603 bp, Triticum aestivum
  unsure (1)..(603): unsure at all n locations
  Clone ID: PAT_TA_21199
tttttttttcaggaaaagggctccaaggccactacgattattattcaaggagcaacatcccatccagggaacaaagggagcaccacgcctgactgcacacacaccaccaccaccaacgttccctctcaaccgacgcaacgcaaactactaacagtccatcagactactaaaaaagcgacacccggatcaatgatggaacaagaccttgacaaggtaggtaaatttaactcttgaagcaaagagcagcaacgaacgcccgccgcctagcaaaagcagactctttttttcgcctccgggaagggaaaaaaagaaagaaatggcaagggaaaagacacgacactccgagtgctccctctcgctcatcgatcgatcaggtctgtggccgccgtcgcgcatcacttgctggagggctctccctccacggccagcggcacgtgctcgccatggtgcggtacttgagcgcgtacacattcaggtacgccgggtctcgcgctctcagttggcactactcagaaccgtcacccggtagggcatagctctcggtaaactcaagtgtctcctcatagctgagccgcctgganatctgtcagtgctcgtcgctgn

SEQ ID NO: 21200 - DNA, 1520 bp, Triticum aestivum
  unsure (1)..(1520): unsure at all n locations
  Clone ID: PAT_TA_21200
cctctcgcccgcggcctcggcagaaaagaaaagatggaggccttcctcgccggcttccgggcgccgcctcgagcttccgccgtacccaccgcccggagcccgcctcccagccccttttttctcggcacacggcgcaggaagccctcctcctccgcctccgtggtctgcatggcggagccacatctcatatcaaagttggattctacagagaaggcatggaaagaaatgtcgattagattgggtgaccctgacattgtctcagatccgagcgaataccaaaaacttgcacagtctgttgccgatctgggagaggttgcgacggcatatagggaatctaaggaatgtgaaaggcagattgaagaaacaaaagctttgcaaaaagagaatggtgatgaccctgatatggctgagatgatagcttcagagctagagtctctctctgatcagcttgcggagctcgaggaaagactgacggtacttctgcttccaagcgaccctctaaattcacgtaacatcttacttgaagtaagagctggcactggnnntgatgaagctggaatttgggctggtgaccttgtacgcatgtaccaaagatattgtgagctcaacaattggaagtttaaaccagtttcttgctcagaagcagaaaagggtggatacaagacatatgtgatggaggtgaagggaaagcaagtctacagtaaactgaagtttgagtcaggtgtgcaccgtgttcagcgtgtaccacagacagagactatgggtcgtgttcacacgtcaaccgcaactgtggctattatgccagaggccgacgaagtggacgtggttattgatccaaaagatattgaacttaaagctgccatatctggtggagctggatggcagaatgttaacaaggtggagacggctattgatcttattcacaagcctacgggaataaggatattctgcacagaagaaaggtcacaacttcaaaacaaagaacgcgcgttccagttattaagagcaaaactatatgagataaagttaaggagcaacaagagtccataagaacccagaggttactgcaggtcggtactggtgctcgctcggagaagatacggacgtacaattataaggacaacagagtgactgatcatcggttgaagatgaattttgtattgtctagcttccttttaggagatattgaatcagctgttcagtcctgcgctgcattggagcagaaggaactcttggaggaaatggccacttcttctgcagtgaaggcatgatcagtttaactattccgtttgcttctggccatatcctaaaggagaacagatccaatggcatcttacagtcgatggagatcgatgaccaagatgtacatgaaaaaactcacgagtcgcgaatcatattccttgcgtgcacacactcttctgtttgctcatggtcattttgcatatacactagtgtctgtagacaatttaatgcactccagttgccctgatgggagcagattttgagtagctgaaaaaaaa

SEQ ID NO: 21201 - DNA, 592 bp, Triticum aestivum
  unsure (1)..(592): unsure at all n locations
  Clone ID: PAT_TA_21201
ccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgatccctccgatgttcccaacacccccgccgccgccatcagcatgggaaccatagaggcaatacctctgaatgttttgccaaagcatcgaacaaggaagtggaccagactgtgatcatttggtacagcgaaggcacagacaggaaactgacacataagtttatagacctcnattctgtacaatatgacagttagtatagatctcgtcagacatagatcggaacttgtcatccctggagcaantttggggtctgttgcattggactcactcatgtgtaattctttnaaatggancttaaantgtta

SEQ ID NO: 21202 - DNA, 947 bp, Triticum aestivum
  Clone ID: PAT_TA_21202
cccacgcgtccgcggacgcgtgggcaaaaacgaaaaaggtggcgagagggagagggagaggaaggtgccggccctagcaatggcggggtggtacgaggaggcggcgggtctgctgctgcgccggccggcgttggcggagatggcggtagatgtgctgctgtgcgccgtgccgatctgggcggcggtcatgatcggcctcttcatagggtgggcatggcggccgcgctggaccgggctgatcttcctcggtttccgcagccgtctccggctcctctacgtgcctcccgggctcggcgcgcgccgcctatggctcgcctgcaccgcgctctccgccttctccgtcgcgccgcagctgctctcctccgccttccgccgccatgggaagtaccagcgcaaggatccctcgaacgacgacacggacgcctgcggggattctggcgcttgcgctaacggcaggtcaatttttgaggtcaagcatggtattgtcactgagaaggacctagatcacctcgtgcagcttttagataataaggagagtgggcatacaacatggcagcatttgatggagcgtaccacttccaacatgacgtacaaggcctggaggcatgagcccgaggtgggacctataatgcattgtagccagaccattttcgaggatgctactcctgaactggttagagatttcttctgggatgatgattttcgtctaaagtgggaccccatgcttgtgtgcttcaaaattttggatgagttccctctgaatggaaccacaattattcactggattaaaaagttccctttcttctgcagtgaccgtgaatacatttttgggcggcgtatctgggagtcggggaaggcttactattgtgttacgaagggaattccttatccatctttgcccaagaaggaaaaaccgaggcgtgtggaattgtacttctcgagttggc

SEQ ID NO: 21203 - DNA, 582 bp, Triticum aestivum
  Clone ID: PAT_TA_21203
tctgcctccatcccttctccccacgtgaagagaggccacgctgttgctgccgcgcccatctcgccccagatcgacggcacggtcgtcggcgtcgcactccgcaccctgcagcgccgccgagcgcccacgctgtgatgagcagtgagggagcagctgaaatagccatggtgtttttgtgaccaacaccaatccatcggtgctggcatccacggtggagagagcggcctctgggtgctgcaaccatcaagttagttggctgggaaccggccggccaaaaagctgcatccgacgcaacgaccaatgctgaaaccggacgaccagcgatcaatttttgccgggactgtccttcaattttgctacaaccggcagaaaatttgttgggttccggcgagattctctgtccgtggggtgacacattttttgctggaacatgatttttctgctggacattttgttttttgctacactagcgaacatttttgttctgagcttttggtgaaatgtggtggaactctcggggtaacaaagcgcatggcggggtgctgaacattttttccacacgaatatgtttgcacacatctc

SEQ ID NO: 21204 - DNA, 619 bp, Triticum aestivum
  unsure (1)..(619): unsure at all n locations
  Clone ID: PAT_TA_21204
acaagacagacctagcacctgctgttggagctgatctgtctgtaatggagcgagacgcacttcgcatgcgcgaaggagggccctttgtgtttgcacaggtgaaacatggagtgggcgtggaggggatcgtgaaccatattctgcaggcgtgggagatcgcgactggtaataagcggcgataagatctcacgacttggggccatatgttggatgcagatttgattcagtcggcacttccacatgcatgtgtcatctgttcgtttctcaataaattctgcgtcatttgctgctgattgtacttgacaagtagagacatggatggactcctaaaatccatccatgtgttaaatgacatattcgagacatcctttctcaataaacccgcacatttggtgaatgcacttgagaagtaaagacatggagccttaaattcaaggggggccccgctaccaatccgcccaaatgatcaccagccccgccctcggcgtcgtcgagcgctgacccggatcccggttccactaacgcctcagaaaccccttccactgngtatacaaaggcnacnttnctccaagtnccaccnaagnaatgaccccgtcggcataancgggggntgggacca

SEQ ID NO: 21205 - DNA, 658 bp, Triticum aestivum
  Clone ID: PAT_TA_21205
ccgcagcccaagttctcctctgcatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaacaccaagttctcgattccatacaactccgtatgcttgtattctgccgtgcctatattagattctctcgaaccatttgggtgttccttgtaaaactgctatcgtgtgatgtatgaaattgtgggccaaagaattgccttgcttgcatatggttggtgttacttaataaatccaatgcggggatacatccgtgtcatggagacatgaaaacagcagacgggattaagggcccgggtttttgaaaaaaaa

SEQ ID NO: 21206 - DNA, 651 bp, Triticum aestivum
  unsure (1)..(651): unsure at all n locations
  Clone ID: PAT_TA_21206
ctcaacctacctacgccgctccgcgctcgaccgcctttgcctgccttcccattccccccgtctcctcttcccttccgccatggcccagcccgctttcctctcctctctccgctcccgcctcggctccgcgccgccgcccccgccgaaccatcgcctccagcccaggcgcggctaccacgtcgagcttggggctcgcgaaaaagcgcttttggaggaggatgttgctttgaagaggttcaaatcatacaaaaacagtgtgaaacaggtctccaagatcggggaatgctctcactttagctgttgtacttgcttgcagctacgagcttgctgtgttggcgactagcacaaaatgaaggaaaactcagtcatgtggcggcacggttatcccgggaagtgatccatcagcatgaactgggactctctctcttcgggtttttaaccccgtttgttgatacccgtaccgtgtaaaataaattaactagttaaccttgattgggaaataatgtcccgtttttatggctaattcaaacaaagtgagagaacatcctggggaacgtgaagataacgcgccgcttgttacaccggggttccgccgctctcttctgatgactgcnttttgccnagttatacatncattctaaaaaaaaaaaa

SEQ ID NO: 21207 - DNA, 287 bp, Triticum aestivum
  Clone ID: PAT_TA_21207
gcaggatttgcgaaaattcgtaccagaggatgaaaggcggcattcacattctttccgtgtgagattctaaaattaaggatttgctccaaggagattttagtaacaaatgtcttcttcttttttttccacttgagaattcatttcccatcttgttctttgtacttcacctttaacttcttctcttgtaatcgttcagaagtcgaacattgttctcgcgcactatttcctcagtgaagtgaacactgcttctgaattttcaagcatgtgtgcaaaaaaaaaaaaaaaaa

SEQ ID NO: 21208 - DNA, 459 bp, Triticum aestivum
  Clone ID: PAT_TA_21208
gccaatctcctcactgagctccacgacgcgtcccttcgccaccagccatgatcatcaccaccgccgcattcccgtccgtctcctccttccaccgcccgcaccacaggccctgcccgcgccgcgcagtgctccagctcgtccggtcggccgcctcctcctcctcctcctcggcgtgggaggagcgcgaggaagcgcggtggctacgcgaggaacagcgctggctgcgagaggagcagcgctggctccgcgaggagtcgcgctggcgtgccgagcgcgaggccctcctcgccgagatcacggcgctccgtctgcgcctccgcgcgctcgagccgctcccgcccgccgccaagcccgtgcctcctcccgcaccggcggcgcgcgtcgctccgtctccgcctaccccagcaccggctgcgcgcgtcgctccgcctccgtcttccccaacaccggctgcgcgcg

SEQ ID NO: 21209 - DNA, 630 bp, Triticum aestivum
  unsure (1)..(630): unsure at all n locations
  Clone ID: PAT_TA_21209
attttcttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacggtggcagctggaggaggacgccgacaaggtgaacctgtggttcgaaggtgcctgggcaatccaaggatgactcaccgtggagatcgacgaagacttgctcgtcatcaaagaagaggaaggactggtgggcaacggagccctgctggcggtggctccaaatacggtcgcatccaacaacagacaagaggggaacgcaaatggaaggaactcccggcggcaaacaaggcaagccgcaagtgtcatgccggatctctccgggggtaaacgggatgctcgccccactactcgggtcagacccccagaatatcatatantaacttntc
